United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 10

SEQ ID NO: 27808 - DNA, 1045 bp, Triticum aestivum
  Clone ID: PAT_TA_27808
cggcacgagatccagccaacaagaagcagcagcagcagcaccagcagcaaggaggagaggccgacgccgcccgccgcccgccgcccgccgccgacgaggaagaagaaggcggccggaggggagggagatggcgtacagggcggaggacgactacgactacctgttcaaggtggtgctgatcggggactcgggggtgggcaagtccaacctgctcacccgcttcacccgcaacgagttcagcctcgagtccaagtccaccatcggcgtcgagttcgccacccgcagcatccacgtcgacgacaaggtcgtcaaggcccagatctgggacaccgccggccaggagaggtaccgggcgatcacaagcgcgtactaccgcggggcggtgggcgccctggtggtctacgacgtcacgaggcacgtcaccttcgagaacgtcgagaggtggctgagggagctcaaggaccacacggacgccaacatcgtgatcatgctcgtggggaacaaggcggacctgcgccacctcaggaccgtcccgtcccgaggacgccaaggccttcgccgagcgcgagaacaccttcttcatggagacgtccgcccctcgaggcgatgaacgtcgaggacgccttcaccgaggtgctctcgcagatctaccgcgtggtgagcaagaaggccctcgacatcggcgacgaccccgccgcgcccccccaagggcaagaccatcaacgtcggctccaaggacgacgtctccgcggtgaagaaatccaactgttgttcctcttagctcaagattgtgggcattggcatcttatactgtaggggagggcactatgttattgcagtcatagtcctccgttttgtattcatgcgccatcaaccatatcccagtgttcattttgccatgtttgatacatttgattcgttcaggactacagcctttggctggtatagtttagggatttgaaagtgtgagtgaggttatcgcgaatttcttacaggcctttccttgggatgttttctacgtcttggatctgtgaaaaaaaaaaaa

SEQ ID NO: 27809 - DNA, 1612 bp, Triticum aestivum
  unsure (1)..(1612): unsure at all n locations
  Clone ID: PAT_TA_27809
aagaaattgaaactgttgatgagatcctgaaacacaaaacaaggggtttaggcacaaagattccagagctaaatatatgccctatttatgcaaatctgcctactgaacttcaagcaaagatctttgagacaacccctgagggttctcggaaagtggtcctggccactaatatagcagagacttcattaaccattgatggtataaaatatgttattgacccaggtttttgcaagatcaagtcatataaccctcgtacagggatggaatccctgcttatcaatcccatctcaaaggcatcagcaaaccagagggcaggaagatctggacggacaggaccaggaaaatgtttccgtctgtacacaagttataactacatgcatgatcttgaggacaatactgttccagagatacaaagaaccaaccttgcaaatgttgttcttacacttaagagtcttggtattcatgacttggttaattttgattttatggacccacctccttcagaggccttgttgaaggccctggaacaactttttgctctcagtgcactcaacagtcgtggagagttgaccaagactggaagacgaatggcagagtttccactagatcctatgctgtcaaagatgatagtagcttcagagaaatataagtgttctgatgaggtcatgtctattgcgtcaatgttgtcgatcggaaattctatattctaccgtccgaaggataaacaggttcatgcagataatgcaagattgaacttccacactgggaacgtcggggaccacatagcattactcaatgtctataactcatggagagaaacagacttctcgactcaatggtgttatgaaaattatatccaggtccgcagcatgaagagagcaagagacattcgagatcaactggagggacttatggagagagttgagattgaggtctgttcaaatgccagtgacttggatgctattaaaaaggccataacatccggtttcttccaccattctgcacggttgcagaagaatggttcatatagaactgtgaagaaccctcagacggtctttatccaccctagttcaggattagcacagctacttcctcgctgggtaatataccacgaactagttctcacgacaaaagagtacatgcgtcaggtgacggaactgaagcccgaatggctggtggaaattgctccgcactactaccaactgaaagatgtggacgacgctggttcaaagaagctgcccaagggccaaggacgagccgcattgtagactgcctggactcactcatgaagccagcgtttggacagattagatgttgcgtaaacagtttagtttcggatatccggatcgggatcgcggcatggccgctcttttctaccttctcttagatcacattgtatcactcaccatgtcctgtcaacatgacccaccgttcttgtacaagtttgtgggtgtgggtagagctgtagacagtttggcacaacctagcgttgatgccgggaccctcaatcctttgtcgtaccccggttatcgaacaaacatacattggcgaccactgtgctgtatcaacattagatcgtcggcatcccatgatgtccacctttncctatgtt

SEQ ID NO: 27810 - DNA, 1252 bp, Triticum aestivum
  unsure (1)..(1252): unsure at all n locations
  Clone ID: PAT_TA_27810
ggcacgagctcatctctcggagcaggaggaggagcttgcaggaacaatggcagcccagggtcttctctctgggaggcagttgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcggattcatcgagcccaggtggctggcctacggcgagatcttcaacggccncaccncnannnntntnnntcncncntnncctncncnaccntcantcncncaatcacnaatncacnattcncacnnacnccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccagccaagctcatcaggcagcggtaccgtgaggctgcagacatgatcaagaaggggtaagatgtgctgcctcttcatcaacgatcttgaccgccggtgcggggttcggatgggcgggaaccaacaanagtacaaccgtcaacaaccagatggtgaacgccaccctcatgaacatcgccgatgcccccaccaatgtgcagctcccaggcatgtacaacaaggtactttgcctgtaccggcaggatgcaccgaccagactgccaagaacttcgacccaacggcgaggagtgacgacggcagctgcctttacaccttttaagcatgccaatttaatatctgatgttttatcctttgtacaaatattatggtcgtatatctggtccgtccgtgccacggcacgcatgcgtatgcgtatggtagagctatactagcccatcatgggcagaagactatactgaacctcctgttaccgctgcaagctttggtcctgacgtcgttgggctggtggtaggcgtcggggcagctggagtcgcggcactggatgttgacgccggtgctgcaggagaagtccatggggaggttgtacctcggccgcgaccacgcta

SEQ ID NO: 27811 - DNA, 511 bp, Triticum aestivum
  Clone ID: PAT_TA_27811
aagactttcaagtcccagctaataaaaccgtcatcaataatcccccgccaccccgccgatctccaccgcaccaccgtccgtccgaaatggagatgaagaagatcgccttcgccgccctcctcgcggccgcctcggccaccgccgtcatggcctccgaggctgcccctgccaccagcgacgcctccgaggtggcaatcgccccggccgccctcgtcgcctccctcgtcgcatatttcctctactgaagcagcggacagtaggggaggagttaattactagcattcattggccgcttgtgtgtatacatgcgaatgatgcggtgtaatttttattgttttcgtcttgatgagcacggttaaccgctgataggtacgtgatacatgtacttgtatcgggtggatgcttaaccgtgctgaacatgttcattttctcttttgtcagatcacatcaacttgtgtaattgttgtgatttgttttatttgttgaatgcaatgttttctagttcactttc

SEQ ID NO: 27812 - DNA, 1563 bp, Triticum aestivum
  Clone ID: PAT_TA_27812
ctgcacatccagggcgggcaatgcggcaaccagatcggcgccaagttctgggaggtgatctgcggggagcacggtgtcgaccccaccggccagtacaccggcagcgcccccgagcagctcgagcgcatggacgtctacttcaacgaggccggcggcaaccgctacgtgccccgcgccgtcctcatggacctcgagcccggcaccatggactcgctccgctccggccccatcggcgccatcttccgcccggacaacttcgtctacggccagtccggcgccggcaacaactgggccaaggggcactacaccgagggggccgagctcatcgactccgtcctcgacgtcgtgcgcaaggaggccgagaactccgactgcctccaaggtttccaagtatgccactctcttggcggaggcactggttccgggatggacacgctgctcatctccaagatccgggaggagtaccctgaccgcatgatgctcaccttctccgtgttcccgtcgcccaaggtgtccgacacggtggtggagccctacaacgcgacgctgtcggtgcaccagctcgtcgagaacgccgacgagtgcatggtcctcgacaacgaggccctctacgacatttgcttccgcaccctcaagctcaccaacccttccttcggtgacctgaaccacctcatctcggcgacgatgagcggcgtcacgtgctgcctgcggtttccagggcagctcaactcggacctccggaagctggcagtgaacctgatcccgttccccaggttgcacttcttcatggtcgggttcgcgccgctcacgtccaggggatcgcagcagtaccgcgcgctcacggtgccggagctgacgcagcagatgtgggacgccaagaacatgatgtgcgcggccgacccgcgccacggccgctacctcacggcgtccgccatgttcagaggcaagatgagcaccaaggaggtggacgagcagatgatgaacgtgcagaacaagaactcctcctacttcgtcgagtggatccccaacaacgtcaagtccagcgtctgcgacatcccgcccgtggggctcgccatgtcctccaccttcgtcggcaactccacctccatccaggagatgttccgcagggtcagcgaacagttcaccgccatgttccgccgcaaggccttcctccactggtacaccagcgagggcatggacgagatggagttcaccgaggccgagagcaacatgaacgacctcgtcgcagagtaccagcagtaccaggacgccaccgccgaggaggactacgaggaggaggaggagccagccgccgaccaaccatgatcatcccttctcttcgttcgtctccctttccatgcgtgcgtacgtcggtttgatttgtgcagctgccaatccagttcaggagggtcgccatatatacatatatctactcttcaccatgtcaagttagtacctagtagtattatgtaccgtaatatcttgtcgtcgtgtttgcctgtattaatttgtatgtatgcttgtttcgtgctacctttatatattcgtcgtcgtcttcgaacc

SEQ ID NO: 27813 - DNA, 1175 bp, Triticum aestivum
  Clone ID: PAT_TA_27813
gccgcagccagccagccagtctcctcctcctcgggcgggagggaagagagagggagacagcgaccgggcgagaggcggcggaggctccgaggaggcggccggcagcgttggcccgggaaagggacggggcccggaggaggctggctgatcggttggagggaagggaaggccgggaggggaggggatggcggcgcggcgggcggcggcgtgggagcagggtcggcgacgagtacgactacctgttcaaggtggtgctgatcggcgactccggcgtgggcaagtccaacctcctctcccgcttcaccaagaacaccttctccctcgactccaagtccaccatcggcgtcgagttcgccacaagaacactccacgatgcacatcttctctgaaactgwcatgttcttaatavgggctgtgtttgatgatagaggtgtagcagggccatgacaaaatccgttgctatcttattccaggatgcacattttctctgaaactgaaactgatgtgttcttaatcttgacctgtttgcaggtggaggagaagataatcaaggcgcagatctgggacacggcggggcaggagcggtaccgggccatcacgagcgcctactaccggggcgcgctcggggcggtgctcgtctacgacgtcaccaagcccaccaccttcgagaacatcagccggtggctcaaggagctgcgcgaccacgccgacgcaaacatccggatcatgctcgtcggcaacaagaccgacctcaaggacctccggggccgtccccgccgacgacgcggggggatacgccgaggccgaggggctgtcctacatcgagacgtccgcgctcgaggccatgaacgtcgaggaggccttccagctcatcctcggcgacatctaccgcgccgtcagcaagaaggcggtggcctccgaggaggacagggcaggggccgccggggtcaaggaaggtaagaccatcaacgtcgccgccgccgctgacaatggcggcgagaagaagtagtgctgctcagcttaggatggacggatgatgcccagcggatgtatgttatgtgatggttgttttttgagttttacaagccttgttgattcattttgtcagatatcctcctacattgttagacctgaaactcatatatattcagttactatatatatatcaagttcat

SEQ ID NO: 27814 - DNA, 916 bp, Triticum aestivum
  Clone ID: PAT_TA_27814
atggataagggggatggaatttaggcttagtttagcgagtctatatatatatataaagacctcacatggctagcatagaacatagtggacacacacggccaacaaatatagtcgatacaatgcataagatttttagtaatacaagtccattggcaatgcaacacatcatacgcatcacggatgaggtaggaaagacttcttaaggtttctttgtaccagggctttgaccatgccttcgaacaatttgaactcaaacttctttccagcatgcactcaaatttcggtaacaagcttcttacttgccatccctacttgtttcagcagcattcgatatttgcctggttgatgagaaaatgcccagatgcttggagatcccactcggaaagtaggtgtaagaatgacccaggggtcttccagagccgccaaaattagccacgccttttacagccttgttcctcatatcaagagcaatcacacaggccttatccccacggggatcaggcatgtgcataaggtaaacaacatcaccgtcatgcaagctaagagcaggatagcctacacgaattttcttcaggcttggcttggcatcatctccctcctgcggattaggtagcatttgggcatacacagggctatccaatggtacatcatctgagcatctgatagtacagtcctcctcccagttgccactaccagaagtagagccaatgcttgaaatttttattttttttgttgcagccatccaaccttcacatatcagggagcttccagtgtcttgagcccggttctgacgttacttgtgcattctcaaaatacttgatgtaaccttggagaacaagtgaggttccgaacaaacaacatagtacccctgacgtgatcgggcgacaagcgggcgagaggtagtgggaggttagcg

SEQ ID NO: 27815 - DNA, 336 bp, Triticum aestivum
  Clone ID: PAT_TA_27815
ttcgagcggccgcccgggcaggtacccgcagtcgcattcaagtaatgccccttgatttcaccggtttcggcctgtgatttataaatagcttcggcacaaaagacaaaacggtctctccagcgcataaatggttgtgagtttacgttttcatcatctttggtaaaatcaagtccaccacgtagacactcataacacgctctaccataattttttgcggataatcccaattttggtttaatagtacattttgttgaattgttgttgattgtgtagttaggtaggactcaaccgaagatggttggagtacctcggccgacctcggccgcgaccacgcta

SEQ ID NO: 27816 - DNA, 1286 bp, Triticum aestivum
  unsure (1)..(1286): unsure at all n locations
  Clone ID: PAT_TA_27816
ccacgcgtccgcttctctttgtctgcttgatcgtcccgttcctcttcatcatcctccccccttccttccttcctccacccacctcctccccccctcccctctccggcgcgccctccctcccccaccggcgaatccgcaaccgaatcgaatcccaggatccgcgtcggcgggcggcggcggagccacatggcgcaccgggtggacaacgagtacgactacctcttcaagatcgtgctcatcggcgactccggcgtcggcaagtccaacatcctctcccgcttcacccgcaacgagttctgcctcgagtccaagtccaccatcggcgtcgagttcgccacccgcaccctccaggtagaaggcaagaccattaaagctcagatatgggatactgctggccaagagaggtaccgtgcaatcacaagtgcttactacaggggagctgtgggagctcttttggtgtatgacataacaaagaagctatcatttgaaaacatcaataggtggcttagtgagctccgtaaccatgctgactccaacattgtcatcatgatggttggaaacaaatccgaccttaaccacctgaggtcagttcaagaggaagaagggcaggcattagcagagaaggaagggctatccttccttgagacctcggcactggaagccttgaacgtcgagaaggcgtttcagactatcctttccgacatccatcagatcataagcaagaaggcgctcgctgcccaggaggctgcaggaagtggacctccgactcaaggaaccaccatcaatgttgccgattcatctggcaacacaaagaaagggtgctgttctacctaggtgcgaacagagaagtggtgattctgcaaaaggatgctcacatggatcttacggcgccctaggtgtctaggtgttagttcggtcccttttgactccttttggcctgtaattctggtggggttgtattaaagttcatactgctagaaagaaattatccttggtagataccgtgtgtagttgcaaatttttggtagagaccattgtttgtcagtcagacttactacagtttcagagcattatcatgtttccttttaggtacatgtttgtcctcctaagacatttggtgcccccgaattaccggagcaggaacaatgggggtatagatatatatctcttgtatttgttatatgtggattgtggtgttatctgaacatcttttgtcctacaaaaggcatgttgttaaaaaaaaaaaaaaannnnctcgtaaacatacgaaatataaacttgaaatt

SEQ ID NO: 27817 - DNA, 716 bp, Triticum aestivum
  Clone ID: PAT_TA_27817
ttcggcacgaggcgaacacccgccgcgaaatcccaaatcaccaaccaaatcccctcccctcctctcccgcgtcccgacgagcaccagccatcagacatggacgcctcagccaccggagcgggagcgaaggcgaagaagggcgcggccgggcgcaaggccggcggccccaggaagaagtcggtgacgaggtccgtcaaggccgggctccagttccccgtcggccgcatcgggcgctacctcaagaatggccgctacgcgaagcgcgtcggcacgggcggcccccgtctacctcgccgccgtcctggagtacctcgccgccgagctgctggagctcgccgggaacgccgccaaggacaacaagaagtcccgcatcgtgcccaggcacctgctgctcgccgtccggaacgaccaggagctcgggaggctgctggctggcgtgaccatcgcgcacggcggcgtgctgcccaacatcaacccggtgctgctgcccaagaggacggcggagaaggagcccaaggagggcaagtcgcccaagaaggtcgccaagtcccccaagaaggccgacaagaaggcgtagagagagccgcgcgtcgattagcttaagctttgctgtaacagtgatcgctgttttactaattgtgtcgatgtagatctgtgctgtcatgaaaaattaattcagaaatctctctgatttatccaaaaaaaaaaaaaaaaaa

SEQ ID NO: 27818 - DNA, 1627 bp, Triticum aestivum
  Clone ID: PAT_TA_27818
tcggcacgaggatctgcttcgactccccccggagccgaggtcgtcgccttcccactccgcggctcgccccaccagccccaatggcgaccgcctgcccgcccctctcgctgccgtccacttccctcctccgcaagacaacccgcgccggccccgcccgccagccgctcccctccgtccgctgcagcgccgtcggagaggctgtcgcggaggcggctgtggccgggacgggcggaggaaccgctgctgggtgagcgcaatcaaggggaagaaggtggagaggccgcctgtctggctcatgaggcaggccgggaggtacatgaagagctatcaaaatctctgcgagaaatatcctttgttccgtgaaagatcagaaaatgttgaccttgttgttgagatctctctgcagccatggaaggttttcaagcctgatggagttatcttgttctcagatatccttactccacttcctgggatgaatataccttttgacattgtgaaaggaaaaggtccagtgatatatgatcccttaagaacagcagcggctgtgaacgaagtcagggaattcgttccagaggagtgggtcccttatgtaggacaggctttaaatttgctgcgaggagaggttaagaatgaagctgctgtgcttggttttgttggagccccctttaccttggcatcttattgcgtggagggaggttcatccaagaatttctcgaagattaagagaatggccttcgcagaaccagcgattctacataatttgctacagaagtttacaacttccatggctagctacattaaataccaagctgacaatggcgcccaggctgtccaatttttgactcgtgggctacagaactcagtccagttgattttgaggaattcagcttgccatatcttaagcaaatcgtggattctgttaaggaaacacatcctgacttacctctgatattatatgcaagcggatctggtggattgctggaaaggcttccgttgacaggtgttgatgttgttagtttggactggacggttgatatggccgagggtaggaaacgattgggatccaacatagcagttcaaggaaatgtggaccctggtgttctttttggatccaaagagttcataaccaagcggatttacgacaccgtgcagaaggctggtagtgaaggacatgtgttgaaccttggtcatggcattaaggtggggactcccgaggaaaatgttgcccatttctttgaggtcgcaaaggggatcagatactgaaagaccttggttgttgaatttgttcctttctcccagccggcagaaattgtagattccactgcttgaggatagatgcaggaagccacatgtctagcataggatacctgacgaacacatccttttgtgattgcttatgtgttctgcatttcggtttccatttcattgtaatactgtaagcacatactaattgggggtgtaagaaagtgtctacttgtttatatcatgtatactacttgaatcttatccacctagtcgagaatatcgatttatatttgtatgaaaataatactgtggtcaaaatatgtaagctgtaagttggatttatttttctgataccgttcttaagcctaaaaaaaaaaaaaaa

SEQ ID NO: 27819 - DNA, 587 bp, Triticum aestivum
  Clone ID: PAT_TA_27819
ctcgtgccgctccctccctcccccgcaacgcgtgcgtctcctccctccttccctctccccggcggcggcggcgggcgaacaccgatcgatcgcgagcggcaatggcgaccaagtgcatcatcggtgcgctggttgggtcccttggaattgcgtacgtctgcgacacgatcgtttctgacaagaagatcttcggcggcaccgtctgcaagaccgcgacagacaaggagtggtttcaggccacagacgccaagttccaggcctggccccgtgtcgccggtccgccggtcatcatgaaccccatcagccgccagaacttcatcgtcaaggacccccgaatgggcggcggcgcgagctcgaccagtgttttgctcccaccatgcagccaaagtttcttttctaggattttggagttcctaataaaagggactttaaagtcagggtatactattttgttttacgaatttcagtttccgtgagcaactttggggggttttgccgctcactcactcgcctttcgatgaactatgttccttggtgaaatttcccaccaggcagtaaaataactgcattgtctttcaaaaaaaaaa

SEQ ID NO: 27820 - DNA, 710 bp, Triticum aestivum
  Clone ID: PAT_TA_27820
gaattctttgcaggtaccgagattaggtgtaatctcagccgctatatcaaggtttacaaatacaggtacacaatatcatcggttgtgtattaagcacgggacaaactgcctactaacgtttcgatcggccagtacattgttacaatgctactacagatatggctgacggtggcagtaaatgacatcaacacattgaggccatacgagtattatagttacacatgctcatgcaccatcatcatcttcaacagtgttgacgcgctcgcactcatcgatccattcgctgtatacatcaataggttcagtcagcgcatttgcagtggtgctgaagctttcctggcagatttgacagttagcctcaccaatcagattcttcaaatcaatccggcactcaacgctgctcccatggttgcagaatgggcaggagaagacggtatcgagcttgtccatcctcttcctaggtggtggcttagcagccgcctttctcttccccatggttcggcctctctccttacttcaaaatctcaaagggagggagggaggagacctggtgacctgtttgcgaggaagaagggaaacggctacggcggcgcaggtcccctagtggcgggaggaaggggaagggattcaggcggcggcgggtggatccgcccccggcgttggaggggaagggggaggggaaaggggagggacgaggggagatggaggtt

SEQ ID NO: 27821 - DNA, 650 bp, Triticum aestivum
  Clone ID: PAT_TA_27821
ccggaggttttttaatattcagggacttagccttgacattgcagcccaaaatgggaaaacatttcaacatcaagggcttatttgggttggaaatcatgacaacacccaggatttctgtacaaactgttccacagaaacttatttctatcatcatcaaatacaccgtatcacactttcaggtcaaatgccaagagcagggctagcaaactgaaacaagagtctgtgtctacagttcccgtggccacacccgtataattttggtccaaaacattgcaggcaacttgcttacaagttcgtctttggcttggatggcgggctcacgcgcctggtcaaggtccgcatcgtcacaaactcctccgccgcagaagggtggatgccgacggtgctgtcgaaggtcgccttggtagctccagccttgagcgcaacagcaatgccctgcataatttcagctgcatctggtccacacatggctgctccgagaaccttatcggtctcagcatcaaccaccagtttcatggtagacttctccacgcgtttggatatgctgttcttcattgggttgaaacttgatgtgtaatcaagaagatcattcttagcttcctccaaagcctcttgttcgatcaaaccctgtacatagaccggtaaaaagc

SEQ ID NO: 27822 - DNA, 2280 bp, Triticum aestivum
  Clone ID: PAT_TA_27822
atgtgatggtgaacggccaaacttatgccacatcacacgaatatgtagcagcaaacctccccagtcaagtattaacctaaacccttaacgaccgtatgtatttcgagtgcattggtatccggtgccaaaattgaacatacacctccagtaggatgaccgcggatgtatgtattacactctttcatctaacacgcaagcacggtcgccgcctcggcctgctttgtgttgctggcgatggtgagaggcccgttgagagaagactcacttctttctccgctgctttatggtctggaatcttcagtatgccaccgtcgatgagcggctgcacctcggatttcgcaagatccttcaccttggaatccgaagattccagataggcagccaccaccttggagctgaatccatctgcaaatgacttgcacttccctttgagggcttttttccatagggtagcagcaaacgcaggacaatcaagtatcatctttctgattacgcggctcgagtggtagttatcaaaggcatgctcaacatcttctgtcctcgggcgttctgcgtcagaagctatagcattgtgaagcacgtggatcctgtcggtgaccccctccaagacattattttttccacctacagcaacctcgtataatacatctttgccgaagtttgttctaagtaactctccaacattttcaatgcaagtctcgatgagaacctcaaaaagctcgcttttcaccaacagttcttgccgccgtttaaacgggtccttcttgctatcagatgcaaccagtgtgtcttctgaacccccatgttctttgtcagctacatcatccaacttactatccaagttaactttagtagcactctctgatgcctcatcctttgaaacaagggaaggcacactgtacttcagacaattcaaatcagtcggagtcagataacgtgagcaaagtgggtgaagtagctgcagcaatgggcgtctcccgttcttgtcaaatatgagttcctttaaatgatttgtcagctcatcaattacaaccttagtaacaagttttgtgtcatcaacaatggagagaagacaagcaaggaaaaggcatccataatcaccaagagcaagcttcatattctgccccttcaagcttttgataattttcttcctatccttcgcactgccatgcttgaggcaagcaagtcctatttttaaaccttccctcgtctgcatgatccgaatgagaagtggttctgaagatcttttcttcttagcttttgatttcgttggtacttcagcgacccctgatagttcatctccatctacgacagatgacccttgggtaagatgggggattaactgacgaatcacgtccgaggctgatgtcttatccgcaattgttaagtactccaatatgaccgtgtgaactatggaatactcaacaatacccttctccaaaagtggctggataacagtagtcatatactgcaggacagatgatttctgtagtccaagcttggaaattgtttctaacaaactgcatgatttttgttcagtcaagtctttgaacagctgaagctcagtggagtacaattccaacaacaaacttcttttctgaggcggcgtcgcctgatgaaaggtgcaatcaacaactgcggctcctattgtgtgacgaagtagagaagcgacatgaccatgaagggaagagatgaacaaggcaagctgttttttagtggcaagttttatgagcttcttcacaaggaaaacagcgtatttcttgcgagaaagatggagcaaatgtggctgcagggcaacaaaaacagcatccctctctggctgtgagcaccacttgacacatgtttgaagaacacgtgcggttacatgggatccagcaatttcgaaatatttgccatccattttacggagagcctcggttactagcttggatctattctccttgctcacatcacgacatctcatcttttcccatagtactgcgagttccttctcgaggttgtaattgggcttccgcttcatcttcctggactcggacatttccttggctgcgacccgcttttcattggcggtgacgggctgcggcttgggcttggcggcgggggcgtagtaggtcttcttccgcttggcggcgtcgccggggccggccccttggagggcgcattgggcctccccgcggcctcgcgcttccgcttgttggcgcccgggtggtcgccgccgccggccatggctgcgcgaggcggtgtcggcgaacgcccacgcgtccgcggacgcgtgggtcg

SEQ ID NO: 27823 - DNA, 687 bp, Triticum aestivum
  Clone ID: PAT_TA_27823
agaacacaatcccaaatcaccaaccaaatcccctcccctcctctcccgcggcacgacgagcaccagccaccggacatggacgcctcagccaccggagccggagcgaaggcgaagaagggcgcggccgggcgcaaggccggcggccccaggaagaagtcggtgacgaggtccgtcaaggccgggctccagttccctgtcggccgcatcgggcgctacctcaagaagggccggtacgccaagcgcgtcggcacgggcgcccccgtctacctcgccgccgtcctcgagtacctcgccgcggagctgctggagctcgccgggaacgccgccaaggacaacaagaagtcccgcatcgtgcccaggcacctgctgctcgccgtgaggaatgaccaggagctcgggaggctgctggccggcgtgaccatcgcgcacggcggcgtgctgcccaacatcaacccggtgctgctgcccaagaggacggcggagaaggagcccaaggagggcaagtcgcccaagaagaccgccaagtcccccaagaaggccgacaagaaggcttagatagaggcgcgcatcgattagcttaagctttgctgtaacagtgatcgctgttttactaatggtgtcgatgtagatctgtgctgccaggaaaaaaacaactcagaaatctctctgatttatccaaaaaaaaaa

SEQ ID NO: 27824 - DNA, 604 bp, Triticum aestivum
  Clone ID: PAT_TA_27824
gcacgaggaagacttccaagtcccagctaataaaaccgagatcaataatcccccgccatctcgccggtctccaccgcaccaccatccgtccgaaatggagatgaagaagatcgccttcgccgccctcatcgccgccgcctcggccaccgccgtcatggcctccgaggccgctcctgccaccagcgacgcctctgaagtggcaatcgcccccgccgccctcgtcgcctcccttgtcgcatatttcctctactgaagcagcggacagtaggggaggagttaattactagcattgcattggccgcatgtgtgtatacatgcgaatgatgtggtgtaatttttatcatttttgtattgatgagcacggttaaccgctgataggtacgtgatacatgtacttgtatccggtggatgcttaaccgtgctgaacatgttcatttttttggtcagatcacatcaacttgtgtaattgttgtgatttgttttatttgttgaattcaatgttttctagttcactttcatatttcgcgttgatcctcctgtcattttaatgtccttcggtcaaaaatgaggaaaaaactgggcgaatttctgcaaaaaaaaaaaa

SEQ ID NO: 27825 - DNA, 1295 bp, Triticum aestivum
  unsure (1)..(1295): unsure at all n locations
  Clone ID: PAT_TA_27825
agagtccgctgaactcagcacgcgcgcgcgagcgatctccagagtccgctggtttcgccctcggctacctgctcggggcggcgttcgagggacggcggtgctgcctggctgggcggtgcgggagggggtgagcagctgcgggcggcggcgatctgggcatggggaacgcgagcgccagggcggtggagaacggccacgcggcggcgccgatggagcaggtggccgtggcccccgtcggcgggagctccgcggaggccgcggcgccgccggacgccgtgatgcgggagctccctcctccggtcccctacgtcttcgcgccgcaggttccagtagctccgatgcagataccgaatgaattttcacctgcttttaaccattcatggatgaatggctcggatgaatccaccaacaataaccccccggaggttgaaattccaactttgattacatggagtcaaggaggaaacgaggtgtttgtggaaggatcatgggataactggacatcaaggaaggtgttagagaggtctgggaaagatcacgccgtgttgttggttctgccatctggaatatatcattacaggatgattgttgatggggtgccgagatatgtgtccgaactaactcaaagtacctgatgaaagagggcaggtggccaacctccttgatgtccatgagtatatcccanatagtcttgacagcgtggcgganttcgacgcgccccatcgcctgagcacagctacaacatggagttcccaaccgatgaggagcttaccaagcaggatccgcccgctcttccacctcagcttctcatgactgcccttggtggcatcgatcactccgacgaactcgctccaaagccgaagccgcagcatgtcgtcctcaaccatctgttcatcgagaaagggtggggggcgcagtctctgctcgccctcggactcacccaccggttccagtcgaagtacgtgaacttcgtgctctacaaaccgctggtgaggaggtgaccggtgccgctggtggaagatgaaagaaagcaacggtggctgattaggactgatgggagtgaataagagagtgtagtttgacaatgtacataagggggattccgtaatcatccgtttctcttttcttctttctttctttctttctttcttgattgagtgaactgttcttgtggcgtggggtttgaaccgtctgaactccggcgaaatgaaacaagagggagtgttgtgaaaatgtctggtcttgtcgtctgatctgttatgtcgatatttccagtgaggtctaaaaaaaaaaaa

SEQ ID NO: 27826 - DNA, 1298 bp, Triticum aestivum
  Clone ID: PAT_TA_27826
gccagctgggcacggcacgagatccctcctttccttcccccagcttccctcctcccctcgtcgccgttccattctcggatctgcccccacccctcccattcccctcccgctcggcccggcgagcagcgccgcgtcccgtcccgtcccatcccggtaagcggaagcgtcgacgaggccttctctgatccgcgcgggctgctcattggccgggtgatcgatcgggtccgcgggaggagaggcgaggcgaggcggcgacggggagggagcaagggaggcgggcgatggcgcaccgggtggacaacgagtacgactacctcttcaagatcgtgctcatcggcgactccggcgtcggcaagtccaacatcctctcccgcttcacccgcaacgagttctgcctcgagtccaagtccaccatcggcgtcgagttcgccacccgaaccctccagatagaaggaaagactgtgaaggcacagatatgggacacggctggtcaggagagataccgtgcaattactagtgcatattacaggggtgctgttggagccctcctagtctttgacataacaaagaggcagaccttcgacaatgttcagaggtggctccgtgagctccgggatcatgcagatgccaacattgttgtcatgatggttgggaacaagtcagacttaaaccacttaagatcggttcccgaggaagacagccaagcattctctgagaaagaaggtctgtcgttccttgagacatctgcactggaggcaatcaatgtggagaaggcattccatactgtgctgagtgaaattcaccagattgtaagcaaaaaagcacttgcagcacaggagtctgctgctgccaacggccgttcgatgcaaggaacgactattaacgttgctgaaccatccgtcaacgcaaaaggttcttgctgttccagttgaagagctggttccagtggaagagattctttccggaaatgtctgcttccgcagaactggaccatgacaatatacataggttatagtttggtatcagatattcttgtttctcatcccgaatcccatgactggtaattcctatcgcaagaacacctttaccatactctataacctgcctccatcaaatcattctcattttgtattcttataactatcatcgatttcacttgtacaattgagaaatcgaacaacatgttgtaacaatgattatttcctattaacaacaataatagttgttaatggaattattatgctcttaaatttcgttataattgcatgaagtgcactgtcaaaaaaaaaaaaaaaaaa

SEQ ID NO: 27827 - DNA, 879 bp, Triticum aestivum
  Clone ID: PAT_TA_27827
attcggacgaggcaacggcccgctagaccgcccgctcctgccaagatccaacacaactttccgccccctcgtccggtcgtcgggccgtcgccgccgaacaccgcccccctccaccgaagcgcggcagctcgaaggttcgtgttctaataagcttattcccttgaggcagcatgcctaagataaagacgagccgtgtgaagtatcctgaaggatgggagcttattgaaccaactctccgtgatttggaagccaaaatgagagaagctgagaatgatacacatgatgggaagaggaagtgtgaggctctctggccaatcttccgtatttctcaccaaaagagccgttatatatatgatctctactatcgaaggaaggagataaaaaaggagctgtatgagttttgcttggaccaaggttatgcagacaaaaatctgattgctaagtggaaaaagccaggttatgagcgtctctgctgcctccgctgcatacagacacgagaccacaactttgcaaccacctgcgtctgcagggtccccaagcacctcagggaagagacggtgatagaatgtgtccactgcggatgcaaggggtgtgccagcggcgattgaagtcgccactcgttgttaagaataatctgaaaccgattgctcgagatgctctgttggatccctgatgaatgaatgaaaacaagtaacgtacaatcaggtgattcgtccatatattcactgtaaactctcgagccgtggtatgtatttgcgtgagaagactcggttttctgccgtggaagttgacaactgtttcgctgagaatgttatgttaacccgatcttccatgatggatcacagtagtattgttgtgccttgcaaaaaaaaaaaaaaa

SEQ ID NO: 27828 - DNA, 699 bp, Triticum aestivum
  unsure (1)..(699): unsure at all n locations
  Clone ID: PAT_TA_27828
agatcgctgtttttcctctcgctcctcctgtgggcggcgccgccgctgcgcacagaacacatcctcaccagcgtagcttctccggcgtccggccaacgcgctcactagcctcccgccttcctccacatctcctcgcctccaccccatccagttcgtgccattcgctgctccaagacaagggcatggcgctcggcggctgcggcaacgaagctgatggtgcacgagccaaccatgaaggcagtagcacggggcagcgacagcagcatggagggcgtcctcttgtttgggaaggtaatggaactgcaaataggagtggcagcggcgaccaggatgcaaatggaagtggttcccaaagaccttggaaagaaatggcacgtgagcaaaggatatcaagaagcttttggatgttgggaagcttggagctgatgcttcaaataagctgatggttgtcttttggctgtactggactatttaaactttgaactatgctgtgatggttgaactgatgctggacggttaagggtttatgtcagaggcaactttataactaatgtgtgcctgttatgttggactgttaagggttatgttggaggcaattttataactaatgtgtgtctgctatgttggattgttaactattatgttggaggcaacattatagctaacgtgtgcctgttatgttgngcagattcattttcc

SEQ ID NO: 27829 - DNA, 1174 bp, Triticum aestivum
  Clone ID: PAT_TA_27829
gccacgtcaagcccatttttgtatagcgtctccaaatccatgacggactagtctgtcatagaggaccgggcctgggcgggcctagggactgatcggtgacggccaggatcagtcatggtggtacagttgtcaaattatgacgcgatatacatgacggattataaatccgtcacggacaaccctccttgacggttttgcactgttccatgacagactgtatccgtcatggattaacaagattcttgtagtgtatatcggacttgcactttaggccttgccggattcctcgcagcctggtggcctgaaggcaatgaagctgacgcactgcacctggcgcatgttgtcgaaaccaatgacgcggacataggcgtcagggtactccttcttgacctcctccacctcgttgagcacctgcgtggcgtcagtgcacccgaacataggaagcttccacattgtccagtatcgaccgtcgtagtaccctggggagctgttgtgctcacggaagacgaagccaaccttgctgaactcaaggcagggcacccacttggagcggatcaggtagtcgacctgcttaaggagggcctccgtggagaggggtggcaagtaagacagggtctcgaacttcttgatgccctcaatcggccacacctgcatgcatctgatccttccgccattgctgacgttgctgaggccggcgctgccggaggggcggctgatgggaaggccggtggtcgacttaagcccctggaagggcgcgacggtggtggcggaagaagccatcacggctggggccatggtggagtacgtgaattgctaggtgggaggcgactcgtgccgaattcggcacgagcaatagaggagattgggatgacaatcgaggagagtcaatagaggagattggggtgctagcaacagtgggaggaaggcgatgttcaagtgtcgctcattggaggaagacgatgttgaaagggggctctgaagtcggagaggaaagctaattaaaagataagataaaggtactccaagaccctggggaatttgaaaaggaattcaagcatctaccggcatgccttttttctggttaagacagttcaatagtgcatgccgtcatgggtgttgtcgattcaagtgcattcctgcactgatatccatatatcagtcttcacggtgcgct

SEQ ID NO: 27830 - DNA, 1054 bp, Triticum aestivum
  Clone ID: PAT_TA_27830
ttttttttttttttttttttttttttttgaaggcacatgagcagcctataatattcagggactgccatgacatacccctcaaaaaaaggtactggcatgacatgcaggctaaatggggaagtatttcaacttcaagggcttatttgggttggaaatcatgacaatacccacgatttctgtacaaactgttccacacaaacttatttctaccatcaaatacaccgtatcaccctttcaggtcaaatgccaagcgcagcagggctcgcgaactgaaacaagcatctacgtgtacacagttcccttcgccacaccggtataattttggtccaaaacattgcacggatcttgcttacaagttcgtcttcggcttggatggcgggctcacgcgcctggtcaaggtccgcatcgtcacaaactcctccgcggcagaagggtggatcccgacggtgctgtcgaaggtcgccttggtagctccagccttgagcgcaacagcaatgccctgcataatttcagctgcatctggtccacacatggctgcaccaagtaccttatcggtctcagcatcaaccaccagtttcatggtagacttctccacgcgtttggatatgctgttcttcattgggttgaaacttgatgtgtaaataagaagatcattcttggtttccgccaaagcctcttgttcgctcagaccgacgacagatagtggtgggatgcagaaaacagcacaaggtacatctttataatcaggcttaactgtctggccaccaaacacagttttagcgaagcaagtagcctccatcagagcaacaggtgttaggttaatccgatttgttacatcacccacggcccatatacttggaactgatgtacgggagtattcatcaaccttgatggctcctatttgatcaacctcaacaccaacagcttccaagttcagcctattggagttcggcgcacgacctgtagcaaaaagaacaacatctgcaatgagctcatcccctttatctgtcacaactttaatgccatcggccgttttactcaactcagtcaaatt

SEQ ID NO: 27831 - DNA, 809 bp, Triticum aestivum
  Clone ID: PAT_TA_27831
ggggtttttttttttttttttttttaaacacatcaaaagttttttgcgtcaatatgtccaacttatttagatatacaattgagtaaggattatattagatgctatgctcaaatatatagtacagatatacagtaattgcacgtctccgttttgagtactttgtgcttctctcaactgggatgcaccttttcaagtgcttcatcgtctagccgctgattatatcctcgtaaatgttcctgaccttagcgaagaacgctttcctgtcgggcttgaatagcaggttcttgtacgcaaaccacccgctgtaaccaatgccaacgacctccatgagacctggaaccacggggagcctgtcgattgccgatactactccgccggcgctccacatgccgagcgtggcggcgacggcgagcgtggtcaccgcgtacttgtcctccactctgtcccactcttgtttcaagccgttgaagaactctgtaagctcggcgttgtcggccagcggcgcggccggctcaccggcggccattgacaccacgttcctcgcgagccttttacagaaggaggcgacgcggggctggccgtgggacgcgaggccgggcagcggcggcagcgcggggagcccgagcccgacggagcgcgcggccttcccgaggtcgctcgcgatcggcgaggggacggcgcccgtggctggggaggcgacggtcggggccatggagatcgatgccttcggtcagtgtacgcctcaccaccaccaccacttgcgcgttaagcgcgttgggcgaatgctaataacgaccgcgaggtcgtcg

SEQ ID NO: 27832 - DNA, 571 bp, Triticum aestivum
  Clone ID: PAT_TA_27832
tcgagcggccgcccgggcaggtacatcccaataaaggacgaccatacttgctcaacttatctctttcaacttggataccatgaggcgggccttggaaagtttttgaataagtagggggaattcgtagatcctccaaacgtagagcacgtagggctttgaaaccaaatacgttacctacaatggaagtaaacatgttagtaacggaaccctcttcaaataggtctaatggataagctacataacagatccattggctgtcttccccagcaacaggctcgatgtgatagcatcgtcctttgtaacgatcaagactggtaagtccatcagtccaaacagttgtccatgtacctgcccgggcggccgctcgaagcgtggtcgcggccgaggtacaaacacagatcataccgaacgaaaaatatgctctggtcggaaagcagagtcctggacaaaagtgaagttcacaaaagacaatcatacataggccattgtttcaactcgtagtttaggccttgccagactcctcgcaacccggtggcctgaatgcgatgaagctgacgcactgcacctggcg

SEQ ID NO: 27833 - DNA, 1263 bp, Triticum aestivum
  Clone ID: PAT_TA_27833
gagccggtacccctcctgcatggacctgccgttccggaccaggccgcgcgcggcgaaccccatgagctcggaggcgtccatgtggcggctgaaccagtgcggaacgcgagagattggagaaaaaacgctctgctcctcctcgagttttttttttttttttttattaaaacatcatataattaccgggaacacatgcgtctcacagtgcagttcaaccgcaacaacaacaataacaaaagaaaacctccacactctagtgcaacagactgtgaataacacagagcacaatatgcgcacatcatggaagcacaagtctcagaaaccattcttaagaaaatgcaggatcaactctctttattagccgctggttggctccatgatggctggaccgagccatcaggtagcgagtgtggtggggaagcaactgtcgtgcacgcagccgagcacgtcgcggtagtccctgtggatggtgaagttgtcgtagaccttgccgtcgctgctcctcttgtactcgaagagaagcgacgagtggttgaaggccgtgagcttggtgaagccatagtcccggtccctgaacacgctccacttggggatggcgctggtgtagccgttgaggtggctgccgccgccgcccgccaccacgaagatggtcccgttcatggtgcccgagtagcggctccgctcgttgctcacgcactggttctggtagagcgggcaggtgcgctcgtagttgtggacgtggccgaagaaggccaggtcgacgcggtaccgctgccacagcttctgcaggctctcccgcccctcgggctcctcgaaggagccctgctcggcgtaccacttgttggaggagtatcccagcacccggtgcgctgcgaagatgagccacggctggtgcttccggtccaccgtggagaggcactccttgatgaacttgtactgcggcgtcccctcccgccagtcgtgctccgagtccgccacgcagaaccggaacatcccgtagtccaccttgtaccagaagtttgctctgttttcggccgggtagtagtacatggtctcggccagcacgccgcactcgccgccggagtcctcgacgtcgaagaaccctccggtgttgggccagtccctctcgtggttgccgctggcgatcatgtagggcttcctggcgctgatgggggcgacctgcgcggtgaactggtcccactgcgagatgtagccgttggcgtagggcaggtcgccgatgtggaagaccatgtcgaagttgtc

SEQ ID NO: 27834 - DNA, 1428 bp, Triticum aestivum
  Clone ID: PAT_TA_27834
aggcatccagtctgaaacacagtggaagctccacatccatcgaccatgggggcgctggcggagtcgatcgcgtcgcacgtgccgtcggggatgctgagcgcggggctggcggcgctggcggcgctgccgaaccccggcgagctggtgcggaaggcggcgcggctggaggacgagctgagggagctgctccggctgaacggccgtggcgccggggcgggggcggagcaggggggcggcaaccgggcgcagcagacgcgagagcgcttcctgcgcgcgtacgagcggctcaaggacgagctcctcaaggaccgcgccttcaacttcgacttcaccgaggagaccaggcagtgggtcgccaagatgctggactacaacgtgcctggagggaagctgaaccgggggctgtctgtgatcgacagctacatgctgctgcgggagggcaccgaggtggacgaagaggacttctacctcgcctgcgtgctcggatggtgcatcgaatggctccaggcgtccgccctggtgatggatgacatcacggacaacgcctacacgaggcgggacaacctctgctggtacaagctgcccaccgttggcctgtccgcgataaacgacggcgtcctgctgaaatgccacgtccaggccatcatcaagcgctacttcaaggagaagttctacttcatggagctcatggagctctggaacgagattgggttgcagaccgccatggggcagatgctggacctcatcaccacccacaccggcgccaaggacctcgccagatacaggatccaagggtaccgccgtattgtcaagtacaaaacatcctactattccttctacctgccggttgcttgtgcattgctcttgaatggcgcgaaactgagcgactacgtcgagctcaaaaatgtactgattgagatgggagtctactttcagatacaggatgactacctggattgcttcggcgaccctcaagttattggcaaggttggaacagacatagaagactacaagtgctcctggctaattgtccaggctatggaactggctaatgagaatgagatgaaaatactatacgaaaactatggcaagtcttgcccggaatgtgtcgcggcagtgaagaatgtttataaggagcttgatctgcaggacatattcttggagtacgagtcaagagtttacaagcacctggtttcaaccattgacgctgaaccggaccgtgcgattcgggagattttgaagatctttttgaagaagatttataggagaaagaagtagacgatccttcctgttttcataactatgattactatgggagaaaccttaaatacattccacggatggggatgtcatgcgctcccttgtacaacatgtatgatatgaactggagaaggcactgccttgagataaagaccagaaatcaataag

SEQ ID NO: 27835 - DNA, 586 bp, Triticum aestivum
  Clone ID: PAT_TA_27835
gaattcactaagtgatttcgagcggccgcccgggcaggtgagaactagtctcgagtttttttttttttttttttggataaatcagcacttgcgtgctgcagctttgttggtcctagacattacagactcgattcagataagagtcacatgcaagaagcaaaaaacgagtgatgtatattaacgggtaaccaggtaaccgcatcaataatcttcacgaagcactctgaacataacttcactaaaccactcactcttagcttgaagtttggagaactcttgagataaaacccggtgaaacgccttcttcaccgcaccactctttgaccctgctggggaccaccttcaacacattgaaccgcacccgtcttgggacagcgggcctgcactgggccaaatgatcacgtgatctccttctctcacacgggaagcaaagggggaaaatgtgggcaagggatgttgggagtgcctcttctcaaacctctggtatttttgacatagtgaaggtagttcctacgaacaatgatggcctgtcattagacaagacatgtccagcatgatcgactctacgaacatgcatgatgggact

SEQ ID NO: 27836 - DNA, 1043 bp, Triticum aestivum
  Clone ID: PAT_TA_27836
agcagaaaaccacgtcctcttcgaaatatagacaacaatggcaatgttaacaccgactctaaccggcctgagactgaagagtttagttacttttgacaaattaatcgagttctaagacccataataccaagatgacgcataaatacaacacaaacagtagagcatgttggacgggtatcactaccatggcagtacggtttctgacaattttaggtcaatatctttaatttacaggagtccaggcctctcgcggagctgctctttttttttagggatcgcagagtagctgctcagtgctccatgtactggtgtgccggcggggttatctttgtcttccctccgtatgcaccacgaatctctacttcgcgccattcttgaacaagagcacagcaacagcacattacatgtgaaaggaaatcgtcacaacaccctcccgcaatatttagcctttgacgaagctttctccttacacagcaagtgtaacagcaacaagacagtatgagggagtacgccataatatcattgcaggcttctcccgaagacatgggcttgttctttgcgattgaagcaattcttgagaacgttccacatggaaaaaagaaggtcttcagacacagagctggctctgaacagcaaccaagtaaatctgcatgccactcatcactgtatgatgctgtactcgagaccagatcatggttgtagggaacaggtgaagaactccgtggtgcaacataggcatctttttgcttctttggagagtcatcatcatatgattttgcactgtcttcattaacttttgtgcactttgacttggttttcttggtcaccttagcatcggtactttcatctggaatagaactttccacggttctggtaactccaagcaggtgatgaataacctcgcactgggccatatccatgttgctttgtgatctttgaagctccacctggagcttctcactttcctttcgaagggcttcgttgaatggcaagtttggataagaacaggacagggtcttcttgagcactatcgaaggatttgt

SEQ ID NO: 27837 - DNA, 1605 bp, Triticum aestivum
  unsure (1)..(1605): unsure at all n locations
  Clone ID: PAT_TA_27837
acacatcctcgccagcgtagcttctctggcgtccggccaacgcgctcactagcctcccgccttcctccacatctcctcgcctccaccccatccagttcgtgccattcgctgctccaagacaagggcatggcgctcggcggctgcggcaacgaagctgatggtgcacgagccaaccatggaggcagtagcacggggcagcgacaacagcatggagggcgtcctcttgtttgggaaggtaatggaactgcaaataggagtggcagcggcgaccaggatgcaaatggaagtggttcccaaagaccttggaaaggacttaaagacaataacttatatgatccttggaaccatgcatggccgtattatgggggttttgattgcacgtactgcagcctaaagcacaaaggtggaggtgcaacccgtgtcgcggagcaccttggtggtattgtaggtaatgtgaggagctgtcccaatgtgccaagaaatgtgagagatgcaatgagagagtgccgggatgaatcaaggaggaagaaaagagacaaacaaaatagcaggctgagaattgaaagaaatattatggaagggttgtataaaaaaggaggggtggttaacgtaccagatgatgatgaagaagaaattcagatgaatattagagaagcattgcgtgacccgaatgtctctcgcagaattgaaaggagaattggcaaggggggtgtgggtgatgtgcatgtttctgttggtaaaaggagtatcagcgcctattttgacaggcaattatctagcaacaaagtatatatgcagcccaagatcagtagtgctttggatcctaattcaagagatgcacttggtctagcttggtccaagttttttcatgccaatgatattgctggacgtaaagctgattgcccatactttcgagctgctgtgaagatcactcaacaattagggcctattcctataccaaccgcgaaggagattgatgggccatatttggaggccaactatgatgaagctaattcgtttcttcaaaaattcaaacaagactggaagaactttggtgtgactcttatgtgcgattcttggactggtcctacaggaatgagcatcataaacttcatggtgtattgtaatgcacgaatgttcttcctcaataccattgatgcatccggacaaactcagaattcagactttatctatagagagattgaaggcgtcttatgttggttcaaagggtaataacaacaattcccgcagccccaacaaccacaacaatcattcccccaacaacaaccatcgttgattcaacaatctctacaacaacagttgaacccatgcaagaatttcctcttgcaacaatgcaaacctgtgtccttggtgtcatccctctggtcaatgatcttgccacgaagcgattgccaggtgatgcggcaacaatgttgccaacaactagcacatattcctcatcaacttccagtgtgcaggcattcattagcatcgtgcattccatcatcatgcagcaaggatcaaccangaacaaacgacaggggtggtgcaaaatccctggtggccactttgtctcaacaaggcaacagggtagggntcaagggt

SEQ ID NO: 27838 - DNA, 1220 bp, Triticum aestivum
  Clone ID: PAT_TA_27838
tgtgtcctcacctcctcgtgctctcgcctccctccaacacccttctcgccgccgccgccgccccctcgccggaaccctaaatggacgccggcgccggcgccggcgctggcgcgccctacgcctcccgcacggcggaggaggtcttccgcgacttccgcggccgccgcgccggcatgatcaaggccctcacccaagaagtggacaagttctaccagctctgcgaccccgaaaaggagaacttgtgcctttatgggtaccctaatgaaacatgggaagtgacgttgcctgctgaggaagttcccccagagattcctgaaccagcacttggaatcaactttgctagggatggcatgaacgagaaggattggttggcactagttgctgttcacagtgattcctggttgttggctgtttcattctacttcgcggcacggtttggatttgacaaagaggcaaggaggcgactcttcaacatgataaataacctgcctacaatatttgaagtcgtgactggggctgcaaagaagcagatcaaggagaaggcccccaacagtacgcacaagagcaataataagccaagcatgaaaacttattcaaagcctgagtcccaatcaaaggccccaaagatagcagcgcccccaaaggatgaagatgagagcggcgaggactatggagaaagaagaggaggaagagcgcgacaacaccttgtgtggtacctgtggaacaaacgacggcaaggacgagttctggatctgctgcgacaactgcgagcggtggtatcatgggaaatgcgtcaagatcacgcctgctcgagccgagcacatcaagcactacaagtgcccagactgcagcaacaagagggcgagggcgtaacggcgacaaacagcaccagcagggcggcaggactcggaatggaaccagcgccagcaccaaatcgtcatcgtcgatgcctgctgcagcctgcagatatggcctagctgtctagctcatcatagactcgcctttcgtttcagtcgaacactgttgattcacccttgaccctgcagttcgttcatgttggtccgactcttcacttgtgtgttttaaaccgttggttggttggtgtagtagtgttgtaccagcttcgatctcttcagcggacatgtcgaagacgttcttcaactgaaaggacccgaaagctgacaccattgtttgcggctttgttagcctcgtctcgttcc

SEQ ID NO: 27839 - DNA, 1849 bp, Triticum aestivum
  unsure (1)..(1849): unsure at all n locations
  Clone ID: PAT_TA_27839
aactaattagaccaaatgccacccgttttgggactgtcttcatgttccttgagagttaccattcaaaggaagataaatttagggagtggatggtttcaaaggattggaaggagtgtcagtggaggtatgagcctgggtatgtgtttgctgaagagtgtttgtctagtaatgtttggtggaacgcactagagtgggtattgagttcattgaggccactttatacggccatgaggtatgctgatacacaaaaacaatgcacactttctggcttcaaaaaaagcatgatgcttgctatacaaaggatggaagcccatcttggccctacatcaaggttgtacctttcgttcatgcgcaaggtgggcaagaggatagatgcaatggaagaagatacatttatggttgcagctgctgtccttgacccatatacacattacaagctgaacctttgcaaccacacagattatgccacttcactaacagatgcgatagcgaagatattagacccagtgagtgctctttcagccattgatgaagtgagcaagttcagggagtgccaagggaggtttgggaccagattggcagaagaagctgcggcgagaatggggccaacccaatggtggtttcagtttggaggggatgttcctgcattgcagaaatgtgcaatgagaatttgctcacaatgtgtctcctctagtgggtgtgagagaaattggagcgcttttgctttggtgcacacaaagcaaagaagtcgtcttctatatgacaagctccacaagctagtttctgtacgctacaacttaaagatacgtgctgaagaagatcaagagaaagagagagatatagataaagaaattgatccaagtgcattgctaatggataccacaatgtttgatgaaacaaacccaataatggagtggctgaatgaggatgtagaggatctgattgtggatggagctgatgcagctagtgctgtttttgagcaaataaggcgcctcaactcaagcaggaaggcgtcttatgttggttcaaagggtaataacaagaaaagaaagaggaatgatgatgatgagaatgagtttcttgaaactgagagtgaggatgatgaagaagagaatgaatatgttgataatgacatcgaggatgatgatggggtgagtgaggatgatgaggatggtgaacaagatcagctagagacacaaatgcagcttgaagaagagacacaagtacaagttcaaaaggaggcaccaacaagcactggccatttggagactagatctggacgacttattaggaagaagaccaagaacgtcaacagcctctactcgtaaatttgaaatggcacgtgagcaaaggatatcaagaagcttttggatgttgggaagcttggagctgatgcttcaaataagctgatggttgtcttttggagatgtttctatgtttaatgctttaaagtcttttggctgtactggactatttaaactttgaactatgctgtgatggttgaactgatgctggacggttaagggtttatgtcagaggcaactttataactaatgtgtgtctgttatgttggactgttaagggttatgttggaggcaattttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaannnnggggngnnaaattaaaggganaaaaaaaattttaagcgggggattagaaaaaaaaactttttttttaagg

SEQ ID NO: 27840 - DNA, 1170 bp, Triticum aestivum
  Clone ID: PAT_TA_27840
ttgcccacgcgtccgcccacgcgtccgccatcccccccttccttccttccttcctccacccacctcccccctctcctctccggcgcgcctccccccaccggcgaatccgcaaccgaatcgaatcccaggatccgcgtcggcgggcggcggcggaggcacatggcgcaccgggtggacaacgagtacgactacctcttcaagatcgtgctcatcggcgactcccggcgtcggcaagtccaacatcctctcccgcttcacccgcaacgagttctgcctcgagtccaagtccaccatcggcgtcgagttcgccacccgcaccctccaggtagaaggcaagacaattaaggctcagatatgggatactgctggccaagagaggtaccgtgcaatcacaagtgcttactacaggggagctgtgggagctcttttggtgtatgacataacaaagaagctatcattcgaaaacatcaataggtggctcagtgagctccgtaaccatgctgactccaacatcgtcattatgatggttggaaacaaatccgaccttaaccacctgaggtcagttcaggaggaagaaggacaggcattagcagagaaggaagggctatccttccttgagacctcggcactggaagccttgaacgtcgagaaggcgtttcagactatcctttccgacatccatcagatcataagcaagaaggcgctcgctgcccaggaggctgcaggaagtggacctccgactcaaggaaccaccatcaatgttgccgattcatccggcaacatgaagaaagggtgctgttctacctaggtgcgaacagagaagtggtgattctgcaaaaggatgctcacatggatcttacggcgctctaggtgtctaggtgttagttgggtccctttgactccttttggcctgtaattctggtggggttgtattaaagttcatactgctagaaagaaattatcccttggtagataccgtgtgtagttgcgaatttttggtagagaccattgtttgtcagtcagacttactacagtttcagagcaatatcatgtttcctttcaggtatatgtttgtcctcctaagacatctgatgccccgaattaccggagcaggaacaatgcgatatatatgtatctcttgtatttgttatgatgcaaaaaaaaaaaaaa

SEQ ID NO: 27841 - DNA, 1590 bp, Triticum aestivum
  Clone ID: PAT_TA_27841
cagcaaacaaaaggcataatttccgttgcaaacagtctaataaagcaagtataccgagtttcagccctattattattggacagtaacacaaccggggccttcgatggaaatgaccctcaaatggagttaaaatgggaaaataaacgccaccttggagggcaggggcttgtaaggctgtgcatctctctgagtcgacaggaacacaaagtgattcccagctcgagagtttcgtaaacatggtatatacattcacgatacttgatcacctctgaaactgaggtttcaaaactgctggtcgaggatcgagtctttctccgacttggtctggccaccactgacatagcccacaaggctccccccaacgtccgagacccaggaaacgctgcgcgccagccaagccttgggagtcgacgcctgcgggctctctgctgccgccgccgccatgctcctctgttcttcctcgagcaatgcatcaagccacctctttgacgtgtactctttcacagcgtctacaccttccttcacgacctccgctggtggcatggacagagggttctgctccaggttaagcttctctagcttgtcaagccggccaaaactgtcgggaagagcatggatctggttgttgctgaggtcaacctcgcgcaggttcagcaggtcaccgaatgagaaagggagctccttcatgtcgctgaagttgctgctcaggttgaggatttgcaaggctggaaagcttccctatggcagatggcagaccgcagagttcattgaaatgagcatcccaggaggtatagtgattgcatctcacagatagatgatggaagagatcgcagcttgttcatgtggacccagagctttcgcagattaatcagttcatagccaatatttgttggcagatatgtgagcccgttgtagcttgcatcaagctcaactagcgacctgcactttgagatgctgtctggcagtgttctcagcttgttagtcgacacattcagaatcttcagattggacagaaatccaacagtatcaggaagagaaaccaaggcattagaagcaagacggagctcttcaagatgttcaagccctcctatagcatctggaataacctgtagctggttgtgtgatacgtcaagcacgcggagtcccaggatccttccgaacgcctcgggcaggtagcgcagctgccgatccacgaggagcacgctctccaccggcttgccctcttgggcttgcttcagcacggcgacgacttcctcttgcacagccacaccctcatcgcccgccgccgattcatccttcccctcggcctcctccaggtccctgccctccatcgccgaccggtagaccttctcgagcctctcctcggcctcctgcagcagcgcctcgtaggtgtcgtgggcctcctcgagccgcaccacggtgcggcacgcctcgaggtcctcctcggtgatccgcggggcgacgtcgccggcggcggcggcggcgacgacggcgcgggaggagtcgatgagctcgtggtcggggcgcgggcccagctcctggagcgcggagcgggcggcggagacgtcggcgacggcgcgggtcatggcg

SEQ ID NO: 27842 - DNA, 956 bp, Triticum aestivum
  Clone ID: PAT_TA_27842
ccccccccggttttaaaacccgggccaggaaatttaatttgggggccccaaaaaaaaagtaaaaacttggcaacccccgggagataaatttggacccctaaaaagggcccccctttttttttttttttttttttttttttttttttttttttttttttttttttttttttttttttttttttttttttttttttttttttttttttttttttttttttttttttttttttttttttttttttttttttttttttttttttttaaacaaccaccatagcataagtataaattctttgcaggtaccgagattaggtgtaatctcagccgctatatcaaggtttacaaatacaggtacacaatatcatcggttgtgtattaagcacgggacaaactgcctactaacgtttcgatcggccagtacattgttacaatgctactacagatatggctgacggtggcagtaaatgacatcaacacattgaggccatacgagtattatagttacacatgctcatgcaccatcatcatcttcaacagtgttgacgcgctcgcactcatcgatccattcgctgtatacatcaataggttcagtcagcgcatttgcagtggtgctgaagctttcctggcagatttgacagttagcctcaccaatcagattcttcaaatcaatccggcactcaacgctgctcccatggttgcagaatgggcaggagaagacggtatcgagcttgtccatcctcttcctaggtggtggcttagcagccgcctttctcttccccatggttcggcctctctccttacttcaaaatctggtgacctgtttgcgaggaagaagggaaacggctacggcggcgcaggtcccctagtggcgggaggagggggaagggattcaggcggcggcgggtggatccgcccccggcgttggaggggaagggggaggggaaaggggagggacg

SEQ ID NO: 27843 - DNA, 769 bp, Triticum aestivum
  Clone ID: PAT_TA_27843
tcgagcggccgcccgggcaggttttttttttttcgataaatgatgcttttatcattccataatataatatcaaggagttacaaagcataattagcatacacctgcctcttgtatgattagtatgcgcacatctaacaccaactcatacccacgagatctttttattagcacgtataaatagtgcagctgaccaattttattgctcgatactccatgacggttggacaccaggtactcacgcccacgagatttgtttattagtacatataaattgtgcggcttaccaattttattgcatgaccctccatgaacggccagaccatcagctagcgagtgtggtggggaagcaactgtcgtgcacgcagctgagcacgtcacggtagtccctgtggatggtgaaggagtcgtagaccttgccatcgctgctcttcatgtactcaaacaaaagcgacgagtggttgaaggccgtcagcttggtgaacccgtagtcgtgatccctgaatatgctcccacttggggatcgccgtggtgtactccgacaggtggctaccgccgccgccggccacgacgaagatggtcccgttcatggtgcccgagtagtggctcttctcgttgttgacgcactggctctggtagagtgggcatgtacgctcgtagttgtggacgtggccgaagtaggcaatgtcgacgcggtacttctgccacagtttctgcaggctctcccggccctctggctcctcgaaggagccctggtcggcgtaccacgagt

SEQ ID NO: 27844 - DNA, 820 bp, Triticum aestivum
  Clone ID: PAT_TA_27844
cacttgcgtgctgcagctttgttggtcctagacattacagactcgattcagataagagtcacatgcaagaagcaaaaaacgagtgatgtatattaacgggtaaccaggtaaccgcatcaataatcttcacgaagcactctgaacataacttcactaaaccactcactcttagcttgaagtttggagaactcttgagataaaaccctagtacaaacagatggcacaatatagatgtaactgtcaaaatttaatggtaaaaaagttttggattctgctatgacttgctcacgcaccggtgaacgccttcttcaccgcaccactctttgaccctgctgggaccaccttcaacacattgaaccgcaccgtcttggacagcggcctgcactggccaatgatcacgtgatctccttctctcacacggaagcaaggggaaatgtgggcagggatgttggagtgcctcttctcatacctctggtattttttgacatagtgaaggtagttcctacgaacaatgatggtcctgttcattttagcactatgacatgttccagcaatgatgcgacctctaactgacacagtgccagtgaatgggcacttcttatcaatgtaggttccctcaatggcttccttgggagtcttgaaaccaaggccaacactcttccagaacctgctgccctccttgccaggcttattattcccctttgtggtcttctttgagcagaggaacaccttaggctgcttcaggaaagccttctcagtctgttctgccatggctgatgctcgaaggcgatggggccgacggcggcacgcgctaggcggc

SEQ ID NO: 27845 - DNA, 836 bp, Triticum aestivum
  Clone ID: PAT_TA_27845
agcagtccagcgacgaacacccgccgcaaaaatcccaaatcaccaaccaaatcccctcctctcccgcgtcccgacgagcaccagccaccagacatggacgcctcagccaccggagccggagcgaaggcgaagaagggcgcggcggggcgcaaggctggcggccccaggaagaagtcggtgacgcggtccgtcaaggccgggctccagttccccgtcggccgcatcgggcgctacctcaagaatggccggtacgcgaagcgcgtaggcacgggcgcccccgtctacctcgccgccgtcctcgagtacctggccgccgagctgctggagctcgccgggaacgccgccaaggacaacaagaagtcccgcatcgtgcccaggcacctgctgctggccgtgaggaacgaccaggagctcgggaggctgctggccggcgtgaccatcgcgcacggcggcgttctgcccaacatcaacccggtgctgctgcccaagaggacggcggagaaggagcccaaggagggcaagtcgcccaagaagaccgccaagtcccccaagaaggccgacaagaaggcttagagagaggcgctcgtcgattagctttgctttgctgtaacagtgatcgctgttttactaatggtgtcgatgtagatctgtagttctgtactgccagggaaaaacaaattcagaaatctctctgatttattatccaaattgtctgccctgtcgtttgttcttgatatggcaatgtgacataagtgctctgggaaaaaaaaaaaaaaaaaaaaaaaagggcggcgctcgcgatctagaactagtccggacgcggggcggacgcgggg

SEQ ID NO: 27846 - DNA, 703 bp, Triticum aestivum
  Clone ID: PAT_TA_27846
ctcctcctgtgggcggcgccgccgctgcgcacagaacacatcctcgccagcgtagcttctccggcgtccggccaacgcgctcactagcctcccgccttcctccacatctcctcacctccaccccatccagttcgtgccattcgctgctccaagacaagggcatggcgctcggcggctgcggtaacgaagctgatggtgcacgagccaaccatggaggcagtagcacggggcagcgacagcagcatggagggcgtcctcttgtttgggaaggtaatggaactgcaaataggagtggcagcggcgaccaggatgcaaatggaagtggttcccaaagaccttggaaaggacttaaagacaataacttatatgattcaggtttctgattcagaaatggcacatgagcaaaggatatcaagaagcttttggatgttgggaagcttggagctgatgcttcaaataagctgatggttgtcttttggagatgtttctatgtttaatgctttaaagtcttttggctgtactggactatttaaactttgaactatgctgtgatggttgaactgatgctggacggttaagggtttatgtcagaggcaactttataactaatgtgtgcctgttatgttggactgttaagggttatgttggaggcaattttataactaatgtgtgtctgctaaaaaaaaaaaaaaaaaaactcgag

SEQ ID NO: 27847 - DNA, 794 bp, Triticum aestivum
  Clone ID: PAT_TA_27847
ttttttttttttcgagaattaacagcaggacaatggtccgcttgttgtatataataaatatcacactggtgttgtatatgtgtagccgtgcatgctccacaacctatgttcgtacaaacacagatcatatggaacgagaaatatgctctggtcggaaagcagagtcgtggacaaaagtgaagttcacaaatgaccatcatacataggccattgtttcaacttgtagtttaggccttgccggactcctcgcaacctggtggcctgaaggcgatgaagctgacgcactgcacctggcgcaggttgtcgaagccgatgacacggacataggcatcagggtactccttcttgacctcctccacctcgttgagcacctgcgtggcgtcggtgcacccgaacataggcagcttccacattgtccagtatcgaccgtcgtagtacccgggagagctgttgtgctcacggaagacgaatccaaccttactgaactcgaggcagggcacccacttggagcggatcaggtagtctacctgctttaggagggcctctgtggagaggggtggcaagtaagacagggtctcgaacttcttgataccctcaatcggccacacctgcatgcacctgatccttccgccattgctgacgcggccgaggctgccgctggagcggcggctgacgggcagaccggctgtggacttgagcccctggaagggtgcgacggtggtagccgacgaagccatcacggcgggggccatggtattgtattatcggaggagaggaggatgccggctcgtgcc

SEQ ID NO: 27848 - DNA, 773 bp, Triticum aestivum
  Clone ID: PAT_TA_27848
gccggccggtttcggagaacacaatcccaaatcaccaaccaaatcccctcccctcccgcgtcccgacgagcaccagcggccagacatggacgcctcagccaccggagccggagcgaaggggaagaagggcgcggccgggcgcaaggccggcgggcccaggaagaagtcggtgacgaggtccgtcaaggccgggctccagttccccgtcggccgcatcgggcggtacctcaagaacggccggtacgcgaagcgcgtcggcacgggcgcccccgtctacctcgcggccgtcctcgagtacctggccgcggagctgctggagctcgccgggaacgccgccaaggacaacaagaagtcccgcatcgtgcccaggcacctgctgctggccgtgaggaacgaccaggagctcggcaggctgctggccggcgtcaccatcgcgcacggcggcgtgctgcccaacatcaaccccgtgctgctccccaagaagacggcggagaaggagcccaagtcgcccaagaagaccgccaagtcccccaagaaggccgacaagaaggcgtagagacagacgagcatcgattagcttgtagaactaatggtttcgatgtagatctgtgctgccaggaaagaaaacaattcagaaatctctcttcgattggcttagccgctgtagtgctctgttgtaacggtgattgctgtgacgtagatctgtgctgcgaagaggaaaaagtgagaaatctctctgatttgagcgaaaaaaaaaaaaaaaaagcccctag

SEQ ID NO: 27849 - DNA, 879 bp, Triticum aestivum
  Clone ID: PAT_TA_27849
ggggacgcaggcggcggcttagggttttaactcgcatccattctcaaggttagcaggaggcgggccatggcgccgtcgcagcccaagtcagggctcttcgtgggcatcaacaagggccacgtcgtcaccaagcgcgagctgccgccacgcccgtccgaccgcaaggggaaaggtaccaagagggtgctgtttgtcaggaacttgattagggaggttgctggatttgctccctatgagaagcgtatcactgagcttcttaaggttggaaaggacaagcgtgcactcaaggtcgccaagaggaagcttggtactcacaagagagcaacgaagaagagggaggagatgtcaagtgtcctcaggaagaaaaataagacttccaaatcccagctaataaaaccgtgatcaataaccccccaccacctcgccggtctccaccgcaccaccgtccttcagaaatggagatgaagaagatcgccttcgccgtcctcatcgccgctgcctcggccaccgccgtcatggcctccgaggctgctcctgccaccagcgatgcctccgaggtggcaatcgcccccgccgccctcgtcgcctccctcgtcgcatatttcctctactgaagcagcggacagtaggggaggagttaattactagcattgcgttggccgcatgtgcgtatacatgcgaatgatgtggtgtaatttttattattttcgtcttgatgagcacggttaaccgctgataggtacgtgatacatgtacttgtatccggtggatgcttaaccgtgctgaacatgttcattttttttgtcagatcacatcaacttgtgtaattgttgtgatttgttttatttgttgaattcaatgttttctagttcactttcg

SEQ ID NO: 27850 - DNA, 605 bp, Triticum aestivum
  Clone ID: PAT_TA_27850
aaaaaggcgcagccgcttcacttctcccaggtaaaggaaagattcgcccatggctccgtcgcagcccaagtcgggcctcttcgtgggcatcaacaagggccacgtcgtcaccaagcgcgagctgccgccgcgcccgtccgaccgcaaggggaaaggtaccaagagggtgcatttcgtcaggaacttgatcagggaggtcgctgggtttgctccgtatgagaagcgtatcactgagcttctcaaggttggcaaggacaagcgtgccctgaaggtggcgaagcgaaagttgggtacccacaagagggcgaagaagaagagagaggagatgtccagtgtcctcaggaagatgagatctgctggaactggaacagacaagaagaaatagagcatcccaggctcatgaagttgatggcaatcttctgttctggtgtccagtttttactgcatgtagaacctactagacctgaaactgttatccgccagctaaacattatgctatgttgaacctcctgtcttgtgagatttttgatctaacttgcaatgcattgtttgccaccctatttctgagtttgcttctatgatccgtcagcttgattccatctgcc

SEQ ID NO: 27851 - DNA, 1360 bp, Triticum aestivum
  Clone ID: PAT_TA_27851
gccactttccccaccagcccttagtgctgacttggaaactttcatgtcctgggttgatgaagttaggcagctcaaggttatggctaatgcacacacccccggggatgcattggcagcaaggaaaaatggggcagaaggaattggactctgtcggacagaacacatgttctttgcttctgatgagaggattaaggctgtgaggcagatgataatggctccaactgtcgaactgaggcagaaagcactagatcgtcttctgccttaccagaggtctgactttgaaggcattttccgtgccatggatgggctcccggtgactattcggctgttggaccctccacttcatgagttccttccagaagggcatgtggaggatattgtgcgtgaactatgtgctgaaaccggagccgctgaggatgatgtccttgcaagaatggagaaactttcagaagtaaacccaatgcttggtttccgtggttgcaggcttggtatttcgtatcctgaattaacagaaatgcaagcccgggccatctttgaagctgctatatccatgaccaaccagggtattcaagtatttccagagataatggttcctcttgttggaacacctcaggaattgggacatcaggtggctcttatccgccaaattgctaacaatgttttcaccaatatggggaaaaccattgattacaaagttgggactatgattgaaattcccagggctgctctagtggcagatgagatagcagagcaggctgagttcttctctttcggaacaaacgacctcacgcagatgacatttggttacagtagggatgatgtggggaagttcctccccatctatctggctcagggtatcctccagcatgacccctttgaggtgcttgatcagagaggagtgggggagctagtaaagattgctacagagaggggtcgcaaagcgaggcctaacttgaaggtgggcatctgcggtgaacatggtggagagccatcttcagttgctttttttgcaaaggctgggctggattatgtttcatgctccccgttcagggtcccgattgctaggctagctgcagcccaggtccttgtctgaggacgctgcctcgtcaaccggataacctgctgttggtgcatctggtgaagataaataagacatagccatggacttgtggaaactctgctgcctaacaaaggccgtttcatatatgtagtctatgatgcgtatgcgcgtgtaagcctgaaatggcttgttctctgcatttcccctgaactgccatggtaatgtaccaaacagcgatgatgacgaagataaatcgaataaaaggtggcgattatctgtgctatccatttaagtgattcc

SEQ ID NO: 27852 - DNA, 818 bp, Triticum aestivum
  Clone ID: PAT_TA_27852
tgatgcccatcttgggtatctggggaggcaagggtcaaggaaaatcattccagtgcgagcttgtcttcgccaagatgggcatcaacccaatcatgatgagtgccggagagctggagagtggcaacgccggagagccagccaagctcatcaggcagcggtaccgtgaggctgcagacatgatcaagaagggtatcttccagaccgacaatgtcagcgacgagtccgtcgtcaagatcgtcgacaccttcccaggacaatccatcgactttttcggtgctctgcgtgctcgggtgtacgacgacgaggtgcgcaagtgggtgacctctaccggtatcgagaacattggcaagaggctggtgaactcgcgggacggacccgtgacctttgagcagccaaagatgacagtggagaagctgctagagtacgggcacatgcttgtccaggagcaggacaatgtcaagcgtgtgcagcttgctgacacctacatgagccaggcagctctgggtgatgctaaccaggatgcgatgaagactggttccttctacggtaaaggggcacagcaaggtactttgcctgtaccggcaggatgcaccgaccagactgccaagaacttcgacccaacggcgaggagtgacgacgggagctgcctttacaccttttaagcatgccaatttaatatctgatgttttatcctttgtacctaagtaccgcatcgcatccaagcgattgctgggcatgttttgttaatataaaaagatattgagtatacctatttggtaaagacaaatagaactacttatcatttgtcaaaaaaaaaa

SEQ ID NO: 27853 - DNA, 874 bp, Triticum aestivum
  Clone ID: PAT_TA_27853
ttggtggcccttttggaggggttttaactttcttttatgcggaatttagctttgaatctttttgggggcccgttttttttttttttttttttttttttttttaatttttttttttttttttttttttttttttttttttttttttttttttttttttttttttttttttttttttttttttttttttttttttttttttgagaacaaccaccaacatagcattcttctcttgtactaaaaattagtcctaatctcaaccatgataacataccggaagagaaccaaccttacagtctcatatatgatggatccatacacatcagacatgcaacactactattaaggttcaaacacaagtacacaatatcatcgcttgtttattaaacacaggatgaactgcctactaacggttcgatcagccataaggctaactacagggatggctgaaggtggaagccaataacaccaacgcattacagtcatagtagtaataaccatttcattttgcaaccagacatgctcatgcaccatcatcatcttcgacagtgttgacgcgctcgcactcatcgatccattcgctgtatatatcaataggctcagtcagcgcgtttacggttgtgctgaagctttcctggcagattcgacaatttgcctcaccaatcagattcttcatatcaattcggcattcaacactgctcccatgattgcagaacgggcaggaaaagaccgtgtcgagcttgtccatccgcttcttagggggtggcttagcagctgactttctcttccccatggttcaacttcttttcttccttgaggaggggaagaagatcgactaggattgggatggggctgtgtgctgctgcccgctccgaac

SEQ ID NO: 27854 - DNA, 713 bp, Triticum aestivum
  Clone ID: PAT_TA_27854
ttgattgaattcccaggctgctctagtggcagatgagatagcagagcaggctgagttcttctctttcggaacaaacgacctcacgcagatgacatttggttacagtagggatgatgtggggaagttcctcccccatctatctggctcagggtatcctccatcatgacccatttgaggtgcttgatcagagaggagtgggggagctagtaaagattgctacagagaggggtcgcaaagcgaggcctaacttgaaggtgggcatctgcggtgaacatggtggagagccatcttcagttgcttttttcgcaaaggctgggctggattatgtttcatgctccccgttcagggtcccgattgctaggctagctgcagcccaggtccttgtctgaggacgctgccccgtcaaccggatagcctgctgttggtgcatctggtgaagataaataagacatagccatggacttgtggaaactctgccgcctaacaaaggccgtttcatatatgtagtctatgatgcgtatgcgcgtgtaagcctgaaatggctgcttctctgcatttcccctgaactaccatggtaatgtaccaaacagcgatgatgacgaagataaatcgaataaaaggtggcgattatctgtgctatcaatttaaaaaaaaaaaaaaaaaaaaaaaaaaaaaaaaaaaaaaaaagaaaaaaaaaaaaaaaaaggccccta

SEQ ID NO: 27855 - DNA, 917 bp, Triticum aestivum
  Clone ID: PAT_TA_27855
atcatagcctctttgttgcaaacaaatagattgcttcaacatgcaaatgcgactgaaaacagtgaccagagacaaacttgtccgtttaatatgtataagattgataactcttacagttcttacaacatcagctgaaactgggtactttaagaacaccacctgtccataagtgtaaattcttgacttaactgttcacagaacatcctcccaaacggcatgtctcaagtacaaattttttgcaggtaccgagattaggtgtaatctcagccgctatatcaaggtttacaaatacaggtacacgatatcatcggtcgtgtattaagcacgggacaaactgcctactaacgtttcaatcggccagtacattgttacaatgctactacagatatggctgacggtggcagtaaatggcagcaacacattgaggtcatagagtattatagttacacttgctcatgcaccatcgtcatcttcaacagtgttgacgcgctcgcactcatcgatccattcgctgtatacatcaatagcttcagtcagcgcatttgcagtggtgctgaagctttcctggcagatttgacagttagcctcaccaatcagattcttcagatcaatccggcattcgacgctgctcccatggttgcagaatgggcaggagaagacggtatcgagcttgtccatccgcttcctagggggtggcttagcggccgccttcctcttccccatggctcgacctctctccttacttcaaaatcacaaagggagggaggagacctggtgacctgcttgcgaggaagaagagaaacggcgacgtcggcgcaggtccccgatggattcaggcggcggcgggtagatccgccccccggcgctggaggggaaggggaaggggaaaggggagggacgagggggtgaaggtggga

SEQ ID NO: 27856 - DNA, 1202 bp, Triticum aestivum
  Clone ID: PAT_TA_27856
ctcatctccaagatcagggaggagtacccagaccggatgatgatgacattctcggtgttcccatcgcccaaggtgtctgatactgttgtggagccatacaatgccaccctctctgtgcaccagcttgttgagaatgcggatgagtgcatggttcttgataacgaggctctctacgacatctgcttccgaacgctcaagcttaccactcccaccttcggtgatctgaaccacctcatctctgcaaccatgagtggcgttacctgctgtctccgcttccccggtcagctcaattcagacctccggaagcttgctgtgaacctgatcccgttcccaaggctgcacttcttcatggttggatttgccccgctaacctcgcggggttcacagatgtaccgtgcactcactgtgcctgagctcacccagcagatgtgggactcaaagaacatgatgtgcgccgctgacccaaggcacggccgctacctcaccgcctcagccatgttccgtgggaagatgagcaccaaggaggttgacgagcagatgctgaacgtgcagaacaagaactcgtcctacttcgttgagtggatccccaacaacgtcaagtcgagcgtctgcgacatcccgcccactggcctgaagatgtcatccacctttgttggcaactcgacgtcgatccaggagatgttccgtcgcgtgagcgagcagttcaccgccatgttcaggaggaaggccttcttgcactggtacacgggcgagggcatggacgagatggagttcaccgaggccgagagcaacatgaacgacctggtggccgagtaccagcagtaccaggacgcgacggtcgaggaggaagaggactatgaggatgagcaggaggatgaggaggccgcctaagcgggcttccccctttcttcccagggatatgccttatatcgctcgttgagtcgttggagtgctcgtggtgctgttaggtgatgatagctagatgctatttttttttttttcgttctgaatgtcggttgtgttgccttgacagacttattttttcgttatgtggacctgtggttgtcgtgtatgctcatgtcgtgatgagcatttggtgtaaggtttgactgtgactgcttggtgtgttattcagtagtgctacttgactgcaaaatctctattcctgtgtccggtatttttggggccaagtttgccacccc

SEQ ID NO: 27857 - DNA, 1569 bp, Triticum aestivum
  Clone ID: PAT_TA_27857
aactagtcttgagttttttttttttttttttttgagaccataccaccatatcttcatttagtttttttggaaatctaaaggtctaagaggatggtacatgtgagaagctgtgaatccacaacaaaaaactaaactaacttccaaacaaacatttcaagtttggaagccacaaagaagcaacccagatctctcgttgtagtgcaggtacatgtccttaatcctgcatccacagcccataatttttcaacacctaaatccacgaaatccaaccaaaggaaatcatggcagaaacatgcgccatggacttacgtctccgagaaggacttcttggcattcttgtgcaggttgaacacagcaatcctcgctgcgagctgctgaagaaccacacatgcaccttccttcaccttgcccttggggaggaggggggcaacacttgcagcgccacgacaaggctttgcaaacgccgccggcgagagcgcgcagcagagggcgttgagagtggcagcggccttcgcctcggcgggggcatggtggccatgcgactcggggcaacacacgaagcggtcgcgctggagcaccacgccagccataaaatcagatgcttcttgattaacaaaatgaacacacaattaagcggggcatagaaggtgtacaattatgtactgaaaaaaatcagagggattagattatgttcaaatgagataaatcatcaaggttccaatgatagaaaactttgggcccgatgcactgattaatgttacagcacacaggcaagctagacatctacgtctggagcgaatactttcttcttccatggcatcgctgggagactcgcgttcatcctccaaattgtctggtttggagcagcaactgatccgggttcgcactcgaccgaagcaacgtttgatcaacagcaggaacttgaacctcatgatgctacaccatatatctatggttaccctttttatttctcccgcctaacctgaagtaattatctgaaacctgacggagtttgcttcggcctccaatccagaacataatcatcaaccatgcgcgccttccccatgtacttcacaagcatcttgtatgagaacaaatgaattgtcaggttgctgcagctgccaaaaatgccccagcttaatacatggattctgtcaatgcaactcacatagtcaccttattcttcttcaccaaaatcttccttgggattcttcctcttctcttcttttacagatctgcacacattgttctacgcatggggaggcggaggctgaccgatggctcgagctcctacctgccatggcgacaaggagaagagggctaggaggtccccgatggccggcgcctctctcctcgccgctccttcctccagcgccggcctccagctccggccgactggccctgctccccctcgactgcgacatcggcgcccgccaccctcctctaccacccgcccgcggtctctctcccagcccgcgttttccaggcgaagtccatggggtggccgacggatccggcgacccatcggaagcaggaggaggtggttggagggagcggcggcgggtcagt

SEQ ID NO: 27858 - DNA, 859 bp, Triticum aestivum
  Clone ID: PAT_TA_27858
taggggccttttttttttttttttttgagaaactgcaaattcatttcagagtttgagctggatacatctgacacctgaacattccagacactaaacaccaccagcgatagtacatagaacctgcctagcagaaccgaagcctaaatcagggaggatgaggcatccttttgtacagacccagagcaccaacgcacacctaaaaccacctataagatcagatcagatcagatcaagcggaggcgaccttgcgggccttcttggcggccggggagcggacggtcttcggcttcgccttggccttcgccgcgggcgacttcttggctttggcgaccagcttcttcttctcgggtgccttgcgcttcgtgccagcggcggcggccttcttgggcttcgcggaggccttcttcttgggcttggcggcgtcctttgcgggcttcgccgcagccttgggggcggcgggcttggccttgggcttgggggagtccttcttggcggcgtcggagagcttgtaggaggccttgaccttgacgagcttgcccttggcggcggaggagcggagctggacggagagcatcttcttgaagttggccgggagggccttgccgtgcttctcctcgatgaacttggcgatggcgaccgagctcgacccggtcctgtccttgagagccgcgatcgcctccttgatcatctcgaagtaggtcgggtgggcggctccagcggcggaggtcttcttcggcttcggcgctgaggcggagggcttggccaaagcagtcatggtggctagtcgaagaaaatatctgaaagggaaactgctacgtgtgcggtgtgctctgctcgcttgcggcttcagaaaagagct

SEQ ID NO: 27859 - DNA, 576 bp, Triticum aestivum
  Clone ID: PAT_TA_27859
accttggatatttaaagttttatataatttaaaagtttcaacttgcaccatttagtttctagtttagactaggtttttagtaacaggaggtaaacacacactgcacaagatttaaatctctacataacatcatcagggttgaagtttgctacagggtacagatatgatattgcctcccagacacatggataaaataaatctctgataatgatcgtcttgttttcagcttgatattaagccatcccaccactagtagccgtcctgataatctgaaacaaggatgatcctatgaccacaaagatgaagaatccaagcacgataggtccaacaggatagtcattccccttcttcacagtagtttcaggcactgagcccctctttgtgacgttcttctgaaacttcgcactcttcctgtcagcaagacgccttgaagtagtcatccttgcttggtgtgaccgccgatgaaccctagagagtatcgatcgcacaggggaaggggaatcggggtaggtgaggagagcagagggagatagacgaagacagggcagaagggaaatccagagttatcttatacat

SEQ ID NO: 27860 - DNA, 513 bp, Triticum aestivum
  Clone ID: PAT_TA_27860
gttttttttttttttttttttttttttttttttttgagacaaacttgcccgtttaacatgtataagattgataactctgtttacagttcttacaacatcagctcaaactaggtacttttaagaagacaaactatgacgacatcaaacagatttagctgcaactgtattaatgtatgacagtgttcaggccatcccaccactgctcgctgtcctgattatctgaaacagagatgatccgatgaccacaaagatgaagaatccaagcactataggtccgacaggatagtcattccccttcttcacagtggtttcaggcaccgaacccctcttggtgatgttcttctggaacttcgatgtcttcctgtcagcaaggcgcctggaagtagtcatcttggcttcgggcggtgtccggtgagctcgacggcgaggaatgggagctggtgcagccggggcatagtttgggctcggtgttgtgatttggccaatttggggcgagccgaggggcttttatac

SEQ ID NO: 27861 - DNA, 1817 bp, Triticum aestivum
  Clone ID: PAT_TA_27861
ccacctccaccccctcccccgcaaccaccaccaccaccgtccaccggaccaccgtcaccggcggcggcgaaggcacgatgagggagatcctgcacatccagggcgggcagtgcgggaaccagatcggggccaagttctgggaggtgatctgcgacgagcacgggatcgacgggacggggcgctacgcgggggactcggacctgcagctggagcggatcaacgtctactacaacgaggccagcgggggccggttcgtgccccgcgccgtgctcatggacctcgagcccggcaccatggactcggtgcgctccggccccttcggccagatcttccgccccgacaacttcgtcttcggccagtccggcgccggcaacaactgggccaagggtcactacaccgagggcgccgagctcatcgactccgtcctcgacgtcgtccgcaaggaggccgagaactgcgactgcctccagggattccaagtttgccattctttgggaggaggcactggatctgggatgggcacccttcttatttctaagattagggaggagtaccctgaccgaatgatgctgaccttctctgtcttcccatcaccaaaggtctcagacaccgtcgttgagccatacaatgctacactttccgttcaccaactcgttgagaacgctgatgagtgtatggtgcttgacaatgaagctctatacgacatatgtttccgcacgctaaagcttgccaccccttcctttggtgacctgaaccatcttatctctgctaccatgagcggtgtcacatgctgcctgaggttccctggacaactcaactccgatcttcgcaagcttgctgtcaatctcatcccattcccccgtctccacttcttcatggttggcttcgcgccgctgacgtcacgtgggtcacaaatgtaccgtgctctcacagtccctgagctgactcagcaaatgtgggatgccaagaacatgatgtgtgccgcagacccccgccacggccgctacctcaccgcctcggcctgcttccgagggaagatgagcaccaaggaggtggacgagcagatgctcaacgtccagaacaagaactcgtcctactttgtggagtggatccccaacaacgtcaagtcgagcgtgtgcgacatgccgcccagggggctgaagatggcgggcaccttcgtcggcaactccacgtccatccaggagatgttccgcagggtgagcgagcagttcacggccatgttcaggaggaaggccttcttgcactggtacacgggtgagggcatggacgagatggagttcaccgaggccgagagcaacatgaacgacctcgtcgccgagtaccagcagtaccaggacgcgaccgccgacgaggagtacgacgaggaggaggaagaggaacgcgacgcggagtagcggcgccggatgtgccctgctccccaacccagctatatgtcccccggttcaggtctgtcgccatgtccaggtcgcgtttcctccggtgagggtttctgtggtttcctcgtgtggcttggacgagtcgaggttgcgtcgtcttgtgctccgttttgtaatttgctacggctagtagtgcgttgggagtctgtcttgttccgcgtccatcctttggtcggtcggtcggtccatagctgacggcggcctcaactgtcgagtgctctccttttgagctggtcgtcgtcgtcgcctttgtaagttctgacaagtattattgttagtcgttcgcttcatcagcaaccaaaaaatcagtattggtagtggtttctcattatctttgtgaatattgtacttatgtcggaa

SEQ ID NO: 27862 - DNA, 1418 bp, Triticum aestivum
  Clone ID: PAT_TA_27862
gcggtcattcatcgctgatcaccaagcacagccgcgcatccaccgttgctagcaaggtcgaccaagcagcaccgagatggctgctgccttctcctccaccgtcggtgccccggcttctacgccgaccaacttcctcgggaagaagctcaagaagcaagtgacctcggccgtgaactaccatggcaagagctccaaggccaacaggttcacaagtcatggcaagcggaaaacatcgacgaagaagaggaacacagacaagtggaagggtcttgcctaacgatatctccgacgaccgtatcggtgtctgcaagggtatcttccagaccgacaatgtcagcgacgagtccgtcgtcaagatcgtcgacaccttcccaggacaatccatcgactttttcggtgctctgcgtgctcgggtgtacgacgacgaggtgcgcaagtgggtgacctctaccggtatcgagaacattggcaagaagcttgtgaactcgcgggacggaccagtgacctttgagcagccaaagatgacagtcgagaagctgctagagtacgggcacatgctcgtccaggagcaggacaatgtcaagcgtgtgcagcttgctgacacctacatgagccaggcagctctgggtgatgctaaccaggatgcgatgaagactggtaccttctacggttagaacattctccatacacacccaccatctcttgctgcataggaggaggtgaactacgcacaatccttttatactttcagcacctactttacatacttacttacttctcacttgcttacttctgaaacaaaagagtgaatcataaacaaacagtggaggcctattcttcttacctgttcttctggcatatcaagctcatctttctcatcagatcgtccaaaacaattaaattgcaggtaaaggggcacagcaaggtactttgcctgtaccggcaggatgcaccgaccagactgccaagaacttcgacccaacggcgaggagtgacgacggcagctgcctttacaccttttaagcatgccaatttaatatctgatgttttatcctttgacacaggcttctaaagccactcgattagctgctgcaccaggtgcatttccccaaggatgtcctaaagttcctcaccaagaaaaacagatcggcattacagtgcagttccaaaaattgaagaccagaggtgctgcacaaagcataggcaactgctctatcggatgaatagctcattttgggaagtacatcggttcgccagacaaggctgcatgaggcagagcagtaggggctgtgccatattgtgccatctgctgtgaagcttggtacaacatcggaggagcaccagagcttgatccgactgctggaaagtgcgggcctgggtttgccatcaataattgacctgcccgggcggccgctcga

SEQ ID NO: 27863 - DNA, 1193 bp, Triticum aestivum
  Clone ID: PAT_TA_27863
catgacatgcaggcccaaatgggaaaatatttaacttcaagggcttatttgggttggaaatcatgacaatacccacgatttctgtacaaactgttccacagaaacttatttctaccatcaaatacaccgtatcaccctttcagggtcaaatgccaagcgcagagctaacgaactgaaacaagcatctacgtgtacacagtttccttcgccacaccggtataattttagtccaaaacattgcagggatcttccttacaagttcgtctttggcttggatggcgggctcacgcgcctggtcaaggtccgcatcgtcacgaactcttctgctgcagaagggtggatcccgacggtgctgtcgaaggtcgctttggtagctccagccttgagcgcaacagcaatgccctgcataatttcagctgcatctggtccacacatggctgcaccgagtaccttatcggtatcagcatcaaccaccagtttcatggtagacttctccacgcgtttggatatgctgttcttcattgggttgaaacttgatgtgtaaacaagaagatcattcttggcttccgccaaagcctcttgttcgctgagtccgacgacagatagcggtggaatgcagaaaacagcacaaggtacatctttataatcaggcttaactgtctggccaccaaacacagttttagcgaagcaagtagcctcccatcaggagcaacaggtgttaggttaatccggtttgttacatcacccacagcccatatacttggaacttgatgtacggggagtattcatcaaccttgatggctcctatttgatcaacctcaacaccaacagcttccaggttcagcctattggagttcggcgcacgacctgtagcaaaaagaacaacatctgcaatgagctcatcccccttatctgtcacaactttaatgccatcggctgttttactcaactcggtcaaatttgtccctggatgcaatttgattccccttccctcaaggttgcttgcaacaacagttctcatctcatcatcaaaacctcttagaggaagctcccttcgataaaacaaatctacttcagcacccatccctctccagatagaagcaaattcaacagcaatatatccgccaccgaggattacagcacgctttggaagctcctccaagctcaaggcctcatctgagtaatagccagct

SEQ ID NO: 27864 - DNA, 684 bp, Triticum aestivum
  Clone ID: PAT_TA_27864
ttttttttttccaaatgatccattccattaccatatagtattttataatttaaggaaactgagtacaagcatccagcaaatcttacgaataccaagtacatgccgcccttatcgctagcccgaaagcttacactcgaatctggtgggcatgtcaagatcaaaggatgattcaaccttgtgaagcaagaaaatagcaaaacatcacatccgtccagcagttttgaagatcgagacacagagcgacaacataggaaagattcaaatactacaatactgcaaagctagttcatattagagcaagagacgatattgcttcctagtagcgcatcttcattcttcttcctgaatctcagccaaggtcttgagtgtcatgcgcacatgaccatcgactggactctgcctgagaatcttgaagacattcagagccgtagcatcaacatccttgacacgaagtttggggaatttcctggcagccttgagatgcccaggatcaatgtcggggaattccttggcagccttgagctcgtaaatgcccgctgatctcccgagcgcacggtcgcaaaatctcctcaccgctagccggagcgccgccatcgtcctcgccctcgctctcgccgactcgatccgcttcctcttcctcttcctcgctggttggggagaaaaaatcccacgcgtccgcggacg

SEQ ID NO: 27865 - DNA, 2150 bp, Triticum aestivum
  unsure (1)..(2150): unsure at all n locations
  Clone ID: PAT_TA_27865
acataatctctgggaacacaagcgtctggcagtgcagttcaacagcagcaacaacaacaaaaaacctccacactgccagcgcaacatactgcgaagaacagagagcacaataggcgcacacctgggacattcagaaaatacaggaccaactatctttattagtcgccggttggctccatgatggctggaccgagccatcaggtagcaagggtggtggggaagcaactgtcgtgcacgcagccgagcacgtcgcggtagtccctgtggatggtgaagttgtcatacaccttgccatcactgctcctcttgtactcaaacagaagcgaggagtggttgaaggccgtgagcttggtgaagccgtagtctctatccctgaacacgctccacttggggacggcgctggtgtagccgttgaggtggctgccgccgccgcccgccaccacgaagatggtcccgttcatggtgcccgagtagcggctccgctcgccggtgacgcactggttctggtagagcgggcaggtgcgctcgtagttgtgcacgtggccgaagatggcaaggtcgacgcggtgccgctgccacagcttctgcaggctctcccgcccctcgggctcctcgaaggagccctgctcagcgtaccacttgttggaggagtatccgagcacacggtgcgccgtgaagatgagccatggctggtgcttccggtccaccgtggagaggcactcctcaatgaacttgtgctgcggcgtcccctcccgccagtcgtgctccgagtccgccacgcagaaccggaacatcccgtagtccaccttgtaccagaagtttgctcggttctcggccgggtagtagtacatggtctcggcgagcacgccgcactcgccgccggagtcctcgacgtcgaagaagccgccggtgtcgggccagtcccgctcgtggttgccgctggcgatcatgtagggcttccgggcgctgatgggggcgacctgcgcggtgaactggtcccactgcgagatgtagccgttggcgtagggcaggtcgccgatgtggaagaccatgtcgaagttgtccaggtctctaaccagcgcgtccgtcgtgttgagcgaccccggctggtagttggcgtactcgttcgacccgtccctctccgccttccccatgtcgccgaagacgatgacgcgctgcagcgagctctgccccggcgtcggcggcgcccggaaggtgtagggcttgccccacaccaccgtcccgtcggggagctcgtgcccgatcttgtagaagtactccttgttgggccacaggccccgcatgaacgccgtgtggatgaacccggggtccctccacccgatcgtccgcgccggcgcgccgcacatgctgccgcggttgaaggttagcgtcccggcgggggtgcgggcggggttcccggcgccggagccggtggtgaccatgccccactccacgaacgggtaggcctcgccgacgtcgtagccgctggtccaggtcacggccatctcgtcgtgggtcttgccctgcgccagccgcgggaacaccggcgccttggggttcttgaacggcgacagcttcgtcaaccccacaagctttgggttttccaggccgccggtgaagagagcgaaggagaagtcggagcgctggttgatgagctggaactggatggtgcccttgccccagtagaggtagttcgccgagaagttggcgtactgatacttgataggcgctgtgcagagcagcggctcggtggggtacctccgtgggttagggcacgagcccgagatgaaatcggagggggagaagacggcgatccagtcgtcggtggcggggttttgccagccgtattccacagtgaccgttgcagtgtctccttcctgctggtcgccgtcgccgagcagcagcgcactcgcgcgcacgtacgcggagccgtgcagctcgacggtggccttgtggatggcgatcttagacagtggctggacccccgcctccggcgaggcgctcaccgtcgtcgccatggccagcaccgccgccaggacgacgacgtgcgccatccccatgcttctgcttcagctgtcactcctacagctaggctgccactgcgcgtgctnccaggggtggtgaccgtgcctcgtgccgaattncctgca

SEQ ID NO: 27866 - DNA, 1699 bp, Triticum aestivum
  Clone ID: PAT_TA_27866
ggttcacactgtgtcgctgtcgcccattactgctccgtcgtcgttcacagcgacgccaacgctgcacccagaccccgcgagatccagagcccagcactagcaggtcggggaggaagaaggtccaggacccgcgaggcagggaggcgatggcgggcagcggaggcggcgcgtaccgggcggaggacgactacgactacctcttcaaggcggtgatcatcggcgactccggcgtcggcaagtccaacctgctctcgcgcttcaccaagaacgagttctgcctcgaatccaagtccaccatcggggtcgagttcgccacccgcagcctccaggtcgacggcaaggtcgtcaaggcccagatttgggacacagccggtcaggagagataccgtgctatcacaagtgcctattatagaggagcagtaggcgcgttgcttgtgtatgatgtcactcgccgtgctacattcgacaatgtggcgcgctggctaaaagagctgagagatcacactgattctagcattgttgtcatgttagttggcaacaaatctgatcttcgccacttggtggctgtttcaactgaagatgggcaggaatatgctgaggcggagtcactgtacttcatggaaacatctgcattagacgcgacaaatgtagacaacgctttctcggaagttttgactcagatataccgaattgcgagcaggaagacggttgatgcaggagacgacggctcatctgccccgagcaaaggggagaacataaatgtgaaagacgacgtgtcttcgctgaagaaagctggctgctgctcgagttagggtatagatgcattattatttgctgcgttttctactagttggtgtatcttgtattgcaacaaaacagatttgttgattctctcattttgctgcggttatggtgatggttaggttggttcagctttcacctgaaacagttatgtcagattgataatgatattctgcgagtactttgtttgcaaaaaaaaaaaaaaaaacttcgagtaaaacaatagtgttagaccgtcagtaccaagcactgcccagataagagaaggattcacaagctgctacaaacaaagaataaatcaaatacaactaaacgactcgattttatcataaggccacgccggcctctatgcatcaagacacatgtataaattatgcagaggaaagctacctcgatttcaaccggcgaacgatgaccgtcagcataccacctgcattttaagtatatcacacaatgttcaaccaaacagcattgccatgatgatccatgccggctcgcctactcggcggtgttgggcctactcaagcagtcgaggatctccgtcctggtgcgcacgatgcggtggaacatctcgcgcacctgccgctcgagcgggtcgagcccttccttgagtgcctcgcacacctgcaccagctcctgcgcggcctcccgcacctcggcgtccttctccttgtccagggggaattgtgcggcgtcggtgatctccatgagctgccgcgaccaacgctcgatgaggtgtatctccttgagcagcccgcacgagtgcttgcggtccttcttcttggactcctcgaggacgcgctcgtagagcgtggtgaccgggccggcccaggggaagctcctgggcacggcgaagtgcgcctggaggccgcggtcctggcaggggaggcggcgacga

SEQ ID NO: 27867 - DNA, 1388 bp, Triticum aestivum
  Clone ID: PAT_TA_27867
ggaagacagcagagacggctgtgccctgctccaccttctcgccggtgccttctgctcgaggcaaacgaaacccatcctcctcctcctgcccctctctcccacgcttcccccttcgtctccgtcgaggagaggcgaggcgaggcgaggcggcgacgatgcaggtgaagcagaaggtctacgagctctacaaggggacggtggagcgggtcacgggcccgcgcactgtctcggcgttcctcgagaagggcgtcctctccgtccccgagttcatcctcgccggcgacaacctcgtatccaagtgccccacctggtcctgggaggcgggcgatccgagcaagagaaagccatacctcccctccgataagcagttcctcgtcaccaggaacgtgccctgcctaaagacgagctgtggcggtcgaggaagagtatgatgcagcgggagctgaggttgttctcgatgatgatgaggatggcgaaggctggctcgcaacacatgggctgcaagcatcagagtcaaaagaggaggaagacataccgtctatggatacattggacatagggaaagttgaagagatcaaatctatcccctcctactttggtgctggtgaaaagccagatgacgaggaggatatacctgatatggacacctatgaagacacaggagatcattccacagctacccctcagccttcatattttgtcgcagaagagcctgatgatgacaacattcttctcaccagaacatatgatgtcagcatcacatatgacaagtactaccaaactccacgtgtctggcttacaggctatgatgaggcaagaatgccattaaagcctgaacttgtgtttcaagatatcagtcaagaccatgcacacaaaacggtgactatcgaagaccaccctcacttgttagtgggacagcacgcttcagtgcatccttgcaagcacgctgctgtgatgaaaaagatcattgatgttatagtgtctcaaggaggtgcaccagaagttgacaagtaccttttcatatttctgaaattcatggcttctgtcatacccaccattgagtatgattacactatggacttcgatctgggcagtacaagcacataagtcgcccattgaagaaaagctgaaacttccaagaaggcaggctggtcattgtcgccgaataattgctgctcttcggaaggatctgtacattgtgtccgtgtgtgttggttcgtctggaaatgaactttcaattgtaaactctgatgctctgcaggaagattgtgccgatttgtcctcttacggtgcagcgccgcactgatgacatttgtgattcttcgccaacaaatctgaattttgttgaaaactgaagatgtaaatcctgcactgacaaaaaaaaaaaa

SEQ ID NO: 27868 - DNA, 1859 bp, Triticum aestivum
  Clone ID: PAT_TA_27868
aaaccaactacctcctcctacgctccggtgagtcagcactgagctcggctctctcctccgtcagctgctctccggcggccgcgttttcctaccggcagagggttaattatttcgggcgtcctgagatcgcagatggccgcagcggtggtcgacgcagcggtgccggtggcggcgaaggcgaacggcgccggggcgaggtgctgcgcggcgaaggggcccgggtacgccacgcccagggaggccatggagaagggcccgcgggaggggctcctctacgtcacctgcgtctacaatggtactggaatcgacaagccggattacctggccacggtggacgtcgacccaaattcagcgacctactcccaggtgatccacaggctccaggcgacccacatcggcgacgagctgcatcactctggctggaacgcctgcagctcctgccacggcgatccatccacgagccggcgcttcttgattcttccttcgttgctgtctggccgtttgtatgtggtcgacactgcgaagaatccgagggcgcctgctctgcacaaggttgtccaggctgaggacattgctgagaagaccgggcttgggttccctcacacatcccattgccttgcaaccggtgacataatgatttcttgtctgggagacaaggagggaaatgctgctggcaatggctttctcttgctggattcagaatttaacgtcaaaggacgttgggaaaagccaggtcacagccccttgtttggctatgatttctggtaccagcctcgtcacaagacgatgatcagctcttcatggggagccccggcagctttcaggacaggttttgatctccaagcatgtccaggatggtctctatggaaggcacctgcatgtgtatgactggcctgggtgggtgagctcaagcagacactggatctaagggagcacaggtcttcttccgctggaggtgaggtttttacatgatccatcaaaggacactggctatgttggctgtgctttaacaagcaacatggtgagattcttcaaaactgcagatggatcatggagccatgagggttagctatatccataaaaccgttgaaggtgcgcaactggatactgccagaaatgccaggattgataactgactttgtcatctctctcgatgaccgttatctctacttggtcaattggcttcatggggatatcaggcagtacaacattgaggaccctgcaaagcctgtgttggctggacaagtgtttgtaggtgggcttcttcaaaagggcagtgatgttgtctatgtgaccgacgatgacaaagaagagcagtatgctgtgcctgaagtcaaggggcatcggcttagaggtgggccgcagatgattcagctgagcttggatggcaagagggtgtatgtgaccaactctctcttcagccggtgggacgagcagttttacggccctgaccttctcaagaagggatctcacatgttgcagatcgacgtcgacactgaggaaggagggctggctgtcaaccccaacttctttgttgatttcgggaccgagcctgaaggtccctccttggcccatgagatgagatatcctggtggagactgcacctctgacatatggatctaggaggaagggtgtaggacacaggcagctggagatccatggtgttgagctcactgtaattaaaatggtctcttccccgcctgcggtgttgtatgtgatgtggtatcaattggaataagttcctgatagaacctctgacattggcttcatgggagctttgggccctaataagagttgcctctgattctgaaatttccaaaaaaaaaaaaaaaaaaaaaaaaaaaaaaacggacgcgtgg

SEQ ID NO: 27869 - DNA, 1851 bp, Triticum aestivum
  Clone ID: PAT_TA_27869
gtatggcatacaccaccctggtatagtcaacttaattgttggtgccttgtaccaagaaattatcaagcgcagaaagaacatcaggttttggattgaactgacacggctcgagtaattttccattttgctgtgcagtttacaggcaccaacagccagacaggtacatttgccacaggggtctcacaagtaccaagaaaaacagatcggcattacagtgcagttccaaaaattgaagaccagaggggctgcacaaagcataggcaactgctctatcggatgaatagctcattttgggaagtacatcggttcgccagacaaggctgcatgaggcagagcagtaggggctgtgccatattgtgccatctgctgcgaagcttggtacaacatcggaggagcaccagagcttgatccgactgctggaaagtgcgggcctgggtttgccatcaataattgggtagggtacgaggttgatgcaggtgcaaacgcccctcgctgcatgttaggattccaggctggcacttgtccgatagaggccgctcttgctgagcttccataaaaagcagcaggggtggtgctttgccatgctgctccaggagtgcttagaccaggggcttgacctgcagcttgtacctgagcactaggatccgagacggtgtagtctctgcttctctcgtcatgtgccttcacattcagatcagtatgacgagagtatgacagatgaagcttacagtaaccaccatcatatatgcaatgtccctccagagcttgtttagcaactcctgctgttgttatatctggatactgaattagagcctgcattccaccattcttctcgaacattgcaatctttcggacagcaccaaaagaagagaacacagtgtgtagaacatccactcccacagcatactgcatgttctcgattgatgctaaaagtacattgctctctggctccttaatcttcccatcagagcctaacatgggctgtgcgattccctcgattgcagttggattaacaggaagataaggatttgtgtaatccctgctgcgatgtgattgaaatttaatattcaaatctttgtgcgcagaaaatgtaatgcgcaggtgacaaatgctgacgtgttgagccagtagatacctcggtatgcttcttccgtctaacgaattttttgcctctagagcagttggagcatcagtatattggataagtgcctggaaaccagcggctttctcaaacgttgctatcttgtgaacaaacccaaaagcagaaaataccaaatggataacatctatgctaacatcattaggctggacaccttcaaaggtgacaagcaggacattgccagaagaatcaccagtgcctttattgtttgttatttcttgcctatttgaatactggatatacacagttttaccacgaacttgggcaggttctgaagatgaagcataatatgaaaccattgaaattgcctggttttgatctgcgaactccacgaaggcctggttgcggttggctccgacgttgcacatggtgttcacaaccctgccgaatggtttgcagagctcgacgagctcctcctcagtgctctcccacggcatgttccgtaggtgcagcaccttggacggcgtctgtgtgtaccggaactgcgtagacccggacggcatcctcggtcgcccgccacggcggccgcgcgcgcgctgggtgagataaattggatgaggagggttagggttagggtttggtaaattgggatgagaaggggagtcgactcggggctacggcttgagaggacagattaggacggctggggcgatgggtggttcgagagagggacgagccggctggtgccgaat

SEQ ID NO: 27870 - DNA, 711 bp, Triticum aestivum
  Clone ID: PAT_TA_27870
gctcccattcgctcgtctcctccaaccctaagcgatgacgaagggtaccggcagtttcggcaagcgccggaacaagacccacacgctctgcatccgctgcggccgccgcagcttccacctccagaagagcacctgctcctcgtgcggctaccccgccgcccgcatccgcaagtacaactggagtgtgaaagccatcaggcgcaagaccaccggcactggaaggatgaggtacatgcgccacgtgcctcgcaggttcaaagagcaacttcaagagaaggtaccggagggctgccgcccaaggaacagggccgcggccaactaggtctgggattttgccccagcaggaatcccgtgaagctagaatttaaagacttttgcttggggttgtaccccacctaaactattgttgctatagcaattgagtatggatctgatatgttttgttgcatgggtttggaaattgaccgctgaatcgaagaccaaatttgtctgaatgttacaagtacgtgatcagttctctttctccttttttttctcttgtgtcatcggctctccaatcttcctgttgtgaagtttggctgaaaaacttcaaaatttgagcatctgcattgactaatatgtcaacataatatttcaaatgatgttgacgcacataattgagcatcattttgaaaccataatttataaagtttgatttgaaaaaaaaagggg

SEQ ID NO: 27871 - DNA, 1211 bp, Triticum aestivum
  Clone ID: PAT_TA_27871
attctgcgtatatttatttctagagaatatgctatgacagcccggctttttattgaagcgacataatcactgggaacaccagcgtcacacagtgttgttcaactacagcaacagtaacagaaaacctccacactctagcgcaacagactgcgaagaacagagaccacaacatgcgcacaccatgaaaatacaagaaaatacagggccaactccctttattagccgctggttggctggctggctccatggcggctcgacggtcaggtagcgagggtggtggggaagcaactgtcgtgcacgcagccgagcacgtcgcggtagtccatgtggatggtgaagttgtcatacacctcgccatcactgctcctcttgtactcgaagagaagcgaggagtggttgaaggccgtgagcttggtgaagccgtagtcccggtccctgaacacgctccacttggggacggcgctggtgtagccgttgaggtggctgccgccgccgcccgccaccacgaagatggtcccgttcatggtgcccgagtagcggctccgctcgttgctcacgcactggttctggtagagcgggcaggtgcgctcgtagttgtgcacgtggccgaagatggccaggtcgacgcggtgccgctgccacagcttctgcaggctctcccgccccctcgggctcctcgaaggagccctgctcggcgtaccacttgttggaggagtatcccagcacccggtgcgccgcgaagacgagccacggctggtgcttccggtccaccgtggagaggcactcctcgatgaacttgtactgtggtgtcccttcccgccagtcgtgctccgagtccgccacgcagaaccggaacatcccgtagtccaccttgtaccagaagttcgctctgttttcggccgggtagtagtacatggtctcggcgagcacgccgcactcgccgccggagtcctcgacgtcgaagaacccgccggtgttgggccagtcccgctcgtggttgccgctggcgatcatgtagggcttcctggcgctgatgggggcgacctgcgcggtgaactggtcccactgcgagatgtagccgttggcgtagggcaggtcgccgatgtggaagaccatgtcgaagttgtccaggtccttcaccagcgcgtccgtcgtgttgagcgaccccggctggtagttggcgtactcgttcgacccgcctcgtgccgaat

SEQ ID NO: 27872 - DNA, 1395 bp, Triticum aestivum
  unsure (1)..(1395): unsure at all n locations
  Clone ID: PAT_TA_27872
tgtactactagaaaacagcagagacggctgtgccctgctcctccttctcgccggtgccttctgctggaggcaaacgaaactcctcctcctcctcctgcccctctctcccacgcttcccccttcgtctccgtcgacaggaagcaaccaggagaggcgaggcggcgacgatgcagatgaagcagaaggtctacgagctctacaaggggacggtggagcgggtcacgggcccgcgcaccgtctcggcgttcctcgagaagggcgtcctctccgtccccgagttcatcctcgccggcgacaacctcgtatccaagtgcccaacctggtcctgggaggcgggcgatccgagcaagaggaagccatacctcccctccgataagcagttcctcgtcaccaggaacgtgccctgcctaagacgagctgtggcggtcgaggaagagtatgatgcagcgggagctgaggttgttctcgatgatgatgaggatggcgaaggctggctcgcaacacatgggctgcaagcatcagagtcaaaagaggaggaagacataccgtctatggatacattggacatagggaaagtcgaagagatcaaatctatcccctcctactttggtgctagtgaaaagccagatgaggaggaggacatacctgacatggacacctatgaagacacaggagatcattctacagctacccctcagccttcatattttgtcgcagaagagcctgatgatgacaacattcttctcaccagaacatatgatgttagcatcacatatgacaagtactaccaaactccacgtgtctggcttacaggctatgatgaggcaagaatgccattaaagcctgaacttgtgtttcaagatatcagtcaagaccatgcacacaaaacggtgactatcgaagaccatcctcacttgttagtgggacagcacgcttccgtgcatccttgcaagcacgctgccgtgatgaaaaaaatcattgatgttatagtgtctcaaggaggtgcaccagaagttgacaagtaccttttcatatttctcaaattcatggcttctgtcatacccaccattgagtatgattacactatggatttcgatctgggcagtacaagcacataagccgcccattgaagaaaagctgaaactcccgagaaggtgagctgttcattgtcgccgaataattgctgctcttcggaaggatctgtacattgtgtccgtgtgtgttggttcgtttggaaatgaactttcaattgtaaactctgatgctctgcaggaagattgtcctgattggtcctcttactgtgtggcgccgcactgatatgacatttgtnattcttcgccgacaaatctgaattatcttgaatcttaaaatcgaaggatagataaaaattcccac

SEQ ID NO: 27873 - DNA, 898 bp, Triticum aestivum
  unsure (1)..(898): unsure at all n locations
  Clone ID: PAT_TA_27873
ccaccctctgaacatcgccgtgcccccccatgtgcagctcccaggcatgtacaacaaggaggagaacccacgtgtgcccatcgtcgtcactggtaacgatttctcgacgttgtacgcccctctgatccgtgatggtcgtatggagaagttctactgggctcccacccgcgacgaccgtatcggtgtctgcaagggtatcttccagaccgacaatgtcagcgacgagtccgtcgtcaagatcgtcgacaccttcccaggacaatccatcgactttttcggtgctctgcgtgctcgggtgtacgacgacgaggtgcgcaagtgggtgacctctaccggtatcgagaacattggcaagaagctggtgaactcgcgggacggaccagtgacctttgagcagccaaagatgacagtggagaagctgctagagtacgggcacatgctcgtccaggagcaggacaatgtcaagcgtgtgcagcttgctgacacctacatgagccaggcagctctgggtgatgctaaccaggatgcgatgaagactggtaccttctacggtaaaggggcacagcaaggtactttgcctgtaccggcaggatgcaccgaccagactgccaagaacttcgacccaacggcgaggagtgacgacggcagctgcctttacaccttttaagcatgccaatttaatatctgatgttttatcctttgtacctaagtaccgcatcgcatccaagcgattgctgggcatgttttgttaatatataaagatattgagtatacctatttggtaaagacaaataggactacttatcatttgtcactctcagtattcattccttcagtggagactgcttctgctttgttgcaaacagaacaaaaaaatattaatttnagcttcagctta

SEQ ID NO: 27874 - DNA, 754 bp, Triticum aestivum
  Clone ID: PAT_TA_27874
gagctcctctcctcttccctcggcggcggcgcaggcggcgcggaggcgacaggcgaagggcgaaatgacgaagggaacgggcagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccatgtgcccaggaggttcaagagcaacttcagagagggaactgaggccgcaccaaggagcaagggagcctcttccagcgggcaactaggcgcggcggccttaacttgttacgctaagcgggagccctgatcatcaaacttagcttttttgttgctttctactggaaccctgatcatcaaacttagcttttttgttgctttctactggaactctatgtttctatgtcgagaggcagacgatatggtgcctggttatgttatttgcacaattgtcgtggacattaatccttcagttttgaaaaaaaaaagctaagtttgatgatcagggcttcgcttagggcaacaaatggagactgtcacacctagttgccgctggaagaggctcccttgctccttggtgcggcctcagttccctctctgaagttgctcttgaacctcctgggcacgtggcgcatgtacctcatcctcccggtgccggtggtctccc

SEQ ID NO: 27875 - DNA, 1439 bp, Triticum aestivum
  Clone ID: PAT_TA_27875
aaaggtgcaaatgcttcagcaagatactcttcatagtcagaatagagttgcaaatactttcggcagggtatagtcatactggcttcacagatggcctccacgtattgagaaagagggccaaataatgtgctcgtagatgagaagcagccgagttaattttatacaagactatgttacagtgggggacggtgaccacttggaccaatcaacacggctatgatttctagtagtacactaacacacaatacccaatcactacaacgcttgttgcagttagcgcccagttagcctgaccatccacgcaccacccaagtacagaccaagcagtggacccgccaaaagcatctgagtcaagggatcagtcgagggcgtaagcacagccgcagcaaccaccgcaccaacaacaacatacctccagattgagagcatttgttcgctggaaaccagtccaacttgcccccagcaacagctggatcacagggacctgaaaagataatcctgtgctgaacagaagcacaagtacgaactcaaagtactggtctattgaccatatcgattccaccgctccttcggcataattcacgaagaagttcaatgctgctggagcaagaacagtgtaggagaataaaatgccaaggtagaacagaactgaagaacccaaaacaatgggccctaggaatttccgctcatccttggttaaaccagggagaacaaatgctatgatctcgtacaaaattataggacttccgattaggaggccacaataaccagagaccttcaatgttgtaaagaaaaattctccaggggagagctgcaaaaatctgacaccctgaacactaacaggcgcttcaagaatcttaattatatctttggagaaagcaaaacaaccaattattgaagctccaacagccaatactgatataaatatcctcgcacgaagttcctctagatgatcaaatatactcatttccttatcatctggaagtagctctttgcttggataaagaaaattatatagactactctgatcttcttcctgtgtgacaccttcaaaagaaccattttcgacacgtcctggaagtggatcttggagggtggcgccgaggctgctcgatggagactcttctctttgagacgctggcaaattcgtgtcctgtctgctgctcccctcaacggcggaacagcgaaggtgccggcggcggcagtggaggggctcgggcatgcatgaggagagatggggaagagagatgtggtggcgacggaggaggatgctgccgagttgcggtggggggtgggagagcagcgctcctgcgcttcccatcgtctctcgcgggagctcgataggtgataaaccgataattttctgctcgcttccgccagttccgtgtgggtgttgcttccctcgcatcttctcctccctggctcctcggattgcatgt

SEQ ID NO: 27876 - DNA, 1859 bp, Triticum aestivum
  Clone ID: PAT_TA_27876
gaatcccccaggaaagccagcgaccccccctccttccttccccgcaaccaccgtccaccgggcccccggcgcccggcaccggggaagcggcggcggctaatatgagggagatcctgcacatccagggcgggcagtgcgggaaccagatcggggccaagttctgggaggtgatctgcgacgagcacgggatcgacgggacggggcggtacgcgggggactcggacctgcagctggagcggatcaacgtctactacaacgaggcgagcgggggacggttcgtgccccgcgccgtgctcatggacctcgagcccggcaccatggactcggtgcgctccggccccttcggccagatcttccgccccgacaacttcgtcttcggccagtccggcgccggcaacaactgggccaagggccactacaccgagggcgccgagctcatcgactccgtcctcgacgtcgtccgcaaggaggccgagaactgcgactgcctccagggattccaagtttgccattctttgggtggaggcactggatctgggatgggaacccttcttatttctaagattagggaggagtaccctgaccgaatgatgctgaccttctctgtcttcccgtcaccaaaggtctcagacaccgttgttgagccatacaatgctacactttccgttcaccaactcgttgagaacgctgatgagtgtatggtgcttgacaatgaagctttatacgacatatgcttccgcacgctaaagcttgccaccccttcctttggtgacctgaaccatcttatctctgctaccatgagcggtgtcacatgctgcctgaggttccctggacaactcaactctgatctccgcaagcttgctgttaatctcattccattcccacgtctccacttcttcatggttggcttcgcaccgctgacgtcgcgtgggtcacaaatgtaccgtgctctcaccgttcctgagctgactcagcaaatgtgggatgccaagaacatgatgtgcgccgcagacccccgccatggccgctacctcaccgcctccgcctgcttccgagggaagatgagcaccaaggaggtggacgagcagatgctcaacgtccagaacaagaactcgtcgtacttcgttgagtggatccccaacaacgtcaagtcaagcgtgtgcgacatgccgcccaggggcctgaagatggcgggcacctttgtcggcaactccacgtccatccaggagatgttccgcagggtgagcgagcagttcacggccatgttcaggaggaaggccttcttgcactggtacacgggcgagggcatggacgagatggagttcaccgaggccgagagcaacatgaacgacctcgtcgcagagtaccagcagtaccaggacgcgaccgctgaggaggagtacgacgacgaggaggaagaggagcgtgacgcgtagtagtggcgatcgcgctccgccagctatatgtcccccgcttcaggtctgtcgctgtgtccagtgagagtttgtggtttcctcctgtggcttggatgagtcgaggttgcgtcttgtactccgttttgtaatttgctacggctagtagtgcgttgcagtgtgtcttgttccgcatccatcctttggtcggtcggtcggtccatagctgacggtggcctgaactgtcgagtgctctccctgagctggtcgtcgtcgccttgtaagttctgacaattattattgttagtcgttcgcttcagcaaccaaaaaatgagtattggtagtggtttctcattatctttgtgaatattgtactccatgtcggaatgttttgcctcgttatttgtgatattatcgtttgcttgctcaaaaaaaaaaaaaaaaaaa

SEQ ID NO: 27877 - DNA, 659 bp, Triticum aestivum
  Clone ID: PAT_TA_27877
gggcggcggattagggtttcacttgcatccattctcaacgttagcaggagcgagtgggagtccggccatggcgccgtcgcagcccaagtcagggctcttcgtgggcatcaacaagggccacgtcgtcaccaagcgcgagctgccgcctcgcccgtccgaccgcaaggggaaaggtacaaagagggtgcattttgtcaggaacttgatcagggaggttgctggatttgctccctatgagaagcgtatcactgagcttcttaaggttggaaaggacaagcgtgcactcaaggtcgccaagagaaagcttggtactcacaagagagcaaagaagaagagagaggagatgtcaagtgtccttaggaagatgaggtctgctggtggtggtgctggtgacaagaagaaatagaacttggctagctggtgaattttatccggaagcaaagtcctgtattaccagtccgtacctatagagctatggccattgtgttgacactatctttagcccgtggtttctattttgagaagaccaatctttttaagatttttatacatgagtctggtgcctttgtttgattacttggtactctgctgtttattcagttatgtagcttgtctgggttttgtacctgcgattgttatatgttttcagaaaaaaaaaa

SEQ ID NO: 27878 - DNA, 907 bp, Triticum aestivum
  Clone ID: PAT_TA_27878
ttttttttttttttttttttctttccaatgatccattccattaccatatagtattttataatttaaggaaactgagtacaagcatccagcaaatcttacgaataccaagtacatgccgcccctattgctagccccaaagcttacactcgaatctggtgggcatgtcaagatcaaaggacgattcaaccttgcgaagcaagaaaatagcaaaacatcacatccgtccagcagttttgaagatcgagacacagagcgacaacataggaaagattcaaatactacaatactgcaaagctagttcatattagagcaagagacgatattgcttcctagtagcgccatcttcattcttcttcttcctgaatctcagccaaggtcctcagagtcatgcgcacttcacgaagggttacatctttatgaccatcgactggactgccccggagaatcttgaagacattcagagccgtagcatcggcatccttgacacgaagtttggggaatttcctggcagccttgagatgcccaggatcaatgtcggggaattccttggcagccttgagctcgtaaatgcccgctgatctcccgagcgcacggtcgcaaaacctcctcaacgctagccggagcgccgccatcgtcctcgccctcgctctcgccgactcgatccgcttcctcttcctcttccttgctggttggggagaaaaaaaaacctcggccgcccgggcaggtaccacttgttggaggagtatccgagcacacggtgcgccgtgaagatgagccatggctggtgcttccggtccaccgtggagaggcactcctcaatgaacttgtgctgcggcgtcccctcccgccagtcgtgctccgagtccgccacgcagaaccggaacatcccgtagtccaccttgtacct

SEQ ID NO: 27879 - DNA, 625 bp, Triticum aestivum
  Clone ID: PAT_TA_27879
ttttttttttaaaacaaattattaccttggatatttgaagttttatataattttaaagtttcaacttgcaccatttagtttcaagtttagactaggttcttggtaacaggaggtaaacacgactgcacaagatttaaatctctacataacatcatcagggtcgaagtttgctacagggtacagatatgatattgcctcccaaacacatggataataaatctctgataatgatagtcttgtttttagctcgatattaagccatcccaccactagtagccgtcctgataatctgaaacaaggatgatcctatgacgacaaagatgaagaatccaagcacgatgggtccaacaggatagtcattccccttcttcacagtagtttcaggcactgagcccctctttgtaatgttcttctgaaacttcgcactcttcctgtcagcaagacgccttgaagtagtcatccttgcttggcggggcaggggagctcgccggagacgatgtaggcagcggacggcgtccgcgggatcggagcaggtgccggaggaggagtgggagatgccggatgcgggatcaggggcgaaagacggggggtttgtaaaaatatcctctcacgacccgaagatttc

SEQ ID NO: 27880 - DNA, 1791 bp, Triticum aestivum
  Clone ID: PAT_TA_27880
ttgctccattccccaccccccccccccccggcgccgccgcaccgcacctcgccgccgtccgtcctccgaaggaagggaagggaagggaaggaaagggaagatgagggagatcctgcacatccagggcgggcagtgcgggaaccagatcggggccaagttctgggaggtggtgtgcgcggagcacgggatcgaccccaccggccgctacgccggcgacaccgacctccagctcgagcgcgtcaacgtctactacaacgaggcctcctgcggccgcttcgtgccccgcgccgtcctcatggacctcgagccggggaccatggactccgtccgctccggcccctacggcggcatcttccgccccgacaacttcgtctttggccagtccggcgccggcaacaactgggccaagggccactacaccgagggcgccgagctcatcgactccgtcctcgacgtcgtccgcaaggaggccgagaattgcgactgcctccaaggtttccaggtgtgccactcgctgggcggcggcaccggctccggcatgggcacgctgctcatctccaagatccgggaggagtacccggaccgcatgatgctcaccttctccgtcttcccctcgcccaaggtctccgacaccgtcgtcgagccctacaacgccaccctctccgtgcaccagctcgtcgagaacgccgacgagtgcatggtgctcgacaacgaggcgctctacgacatctgcttccgcaccctcaagctcacaaccccgagcttcggcgacctgaaccacctcatctcggccaccatgagcggggtcacctgctgcctgcgcttcccggggcagctcaactcggacctccgcaagctggccgtgaacctcatcccgttcccgcggctgcacttcttcatggtgggcttcgcgccgctcacctcggcgcggcagccagcagtaccgcgcgctcaccgtgcccgagctcacccagcagatgtgggacgccaagaacatgatgtgcgcggccgacccgcgccacgggcgctacctgacggcctcggccatgttccggggcaagatgagcaccaaggaggtggacgagcagatgctgaacgtgcagaacaagaactcgagctacttcgtggagtggatccccaacaacgtcaagtcgacggtgtgcgacatcccgcccacaggcctcaagatggcctccaccttcatcggcaactcgacgtccatccaggagatgttccggcgcgtgagcgagcagttcacggccatgttccggcgcaaggccttcctgcactggtacacgggggagggcatggacgagatggagttcaccgaggccgagagcaacatgaacgacctcgtgtccgagtaccagcagtaccaggacgccaccgccgacgaggagggcgagtacgaggacgaggaggacgatgccgacctccaggactagagatcaaccgagtaccgcgtatgattattggttttcttatgttaatttgatgattgttttaggcttgtgtagtgctgtttctgtctttcttggtgggtgctgttgttgaggaacagaaaactcatggaagggtggttgttggtgagatagcttggtataacctctggcacaattgctgtgtgcaagcaacgccctgttgcgttctactggtagtggtgtgtgttgtctggtgtccattgtctaactatcatgtccaaatctaatgtaatttgaagttgcttgtgtctaaaaaaaaaaaaaaaaaaaaaaaaaaaaaaaaaaaaagggaaactccacaagactcaaa

SEQ ID NO: 27881 - DNA, 1849 bp, Triticum aestivum
  Clone ID: PAT_TA_27881
tttttttttttttttttttttttggaaagatctttgggaaggaccagttaccctgtgtaaaaatttccccgtgttgtctgatattcctcataagcaagattgcactattttacagtttaattcgacaattgatcgccacattcccgattcagactacggatttccaggaggggatacaacggggatttcccgattcagaggactccaaagaaagggttggtgatggcagagttgagctcggctccagcgacattcaggacggccttgtcaaccttgtcccttgccagaaacaagatctcctcgccttccggtttctcaaacccgcacagctcgagaaactctatgcctccaaggctgccaactctctcctggaatgtagcattattaagtctgatctttctgaatttctcctcgtcgggatttttaaccacgtttccgatgtaggtgaggagtgtctgaaaagccctctttactttagcatcctcctccttgttctgctgcttgatatttcgcaagcaatccctcatccgcctctgcctttgtggctggtctgacaggtaaaaatgcactcttcttctcttcaacaggcggtggcgcacttggcttggatgcagctggggcttctgccggcaatccaagttttcttctacgttcagccttgtcctcttcaagtttctggcgaatcttttctctggctctcttctcctcctctttctcaagccttctcaattctatgatgcgtttcctttcatttaactcctccatttttttggcttcaagaagctccttaccaatccttatgcgctccttttccctttctctctccatccttttttcttcttcttctttctttttacgagcacgctccctcagctcttgtgccttaatcttcttctcttcctcagttagagagggcttgttagcctcggtgttggccggcaccataggcatttcatcaatatctggatcctcctgatgctcagagagccaattaatggcgccttcaatggtgctattaccggagaagtgaagtgccctagtggcacgcgcagtcgaaaagcccatggattcgagttccccaagcatctccttgttcacctctggcgccaccaactcttgcggctccgcactccccgacgcgtccacatccatggcctccaaggccggcttcggcggcgcctcgagatcgatgggcttggccgcctccatggtcttgtccgtgaactcggcgtggcccgtgcgcttcctgtgcaggtccacctcggtctgggagcggcatggctttccgcagtcggcgcagacgaggttgaggacggcctcggtggactcggcgaagttggtgtgggaggtggcctcggcgtgcgcctgcgcctcctccacgctcctcagctgcacgccgcagtcgccgcaccgcagggacagccccgccattgctgctttcgacggcgtcgcttccgatcgagcgaatttggggtcgaaagtcgaacctcgtgccgaattcggcacgagggctaaatctacatatatgtgctggctgtactctcgaggctattttgtctgtctcaataattaaaacaacactattgtgtagggcaccgtggttatatttcttctgaagaacagaagagaacctgaagcatatttgctttggactttttgtcatctttcgtttgcacaaacatatgtttattttcaatttgtgcttgtcagtgcatcggagtatgtggcttgcaaattcagacccttttcctaactccaggctaggatccagatggcctctgatcatagtcttgtttcttagcactgaaataatatccaacatttggcaatcaaaaaaaaaaaaaaaaaa

SEQ ID NO: 27882 - DNA, 895 bp, Triticum aestivum
  Clone ID: PAT_TA_27882
gaagtaaatagagattgggaaattgcttgtatggagaaactgcagattcatttcacagagttagagctgaaaacatctctaaagcaaccattacattacactaaacaccacccacgatacataaacttgcctagcagaaccgaaaccctaaacaagggaggatgaggcatccttttgtacagccccttgaacaccaagcactcctaagaccagatatcggataggatcagatcaggcggcgggcgaccttgcgtgccttcttggcggccggggagcggacggtcttcggcttcgccttggccttggccgccggcgacttcttggccttggtgaccagcttcttcttctcgggcgccttgcgcttggtgccagcggcggcggtcttcttgggcttcgcggccaccgtcttcttggccttggcggcgtctttggcgggcttggccgcgggcttagccttgggggagtccttcttggcggcgtcggagagcttgtaggaggccttgaccttgacgagcttgcccttggcggcggaggagcggagctggacggagagcatcttcttgaagttggccgggagagccttgccgtgcttctcctcgatgtacttggcgatggcgaccgagctcgacccagtcctgtccttgagcgccgcgatcgcctccttgatcatctcgaagtaggtcgggtgggcggctccagcggcggccgccttgggcttggcggcggcgggcttcggcttcggcgccgcggcggcgggcttggccgggcgggcagcgggcttggcgagggcaggcatggcggctaacggaagcggagctctgaaactgaaactgacgctgctacttgcgcggtgtgctcgcttgagatttcgagagggagctcgcccacgcgtccg

SEQ ID NO: 27883 - DNA, 742 bp, Triticum aestivum
  Clone ID: PAT_TA_27883
gaccattcgaaccaaaattaagccatggagacaaatttaacaagggtggcatatagcaaaggttctttacttggcacagcatggtaacatgagtacaccagagtacaagcaatatcctcataacacgacgaaattgataacagagacatatcctggaatcacttcctagcttgcataacaaacactgaaacgtccataaaacaaaatgcagataactcttgagccatggctccaccacgccgcggccgggcgggccggatctagaacccgagcttggtgcggcgccagtgcctgcgcttcgcgttgtacctgatggtgttgtcggtccgcatgcggatccagtaggggatggggcggttctggcgctgcttcttggccagcttctgcttgatgcggaaggtcttgtgggacggcatcgtcgcggcggagacgaagacgcagcggcggcttcggcgtcggcggcggctgcggcggcggcgctcgtgccgaattcggcacgaggttccaagggcccaaagattggcggtggcggcgggaagcgttgaaagtcgattacgccatagacatagaattgtgctgccctagccttgtttcctatcctactatcatagacctttgtcaaagttattaccccgcatcttgaatttgcacctttatctgtgaggctgaatggtgttaacgttttggattgtctcgatgagtttatttataatgaaatgggtacttaatgtgggtcttggtc

SEQ ID NO: 27884 - DNA, 1401 bp, Triticum aestivum
  unsure (1)..(1401): unsure at all n locations
  Clone ID: PAT_TA_27884
aatatctcaatttttttttttttttttgcaaggcaaaattacctttgacatctggcacatggtggtaaacacatcaaaagttttttgcgtcaatatgtccaacttatttagatatacattgagtaaggattatattagatgctatgctcaaatatacagtacagatatacagtaattgcacgtctccgttttgagtactttgtgcttctctcaattgggatgcgcctcttcaagtgcttcatcgtctagccgctgattatatcctcgtaaatgttcctgaccttggcgaagaacgctttcctgtcgggcttgaatagcaggttcttgtacgcaaaccacccgctgtagccaatgccaacgacctccatgagacctggaaccacggggagcctgtcgattgccgatactactccgccggcgctccacatgccgagggtggcggcgacggcaagcgtggtcaccgcgtacttgtcctccaccctgtcccactcttgtttcaagccgttgaagaactcggtaagctcggcgttgtcggccagcggcgccgccggctcaccggcggccattgacaccacgttcctcgctagccttttgcagaaggacgcgacgcggggctggccgtgggacgcgaggccgggcagcggcggcagcgcggggagcccgagcccgacggagcgcgcggccttcccgaggtcgctcgcgatgggcgaggcgacggcgcccgtggctggggaggcgacggtcggggccatggagatcgatgccttcggtcagtgtacgcttttttttttgaattaataacagcaagacaatggtccgcgtgtttgtatataataaatatcacacaggttttgtatatgtgtagccggttctagaatttacatatgcatgctcgagaacctatgttcgtacatacacacacagaccatatagaatgaaaaatatgctctggtcgtccagcagagtggtggacaaaagttaagttcacaaaagaccttcatacataggccattgtttcaactcgtagtttaggccttgccagactcctcgcaacccggtggcctgaaggcgatgaagctgacgcactgcacctggcgcaggttgtcgaagccgatgacgcggacataggcgtcagggttttttttttttttttttttttttttttttttttttttttttttttttttttttttttttttttttttttttttttttttttttttttttttttttttttttttttttttttttttttttttttttttttttttttttttttttttcccccgggggcccattttttttttgggggggggggggaaaaaaannattttttggggggggggggnccgggagggaaaaaccctgttaaaaaaacattttgggattaaaaaaaaaaaa

SEQ ID NO: 27885 - DNA, 858 bp, Triticum aestivum
  Clone ID: PAT_TA_27885
gccaataaggaaatcttaatgtcaaatactgaattcttccaccaactaggtgtgagacatatccatcgcagtgccaaataaagaaagttttccgagaattaacagcaggacaatggtccgcttgttgtatataataaatatcacactggtgttgtatatgtgtagccgtgcatgctccacaacctatgttcgtacaaacacagatcatatggaacgagaaatatgctctggtcggaaagcagagtcgtggacaaaagtgaagttcacaaatgaccatcatacataggccattgtttcaacttgtagtttaggccttgccggactcctcgcaacctggtggcctgaaggcgatgaagctgacgcactgcacctggcgcaggttgtcgaagccgatgacacggacataggcatcagggtactccttcttgacctcctccacctcgttgagcacttgcgtggcgtcggtgcacccgaacataggcagcttccacattgtccagtatcgaccgtcgtagtacccgggagagctgttgtgctcacggaagacgaagccaaccttgctaaactcgaggcagggcacccacttggagcggatcaggtagtctacctgctttaggagggcctctgtggagaggggtggcaagtaagacagggtctcgaacttcttgataccctcaatcggccacacctgcatgcacctgatccttccgccattgctgacgcggccgaggctgccgctggagcggcggctgacgggcagaccggctgtggacttgagcccctggaagggtgcgacggtggtagccgacgaagccatcacggcgggggccatggtattgtattatcggaggagaggag

SEQ ID NO: 27886 - DNA, 854 bp, Triticum aestivum
  Clone ID: PAT_TA_27886
gcagtgccaaataaagaaacttttccatgaattaataacagcaagacaatggtccgcgtgttgtatataataaatattacacaggttttgcatatgtgtagccggtgcatatagacctatgaggaattacgtatgcatgctcaagaacctatgttcgtacatacatacacaaatcatatagaacaaaaggtatgctccggtccgaaagcagagtcgtgcagcagagttgtggacaaaagtgaagttcacaaaagaccttcatacgagataggccattgtttcaactcgtagtttaggccttgccggactcctcgcaacccggtggcctgaaggcgatgaagctgacgcactgcacctggcgcaggttgtcgaagccgatgacacggacataggcgtcagggtactccttcttgacctcctccacctcgttgagcacctgtgtggcgtcggtgcacccaaacatgggcagcttccacattgtccagtatcgaccgtcgtagtacccgggggagctgttgtgctcacggaagacgaagccaaccttgctgaactcgaggcagggcacccacttggagcggatcaggtagtcgacctgcttcaggagggcttccgtggagaggggtggcaagtaagacaaggtctcgaacttcttgatgccctcaattggccacacctgcatgcacctgatccttccgccattgctgacgctgccgaggctggcgctggagcggcggctgacggggagaccggctgtggacttgagcccctggaagggtgcaacggtggtagccgacgaagccatcacggcgggggccatggtattctattaactgaggagaggagcctcgtgccga

SEQ ID NO: 27887 - DNA, 826 bp, Triticum aestivum
  Clone ID: PAT_TA_27887
gcggggaaaaaagaattaataacagcaagacaatggtccgcgtgttgtatataacaaatattacacaggttttgcatatggatagccggtgtatatagacctatgaggaattatgtatgcatgctcgagaacataggttcctacatacatacacaaatcatatagaacaaaaggtatgctccggtcggaaagcagagtcgtgcaacagaggtcgtggacaaaagtgaaattcacaaaagatcttcatatgagataggccattgtttcaactcatagtttaggccttgccggactcctcgcaacccggtggcctgaaggcgatgaagctgacgcactgcacctggcgcaggttgtcgaagccgatgacgcggacataggcgtcagggtactccttcttgacctcctccacctcgttgagcacctgtgtggcgtcggtgcacccgaacataggcagcttccacattgtccagtatcgaccgtcgtagtacccgggggagctgttgtgctcacggaagacgaagccaaccttgctgaactcgaggcagggcacccacttggagcggatcaggtagtcgacctgcttcaggagggcttccgtggagaggggtggcaagtaagacagggtctcgaacttcttgatgccctcaattggccacacctgcatgcacctgatccttccgccgttgctgacgctgccgaggctgccgctggagcggcggctgacgggcaggccggctgtggacttgagcccctggaagggtgcgacggtggtagccgacgaagccatcacggcgggggccatggtatttgtattatcggaggagag

SEQ ID NO: 27888 - DNA, 1595 bp, Triticum aestivum
  Clone ID: PAT_TA_27888
ccacgcgtccgcttatccactcccctcaccctctccaccccaagcccccgtacctcttagcttagctctcctgctcatcacccaccagacaccactccatctcccgcgcgcgcgtgtggcctccgctcctctccccatctcctctctcgccaagaaccaccgagcttggagcgccaccgccatggccatggccacgcaagcctcggcggcgacgcgccacctcatcaccgcggcctggtcgccctccgccaagccccgccatcatgcgcgaggggcccaacctcctcaagctcgcccgcaaggagcagtgcctcgccctcggcaaccgcctccgctccaagtacaagatcgcctaccagttctaccgcgtcttccccaacggcgaggtgcagtacctccaccccaaggacggcgtctacccggagaaggtcaacgccggcaggcagggcgtggggcagaacttccgcagcatcggcaagaacgtcagccccatcgaggtcaagttcaccggcaagaactccttcgacatctaatctcgtaccggagtggatatgatctcccccagacatacgcaatgctttagctaatacacggaaatgcataccatgatttttctgtctatcaataactgcatgcattgcacggtgaatgtgaagaagtaggccattgtcgcggcaataatgagccaaagtagtatttgcggtgaatcccccagttaagtagtcatgcattacaataggaacccctaattctcttgcaaatacagctctcttaatcatttcttcacatgtacattgttacaatgctactacagatatggctgacggtggcagtaaatgacatcaacacattgaggccatacgagtattatagttacacatgctcatgcaccatcatcatcttcaacagtgttgacgcgctcgcactcatcgatccattcgctgtatacatcaataggttcagtcagcgcatttgcagtggtgctgaagctttcctggcagatttgacagttagcctcaccaatcagattcttcaaatcaatccggcactcaacgctgctcccatggttgcagaatgggcaggaaaagacggtatcgagcttgtccatccgcttcctagggggtggcttagcggccgccttcctcttccccatggttcggcttctgtccttccttcaaaatcataataaaaaaagcaccaagctatcatcatcatcccttgtaaaagaagccgaaatttgtaaccacgcaagagtagacagcacccgaatcatacacatatcatccacaagaaggaatccaggaacacaacagcaggcatgaccctgccaggggcggatctggcccggaaatttcgaaggccccatccccaccctcagactcagagggagggaggagatccggtggccggacgaagactgggacggggtggagtcagccgcaggacgccccggggcccgagtaagaagggcggcggcgacggcgactgcgcaaggtcgccgagaggcgggatcgaggcggcggcaggtagatccgctgcccggggctggaagggaaagggggtgcgaggggagaggaaggtgggccctcgtgccg

SEQ ID NO: 27889 - DNA, 684 bp, Triticum aestivum
  Clone ID: PAT_TA_27889
gcggcggattagggtttcacttgcatccattctcaacgttagcaggagcgagtgggagtccggccatggcgccgtcgcagcccaagtcagggctcttcgtgggcatcaacaagggccacgtcgtcaccaagcgcgagctgccgcctcgcccgtccgaccgcaaggggaaaggtacaaagagggtgcattttgtcaggaacttgatcagggaggttgctggatttgctccctatgagaagcgtatcactgagcttcttaaggttggaaaggacaagcgtgcactcaaggtcgccaagagaaagcttggtactcacaagagagcaaagaagaagagagaggagatgtcaagtgtccttaggaagatgaggtctgctggtggtggtgctggtgacaagaagaaatagaacttggctagctggtgaattttatccggaagcaaagtcctgtattaccagtccgtacctatagagctatggccattgtgttgacactatctttagcccgtggtttctattttgagaagaccaatctctttaagatttttacatgagtctggtgcctttgtttgattacttggtactctgctgtttattcagttatgtagcttgtctgggttttgtacctgcgattgttatatgttttcagaaagccctgccacggtgtgaacttggagcccataccccc

SEQ ID NO: 27890 - DNA, 845 bp, Triticum aestivum
  Clone ID: PAT_TA_27890
agaagaaaacaatgcaagacataggcatctccagctgcaaacaaagtaacatttccatcaattgatggcaagacaacaatccgcggattgcatataatatatgtgtgtatgtatagccggtgctataattctcatatgcatcctcctcgacctacgttggtaggtgcttacataatatactcatatattcacatatgagtagtacgagaagtaaaaccgagaaagcagcgctgccgacaaatgtgaactaacatggcatgtatatgcgttacttcaacttgcactttaggccttgccagattcctcgcagcctggtggcctgaaggcaatgaagctgacgcactgcacctggcgcatgttgtcgaagccgatgacacggacataggcgtcagggtactccttcttgacctcctccacctcgttgagcacctgcgttgcgtcggtgcacccgaacataggcagcttccacattgtccagtatcgaccgtcgtagtagccgggggagctgttgtgctcacggaagacgaagccaaccttgctgaactcgaggcagggcacccacttggagcggatcaggtagtcgacctgctttaggagggcctcagtggagaggggtggcaagtaagacagggtctcgaacttcttgatgccctcaatcggccacacctgcatgcatctgatccttccgccgttgctgacgctgctgaggccggcgctgccggagcggcggctgacggggaggccggcggtcgacttgagcccctggaagggcgcgacggtggtggcggaggaagccatcacggctggggccatggcggagtcggacgcgtgggcggacgcgtggg

SEQ ID NO: 27891 - DNA, 1875 bp, Triticum aestivum
  Clone ID: PAT_TA_27891
ttttttttttggtaaaatatttcaacatcaagggcttatttgggttggaaatcatgacaatacccaccatttctgtacaaactgttccacagaaacttatttctaccatcaatcagatacaccgtatcacactttcaggtcaaatgccaagagcagggctagcaaactgaaacaagagtctgtgtctacagttcccgtggccacaccagtataattttggtccaaaacattgcagggatcttgcttacaagttggtctttggcttggatggcgggctcacgcgcctggtcaaggtccgcatcgtcacaaactcctccgctgcagaagggtggatcccgacggtgctgtcaaaggtcgccttggtagctccagccttgagcgcaacagcaatgccctgcataatttcagctgcatctggtccacacatggctgcaccgagtaccttatcggtctcagcatcgaccaccagtttcatggtagacttctccacgcgtttggatatgctgttcttcattgggttgaaacttgatgtgtaaacaagaagatcattcttggcttccgccaaagcctcttgttcgctcagaccgacgacagatagtggtggaatgcagaaaacagcacaaggtacatctttataatcaggcttaactgtctggccaccaaacacagttttagcgaagcaagtagcctccatcagagcaacaggtgttaggttaatccgattgttacatcacccacggcccatatacttggaactgatgtacgggagtattcatcaaccttgatggctcctatttgatcaacctcaacaccaacagcttccaggttcagcctattggagttcggcgcacgacctgtagcaaaaagaacaacatctgcaatgagctcatcccccttatctgtcacaactttaatgccatcggctgttttactcaactcggtcaaatttgtccctggatgcaatcggattccccttccttcaaggttacttgcaacaactgttctcatctcatcatcaaaaccccttagaggaagttctttcctataaaatagatctacttcagcacccaaccccttccagatagaagcaaattcaacagcaatatatccgccaccaagaatcacagcacgtttcggtagctcctccaaacttaaagcctcatctgaagtaatagccagctcctttccaggaatgtcgaccagagttgcccggctaccagttgcaatcaatatgtgcttggtcgtgtgcctttgctttgaaccatctggctgggtgacttcaacggtatgagcatccactatacttcctgccccttcgatcatcgtcacaccagaaccaccaaggattctcttgtacactccatttaatctcacaatttcttgagtcttattttccagcaactttttccagttgtagttgatgtccccgttgatctcccacccgaattgcttggcgtcatcgaattccccccggaaagatgccccgtagacgagaatcttcttcgggacacagccacgtatcacgcacgttccgccgtgtcctcccagccactcggagctgatggggtggaacgggagctcgcagatcgcaaccttggccccgaatcccgcggcggtgcgggagccgcggacgccgccgctgccggcgccgatgacgaagaggtcgtagtcgtagctcccctcgccctcgccgccgccgtcgtcggcgacgaggggcgcctccccgtccttgagcatcttccgcgccatggtctgcacaaaaccctaggtcgacgacggcctgggtggacggatggatcccggagcagaggggagcaggtgggggcggctaggctacgctggctgctacgggattagcggatggacggatggatc

SEQ ID NO: 27892 - DNA, 811 bp, Triticum aestivum
  Clone ID: PAT_TA_27892
ctctctctctctctctctctctctctctctctctctctctctctctctctctctctctctctctctctctctcggcggcttagggttttaactcgcatccattctcaaggttagcaggagaccggccatggcgccgttgcagcccaagtcagggctcttcgtcggcatcaacaagggccacgtcgtcaccaagcgcgagctgccgcctcgcccgtccgaccgcaaggggaaaggtaccaagagggtgctgtttgtcaggaacttgattagggaggtcgctggatttgctccctatgagaagcgtatcactgagcttcttaaggttggaaaggacaagcgcgcactcaaggtcgccaagaggaagcttggtactcacaagagagcaaagaagaagagggaggagatgtcaagtgtcctcaggaagatgaggtctggtggtggtggtgctacggacaagaagaaatagattttgcatgttgatttatctcaatgctttgccctgtatttccacattatgccaagtttgtagcctgtggcaattggagacgaatgtagtacattgcacttcaagttcagagtcaaactatgaatttttgacactatttgcaattggagtgacatggtagtacattgcattctgagtttttggcactatctttagtgcgtggtttctatttgagaatacccatcaccttttcttcgcagaaatcaagcgtctttgttttctaacctttgtatccgagctatctgtatgctgatggtcgtatgttttttgccaaaccttaatgatctgggcagtaaaaaaaaaaaa

SEQ ID NO: 27893 - DNA, 2006 bp, Triticum aestivum
  Clone ID: PAT_TA_27893
tagtctcgagttttttttttttttttgcaataaaatttatgaagtgccatatatatgaaatttacagtctcgctccacgtgtcgatgaattcactgtacaaataatcctataattgtatcaatgtactatgtactgctttcttttctttatttctgcagcatgtagaacatgcagagtcttttttatcactgttcctcacacctctgcttgctgatgtaccagttgttcctcgttgacaaagaaggcgtggaacccgtagggaacccggttcggcagctcgacgaccgccaccggatcaggcgacatggtcttggcatcaatcacattcacctcagatttccctgtgttctcatcatgcacaaagagtatcagatagccgtcatcttcttgaccagaaacaccgggctccttgggcacgaagaccgcctccgagccgaacctaccaggtcccaggtcgtatatgcccatcacattcccaccgacttcaagctgcttcttgccgctctctggctcggcgtgcaggtcaaatttgatgatgccggtcaccttcgctatgctgtcgagtatcgtgcagtacacatactgctgctttctgccagtatagctctcgttgattcgaggaaagtctacagcagagacggacagttgcttctgcgaagcagcacctgttttcatgttgaatctcatctcatacagctcattcccgaagttctcgagcttgtcgttttgggtgccgttcaccttgtccagatctgggttctcaaggcggcaggtaatcagaacaacttcgtcgccctcttcccaggcattagcgttgtggaatatgaagcaattggggagttcaaaccatctgatggttttttcatccttttcataacgctggagtatgccgaaacgagctttcttggtagggtcaaacttgtagatgaattcaccattcttaaccatttcctttggtcgaaacaacaaaggcaggtccataaatatggaatagttctctgtgattgcaaagtcgtgcatcattacagactctggtattgttattggcacaggatcaagcataactccgtccttggtgatgacccggtatgtgcaataaggaggttcatgcgagtacccaaacgtgaacatttcatctgtaaatggatcaaccttgggatgagcagtgaaagaatgtttcaacctattgtcataatccaacaacccaagagtttgcaggtctccatcttcaaggaccttaacaacatagggtttatctgcttctgacagggccagtagtttgccatgatgatatataagtgcggtattagctgtcccaaatccataagtaacatccaggattttcagttttttcctaagtgcttgcatttgaaccataaacaatccaaaaaagccctttagatctccaatcttcataaactttgctccaccaaaatattcttcttgcttgaggcgagaagtcttcacgtatcttgatacatatgtagctttgccatctttaatacgcattgcatggatcattccatctccatcaaccagtgataccctgcaacagggacaaacttcggattaggccccaccctgacaaattctccattcaagcactccgggaggtggccgcggacggggaggccggcggcgggcggggtctcgtcgcggacgggggcgaagttgccggagagccagtggagcggcttggccttgtcgtggccgaggcggacggcgaggcgctcgagcaggtcgaccgcccaggacgccacgcccttgctcggccgcggcgccggcaccaccaccgccccctccttcttcagggtgtcctccgccgcggccaccgcttctcccatggtgactactgctggccactgacgggtcggtgtgggtgggttggtgaaagaagaggaggaggaggaggccggagatgatgctcagcgcattgttccctgggcgttggctgggtgggggtttggtttgtagccagccacgcgagcggaggagagcctcgtgc

SEQ ID NO: 27894 - DNA, 1110 bp, Triticum aestivum
  Clone ID: PAT_TA_27894
ataaaaattgcttacttgctaatgccaaagcaagacatgaacactgaataatagtaccatcatgactggatatatagccagtagatacaatgtgatgtaactttcacaattgctcagtatgctgctccgagaagattatgtgctgagcaaatgaatgatagtacagctgctggcttgctgcataaacttcagagagcagagctcaaattgtacagacaaaccctcgcacaaccaagtttcatagcttggcagtgcttgagcaaaatacaggaggaacatttacaggcttctttgcccctgtatgatccctacatatttgttcttcacaaagcggcggagagaggaatggttgcttgcatgcctgttttacaggcatgtgtcgcaaagcagacgtccgtcgtctcaaggaactcctgggtcttcaccagaatcagtgggatgtagtcaaggacaagcctcttgcactgcggttcgtagttcttcgccttgctgcatgttttgaaaagaagcccgactatctccagcttggtgttgggatccttaagcatcataagaacctcaacaagaacatgatggcatagaccacaggcatcccctcgtgtggacgaccgagtcgccgccccctttgggcagaggtgcgctgattcacataactcctcaggtttaactacagaaacctccaagaagaacacgggaatgtagtagtcggcccagcgtgatgcactgctgtcttagaggaccaagacttgcacacgtgtggtggagggcactgagaatctcggtctgggtttcgttttgtcgcaaggtagaataagaagttcggttggagtattgctaaacattagtacaacaaaacttccgtttgccggaagttaatcctggaccctttgcttgcaacaagggaactctcctgggtcagtatgcaggcataccccccctcgcgctccttaaaaaaggaatctcggctctctgcgagcgcggccgaaaaggccagcccgagcagcacaaacgccagcctcctcgtcgagctcgccatcgccatgcccggttgactcgctctgcggccgctcccctcggcgtctgatttgctcttggaacggggcctcgtgc

SEQ ID NO: 27895 - DNA, 879 bp, Triticum aestivum
  Clone ID: PAT_TA_27895
agggcgaattgggtaccgggccccccctcgagtttttttttttttttttttttttgcaaagaaagtagcctttccatcgattgatggcaagacactaatccgttgattgcatataatatatatgtatatgtatagccggtgctataattctcatatgcatcctcctcgacctacattggtaagtgcttacatacatatgctcatatattcacatatgagtagaacgagaagtaaaactgagaaagcagagccgccgacaaatgtgactaacatgacatgtatatcggttacttcaacttgcactttaggccttgccggattcctcgcagcctggtggcctgaaggcaatgaagctgacgcattgcacctggcgcatgttgtcgaagccgatgacgcggacataggcatcagggtactccttcttgacctcctccacctcgttgagcacctgtgtggcgtcggtgcacccgaacataggcagcttccacattgtccagtatcgaccgtcgtagtacccgggggagctgttgtgctcacggaagacgaagccaaccttgctgaactcgaggcagggcacccacttggagcggatcaagtagtcgacctgcttcaagagggccctccgtggagaggggtggcaagtaagacagggtctcgaacttcttgatgccctcaattggccacacctgcatgcatctgatccttccgccattgctgacgctgctgaggccggtgctgccggagcggcagctgacggggaggccggcggtcgacttgagcccctggaagggcgcgacggtggtggcggaagaagccatcacggctggggccatggcggagtacgtaaattgctaggtggggaggcgatagctagctagg

SEQ ID NO: 27896 - DNA, 1830 bp, Triticum aestivum
  Clone ID: PAT_TA_27896
gaattcggcacgaggctcccccctccccccttcctcctcccctccaaaacctcgccggaaccctacccctcccccgccgccgccatgagggaaatcctccacatccagggcggccagtgcggcaaccagatcggggccaagttctgggaggtgatctgcgacgagcacggcatcgaccagaccggcaagtacgccggcgactccgacctccagctcgagcgcatcaacgtctactacaacgaggccagcggcggccgcttcgtgccccgcgctgtcctcatggacctcgagccggggaccatggactccctccgatccggcccctacggccagatcttccgccccgacaacttcgtcttcggccagtccggcgctggcaacaactgggccaagggtcactacaccgagggcgccgagctcatcgactccgtcctcgacgtcgtccgcaaggaggccgagaactgcgactgcctgcaaggatttcaagtctgccactctctgggaggaggaactggttctggtatgggtacactgctcatctccaagatcagggaggagtacccagataggatgatgttgacattctcagtcttcccatcaccgaaggtgtctgacactgtggtggagccttacaatgctacactttctgtacaccaacttgtcgagaatgctgatgagtgcatggtgcttgacaatgaggctctctatgacatctgcttccgcactctgaagcttgctacacccacatttggtgatctgaaccatcttatatctgcaaccatgagtggcgtcacttgttgcctccgcttccccgggccagctgaactctgacctccggaaactcgcagtcaacttgatcccgttccctcgcctccatttcttcatggttggctttgcaccactgacctcaaggggttctcagcagtaccgtgccctcactgttcctgagttgacccagcagatgtgggactcaaagaacatgatgtgtgctgctgacccgcggcacggccggtacctcacagcctctgccatgttccgtgggaagatgagcacaaaggaggttgatgagcagatgctgaacgtccagaacaagaactcgtcgtacttcgttgagtggatacccaacaatgtgaagtcaagcgtgtgtgacatccctcccacaggcctgtcaatgtcgtccacctttgttggcaactccacctccatccaggagatgttccgccgtgtgagtgagcagttcacggccatgttcaggaggaaggctttcttgcactggtacaccggtgagggcatggatgagatggagttcaccgaggcagaaagcaacatgaacgatcttgtcgctgagtaccagcagtaccaggatgccactgccgatgaggaggaagagtatgacgaggaggaggaagaggatgcctaagccacctgacctcatccggtcgtcctgctgtctgctagatatgccttgtgtttactattgctgtcgatttggtggtgcttgtggtgcggatagatctttaggtggttgataacacttatagatgcttttgctgcttcggcgaatcgatattttttgaactgtcttttgtatgttgatggtggttttatgcgaattgtgatattagcgtaactgtggacttgatactcgtaaattctggaattatattttgtgtctttttactgtgcattgtggttagctcacgattgttctttctgcatcaactcctgtgttgtatcgtgctctgaaatttggtctattgttgctgcaagttttcgcagctatatgctccaacatttcaagaaaagaagctgtatggtttaaaaaaaaaa

SEQ ID NO: 27897 - DNA, 2243 bp, Triticum aestivum
  Clone ID: PAT_TA_27897
ctactgaagaaggtggctttatttttcgataagtgatgcttttactaatccataatataacaacaaggagttacaaagcataattagcatacacctgcctcttgtatgattagtatgcgcacatctaacaccaactcatacccacaagatctttttattagcacgtataaacagtgcagctgaccaattttattggttgacaccccatgacggttggacaccaggtactcacgcccacgagatttgtttattagcacatataaattgtgctgcttaccaattttattgcacgaccctccatgacggccggaccatcagctagcgagcgtggtggggaagcaactgtcgtgcacgcagctgagcacgtcgcggtagtccctgtggatggtgaaggagtcatacaccttgccatcgctgctcttcatgtactcgaacaaaagcgatgagtggttgaaggccgtcagcttggtgaacccgtagtcgtgatccctgaatatgctccacttggggatcgcggtggtgtactccgacaggtggctgccgcccgccgccggccacgacgaagatggtcccgttcatggtgcccgagtagtggctcttctcattgttgacgcactggctctggtagagcgggcatgtgcgctcgtagttgtggacgtggccgaagtaggcaatgtcgacgcggtacttctgccacagcttctgcaggctctcccggccctcgggctcctcgaaggagccctggtcggcgtaccacgagttggaggagtagccgagcacccggtgcgccgtgaagatgagccacggctggtgcttgcggtccaccgtggagaggcactcctcgatgaacttgtactgcggagtcccctcccgccagtcgtgctccgagtccgccacgcagaaccgaaacatcccgtagtccaccttgtaccaaaagtttgctctgttttcggccgggtagtagtacatggtctcggcaggcaccccgcattcaccgccggagtcctcgacgtcgaaaaacccgccggtgttgggccagtccctctcgtggttgccacttgcaaccatgtaggcctttttggcgctgatgggggcaacctgtgcggtgaactggtcccactgcgagaggtacccgttagcgtagggcatgtcgccgatgtggaagacgatgtcgtagttgtccagatcttcaatcaacctatccgtcgtgttgagcgatcctggctggtagttggcgaactcgtttgatccatccctgctccgcctttcccatgtcaccgaagacgatgatgcgctgcagcgagttctggccgggggttggcggtgcccggaaggtgtagggcttagcccacaccacggttccgtcggagagctcatgcccaatcttgtagaagtactctttgttgggccacaggttcctcatgaacgccgtgtggatgaacccgggttccctccacccaaccgttcgcgccggctcaccgcacatgctgccgcggttgaaggtgagcgtcccggcgggcgtgcgtgcgccggcggcgccgaccatgccccactccacgaacgggtaggcctcgccgacgtcgtagccgctggtccacgtcaccgtcatctcgtcgtgggtcttgccctgcgccagccgcgggaacaccggcgcttggggttcttgaacaccgcttcttcgacaccgacaccagcttcgggttttcgaggccgccggtgaagagggcgaaggagaagtcggcgcgctggttgatgagctggagccggatgctgcccttgccacctttgaggtagttcgccgagtagttggcgtacttgatacttgatcggcgccgtgcatagcagcggctcggcggggtacctctcggggttagggcacggtgcccgagatgaaatcggcgggggagaagacggcgatccagtcgtcgggggtagggttgagcccagccgtacttgacggtgaccaacacagtgtcatcgtcatggccgccgagcactgccggagtagcccgcacgcacgcggaggagcggtggaggtcaaggtgaacggtggcattgtggatggcgatcttggacagcggctggacccccagggccggcgacgcgctcaccgtcgccgccgctgccgccatggccagcaccgctgccagggcgacatgcgccatccccatgcctctgcttcagctgtagctcgtgcgcactagagctgctcctgcaagtgcaactgtgctcgtgccgaatta

SEQ ID NO: 27898 - DNA, 1750 bp, Triticum aestivum
  Clone ID: PAT_TA_27898
ggcacgagctccactcccccctctccccccccctcctcccccctccaaaacctcgccggaaccctacccctcccccgccgccgccatgagggagatcctccacatccagggcggccagtgcggcaaccagatcggggccaagttctgggaggtgatctgcgacgagcacggcatcgaccagaccggcaagtacgccggcgactccgacctccagctcgagcgcatcaacgtctactacaacgaggccagcggcggccgcttcgtgccccgcgccgtcctcatggacctcgagccgggcaccatggactccctccgctcggggccctacggccagatcttccgccccgacaacttcgtcttcggccagtccggcgccggcaacaactgggccaagggccactacaccgagggcgccgagctcatcgactccgtcctcgacgtcgtccgcaaggaggccgagaactgcgactgcctgcaaggattccaagtctgccactctctgggaggaggaactggttctggtatgggtacactgctcatctccaagatcagggaggagtacccagataggatgatgttgacattctcagtctttccatcaccaaaggtgtccgacactgtggtggaaccttacaatgctacactttctgtacaccaacttgttgagaacgctgatgagtgcatggtacttgacaatgaggctctctatgacatctgcttccgcactctgaagcttgctacacccacatttggtgatctgaaccatcttatatctgcaactatgagtggtgtcacttgctgcctccgcttccccggtcagctgaactccgacctccggaaactcgcagtcaacttgatcccgttccctcgcctccatttcttcatggttggcttcgcaccactgacctcgaggggttctcagcagtaccgtgccctcactgttcctgagttgacccagcagatgtgggactcaaagaacatgatgtgtgctgctgacccgcgtcacggccggtacctcacagcctctgccatgttccgtgggaagatgagcacaaaggaagttgatgagcagatgctgaacgtccagaacaagaactcgtcatactttgttgagtggatacccaacaatgtgaagtcaagcgtgtgtgacatccctcccacaggcctgtcaatgtcgtccacctttgttggcaactccacctccatccaggagatgttccgccgtgtgagcgagcagttcactgccatgttcaggaggaaggctttcttgcactggtacaccggtgagggcatggatgagatggagttcaccgaggccgagagcaacatgaacgatctggtcgctgagtaccagcagtaccaggatgccacagccgacgaagaggaagagtatgacgaggaggaggaagaggaggctgcctaagccaccagacctcatacggtcgtcctgctgtctgctagatatgccttgtgtttactattgctgtcgatttggtggtgcttgtggtgcggatagatctttaggtggttgataacacttatagatgcttttgctgcttcggcgaatcgatattttttgaactgttttttggatgctgatggtggttttatgcgaattgtgatattagcgtaactgtgggcggacttgatactcgtaaattcggtaactatattttgtgtctgtttactgtgcgttttcgctcacgatttctgaaatttggtctattgttgctccaacaaaaaaaaaaaa

SEQ ID NO: 27899 - DNA, 1719 bp, Triticum aestivum
  unsure (1)..(1719): unsure at all n locations
  Clone ID: PAT_TA_27899
tacgcctccgtagattccgggtccacggggacaatcacagtttttcctctcgctcctcctgtgggcggcgccgccgctgcgcacagaacacatcctcgccagcgtagcttctccggcgtccggccaacgcgctcactagcctcccgccttcctccacatctcctcgcctccaccccatccagttcgtgccattcgctgctccaagacaagggcatggcgctcggcggctgcggcaacgaagctgatggtgcacgagccaaccatgaaggcagtagcacggggcagcgacagcagcatggagggcgtcctcttgtttgggaaggtaatggaactgcaaataggagtggcagcggcgaccaggatgcaaatggaagtggttcccaaagaccttggaaagaaatggcacgtgagcaaaggatatcaagaagcttttggatgttgggaagcttggagctgatgcttcaaataagctgatggttgtcttttggagatgtttctatgtttaatgctttaaagtcttttggctgtactggactatttaaactttgaactatgctgtgatggttgaactgatgctggacggttaagggtttatgtcagaggcaactttatacatccccccttccttcctccacccacctcctccccctccccctccggcgcctccccccaccggcgaatccgcaaccgaatcgaatcccaggatccgcgtcggcgggcggcggcggcggcacatggcgcaccgggtggacaacgagtacgactacctcttcaagatcgtgctcatcggcgactccggcgtcggcaagtccaacatcctctcccgcttcacccgcaacgagttctgcctcgagtccaagtccaccatcggcgtcgagttcgccacccgcaccctccaggtagaaggcaagaccattaaagctcagatatgggatactgctggccaagagaggtaccgtgcaatcacaagtgcttactacaggggagctgtgggagctcttttggtgtatgacataacaaagaagctatcattcgaaaacatcaataggtggctcagtgagctccgtaaccatgctgactccaacatcgtcattatgatggttggaaacaaatctgaccttaaccacctgaggtcagttcaggaggaagaaggacaggcattagcagagaaggaagggctatccttccttgagacctcggcactggaagccttgaacgttgagaaggcgtttcagactatcctttccgacatccatcagatcataagcaagaaggcgctggctgcccaggaggctgcaggaagtggacctccgactcaaggaacccacccatcatgttggcgattcatcccgcaacaatgaagaaagggtgctggtcaaactaggtgcgaacaaaagaagtggggattctgcaaaaggatgctcacatggatctcacggcgctttaggtgttagttgggtccctttgactccttttggcctgtaattctggtggggttgtattaaagttcatactgctagaaagaaattatccttggtagataccgtgtgtagttgcaaatttttggtagagaccattgtttgtcagtcagacttactacagtttcagagcaatatcatgtttcctttcaggtatatgtttgtcctcctaagacatctgatgccccgaattaccggagcaggaancaatgcgantatatatgtatctcttgtatttgtt

SEQ ID NO: 27900 - DNA, 1874 bp, Triticum aestivum
  Clone ID: PAT_TA_27900
cgtccgaggacgcgtgggctctcctgtcctctgctcccttcctctgtccctctcgcacagcagaagagaactcctaccctccggtgagtcagcactgagctcggctccctgctccgtcagctgctctccggcggctggcaccgggagcggcgttttccttcaggcagggggttaactaatttgggcgtcctgagatcacagatggccgcagcggtggctgacgcggcggtgccggcggtggcgaaggcgaacggcgccggggcggggtgctgcgcggcgaagggccccgggtacgccacgcccagggaggccatggagaagggcccgcgggaggggctcctctacgtcacctgcgtctacaatggtactggaatcaacaagccggattacctggctacagtggacgtcgaccccaattcagcgacctactcccaggtgatccacaggctcccggccacccacatcggcgacgagctgcatcactccggctggaacgcttgcagctcctgccatggtgatccatccacgagccggcgcttcttgattctcccttcgttgctgtctggtcgcgtgtatgtggtcgacactgcaaaggatccgagggcgcctgctctgcacaaggttgtccaggctgaggacattgctgagaagaccgggcttgggttccctcacacatcccattgccttgcaactggggatatcatgatttcctgcctgggagacaaggagggcaatgctgctggcaatggctttctcctgttggattcagagtttaacgtcaaagggcgttgggaaaagccaggtcacagccccttgtttggctatgatttctggtaccagcctcgtcacaagacgatgattagctcttcatggggagctccggcagctttcaggacaggtttcgatctccagcatgtccaggatggtctctatggaaggcacctgcatgtgtatgactggcctggtggtgagctcaagcagacactggatctaggcagcacaggtcttcttccactggaggtgaggtttttacatgacccatcaaaggacactggctatgttggctgtgctttgacaagcaacatggtgagattcttcaaaactgcagatggatcatggagccatgaggtagctatatccatagagccactgaaggtgcgcaactggatgctgccagaaatgccaggattgataactgactttgtcatctctctcgatgaccgttatctctacttggtcaactggcttcatggggatatcaggcagtacaacattgaggaccctgcaaagcctgtgttggctgggcaagtatttgtaggtgggcttcttcaaaagggcagtgatgttgtctatgtgaccgacgatgacaaagaagagcagtatgctgtgccccaagtcaaggggcaccggcttagaggtgggccgcagatgattcagctgagcttggatggcaagagggtctatgtaaccaactctctcttcagccgatgggacgagcagttctatggccctgaccttctcaagaagggatctcacatgttgcagatcgacgtcgacaccgaggaaggagggctgactgtcaaccccgacttctttgtggattttggcaccgagcctgaaggtccctcattggcccatgaaatgagatatcctgggggagactgcacctctgacatatggatctaggacgaagggtgtagggtgcatatgcagctggagatccatggtgttaagctcactgtaattaagatggtttcttccctgcctgcggtgttgtatgtgatgtggtatcaattggaataagttcctgatagaacctctgacattggcttcatgggagcttgtgccctaataagagttgcctctgattctga

SEQ ID NO: 27901 - DNA, 1885 bp, Triticum aestivum
  Clone ID: PAT_TA_27901
ggcatgcccaagggaaatctgcaattctggtgaggacagagaccagcccagaagatgttggtggcatgcatgcagccgctggaattcttacagcaagaggtggtatgacttctcatgctgccgttgtagcacgtggttggggaaaatgctgtgtgtcagggtgctcaagcatgcgtgtaaatgaaattgaaaaggtggtagctattgaagacaagatgctctatgaaggtgactggatatcactcaatggatcaactggtgaagtgatccttggcaaacagccacttttcccaccagcccttagtgctgacttggaaactttcatgtcctgggttgatgaagttaggcagctcaaggttatggctaatgcagacacccccggggatgcattggcagcaaggaaaaatggggcagaaggaattggactctgtcggacagaacacatgttctttgcttctgatgagaggattaaggctgtgaggcagatgataatggctccaactgtcgaactgaggcagaaagcactagatcgtcttctgccttaccagaggtccgactttgaaggcattttccgtgccatggatgggctcccggtgactatccggctgttggaccctccacttcatgagttccttccagaagggcatgtggaggatattgtgcgtgagctatgtgctgaaagtggagccgctgaggatgatgtccttgcaagaatggagaaactttcagaagtaaatccaatgcttggtttccgtggttgcaggcttggtatttcgtatcctgaattaacagaaatgcaagcccgggccatctttgaagctgctatatccatgaccaaccagggtattcaagtatttccagagataatggttcctcttgttggaacacctcaggaattgggacatcaggtggctcttatccgccaaattgctaacaatgttttcaccaatatggggaaaaccattgattacaaagttgggactatgattgaaattcccagggctgctctagtggcagatgagatagcagagcaggctgagttcttctctttcggaacaaacgacctcacgcagatgacatttggttacagtagggatgatgtggggaagttcctccccatctatctggctcagggtatcctccagcatgacccatttgaggtgcttgatcagagaggagtgggggagctagtaaagattgctacagagaggggtcgcaaagcgaggcctaacttgaaggtgggcatctgcggtgaacatggtggagagccatcttcagttgcttttttcgcaaaggctgggctggattatgtttcatgctccccgttcagggtcccgattgctaggctagctgcagcccaggtccttgtctgaggacgctgcctcgtcaaccggatagcctgctgttggtgcatccggtgaagataaataagacatagccatggacttgtggaaactctgctgcctaacaaaggccgtttcatatatgtatgcgtatgcgcgtgtaagcctgaaatggcgtgttctctgcatttcccctgaactgccatggtaatgtacatacatacacagaccatatagaatgaaaaatatgctctggtcgtccagcagagtcgtggacaaaagtgacgttcacaaaagaccttcatacataggccattgtttcaactcgtagtttaggccttgccagactcctcgcaacccggtggcctgaaggcgatgaagctgacgcactgcacctggcgcaggttgtcgaagccgatgacgcggacataggcgtcagggtactccttcttgacctcctccacctcgttgagcacctgtgtgatatttattatatacaacacgcggaccattgtcttgctgttattaattcatgaataagg

SEQ ID NO: 27902 - DNA, 2355 bp, Triticum aestivum
  Clone ID: PAT_TA_27902
ttttttttttttttttttttctactggaagttactttcatcaactttctgttgctgaacaagcagatccagaggtagcaacaaacgggaagagaaaatacaacaaagtctcagaaaaaagtttgccaagtcccagcggggaaggtaataaagaaacataaatatgttgaatcttgaccacctctaaattaatcaccacgaagctaggacttggccctaacgcgcacacgccgacgacgaagacgacaacaacaaccaacagcagcagcagcagcagcaaattattgctatctatcaaacaatgatggtggtggtgatactaccaacaggctggagcaccatggaattatgggatgctcccaggcggactgttgacgaatagggtggtggtatcctgtcatttacagagtcgcaaacagcgtcgtttccttgttccatcgttcgttctcgggttcgggttcccttgccccccttcctgttatttcctcttgccggtgccgagggacaggagctcgaggctgcggtggaggggctcgtcgcgcgaccctcttgcgaccgctgcccgtgagagggatgtggccctcgactcgctcactccaggattgactctctgggtgctggacgggcggctgccgccgttattgctgctggagaacaacctgctcgttcggctgtactgctgctcgctcggttgcatggatgagcctggcctgctgcttgatgcaactgctctcctggacgcactgcctgtacgagaggatgtacggggtctctccgtggtcctctccacagtcctttcgccggaccggtctgtgctatgcataatctcctttaatgacatcgatacagtttcccgtggtcgggttgcatggttgtcactctgattcagagaagcactgggattcctccgagcagatgcttcgcctggggccttctctatcttctcgatagaaggtccagcagctccactgactctttcacttggcctcatccttggattggagcctatctggggatatttcaaaatggtccagtcaaacacataatcgaattggtatccttcccggatgaagagatcacggaatagtctctttaggtaagaataatctggcttgtcttcaaaccgcaatgatcgacagtagtggaagtaagaaatgaattctgaagggtaagacttgcagagtacctccactggagtaagcatcttcttctcactaattttgtcatatttctgcttcttagtgcccgctttcagcccctgccatggcagactgcctctgaggaagtacataagtacataaccaagtgattctaaatcatctctcctgctttgctcaacgccaaggtgagtattgacactagcatagcgtgcagttccagtgagattcttgttctccctgtaggggatgtgcttatgagtctgaaggtctctgaatttctttgcaagtccataatctattatatatacctgattggctttccttccgaggcccataaggaaattatcaggttttatgtcacgatgaagaaatcccttttgatgcatgtactcaactcgattaatcatctgatcagcgagcatgagcacggtcttgagcgagaactttctactgcagtagttgaagaggtcctcgaggctgggtccgagaagatcaatcaccatcacattatactctccctcgacaccaaaccacttgaggtgcggaatgccagttcctccttggagaagcatgtagagcttggactcgtaatggagctgcgggtgcttggtcttgacattttccagtttgacggcgacctcctctccggtctgcacattcacagcgaggaagagctccccgaaggatccgctcccgatcttcttgccgagcttgaacttgccgccgacgatgtgatccatccccggttaccgctgcctggctcccgacgaatcaacggccttgaccccctcccctcccctctcttaaccccgcgagatccaaaccggccgcggcggcgcctgggagcgaatcgagccgggatttcgcgcgcgagctcagatccagacacgccgccgagaaatccgggcgccgaccgagcggatatgtacagcaggacaggggagcaagaatcgaacaaacgaaacgaatcgaggcgagcgggccggcgggtcgggcgaggatatccggagaggcgggggcagaaactgggccttctccggaggaggcagcaagcagaccgggttcctacgggccggcggcgggaggggaggcaggagaagcggcggacggggagagggtgggggtggggttggcggcagagagcaaggcgaagacggcgaccagcaagggaaggtggggcgggggaaaggtggagg

SEQ ID NO: 27903 - DNA, 1488 bp, Triticum aestivum
  Clone ID: PAT_TA_27903
gcacgagggctagctatcgcctccccacctagcaattcacgtactccgccatggccccagccgtgatggcttcttccgccaccaccgccgcgcccttccaggggctcaagtcgaccgccggcctccccgtcagccgccgctcctgcagcgccggcctcagcagcgtcagcaatggcggaaggatcagatgcatgcaggtgtggccaattgagggcatcaagaagttcgagaccctgtcttacttaccacccctctccacggaggccctcctgaagcaggtccgactacttgatccgctccaagtgggtgccctgcctcgagttcagcaaggttggcttcgtcttccgtgagcacaacagctccccccgggtattatgacggtcgatactggacaatgtggaagctgcctatgttcgggtgcaccgacgccacacaggtgctcaacgaggtggaggaggttaagaaggagtaccctgatgcgtatgtccgcgtcatcggcttcgacaacatgcgccaggtgcaatgcgtcagcttcattgccttcaggcccaccaggctgcgaggaatctggcaaggcctaaagtgcaagttgaagtaaccgatatacatgtcatgttagtcaaatttgtcggcggctctgctttctcagttttacttctcgttctactcatatgtgaatatatgagcatatgtatgtaagcacctaccaatgtaggtccgtaggaggaatgccatatgagaattatagcaccggctataattctcatatgcatcctcctcgacctacgttggtaggtgcttacatacatatgctcatatattcacatatgagtagaacgagaagtaaaactgagaaagcagagctgccgacaaatgtgaattaacatgacatgtatatcaattatttcaacttgcactttaggccttgccagattcctcgcaacctggtggcctgaaggcaatgaagctgacgcactgcacttggcgcatgttgtcgaagccgatgacgcggacataggcgtcggggtactccttcttaacctcctccacctcgttgagcacctgtgtggcgtcggtgcacccgaacataggcagcttccacattgtccagtatcgaccgtcgtagtacccgggggagctattgtgctcacggaagacaaagccaaccttgctgaactcgaggcagggtacccacttggagcggatcaagtagtcgacctgctttaggagggcctccgtagagaggggtggcaagtaagacagggtctcaaacttcttgatgccctcaattggccacacctgcatgcatctgatccttccgccattgctgacgctgctgaggccggcgctgccggagcggcggctgactgggaggccggcggtcgacttgagcccctggaagggtgcgacggtggtggcggacgaagccatcacggctggggccatggcggagtacgtgaattgctaggtggggaggcgatagctagc

SEQ ID NO: 27904 - DNA, 874 bp, Triticum aestivum
  Clone ID: PAT_TA_27904
ttttttttttttctggtaataaatctgcaatttcatttcatctccggaaacctaacaatttcatagagttacacaccacacgcgatacatagaaactgcctagcagaatcgagacctgcatcaggggaggcatgaggcgtccattttgtacataccctgaacacaaacacaccaagggcaactaaaacccatcatgccatcggaccagatcaagcggcggcgactttgcggcccttcttggcggccggggagcggacggtcttgggcttcgccttggccttggccgcgggcgacttcttggccttggcgaccagcgtcttcttctccggcgccttgcgcttcgtgccagcagcggcggcggcggccttcttgggcttcgcggccgccttcttcttgggcttggcggcatcctttgcgggcttcgccgcggccttgggggcggcaggcttggccttgggcttgggcttgggcgcgtccttcttggcggcgtcggagagcttgtaggaggccttgaccttgatgagcttgcccttggaggcggacgcgcggagctggacggagagcatcttcttgaagttggccgggagggacttgccgtgcttctcctcgatgtacttggcgatggcgaccgagctggacccggtcctgtccttgagcgccgcgatcgcctccttgatcatctcgaagtaggccgggtgggaggggccggcggcgaccttcttcggcttggcggcggagggcttcgccttcggtgcggcggcggcgggcttggcgagggcaggcatggtggccaactgaagcggagctctgaaactgaaactgaaactgctacttgtgctgagcgcgcgtgaaattttcggagagttcgcggacg

SEQ ID NO: 27905 - DNA, 757 bp, Triticum aestivum
  Clone ID: PAT_TA_27905
aggaattcggcacgagggcgcaccaagcgccgcctcctcctccacgaacctcgattcagatcgcccttcacctcacctgggctcctgtttgattattccggtttgttcttgttccattgcgcccttctcaaggttagcaggagaccggccatggcgccgtcgcagcccaagtcagggctcttcgtgggcatcaacaagggccacgtcgtcaccaagcgcgagctgccgccacgcccgtccgaccggaaggggaaaggtaccaagagggtgctgtttgtccggaacttgattagggaggttgctggatttgctccctatgagaagcgtatcactgagcttcttaaggttggaaaggacaagcgtgcactcaaggtcgccaagaggaagcttggtactcacaagagagcaaagaagaagagggaggagatgtcaagtgtcctcaggaagatgaggtctggtggtggtggtgctgcggacaagaagaaatagattttgcatgttggtgaaattctatttatctcaatgcgttgccccgtatttccatattatgccaagtctgtagtctgtagcctgtggcaatttcaagttcagagtcaaactatgaattttcgacactatatttgcaagtggagtaacatggtagtacattgcattctgagttcagagtaaaaccgtgagtttttggcactatcttagtgggtggtttctattttgagaatacctatcaccttttcttcacagaaatcaagcgtctttg

SEQ ID NO: 27906 - DNA, 1974 bp, Triticum aestivum
  Clone ID: PAT_TA_27906
gccggccgggttgggctagaatcgctcattccctgtccctcctcctgtgtgcgccgccgccgctgcgcacaggccacatctcctcgccctcctcgacatctccggccaaggcgctcacttctccggcccccctccacatctcctcgccctccaccccatccacttcctgtcgaagacttctccggtcgtcctcctcatctcctcgcctccaccccatccacttcctgttctccaagactgcagcatggtgctcggcggctgcggcaacggagctgatggagcgcgagccgaccagttcaacggaggcagtagcacggggcagcggcagcagcatggagggcgtccgcttgactgggaaggagtggcagcggcaaccatgatgcaagtgcaattggttcccaaagctcttggaaaggaattaaagataataacttatatgatccttggaaccatacatggccgtattatgggggttttcattgtatgtactgtggcctaaagcacaaaggtggaggtgcaacccgtgccaaggagcaccttggttggattgtaggtaacgtgaggagctgcccaaatgtgccaagaaatgtgagagatgcaatgagagaggatagatgcaatggaagaagatacatttatggttgcagctgccgtccttgatccatatacacattacagcctcaacctttgcaaccatacagattatgctactgcactaacagatgcgatagcgaagatattagatccaaagagtgctctttcagccattgatgaagttagtaagtttagggagtgccaatgaaggtttgtgaccagattagcacaagaagctgcggcgagaatggagccaacccaatggtggtttcaatttggaggggatcttcctgcattgcagaagtgtgcaatgagagtttgctcacaatgtgtctcatctagtgggtgtgagaggaactagagcgcctttgctttggtgcacacaaagcaaagaaatcgccttttatatgacaagctccacaagctagtttctgtccgctacaacctaaagatacgtgctgaagaagatcaagagaaagagagagatatagataaagaggttgatccaagtgcattgctgakagakacaacaatgttcgatgagacaaatccaataatggagtggctgaatgaggatgaagaggatccagttttggatggagccgatgcggccagtgctgtttttgagaaaataaggcgcctcaactcaagcaggaaggattcttatgttggtacaaaggctaataagaagaaaagaaagaggaatcatgatgaggagaatgagtatgttgaaactgacagtgaggatgacgacaacgataatgaatatgttgataatgagagtgaggatgatgatggggtgagtgaggatgatgaggatgatcaacaagatcagcaagaaacacaaatgcaagtggaagaagagacacaagtacaagttgaaaaggagacacaagcaagcattggcaatttggagactcgtagatctggacgactagttaggaagaagaccaaggaaatcaacagcctctactcgtagatttgctggagcttggagctagctggagcttggagaatgatgctagttggaggcttggagcatggaagctggagctagtgatgatttcttttggagttgttgttcgttgtgatgctttgatggttgccttttgctgttcggtgtgatgctttgatggctgtcttttggagatgtttctacgtgaagtcctttaaattcctagagttggttgtactgaagtatttaaactttgaactatgatgtgatggttgtggactgtaagtttagaactaatgtgatggttgtggactgtaagtttatattggactgacgctcttattttaatccctagagctaatttgctaaccattatatgattactccctgatggctgttgggctgccaaaaaaaaaaaaaaaaaa

SEQ ID NO: 27907 - DNA, 1213 bp, Triticum aestivum
  Clone ID: PAT_TA_27907
ttcatggattggatacatagcagtagatacaatgtgatgttaactttcacaattctctgagacgattgtgcgctgagcaaatttatgatagtacagctgcaggcttgctgcataaacttcagagggcagagctcaaattgtacagacaaagcatcacacgacccgaagtttcatagcttggtagtgcttgagctaaacataggaagaacatttacaggcttctttgccgcgtatgattcctacacatttgttcttcacaaagcggcggatagaggaatggttgcttgcatgcctgttttacaggcatgtgtcgcaaagcagacatccgtcgtctcaaggaagttctgggtcttcaccagaatcagtgggatgtagtcaaggacaagcctcttgcactgcggttcatagttctttgccttgctgcatgttttgaaaagaagcccgactatctccagcttggtgttgggatccttaagcatggtaagaacttcaacaagaacatgatggcatagaccacaggcctcccctcgcgtggacgaccgagtcgccgccccctttgggcagaggtgcgctgactcacagagctcttcaggtttaaccacagaaacctccaagaagaaagcgggaatgtagtagtcaaccagcgtgatgcactgctgtcttagaggaccaagacttgcacacgtgtggtggagggcacttgagaatctcggcctgtgtttcgttttgtcgcaggtagacccagagcttcggttgagtattgctcaacatagtacacacagctttccgtttgccgaaaagttaatcttgacctctgcttgccagggagggagttttccttgggtcagtatgcaggcatatcgatctgcgctcctcatatatgcatctctgctctctgcgagcgcggccgaaaaggccagcacgagtagcacaaacgcaagcctcctcgacgtcctcgtcgagctcgccaccgccatgccagattcagcaagactcgttcttgtggcaccgccagaacaatcttccgtccccacgccagaacaaggcccgacgagatccaaaaacgtgcagcggatgctgctcgaatcgagcgtcgctcggtagatgcaggatgaacatggggggtccaacccaaccgggcagggcggagcaaatcaacaagtagtaaaatattctctcaggggaatcgcggagcagctcacccggttgactc

SEQ ID NO: 27908 - DNA, 669 bp, Triticum aestivum
  Clone ID: PAT_TA_27908
cggacgcgtgggtccggacgcgtgggcggacgcgtgggcggacgcgtgggctcccctctcgctctctccaccaaccaagaacagcaacacctcggcctcggagcgccgccgaatccgccgcccggcagaagggatccgaagctcccatggctggcaagtacatcgtcgccggcctcgtcggctcctgtgtcatctcgtacgcctgcgactacattgtttctcagaagaagatcttcggtggcaccatcccagggactgtgtccgacaaggagtggttgaaggcgacggagcagaggttccaggcctggcctcgcgtcgccggcccgccggtcatcatgaaccccatcagccgccagaacttcatcgtcaaggacctcaacccctgaggcccaagaccttgaggtttgcggtcggttggaacctttaccctgatggcgatgcctgttgctaaatctacctatatgtgctggctgtactctcgaggctattttgtctgtctcaataattaaaacaacactattgtgtagggcgccgtggctatatttcttctgaagaacagaagagaacctgaagcatatttgctttggactttttgtcatcttttgtttgcataaacatatgtttacttttcaatttgtgcttgtcggagcattggagtatgtgccttgc

SEQ ID NO: 27909 - DNA, 955 bp, Triticum aestivum
  Clone ID: PAT_TA_27909
ttgtaaaacgacggccagtgaattgtaatacgactcactatagggcgaattgggtacacttacctggtaccccacccgggtggaaaatcgatgggcccgcggccgctctagaagtactctcgagtttttttttttttttttttccagctgcaaacaaagtaacatttccatcaactgatggcatgacaataatccgcggattgcatataatatatgtgtgtatgtatagccggtgctataattctcatatgcatcctcctcgacctacgttggtaggtgcttacatacatatgctcatgtattcacatacgagtagtacgagaagtaaaaccgagaaagcagagctgccgacaaatgtgaactaacatggcatgtatatgcgttacttcaacttgcactttaggccttgccagattcctcgcagcctggtggcctgaaggcaatgaagctgacgcactgcacctggcgcatgttgtcgaagccgatgacgcggacataggcatcagggtactccttcttgacctcctccacctcgctgagcacctgcgttgcgtcggtgcacccgaacataggcagcttccacattgtccagtatcgaccgtcgtagtagccgggggagctgttgtgctcacggaagacgaagccaaccttgctgaactcgaggcagggcacccacttggagcggatcaggtagtcgacctgctttaggagggcctccgtggagaggggtggcaagtaagacagggtctcgaacttcttgatgccctcaatcggccacacctgcatgcatctgatccttccgccattgctgacgctgctgagaccggcgctgccggagcggcggctgacggggaggccggcggtcgacttgagcccctggaagggcgcgacggtggtggcggacgatgccatcacggctggggccatggcacgtgaattgctaggtggggaggcg

SEQ ID NO: 27910 - DNA, 660 bp, Triticum aestivum
  Clone ID: PAT_TA_27910
ggggagacctcgcctcgcgcacaggcgagcacatataaaagggcgtccgccgatctagggtttcttctgggacgcaggcggcggcttagggttttaactcgcatccattctcaaggttagcaggaggcgggccatggcgccgtcgcagcccaagtcagggctcttcgtgggcatcaacaagggccacgtcgtcaccaagcgcgagctgccgccacgcccgtccgaccgcaaggggaaaggtaccaagagggtgctgtttgtcaggaacttgattagggaggttgctggatttgctccctatgagaagcgtatcactgagcttcttaaggttggaaaggacaagcgtgcactcaaggtcgccaagaggaagcttggtactcacaagagagcaaagaagaagagggaggagatgtcaagtgtcctcaggaagatgaggtctggtggtggtggtgccgcggacaagaagaaatagattttgcatgttggtgaaattctatttatctcaacgctttgccccgtatttccatattatgccaagtttgtagcctgtggcaattggatacgaatgtagcacattgcacttcaagttcagagtaaaactatgaatttttgacactatatttgcaattggattgacatggtagtacattgcattctgag

SEQ ID NO: 27911 - DNA, 1848 bp, Triticum aestivum
  Clone ID: PAT_TA_27911
cccacgcgtccgatcccccacctccaccccctcccccgcaaccaccaccaccggaccaccgtcaccggcggcgaaggcacgatgagggagatcctgcacatacagggcgggcagtgcgggaaccagatcggggccaagttctgggaggtgatctgcgacgagcacgggatcgacgggacggggcgctacgcgggggactcggacctgcagctggagcggatcaacgtctactacaacgaggcgagcgggggccggttcgtgccccgcgccgtgctcatggacctcgagccggggaccatggactcggtgcgctccggccccttcggccagatcttccgccccgacaacttcgtcttcggccagtccggcgccggcaacaactgggccaagggacactacaccgagggcgccgagctcatcgattccgtcctcgacgtcgtccgcaaggaggccgagaactgcgactgcctccagggattccaagtttgccattccttgggaggaggcactggatctgggatgggcacccttcttatttctaagattagggaggagtaccctgaccgaatgatgctgacattctctgtcttcccatcaccaaaggtctccgacaccgttgttgagccatacaatgctacactttctgttcaccaacttgttgagaacgctgatgagtgtatggtgcttgacaatgaagctctatacgacatatgcttccgcacactaaagcttgccaccccttcctttggtgacctgaaccatcttatctctgctaccatgagcggtgtcacatgctgcctgaggttccctggacaactcaactccgatcttcgcaagcttgctgtgaatctcatcccattcccccgcctccacttcttcatggttggcttcgcaccactgacgtcgcgtgggtcacaaatgtaccgtgctctcacagtccctgagctgacccagcaaatgtgggatgccaagaacatgatgtgcgccgcagacccccgccatggccgctacctcaccgcctcggcctgcttccgagggaagatgagcaccaaggaggtggacgagcagatgctcaacgtccagaacaagaactcgtcgtactttgtggagtggatccccaacaacgtcaagtcgagcgtgtgcgacatgccgcccagggggctgaagatggcgggcaccttcgtcggcaactccacgtccatccaggagatgttccgcagggtgagcgagcagttcacggccatgttcaggaggaaggccttcctgcactggtacacgggcgagggcatggacgagatggagttcaccgaggccgagagcaacatgaacgacctcgtcgccgagtaccagcagtaccaggacgcgaccgccgacgaggagtacgacgaggaggaggaagaggaacgcgacgcggagtagtggcgccgtgccctgctccaccccagctatatgtcccccggttcaggtctgtcgccatgtccaggtcgcgtttcctccggtgagggtttgtgtggtttcctcctgtggcttggatgagtcgaggttgcgtcttgtgctccgttttgtaatttgctacggctagtagtgcgttgcagtctgtcgtgttcagcatcatttggtcagtcggtccatagctgacgatggcctgaactgtcgagtgctctccttgagctagtcgtcgccttgtaagttctgacaagtattattgttagtcgttcgcttcagcaaccaaaaaatgagtattggtagtggtttctcattatctttgtgaatattgtacttatgtcggaatgtttttgccttgttatttgtgtatatttcgtaaaaaaaaaaaaaaaaaaaaaaaaa

SEQ ID NO: 27912 - DNA, 1713 bp, Triticum aestivum
  Clone ID: PAT_TA_27912
gccgggttgaacagatccgcgcctccactccccctcccccttcctcctcccctccaaacctcgccggaaccctacccctcccccgtcgccgccatgagggaaatcctccacatccagggcggccagtgcggcaaccagatcggggccaagttctgggaggtgatctgcgacgagcacggcatcgaccagaccggcaagtacgccggcgactccgacctccagctcgagcgcatcaacgtctactacaacgaggccagcggcggccgcttcgtgccccgcgccgtcctcatggacctcgagccggggaccatggactccctccgctcggggccctacggccagatcttccgccccgacaacttcgtcttcggccagtccggcgccggcaacaactgggccaagggccactacaccgagggcgccgagctcatcgactccgtcctcgacgtcgtccgcaaggaggccgagaactgtgactgcctgcaaggatttcaagtttgccactctctgggaggaggaactggttctggtatgggtacactgctcatctccaagatcagggaggagtacccagataggatgatgttgacattctcagtcttcccatcaccgaaggtgtctgacactgtggtggaaccttacaatgctacgctctctgtacaccaacttgttgagaatgctgatgagtgcatggtgcttgacaatgaggctctctacgacatctgcttccgcactctgaagcttgctacacccacatttggtgatctgaaccatcttatatctgcaacaatgagcggtgtcacttgctgcctccgcttccccggtcagctgaactccgacctccggaaactcgcagtcaacttgatcccgttccctcgcctccatttcttcatggttggctttgcaccactgacctcaaggggttctcagcagtaccgtgccctcactgttcctgagttgacccagcagatgtgggactcaaagaacatgatgtgtgctgctgacccgcggcacggccgctacctcacagcctctgccatgttccgtgggaagatgagcaccaaggaggttgacgagcagatgctgaacgtccagaacaagaactcatcatactttgtggagtggatacccaacaatgtgaagtcaagcgtgtgtgacatccctcccacaggcctgtcaatgtcgtccacctttgtcggcaactccacctccatccaggagatgttccgccgtgtgagcgagcagttcactgccatgttcaggaggaaggctttcttgcactggtacaccggggagggcatggatgagatggagttcaccgaggcggagagcaacatgaacgatctggtcgctgagtaccagcagtaccaggatgccacagccgacgaggaggaagagtatgacgaggaggaggaagaggaggctgcctaagccacctgacctcatatggtcatcctgctgtctgttagatatgccttgtgtttactattgctgtcgatttggtggtgcttgtggtgcggatagatctttaggtggttggtaacacttatagatgcttttgctgcttcggcgaatcgatattttttgaactgttttttttttgtatgttgatggtggttttatgcgaactgtgatattagcgtaactgtgggcttgatacccgtaaatttgccaactatattttgtgtctaaaaaaaaaaaaaaaaaaaaaaa

SEQ ID NO: 27913 - DNA, 958 bp, Triticum aestivum
  Clone ID: PAT_TA_27913
gaattcggcacgagcaccactccatctcccgcgcgcgcgtgtggcctccgctcctctccccatctcctctctcgccaaggaccaccgagcttggagcgccaccgccatggccatggccacgcaagcctcggcggcgacgcgccacctgatcaccgcggcctggtcgccatccgccaagccccgccccgccaccctcggcatgccctccgcccgtggcccggccccgctctgcgccgcggccccggacacccccgcccccgccgcgccgccggcggagcccgcccccgcgggcttcgtgccgccgcagctggacccgtccaccccgtccccgatcttcggcggcagcacgggcggcctcctccgcaaggcccaggtcgaggagttctacgtcatcacctggacctcccccaaggagcaggtgttcgagatgcccaccggcggcgccgccatcatgcgcgagggccccaacctcctcaagctcgcccgcaaggagcagtgcctcgccctcggcaaccgcctccgctccaagtacaagatcgcctaccagttctaccgcgtcttccccaacggcgaggtgcagtacctccaccccaaggacggcgtctacccggagaaggtcaacgccggcaggcagggcgtggggcagaacttccgcagcatcggcaagaacgtcagccccatcgaggtcaagttcaccggcaagaactccttcgacatctaatctcgtacgtcgtatatgcgtacgtgctagttcatcgaccggtagttattggcgggtggcgatgatgatggacgtcctgtaattttaattgtcgagtttgaatgctggattcgatcggtgataatgatgcatcaggttatatgtacatggtaatttgatgatgatactgctgtatgttaacgttgttcatatgcatgatcggcttcttttcatgttgatgatgagtagtaatttgtt

SEQ ID NO: 27914 - DNA, 608 bp, Triticum aestivum
  unsure (1)..(608): unsure at all n locations
  Clone ID: PAT_TA_27914
accggatcgttcgtagccggacgggccggaatataaaaaaaccgccgccactcccattcgctcgcctcctccaaccctaagcgatgacgaagggtaccggcagtttcggcaagcgccggaacaagacccacacgctctgcatccgctgcggccgccgcagcttccacctccagaagagcacctgctcctcctgcggctaccccgccgcccgcatccgcaagtacaactggagtgtgaaggccatcaggcgcaagaccaccggcactggaaggatgaggtacatgcgccacgtgcctcgcaggttcaagagcaacttcagagaaggtaccgaggctgcgcccaggaacagggccgcggccaactagttctggattttgccccatcaggaataccctgaagctagaatttaaagactttttgcttgggttgtaccccgcctaaactattgttgctatagaattgagtatggatctgatatgttttgttgcatgggtttggaaattgacctctgaatctaagtccaaatttgtctgaatgttacaattgtttgtgggtttaaagggcatctgctttccaatctagtgaattttggagggctnaaaaaaaaa

SEQ ID NO: 27915 - DNA, 858 bp, Triticum aestivum
  Clone ID: PAT_TA_27915
ggggtgttggggttttttttttttttttttttttttttttttttttttgaattaataacagcaagacaatggtccgcatgttttatataataaatatcacacaggttttgtatatgtgtagccggctctagaatttacatatgcatgctcgagaatctatgttcgtacatacatacacagaccatatagaatgaaaaatatgctctggtcgtccagcagagtcgtggacaaaagtgaagttcacaaaagaccttcatacataggccattgtttcaactcgtagtttaggccttgccagactcctcgcaacccggtggcctgaaggcaatgaagctgacgcactgcacctggcgtaggttgtcgaagccgatgacgcggacataggcgtcagggtactccttcttgacctcctccacctcgttgagcacctgtgtggcgtcggtgcacccgaacataggcagcttccacattgtccagtatcgaccatcgtagtacccgggggagctgttgtgctcacggaaaacgaagccaaccttgctgaactcgaggcagggcacccacttggagcggatcaagtagtcgacctgcttcaggagggccctccgtggagaggggtggcaagtaagacagagtctcgaacttcttgatgccctcaatcggccacacctgcatgcacctgatccttccgccgttgctgacgctgctgaggccggcgctgctggagcggcggctgacgggcaggccggcggtcgacttgagaccctggaagggtgcgacggaggtggccgaggaagccatcacagtgggggccatggtgttggaggagagaaggtgacctcgtaccgaattcggcacgag

SEQ ID NO: 27916 - DNA, 1765 bp, Triticum aestivum
  Clone ID: PAT_TA_27916
tcggcacgaggctccgctccaaaacccccacccccgcctcgccggaaccctaaccctagccccgccgccgccgcccccgccccgccgccatgagggagatcctccacatccagggcggccagtgcggcaaccagatcggggccaagttctgggaggtgatctgcgacgagcatggcatcgaccagacgggcaagtacgccgggcgactccgacctccagctcgagcggatcaacgtctactacaacgaggccagcggcggccgctacgtgccccgcgccgtgctcatggacctccgagcccggcaccatggactcgctgcgctccggggccctacggccagatcttccgccccgacaacttcgtcttcggccagtccggcgccgggcaacaactgggccaagggccactacaccgaagggcgccgagctcatcgactccgtcctcgacgtcgtccgcaaggaggccgagaactgcgactggcctccaagggatttcaggtctgccactcgctgggaggaggcactggctccggaatgggcaccctgctcatctccaagatcagggaggagtacccggaccggatgatgatgacattctcggtgttcccatcgcccaaggtgtctgatactgttgtggagccatacaatgctacgctctctgtgcaccagcttgttgagaatgcggatgagtgcatggttcttgacaacgaggctctctacgacatctgcttccggacgctcaagcttaccacacccaccttcggtgatctgaaccaccttatctctgcaactatgagtggtgttacctgctgtctccgcttccctggacagctcaattcagacctccggaagcttgctgtgaacctgatcccgttcccaaggctgcacttcttcatggttggatttgctccgctaacctcgcggggttcacagatgtaccgtgccctcactgtgcccgagctcacccagcagatgtgggactccaagaacatgatgtgcgccgccgacccaaggcacggtcgctacctcaccgcctcagccatgttcccgtgggaagatgagcaccaaggaggtggatgagcagatgttgaacgtgcagaacaagaactcgtcctacttcgtcgagtggatccccaacaacgtcaagtcgagcgtgtgtgacatcccgcccactggcctgaagatgtcttcgacgttcgtcggcaactccacatcgatccaggagatgttccgccgtgtgagcgagcagttcaccgccatgttcaggaggaaggccttcttgcactggtacacgggcgagggcatggacgagatggagttcaccgaggccgagagcaacatgaacgacctggtggccgagtaccagcagtaccaggatgcgacggtcgaggaggaagaggactatgaggatgagcaggaggatgaggaggccgcctaagcgggcttccccctttcttcccagggatatgccttatatatcgctcgttatgtcgttggagtgctcgtggtgctgttaggtgatgatagctagatgctatttttttccgttctaaatgtcggtcgtgttgccttgacagacttattttttcgttatgtggacctgtggttgtcgtgtatgctcatgtcgtgatgagcgtttggtgtaaggtttgactgtgactgcttggtgtgttattcagtagtgttgctagactgcaaaatctctgtttcgtgtccagtatttttgggccaagttgccaaaaaaaaaaaaaaaaaaggcccctaa

SEQ ID NO: 27917 - DNA, 1638 bp, Triticum aestivum
  Clone ID: PAT_TA_27917
gaggaattcggcacgaggccgcctcctacccccacccctccgctcccctctcgccgccgattgttctgcctgcgggaaccatctcatatctcggcgaagatgagggaaatcctgcacatccagggcgggcaatgcggcaaccagatcggtgccaagttctgggaggtggtgtgtgatgagcatggcattgacccaactgggcgctacaccggtacctctgacctgcagttggagcgtgtcaatgtctactacaacgaggcctcctgtggtcgctttgtgccccgggctgttcttatggaccttgagcctggtaccatggacagtgtccgcactggcccttatgggcagatcttccgccctgacaacttcgtctttgggcaatctggtgccggtaacaactgggccaagggccactacaccgagggtgctgagcttatcgattctgttttggatgttgtgaggaaggaggctgagaactgtgactgtctgcaaggattccaagtatgccactctcttggtggtggtaccggatctggcatgggtaccctcttgatatctaaaatcagggaggagtaccctgaccgcatgatgctgacgttctcagtgttcccctcaccaaaagtatctgatactgtggttgagccatacaatgcaactctctcagtccatcagttggttgagaatgctgatgagtgcatggttcttgacaacgaggctctctatgacatctgtttcaggactcttaagctgaccacacctagctttggggacttgaaccatctaatctctgctaccatgagtggagtcacctgctgcctaaggttccctggtcagctgaattccgacctccggaagctggcagtgaaccttatcccgttccctcgcctccacttcttcatggtgggcttcgctccattgacatcccgtgggtctcagcagtaccgtgccctcacggtcccagagctcacacagcaaatgtgggatgccaagaacatgatgtgcgccgctgatcctcgccatggccgttacctcaccgcctctgccatgttccgtggaaagatgagcacaaaggaggtggacgagcagatgatcaacgtccagaacaagaactcgtcctactttgttgagtggatccccaacaacgtgaagtccagtgtctgtgacatcccgccgacggggctctccatggcgtccacctttgttggcaactcgacctccatccaggagatgttccggagggtgagcgagcagttcactgccatgttcaggaggaaggctttcttgcattggtacactggtgaaggcatggacgagatggagttcaccgaggcggagagcaacatgaacgaccttgtctcggagtaccagcagtaccaggatgccactgccgacgaggagggtgagtacgaggatgaggatcaggaggccgaggaggacatgtaaggagggaggtccatgtggtgctttgctgggtgggggggttctgggggcagagtttgatctgtttggtgctttgttatgaatctgtttatcatcgcaactaccgcttgtacgccaccgccgctcttcctgtacggaatctgttttctatgttatgaatctattttctatgttatggcacctcctgggtattgtatc

SEQ ID NO: 27918 - DNA, 670 bp, Triticum aestivum
  Clone ID: PAT_TA_27918
gattccaaaatctttctcccctctcgctctctccaccaaccaagaacagcaggaactcgacctcggagcagcaacgaatccgccgccgcccggcaaaagggatccaaagctccaatggctggcaagtacatcgtcgccggcctcgtcggctcctgtgtcatctcgtatgcctgtgactacatcgtttctcagaagaagatcttcggtggcaccatcccagggactgtgtccgacaaggagtggttgaaggcgacggagcagaggttccaggcctggccccgggtcgctgggccgccggtcatcatgaaccccatcagccgccagaacttcatcgtcaaggacctcaacccctgaggctcaagatcttaaggtttgcggtcggttggaacctttaccctgatggcgatgcctgttgctaaatctacctatgtgtgctggctgtactctcgaggctattttgtctgtcgcaataattaaaacaacactattgtgtagggcatcgtggttatatttcttctgaagaacagaagagaacctaaagcatgctttttgtcatcttttgtttgtataaacatctgtttacttttcaatttgtgcttgtcagagcatcggagtacttgccttgcaaattcagaccctttccttgcgttgcaaattcagaccctttcct

SEQ ID NO: 27919 - DNA, 820 bp, Triticum aestivum
  Clone ID: PAT_TA_27919
ttttttttttttccatcaattgatggcaagacaataattcacggattgcatataatatatgtgtgtatgtatagccagtgttgtaattctcatatgcatcgtcctcgacctacgttggtaggtgcttacatacatatgctcatatattcacatatgagtagaacgagaagtaaaaccgagaaagcagagctgccgacaaatgtgaactaacatggcatgtatatgtgttacttcaacttgcactttaggccttgccagattcctcgcagcctggtggcctgaaggcaatgaagctgacgcactgcacctggcgcatgttgtcgaagccgatgacacggacataggcgtcagggtactccttcttgacctcctccacctcgttgagcacctgcgttgcgtcggtgcacccgaacataggcagcttccacattgtccagtatcgaccgtcgtagtagccgggggagctgttgtgctcacggaagacgaagccaaccttgctgaactcgaggcagggcacccacttggagcggatcaggtagtcgacctgctttaggagggcctccgtggagaggggtggcaagtaagacagggtctcgaacttcttgatgccctcaatcggccacacctgcatgcatctgatccttccgccattgctgacgctgctgaggccggcgctgccggagcggcggctgacggggaggcccgcggtcgacttgagcccctggaagggcgcgacggtggtggcggacgatgccatcacggctggggccatggcggagtacgtgaattgctaggtggggaggcgcctcgtgccgaattc

SEQ ID NO: 27920 - DNA, 1726 bp, Triticum aestivum
  Clone ID: PAT_TA_27920
gagggctctctccccccaacccaatccccatcccccctcatccccccacgcgcgacgcgaactcttcaatcctctcctcagggagcgtagggaggcgaagatgagggagatcctgcacatccagggcgggcagtgcgggaaccagatcgggtccaagttctgggaggtggtgtgcgacgagcacggcatcgaccccacggggaggtacgtcggcacctccgacctgcagctggagcgcgtcaacgtctactacaacgaggcctcgtgcggccgcttcgtgccgcgcgccgtgctcatggatctcgagcccggcaccatggactccgtgcgcacggggccctacggccagatcttccgccccgacaacttcgtcttcggccagtccggcgccggcaacaactgggccaagggtcactacaccgagggcgcggagctcatcgactccgtcctcgacgtcgtccgcaaggaggccgagaactgcgactgcctccaaggcttccaggtgtgccactccctcggcgggggcaccggttccggcatgggcacgctgctgatttccaagatcagggaggagtacccggaccggatgatgctcaccttctccgtgttcccatcccccaaggtgtctgacaccgtggtcgagccctacaacgccaccctctcggttcaccagctggtggagaacgccgacgagtgcatggtgctggacaacgaggcgctctacgacatctgcttccgcaccctcaagctgaccacacctagctttggtgacctgaaccacttgatcagtgccaccatgagcggtgtcacctgctgccttcgcttcccaggacagctgaactcagacctccgcaagctcgccgtcaacctgatccccttcccgcgcctccacttcttcatggtgggctttgcgccgctcacatctcgtgggtcacagatgtaccgccccctcactgtccctgagctcacacagcagatgtgggactcgaagaacatgatgtgtgctgctgacccgcgccatggccgctacctcacagcctcggccatgttccgtggcaagatgagcaccaaggaggttgacgagcagatgatcaacgtgcagaacaagaactcctcctacttcgtggagtggatcccgaacaacgtcaagtcaagcgtgtgtgacatcccaccacgcggcctctccatggcgtccaccttcattggcaactccacctccatccaggagatgttcaggcgtgtgagcgagcagttcacggccatgttcaggaggaaggctttcttgcattggtacactggcgaggggatggacgagatggagttcactgaggccgagagcaacatgaacgaccttgtctccgagtaccagcagtaccaggacgccactgccgacgaggagggcgagtacgaggaagaggaagagctggagcaggagtaagatcggtgacgattgcatctctccgtttatgtggtattgtggttttcgtacaactggagcttgttactagtagagactagagggtaccatggctacaactctgctgcttgcttgcgtgtcttggcatgtattggatttgtactgcgttcgtttgtaggcatgttcactcgatgctatgtttctttgcgtgaattatttattctatgtgaggtttcaagcaagtggatttgaaatacagtagaatgctttgtagtttgaacaatgatatgctcattctgcatgttgtcc

SEQ ID NO: 27921 - DNA, 944 bp, Triticum aestivum
  Clone ID: PAT_TA_27921
gccggccgggttccggagctagcatgcgacgcctgcgcccgccgcccgccccgacccacgttaggggcgcttgcgcccccaagggcccgtgccattggctaagccggtccggccgaagtgccgcggtcggccgcctcgaagctcccttcccaacgggcggtgggctgaatcctttgcagacgacttaaatacgcgacggggcattgtaagtggcagagtggccttgctgccacgatccactgagatccagccccatgtcgcacggattcgtccctgcgtccattctcaacgttagcaggagcgagtgggagtccggccatggcgccgtcgcagcccaagtcagggctcttcgtgggcatcaacaagggccacgtcgtcaccaagcgcgagctgccgccacgcccgtccgaccgcaaggggaaaggtaccaagagggtgcattttgtcaggaacttgattagggaggttgctggattcgctccctatgagaaacgtatcactgagcttcttaaggttggaaaggacaagcgcgcactcaaggtcgccaagagaaagcttggtactcacaagagagctaagaagaagagagaggagatgtcaagtgtccttaggaagatgaggtctgctggtggtggtggtgctggtgacaagaagaaatagagcgtggctagtcggtgaattttatcccaaaactctgtcctgtattaccagtccgtacctttagagctatctatggccatagtgttggattttggaattaagcccgtggtttctattttgagaagaccaatctttttaagatatttatgtcagattggtgcctttgttttattgttacttgctttgtttgattacttgatacccagctgtttattcggttatgtagcttgtcggggttttgtacatgcgattgttttatgttttcagaagacgtattgctgtag

SEQ ID NO: 27922 - DNA, 761 bp, Triticum aestivum
  Clone ID: PAT_TA_27922
gtgctctcttcttcctcctctcctctttcctcggcggcggcgcaggcggcgcagcggcgacaggagaaggcgaaatgacgaagggaacgggcagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccacgtgcccaggaggttcaagagcaacttcagagagggaactgaggccgcaccaaggagcaagggagcctcttccagcggcaactaggtgtgacagtctccatttgttgccctaagcgaagccctgatcatcaaacttagctttttttgttgatttctactggaactctatgtttctatgtcgagaggcagacgatatggtgcctggttatgttatttgcacaattgtcgtggacattaatccttcagttttgaatgttgaatcgtgtcgatgtcctgtgttagatgctgcatctcttgttcaatgtgctatttgtgatgagtctttttgttgtttcaatatgagatatttgctcaagttgttatgcatgtaatagatcatgacatggtcactcacatagtgtttgtctgttaatatttatgctgtgcaggtccagcaagaacataaaaatgcaactttcaatgtgaatagctcaatggtccg

SEQ ID NO: 27923 - DNA, 489 bp, Triticum aestivum
  Clone ID: PAT_TA_27923
caaaattaagccatggagacaaatttaacaagggtggcatatagcaaaggttctttacttggcacagcatggtaacatgagtacaccagagtacaagcaatcctcatgacatagacgaaattgataacagagacagcatcctggaatcacttcctagcttgcataacaaacactaaaacgtccataaaacaaaatgcagataagtcttggaaccatggctcccccacgcggcggtcggcaggcacggatctagaacccgagcttggtgcggcgccagtgcctgcgcttcgcgttgtacctgatggtgttgtcggtccgcatgcggatccagtaggggatggggcggttctggcgctgcttcttggccagcttctgcttgatgcggaaggtcttgtgggacggcatcgtcgcggcggagacgaagacgcggcagcggcttcggcggcggcggcggcggcgggagcaaaaccccccacgcgtccgcggacg

SEQ ID NO: 27924 - DNA, 1083 bp, Triticum aestivum
  Clone ID: PAT_TA_27924
atatgaaatccatgtttactatcataaataatcatgtagtatgaaatttgcagtctcgttcatgtgtcgattaattcactcactgtacaaatatttgagggcaatgctactaatttaacgcatatatggtatcaatatactatgtactacattttcctttatttctgcaccgtgtacaacatgaagagtagagtcgtttatcactcactcttcttcacacctctgcttgttgatgtaccagttgttcctcgttgacaaagaaggcgtggaacccgtaaggaacccggttcggcagctcgacgaccgccaccggatcaggagacatggtcttggcatcaatcacattcacttcagacttccctgtgttctcatcatgcacaaagagtatcaggtagccgtcatcttcttccccagacacaccgggctccttgggcacaaagaccgcctccgagccgaacctaccaggtcccaggtcatatatgcccatcacattccccccaacttcaagctgcttcttgccgctctctggctcggcgtgcaggtcgaatttgatgacgccagtcaccttcgctatgctgtcgagtatcgtgcagtacacgggcgagggcatggacgagatggagttcaccgaggccgagagcaacatgaacgacctggtggccgagtaccagcagtaccaggatgcgacggtcgaggaggaagaggactatgaggatgagcaggaggacgaggaggccgcctaagcgggacctgcggcaccaacgacggcaaggacgagttctggatctgctgcgacaactgcgagaagtggtaccacggcaagtgcgtcaagatcacgcccgcccgggcggagcacatcaagcactaccggtgcccggagtgcaccaacggcggctccaacagcaacaagagggtcaagacatgagcggggcggcgccggaggaggaaagccgcgccgcgcttgctgcgaggaaaaccaagcaatcttcgcccggcctctagataccatttattcatggcttagtttccttcctagtctgtaagcgtgtttcatcatcatgttttaagaaaacttgagatttt

SEQ ID NO: 27925 - DNA, 734 bp, Triticum aestivum
  Clone ID: PAT_TA_27925
gccggccgggtcgggattccagaatctttctcccctctcgctctctccaccaagaacagcaagacctcgacctcggagcaccaaggaatccgccgccgcccggcaagctccaatggctggcaagtacatcgtcgccggcctcgtcggctcctgtgtcatctcgtacgcttgtgactacatcgtttctcagaagaagatcttcggtggcaccatcccagggactgtgtccgacaaggagtggttgaaggcgacggagcagaggttccaggcctggccccgggtcgctgggccgccggtcatcatgaaccccatcagccgccagaacttcatcgtcaaggacctcaacccctgaggctcaagaccttaaggattgcggtcggttcgaacctttaccctgatggcgatgcctgttgctaaatctacctatatgtgctggctttactctcgaggctatttggtctgtctcaataattaaatcaacactattgtgtagggcaccgtggttatatttcttctgaagaacagaagagaacctgaagcatatttgctttggactttttgtcatctttcgtttgcataaacatatgtttacttttcaatttgtgcttgtcggagcattggagtatgtgccttgcaaattcagaccctttccctaactccagactaggatccagatggccttgttctcgagaggtttcttttgagtaatgcttattgcttgtgttggtaaactc

SEQ ID NO: 27926 - DNA, 2074 bp, Triticum aestivum
  Clone ID: PAT_TA_27926
atgtgatggcgaacggtcaaacttatgccacatcacacgaagtatatcgcagcaaacctccccagtaacagtcaagtattaacctaaacccttaacgactgtatgtatttcgagtccattggtatccagtgccaaaattgaacatacacctcgagtaggatgaccacggatgtatgtattacactctttcatccacaacaggcaagcacggacgccgccttggcctgcttgtgttgctggcgatggcgagaggcccgtcgagagaagactcacttcttctccgctgctttatggtctggattcttcagtatgccaccgtcgatgagcagctgcacctcggatttcgcaagatccttcaccttggaatcccgagattccagataggcagccagcaccttggagctgaatccatctgcatataacttgcacttccctttgagggcttttttccagagggtagcagcaaatgcaggacaatcaagtatcattctcctgattgtacggctggagtggtagttatcaaaggcgtgctcatcaccatcatctgtcctcgggcgtgctgcgtcacaagctatagcattgtgaagtacgtggatcctgtcagtgaccccctccaagaagttattttttccacctacagcaacctcatatagtacatctttgccaaagtttgttcgaagtaactgtccaacattttcaatgcaagtctcaatgagaacctcataaagctcacttttcaccaacagttcttgccgccgtttaatcgggtcctccttgctatcagatgcaatcagtgtgtcttctgaacccccatgttctttgtcagctacatcatccaacttactaccaaagttaactttagtagcactctctgatgcctcatcctttgaaacaagggaaggcacgttgtaattcagataaaacaattcacccagagtcagataacgtgaacaaagtgggtgaaagagctgcagcaatgggtgtctcccgttcttgtcgaatatgagttcctttaactgctttttcaacacatcaattacaacctcagtaacaagttctgtgttgtcaacaatggagagaagacaagcaaggaaaaggcatccataatcaccaagagcaagcttcatattctgccccttcaagcttttgataattttcttcctatcctccgcaaggccatgcttgaggcaagcaagccctaattttaatccttccttcgtctgcatgatctgaatgagaagtggttttgaagatcttttcttctccacttctggtttccctagtaatctggcgacacctgatagttcatctaaggcgtatgtccgttcagtaagatgggggattaattgacgaatcacgtccaaggctgatgtcttatctgcaattgttaagtacaaacacagatcataccgaaggaaaaatatgctctggtcgggaagcagagtcctggacaaaagtgaagttcacaaaagacaatcatacataggccattgttttaactcgtagtttaggccttgccagactcctcgcaacccggtggcctgaatgcgatgaagctgacgcactgcacctggcgcaggttgtcgaagccgatgacgcggacataggcgtcagggtactccttcttgacctcctccacctcgttgagcacctgcgtggcgtcggtgcacccgaacataggcagcttccacattgtccagtatcgaccgtcgtagtacccggaggagctgttgtgctcacggaagacgaagccaaccttgctgaactcgaggcagggcacccacttggagcggatcaggtagtcgacctgcttcaggagggcctccgtggagaggggtggcaagtaagacagggtctcgaacttcttgatgccctcaatcggccacacctgcatgcacctgatccttccgccattgctgacgcggccgaggctgccgctggagcggcggctgacggggagaccggctgtggacttgagcccctggaagggtgcgacggtggtagccgacgaagccatcacggcgggggccatggtattgtattatcggaggagaggaggatgccctcgtgccga

SEQ ID NO: 27927 - DNA, 1680 bp, Triticum aestivum
  Clone ID: PAT_TA_27927
cgtccgcacaccccctcctaccccaccctccgctcccctctcgccgcccattgttctgcctgcggggaccatctcatatctgggccaagatgagggaaatcctgcacatccagggtgggcaatgcggcaaccagatcggtgccaagttctgggaggtggtgtgtgatgagcatggcattgacccaactgggcgctacaccggtacctctgacctgcagttggagcgtgtcaatgtctactacaatgaggcctcctgtggtcgctttgtgccccgggctgttcttatggaccttgagcctggcaccatggacagtgtccgcactggcccttacgggcagatcttccgccctgacaacttcgtctttgggcaatctggtgcgggtaacaattgggccaagggccactacaccgagggtgctgagcttatcgattctgttttggatgttgtgaggaaggaggctgagaactgtgactgtctgcaaggattccaagtatgccactctcttggtggtggtaccgggtctggcatgggtaccctgttgatatctaaaatcagggaggagtaccctgaccgcatgatgctgacgttctcagtgttcccctcaccaaaagtatctgatactgtggttgagccatacaatgcaactctctcagtccatcagctggttgagaatgctgacgagtgcatggttcttgacaatgaggctctctatgacatctgtttcaggactcttaagctgaccacacctagctttggggacttgaaccatttaatctctgctaccatgagtggagtcacatgctgcctaaggttccctggtcagctgaattccgacctccggaagctggcagtgaaccttatcccattcccccgcctccacttcttcatggtgggctttgctccattgacatcccgtgggtctcagcagtaccgtgccctcactgtcccagagctcacacagcaaatgtgggatgccaagaacatgatgtgcgccgccgatcctcgccatggccgttacctcactgcctctgccatgttccgtggaaagatgagcacaaaggaggtcgacgagcagatgatcaacgtccagaacaagaactcatcctactttgtgggagtggatccccaacaatgtcaagtccagcgtctgtgacatcccaccgacagggctctccatggcgtccaccttcgttggcaactcgacctccatccaggagatgttccggagggtgagcgagcagttcactgccatgttcaggaggaaggctttcttgcattggtacactggtgaaggcatggacgagatggagttcactgaggctgagagcaacatgaacgaccttgtctcggagtaccagcagtaccaggatgctactgccgatgaggagggcgagtacgaggatgaagatcaggagcctgaggaggacatgtaaggtgggaggtccatgtggtgctttgctgggtgggggggttctgggggcagagtttgatctgtttggtgctttgttataaatctgtttatcatcgcaactaccgcttgtacgccaccgccattcttcatgcctttcctaagctttgtatttctcatgttatggcaccttttcggtattgtatcacttgatgccatccggtatgttctgtgttgaggtttctggacctctctggtggtgaatggcttc

SEQ ID NO: 27928 - DNA, 805 bp, Triticum aestivum
  unsure (1)..(805): unsure at all n locations
  Clone ID: PAT_TA_27928
ctcgagtttttttttttttttttttttttctttccaaatgatccattccattaccatatagtattttataatttaaggaaactgagtacaagcatccagcaaatcttacgaataccaagtacatgccacccttatcgctagcccgaaagcttacactcgaatctggtgggcatgtcaagatcaaaggatgattcaaccttgtgaagcaagaaaatagcaaaacatcacatccgtccagcagttttgaagatcgagacacagagcgacaacataggaaagattcaaatactacaatactgcaaagctagttcatattagagcaagagacgatattgcttcctagtagcgcatcttcattcttcttcctgaatctcagccaaggtcttgagtgtcatgcgcacttcacgaagggttacatctttatgaccatcgactggactctccctgagaatcttgaagacattcagagccgtagcatcaacatccttgacacgaagtttggggaatttcctggcagccttgagatgcccaggatcaatgtcggggaattccttggcagccttgagctcgtaaatgcccgctgatctcccgagcgcacggtcgcaaaatctcctcaccgctagccggagcgccgccatcgtcctcgccctcgctctcgccgactcgatccgcttcctcttcctcttcctcgctggttggggagaaaaaaaaacctcggccgaggactcgaggacggcggcgaggtagacgggggcgccggagccgacgcgctgggcgtagcggccnncttgaggtagcgcccgat

SEQ ID NO: 27929 - DNA, 532 bp, Triticum aestivum
  Clone ID: PAT_TA_27929
ttttttttttgcaaacaaatagattgcttcaacatgcaaatgcgactgaaaaacagtgaccagagacaaacttgtccgtttaatatgtataagattgataactcttacagttcttacaacatcagctgaaactgggtacttttaagtaagacaaactatgacgacatcaaacgaatttagctgcaactgtattaatgtatgacggcgttcaggccatcccaccactgctcgctgtcctgattatctgaaacagagatgatccgacgaccacaaagatgaagaatccaagcactataggtccaacaggatagtcattccccttcttcacagtggtttcaggcaccgaacccctcttggtgatgttcttctggaacttcgctgtcttcctgtcagcaaggcgcctggaagtagtcatcttggcttcgggctgtgtccggtgagctcgccggcgaggaatgggagctggtgcagccgggggttagtttggactcggtgttgtgatttccccgcgtactcttcgttgttaccactg

SEQ ID NO: 27930 - DNA, 909 bp, Triticum aestivum
  Clone ID: PAT_TA_27930
ggcacgagctagtctcgagttttttttttttttttttcttgaaagaccatcctaccctttattatgaaaaggtatgaacagatctcgtccattaatgtattcggggggttgtaccgaagaagaagatatagacctatgaggaactacgtatgcatgctcaagaacctatgttcgtacatacatacacaaatcatatagaacaaaaggtatgctccggtcagaaagcagagtcgtacagcagagttttggacaaaagtgaagttcacaaaagaccttcatacgagataggccattgtttcaactcgtagtttaggccttgccggactcctcgcaacccggtggcctaaaggcgatgaagctgacgcactgcacctggcgcaggttgtcgaagccgatgacacggacataggcgtcagggtactccttcttgacctcctccacctcgttgagcacctgtgtggcgtcagtgcacccgaacataggcagcttccacattgtccagtatcggccgtcgtagtacccgggggagctgttgtgctcacggaagacgaagccaaccttgctgaactcgaggcagggcacccactttgagcggatcaggtagtcgacctgcttcaggagggcctccgtggataagggtggcaagtaagacagggtctcgaacttcttgatgccctcaattggccacacctgcatgcacctgatccttccgccattgctgacgctgccgaggctgccgctggagcggcggccgacggggagacccggctgtggacttgagcccctggaagggtgcgacggtggtagccgaggaagccatcacggcgggggccatggtaatgtattatctggaggagaggagcttggtgtttctgagctgttccgtgcccaggtaatgtgcctcgtgcc

SEQ ID NO: 27931 - DNA, 707 bp, Triticum aestivum
  Clone ID: PAT_TA_27931
cgctagaatttacatatgcatgctccacaacctatgttcgtacaaacacagatcatatggaacgagaaatatgctctggtcggaaagcagagtcgtggacaaaagtgaagttcacaaatgaccatcatacataggccattgtttcaacttgtagtttaggccttgccggactcctcgcaacctggtggcctgaaggcgatgaagctgacgcactgcacctggcgcaggttgtcgaagccgatgacacggacataggcatcagggtactccttcttgacctcctccacctcgttgagcacctgcgtggcgtcggtgcacccgaacataggcagcttccacattgtccagtatcgaccgtcgtagtacccgggagagctgttgtgctcacggaagacgaagccaaccttgctgaactcgaggcagggcacccacttggagcggatcaggtagtctacctgctttaggagggcctctgtggagaggggtggcaagtaagacagggtctcaaacttcttgataccctcaatcggccacacctgcatgcacctgatccttccgccattgctgacgcggccgaggctgccgctggagcggcggctgacgggcagaccggctgtggacttgagcccctggaagggtgcgacggtggtagccgacgaagccatcacggcgggggccatggtattgtattatcggaggagaggagg

SEQ ID NO: 27932 - DNA, 1112 bp, Triticum aestivum
  unsure (1)..(1112): unsure at all n locations
  Clone ID: PAT_TA_27932
ttttttttttttaaactggggcttgggaaattgcttgtatggtgaagaaaactgcagattcatttcagagttaagagctgaaaacatctctaaaacaaccatttcattacactaaacaccacccacgatacataaacttgcctagcagaaccgaaacctaaacaagggaggatgaggcatccttttgtacagacccttggaacaccaagcactcctaagaccagctatcgcatcaagatcaagcggcggcgaccttgcgggccttcttggcggccggggagcggacggtcttcggcttcgccttggccttggcagccggcgacttcttggccttggtgaccagcttcttcttctcaggcgccttgcgcttggtgccaacggcggccgtcttcttgggcttctcggccgccttctttttgggcttggcggcgtccttggcgggcttcgccgcgggcttggccttgggggagtccttcttggcggcgtcggagagcttgtaggaggccttgaccttgacgagcttgcccttggcggcggaagcgcggagctggacggagagcatcttcttgaagttgggcgggagagccttgccgtgcttctcctcgatgtacttggcgatggcgaccgagctcgacccggtcctgtccttgaacgccgcgatcgcctccttgatcatctcaaagtaggtcgggtgggcggctccagcggcggccgccttgggcttggcggcggcgggcttcggcttcggcgccgcggcggcgggcttggcggggcgggcagcgggcttggcgagggcaggcatgtcagctgacgaagcggagctcttgaaaccgaaactgaagcggtgctacttgcgcggtgtgctcgcttgagatttggaggaggaggaggagctcctctctctctctctctctctctctctctctctctctctctctctctctctctctctctctctctctctctctctctctctctctctctctctcctcgtgccgaattcctgcagcccgggggatccactagttctagagcggccgccaccgcggtggagctccagcttttgttccctttaggagggttaaagtnaaggttanngngagaggngattc

SEQ ID NO: 27933 - DNA, 1392 bp, Triticum aestivum
  Clone ID: PAT_TA_27933
ggcacgaggtcattcatcaccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatcattccagtgcgagcttgtcttcgccaagatgggcatcaacccaatcatgatgagtgccggagagctggagagtggcaacgccggagagcccagccaagctcatcaggcagcggtaccgtgaggctgcagacatgatcaagaaagggtaagatgtgctgcctcttcatcaacgatcttgacgctggtgcgggtcggatgggcgggaccacacagtacaccgtcaacaaccagatggtgaactcgcgggacggacccgtgacctttgagcagccaaagatgacagtggagaagctgctagagtacgggcacatgcttgtccaggagcaggacaatgtcaagcgtgtgcagcttgctgacacctacatgagccaggcagctctgggtgatgctaaccaggatgcgatgaagactggttccttctacggttagaacattctccatacacacccaccatctcttgctgcataggaggaggtaaaggggcacagcaaggtactttgcctgtaccggcaggatgcaccgaccagactgccaagaacttcgacccaacggcgaggagtgacgacgggagctgcctttacaccttttaagcatgccaatttaatatctgatgttttatcctttgtacctaagtaccgcatcgcatccaagcgattgctgggcatgttttgttaatataaaaagatattgagtatacctatttggtaaagacaaataagaactacttatcatttgtcactctctgtattcattccttcagtgggagactgcttctgctttattgcaaacagaacaaaaaagtactaatttgcgcttcagcttattaa

SEQ ID NO: 27934 - DNA, 2035 bp, Triticum aestivum
  unsure (1)..(2035): unsure at all n locations
  Clone ID: PAT_TA_27934
ccaagctcgaaattaaccctcactaaagggaacaaaagctggagctccaccgcggtggcggccgctctagaactagtggatcccccgggctgcaggaattcggcaccagctcgcacaacagaagaaaaaccaactacctcctcctacgctccgatggccgcagcggtggctgacgcggcggtgccggcggcggcgagggcgaacggcgccggggcggggtgctgcgcggcgaaggggcccggctacgccacgccgagggaggccatggagaagggcccgcgggaggggctcctctacgtcacctgcgtctacaatggtactggaatcgacaagccggattacctggccacggtggacgtcgaccccaattctgcgacctactcccaggtgatccacaggctcccggcgacgcacatcggcgacgagctgcatcactccgggctggaacgcctgcagctcctgccacggcgatccgtccacgagccggcgcttcttgattcttccttccttgctgtctggtcgcgtgtatgtggtcgacactgcgaaggatccgagggcgcctgctctgcacacggttgtccaggctgaggacattgctgagaagaccgggcttgggttccctcacacatcccattgccttgcaactgggtgatataatgatttcctgcctgggagacaaggagggaaatgctgctggcaatggctttctcctattggattcaagagtttaacgtcaaaggacgttgggaaaagccaggccacagccccttgtttggctatgatttctggtaccagcctcgtcacaagacgatgattagttcttcatggggagccccggcagctttcaggacaggttttgatctccagcatgtccaggatggtctctatggaaggcacctgcatgtgtatgactggcctggtggtgagctcaagcagacgctggatctaggcagcacaggtcttcttccgctggaggtgaggtttttacacgacccatcaaaggacaccggctatgttggctgtgctttgacaagcaacatggtgagattcttcaaaactgcagatggatcatggagccatgaggtagctatatccatagaaccattgaaggtgcgcaactggatgctgccagaaatgccaggattgataactgactttgtcatctctctcgatgaccgctatctctacttggtcaactggcttcatggggatatcaggcagtacaacattgaggaccctgcaaagcctgtgttggctggacaagtgtttgtaggtgggcttcttcaaaagggcagtgatgttgtctatgtgaccgacgatgacaaagaagagcagtatgctgtgccccaagtcaaggggaatcggcttagaggtgggccgcagatgattcagctgagcttggacggcaagagggtgtatgtgaccaactctctcttcagccggtgggacgagcagttctacggccctgaccttctcaagaagggatctcacatgttgcagatcgacgtcgacactgaggaaggagggctggctgtcaaccccaacttctttgttgatttcgggaccgagcctgaaggtccctccttggcccatgagatgagatatcctggtggagactgcacctctgacatatggatctaggaggaagggtgtaggacacaggcagctggagatccatggtgttgagctcactgtaattaagatggtttcttcactgcctgcggtgttgtatgtgatgtggtatcaattggaataagttcctgatagaacctctgacattggcatcatgggagcttgtgccgtaataagagttgcctctgattctgaaaaaaaaaaaaaaaaaaaaactttgtgcttctctcaattgggatgtgcctcttcaagtgcttcatcgtctagccgctgattatatcctcgtaaatgttcctgaccttagcgannnacgctttcctgtcgggcttgaatagcaggttcttgacgtccgtccgtccgtgctttgcttgtttgttgtgtacctgcccgggcggccgctcga

SEQ ID NO: 27935 - DNA, 827 bp, Triticum aestivum
  unsure (1)..(827): unsure at all n locations
  Clone ID: PAT_TA_27935
tagggtttcacctgcatccattctcaacgttagcaggagcgagtgggagtccggccatggcgccgtcgcagcccaagtcagggctcttcgtgggcatcaacaagggccacgtcgtcaccaagcgcgagctgccgccacgcccgtccgaccgcaaggggaaaggtaccaagagggtgcattttgtcaggaacttgattagggaggttgctggattcgctccctatgagaaacgtatcactgagcttcttaaggttggaaaggacaagcgtgcactcaaggtcgccaagagaaagcttggtactcacaagagagcaaagaagaagagagaggagatgtcaagtgtccttaggaagatgaggtctgctggtggtggtggtgctggtgacaagaagaaatagagcgtggctagttggtgaattttatccgaaaactcggtcctgtattaccagtccgtacctatagagctatggccattgtgttggattttggaactattaaatttgacgctcttaagcccgtggtttctattctgagaagaccaatctttttaagatttttagtttggtgcctttgttttattattacttgctttgtttgattacttggcacaaagctgtttattgcaattatgtagcgtgtctgggttttgtacctgcgattgttgtatgttttcagtaggtgaattgctataagaagccctgccacggtgtggtcttggatcccatatccccattacagcatccatgtctggcataatatcttgatttaccaattgtcaactgtatagcatctattaatagcgccttccnagtacaaaacatcttcat

SEQ ID NO: 27936 - DNA, 622 bp, Triticum aestivum
  Clone ID: PAT_TA_27936
ttttttttttagatagcacaactagcagccagttcatcacaattactatgccctttggccattacaatggcacaatacaaagagaggtacacagaaacaaacaagagcacaatacagttgaccattcgaaccaaaatcaagccatggagacaaatttaacaagggtgacattatagcaaaggttctttacttggcacagcacggtaacatcagtacaccagggtacaagcaatcctcataacacgaagaaattgataacagagacatcctgggatcacttcctagcttgcataacaaacactgaaacgtccataaaacaaaatgcagataactcttgagccatggctcccccacgcggcggtcggccgggccggatctagaacccgagcttggtgcggcgccagtgcctgcgcttcgcgttgtacctgatggtgttgtcggtccgcatgcggatccagtaggggatggggcggttctggcgctgcttcttggccagcttctgcttgatgcggaaggtcttgtgggacggcatcgtcgcggcggagacgaagacgcagcggcgacttcggcggcggcggcggcggcgggagcaaaaccctaggtccgtcccagcccggccggc

SEQ ID NO: 27937 - DNA, 1850 bp, Triticum aestivum
  Clone ID: PAT_TA_27937
aattaaccctcactaaagggaacaaaagctggagctccaccgcggtggcggccgctctagaactagtggatcccccgggctgcaggaattcggcaccagccccaccccacaaccaatctctcctcgccgccacactccccactcccactgcttcgtcgagccagctcgccaaccagagaagatgagggagatcctgcacatccagggtggacagtgtggaaaccagattggttccaagttctgggaggtggtgtgtgatgagcatggcatcgaccccaccgggcggtatgtcggcacctctgacctgcagctggagcgcgtcaacgtctactacaatgaggcctcctgtggtcgctttgtgccccgagctgtccttatggatcttgagcctggtactatggacagtgtccgtactggaccgtacgggcagatcttccgccctgacaactttgtgtttgggcagtctggtgctggtaacaactgggccaagggtcactacaccgagggtgcagagcttattgattctgttcttgatgttgtcaggaaggaggctgagaactgtgactgccttcaaggtttccaagtatgccactctcttggtggtggtactggatcaggcatggggacccttttgatatcaaagatcagggaggaataccctgaccgcatgatgccttacgttctctgttttcccctcaccgaaagtatctgatactgttgttgagccttacaatgccactctttccgtccatcagttggttgagaatgcagatgagtgcatggttcttggacaacgaggctctttatgacatctgtttcaggactctcaagctgaccactcccagctttgggagatttgaaccatctgatctctgccaccatgagcggagtgacctgctgcctgaggttccccggccagctgaactccgacctccggaagctggcagtgaacctgatccccttcccacgtctccacttcttcatggtcgggttcgcgccgctgacctcccgcggctcccagatgtaccgctccctcacggtcccggagctgacccagcagatgtgggactccaagaacatgatgtgcgccgccgacccccgggcacggccgctacctgacggcctcggccatgttccgcggcaagatgagcaccaaggaggttgacgagcagatgatcaacgtgcagaacaagaactcttcctacttcgtggagtggatccccaacaacgtcaagtcgagcgtgtgcgacatcgctcccaggggcctgtcgatggcgtccaccttcatcggcaactcgacgtccatccaagagatgttccggcgggtgagcgagcagttcacggccatgttcaggaggaaggctttccttcactggtacaccggcgagggcatggacgagatggagttcaccgaggccgagagcaacatgaacgacctggtcgccgagtaccagcagtaccaggacgccaccgccgacgaggaggaggagcttgtacgaggacgaggacgacgccgacctccaggagtaggggcgagcgagcgaggtctgtgttcctccgtgatcgtgtgcgtgctcggtcaggggctatttctgatggctccatgtcgctactagtagtgtgtgtttcgcgcttgctggccccaatcttcggggggttgtggacttgttgctggttgtgtagttggtctgtgtcgggttaattcggtagtcagtttgttgcgccttacggtggacttgagatcttagtagcaggtttgtaatatggctctgaatcctaatgcaacgtttgctgtttcttcacaatgaacagagtttgtgattgccacctcgatggactagccacgctag

SEQ ID NO: 27938 - DNA, 716 bp, Triticum aestivum
  Clone ID: PAT_TA_27938
ctcccattcgctcgcctcctccaaccctaagcgatgacgaagggtaccggcagtttcggcaagcgccggaacaagacccacacgctctgcatccgctgcggccgccgcagcttccacctccagaagagcacctgctcctcgtgcggctaccccgccgcccgcatccgcaagtacaactggagtgtgaaagccatcaggcgcaagaccaccggcactggaaggatgaggtacatgcgccacgtgcctcgcaggttcaagagcaacttcagagaaggtaccgaggctgcccccaggaacagggccgcggccaactaggtctggattttgccccatcaagaatctcgtgaagctagaatttaaagacttttgcttggattgtaccccgcctaaactattgttgctatagaattgagtatggatctgatatgttttgttgcatgggtttggaaattgacctctgaatctaagaccaagtttgtctgaatgttacaattgtttgtgggttaagggcatctgctttccaatctagtgaattctgtagggctatgttgctgtgcgacacatacattagtagtacacaggagagaatgtcgaacacttcattttgaaacaaataatggctgaaaagcatcaaaatttggcaactgggagtcggtcattgagcatatcaattgcacaactattcggttaaaaaaaaaaaaaaaaaaaaaaaaaaa

SEQ ID NO: 27939 - DNA, 841 bp, Triticum aestivum
  Clone ID: PAT_TA_27939
tttaattatatattatttttataatatttttttttttttccgagaattaacagcaggacaatggtccgcttgttgtatataataaatatcacactggtgttgtatatgtgtagccggtgctagaatttacatatgcatgctccacaacctatgttcgtacaaacacagatcataccgaacgaaaaatatgctctggtcggaaagcagagtcctggacaaaagtgaagttcacaaaagacaatcatacataggccattgcttcaactcgtagtttaggccttgccagactcctcgcaacccggtggcctgaatgcgatgaagctgacgcactgcacctggcgcaggttgtcgaagccgatgacgcggacataggcgtcagggtactccttcttgacctcctccacctcgttgagcacctgcgtggcgtcggtgcacccgaacataggcagcttccacattgtccagtatcggccgtcgtagtacccgggggagctgttgtgctcacgaaagacgaagccaaccttgctgaactcgaggcagggcacccacttggagcggatcaggtagtcgacctgcttcaggagggccctccgtggagaggggtggcaagtaagacagggtctcgaacttcttgatgccctcaatcggccacacctgcatgcacctgatccttccgccattgctgacgctgccgaggctgccgctggagcggcggctgacgggcagaccggccgtggacttgagcccctggaagggtgcgacggtggtagccgacgaagccatcacggcgggggccatggtattgtattatcggcggagaggaggatgctggctcgtgccg

SEQ ID NO: 27940 - DNA, 1498 bp, Triticum aestivum
  unsure (1)..(1498): unsure at all n locations
  Clone ID: PAT_TA_27940
cctcgctcatctttctcccagatccgatcaaggcaccgccgccacccccacccaccaccgccgacctctccaccatctcctccccgtcccccatcgcgccgccatccacctcgtcgcctcccatctcctccctcccccaccttccccacccccacaacaagatcgccgacgcgacgggagcaatggcggcggggtaccgggcggaggacgactacgactacctcttcaaggtcgtcctcatcggcgactccggcgtcggcaagtccaacctgctctcccgcttcacccgcaacgagttcagcctcgagtccaagtccaccatcaggggggtcgagttcgccacccgctccctccaggtcgacggcaaggtcgtcaaggcccagatttgggacaccgccggccaggaacgataccgtgctattactagcgcatactaccgtggtgctgtaggagcgttgcttgtctacgacgtcactcggcacgcaaccttcgagaatgcagagcgctggctgaaggaattgagggaccatacggacccgaacatagttgtcatgcttgttggcaacaagtctgatctccgccatctcgtggccgtcccaactgacgaagggaaggcgtttgcagagagggagtcactctatttcatggagacctctgcgctcgagtcgaccaatgtggaggacgcgtttgcggaggtcttgaaacagatttaccgcatcgtgagcaagagggcggtcgaggcaggcgaagactcggccgccggccctggcaagggtgagaagatcaacatgaaggacgatgtctcggcggtaaagaagggcgggtgctgctctagctgaggcgccatgatgcattctttttgctgagcttttgtgatgtggcatttccagcgaccgggaattattagtagcagtagtagcaagtattattattatgaatgttacctagagaagttgaagtttgttgctgaaccgggaagtttgtctagatgagggtggtggtgatgatgagggtgttgatgaccaggccgtgaaggtggttgacattgttgacaccttccgtcttcaggagcaacctgcttttgccaacaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctccaatgttggtgtcagtaactgtcagatgttgagtgtcttgaaaactttctgataattgtgggatttgctttgtaangtaatcg

SEQ ID NO: 27941 - DNA, 631 bp, Triticum aestivum
  Clone ID: PAT_TA_27941
gccggccgggttcgagacgcagccgcttcacttctcccaggtaaaggaaagattcgcccatggctccgtcgcagcccaagtcgggcctcttcgtcggcatcaacaagggccacgtcgtcaccaagcgcgagctgccgccgcgcccgtccgaccgcaaggggaaaggtaccaagagggtgcatttcgtcaggaacttgatcagggaggtcgctgggtttgctccgtatgagaagcgtatcactgagcttctcaaggttggcaaggacaagcgtgccctgaaggtggcgaagcgaaagttgggtacccacaagagggcgaagaagaagagagaggagatgtccagtgtcctcaggaagatgagatctgctggaactggaacagacaagaagaaatagagcatcccaggctcattaagttgatggcaatcttctgttctggtgtccagtttttactgcatgtagaacctactagacctgaaactgttatccgctagctaaacattatgctatgttgaacctcctgtcttgtgagatttttgatctaacttgcaatgcatcgtttgccaccctatttctgagttcgcttctatgatccgtcttgattccatctgccattcttgtgccagatgctt

SEQ ID NO: 27942 - DNA, 1839 bp, Triticum aestivum
  Clone ID: PAT_TA_27942
gccgcccccaaccactctctcctcgccgccacactccccactcccactgcgcttcgtcgagccagctcgccagccagagaagatgagggagatcctgcacatccagggtgggcagtgtggaaaccagattggttccaagttctgggaggtggtgtgtgacgagcatggcatcgaccccactgggcggtatgtcggcacctctgacctgcagctggagcgtgtcaacgtctactacaatgaggcctcctgtggtcgctttgtgccccgtgctgtccttatggatcttgagccgggcaccatggacagtgttcgtactggaccgtacgggcagatcttccgccctgacaactttgtgtttgggcagtctggtgctggtaacaactgggccaagggtcactacactgagggtgcagagcttattgattctgttcttgatgttgtcaggaaggaggctgagaactgtgactgccttcaaggtttccaagtatgccactctcttggtggtggtactggatcaggcatggggacccttttgatatcaaagatcagggaggagtaccctgaccgcatgatgcttacgttctctgttttcccctcacccaaagtatctgataccgtggttgagccttacaatgccactctttcggtccatcagttggttgagaatgcagatgagtgcatggttcttgacaacgaggccctttatgacatcctgtttcaggactctcaagctgaccactcccagctttggagatttgaaccatctgatctcagccaccatgagtggagtgacctgctgcctgaggttccccggccagctgaactccgacctccggaagctggcagtgaacctgatcccgttcccgcgtctccacttcttcatggtcgggttcgcgccgctgacctcccgcgggtcccagatgtaccgctccctcacggtcccggagctgacccagcagatgtgggactcgaagaacatgatgtgcgccgccgacccgcgccacggccggtacctgacggcctcggccatgttccgcggcaagatgagcaccaaggaggtggacgagcagatgatcaacgtgcagaacaagaactcgagctacttcgtggagtggatccccaacaacgtcaagtcgagcgtgtgcgacatcgcgcccaggggcctgtccatggcgtccaccttcatcggcaactcgacgtccatccaggagatgttccggcgggtgagcgagcagttcacggccatgttccggcgcaaggccttcctccactggtacacgggcgagggcatggacgagatggagttcaccgaggccgagagcaacatgaacgacctggtcgccgagtaccagcagtaccaggacgccaccgccgacgaggaggaggagctgtacgaggacgaggacgacgccgacctccaggagtaggggcgtgcgaggtctgggttcttctgtgatcgcgtgcgtgctcagtcgggggctatttctgatggctccatgttgctgctactagtagtgtgtgtgtgtgtgtttcgcgcttgctggcccccatcttcggggtgtcgtggacttgttgcttgtgtagtttgtctgtgtcgggttaattcggtagtcagtttgttgcgcgtgcgttacggtgaactagaggtcttagtagcaggtttgcaatatggctggctcattgtttcttcacatagtttgtgatgattgtcgttgtcaagtgctccaccacctcgagggcaatattggctttaccagtggactggatgcatccgtggatgtgttacgtgccatgatgtgcagtcggcatcgtttgacaccatctgccacttgacttgag

SEQ ID NO: 27943 - DNA, 1891 bp, Triticum aestivum
  Clone ID: PAT_TA_27943
ggccttgtatttagactttttgacagtgtgggttttcgccagattaaaagggggcccctagaggtcaataatgccttgcgcccccccccaaaattttaaggggtgggtcatgagaggctccgcctcttaagggttttcccctctagcgggaggccgctttattaaggggcccttgtccaaagggaaaacctccaacctttcggggttttttttatatataagggatttgccttctgggcttgggtataaaaagaggtgttaacaaaattgtacgggaattaaaaaaatattacggttccttttcctttccccttaggttgcaaattttgagaaggcgatgggtggggcctttggtttttccccaacttgaaaaaggggttttcttccaagcgtttaagtgggtaaccccagggtttcccgccccggggtgttaacgccggcacgtgtattgtattcccctccctttaaggggaatttgggtccgggggccccccccaaattttttttttttttttttttgtttccaagtacacattctttgcaggtaccgagattaggtgtaatctcagccgctataccaaggtttacaaatacaggtacacaatatcatcggttgtgtattaagcacgggacaaactgcctactaacgtttaagtcagccagtacattgttacaatgctactacagatatggctgacggtggcagtaaatgacatcaacacgttgagatcatagagtattatagttacacttgctcatgcaccatcgtcatcttcaacagtgttgacacgctcgcactcatcgatccattcgctgtatctgcaggaaagataatacgatcttcagttcctggtctcttgacgtatttgaaccaactcactagtcaagagttatttgttggattggacttacatatcaataggctcagtcagcgcatttacagtggtgctgaagctttcctggcagattcgacaattggcctcaccaatcagattcttcatatcaattcggcattcaacactgctgccatgattgcagaacgggcaggaaaagacagtgtcgagcttgtccatccgcttcttagggaggtggcttagcagctgactttctcttccccatggttcaacttctttttctcccttcaaaatctcggggcgtgcgtcgcgtcggacgaggcttcgggaaacgccgggcgaagaatggagaggagcccccgttttatgacgcgacacgccccgagattttgaaggaagaaaaagaggttgaaccatggggaagagaaagtcagccgctaagccaccccctaagaagcggatggacaagctcgacacggtcttttcctgcccattctgcaatcatgggagcagtgttgaatgccgaattgatatgaagaatctgattggtgaggctaattgtcgaatctgccaggaaagcttcagcaccactgtaaatgcgctgactgagcctattgatatatacagcgaatggatcgatgagtgcgagcgcgtcaacactgtcgaagatgatgatggtgcatgagcatgtctggttgcaaaacgaaatggttactactatgactgtaatgcgttggtgttattggctgccatcttcagccatgtctgtagtagcgttttgaggtcgtgctggctgatcgaaccgttagtaggcagttcatctcgtgttttaataaacaagtgatgatattgtgtacttgtgtttgaaccttaatagtagtgttgcatgtccgatgtgtatggatccatcgtatatgagactgtaaggttctctaccagtatgttatcatggttgagattaggactaatttcagtaccagattagaagtattactcatgctatggttggttgttgcttgggggtgttatgttcatgt

SEQ ID NO: 27944 - DNA, 1757 bp, Triticum aestivum
  Clone ID: PAT_TA_27944
gcacgaggcacgctctctcccccaacccaacccaatccccgtcccccctcactcccccacgcgcgacgcgaccgcttcaatcctctcccaagggaggcgaagatgagggagatcctgcacatccagggcgggcagtgcgggaaccagatcgggtccaagttctgggaggtggtgtgcgacgagcacggcatcgaccccacggggaggtacgtcggcacctccgacctgcagctggagcgcgtcaacgtctactacaacgaggcctcgtgcggccgcttcgtgccgcgcgccgtgctcatggatctcgagcccggcaccatggactccgtgcgcacggggccatacggccagatcttccgccccgacaacttcgtcttcggccagtccggcgccggcaacaactgggccaagggccactacaccgagggcgcggagctcatcgactccgtcctcgacgtcgtccgcaaggaggccgagaactgcgactgcctgcaaggcttccaggtgtgccactccctcggcgggggcaccggttccggcatgggcacgctgctgatttccaagatcagggaggagtacccggaccggatgatgctcaccttctccgtgttcccatcccccaaggtgtctgacaccgtggtcgagccctacaacgccaccctctcggttcaccagctggtggagaacgccgacgagtgcatggtgctggacaacgaggcgctctacgacatctgcttccgcaccctcaagctgaccacacctagctttggtgacctgaaccacttgatcagtgccaccatgagcggtgtcacctgctgcctccgcttcccgggacagctgaactcagacctccgcaagctcgccgtcaacctgatccccttcccgcgcctccacttcttcatggtgggctttgcgccgctcacatctcgtgggtcgcagatgtaccgctccctcactgtccctgagctcacacagcagatgtgggactcaaagaacatgatgtgtgctgctgacccacgccatggccgctacctcacagcctcggccatgttccgtggcaagatgagcaccaaggaggttgacgagcagatgatcaacgtgcagaacaagaactcttcctacttcgtggagtggatcccgaacaacgtcaagtcaagcgtgtgtgacatcccaccacgcggcctctccatggcgtccaccttcattggcaactccacctccatccaggagatgttccggcgtgtgagcgagcagttcaccgccatgttcaggaggaaggctttcttgcattggtacactggtgaggggatggacgagatggagttcactgaggccgagagcaacatgaacgaccttgtctctgagtaccagcagtaccaggacgccactgccgacgaggagggcgagtacgaggaagaggaagacctggagcaggagtaagatcggtgacaaattcatctctccgtttatgtggtattgtggttttcgtacaactggagcttgttactagtagagactagagagtaccatggctacaactctgctgcttgtttgcgtgtcttggcatgtattggatttgtactgcgttcgtatgtaggcatgttcactcgatgctatgtttctttgcttgaattatttattctatgtgaggtttcaagcaagtggatttgaaatacagtactactccctccgttccaaaaaaaaaaaaaaaaaataaaaaaaaaaaaaaaagaaaaaacaaaaaagaaaacaaaaag

SEQ ID NO: 27945 - DNA, 916 bp, Triticum aestivum
  Clone ID: PAT_TA_27945
tgacatcagcaagcgccggccagcctcggcacagctgcgggtggttatatggtgggcggagtacacgagtgggttccgatgtcaggataaccaccgtccatagctctcatgtgaatgtggcaaggccacaaaacaagttttccatcgccagatatccaacagatcaactggtgttatggatgcgtcttaaagatatttttttgtcatttcaaacatcaaacaccaactattcacaatggagacacagccgcttcacttctcccaggtaaaggaaaggttcgcccatggctccgtcgcagcccaagtcgggcctcttcgtgggcatcaacaagggccacgtcgtcaccaagcgcgagctgccgccgcgcccgtccgaccgcaaggggaaaggtaccaagagggtgcatttcgtcaggaacttgatcagggaggtagctgggtttgctccgtatgagaagcgtatcactgagcttctcaaggttggcaaggacaagcgtgccctgaaggtggcgaagcgaaagttgggtacccacaagagggcgaagaagaagagagaggagatgtccagtgtcctcaggaagatgagatctgctggaactggaaccgagaagaagaaatagagcatcccaagctgatgaagttgatggcaatcttctgttctggtgtccagtttttactgcatgtagaaccaactagacttgaaactgttatccgccagctaaacattatgctatgttgaacctcctgtcttgtgagatttttgatctaacttgcaatgcatcgtttgctcctatttctgagtttgcttctatgacctgtcagttcgattccatctgccattcatatgcaagtggctttacaattggtggcatatatgtgcctaatttctgtgatgtaggctccttgaaaaaaaaaa

SEQ ID NO: 27946 - DNA, 684 bp, Triticum aestivum
  Clone ID: PAT_TA_27946
gccggccgggccgggctttagacgcagccgcttcacttctcccaggtaaaggaaaggttcgcccatggctccgtcgcagcccaagtcgggcctcttcgtgggcatcaacaagggccacgtcgtcaccaagcgcgagctgccgccacgcccgtccgaccgcaaggggaaaggtaccaagagggtgcatttcgtcaggaacttgatcagggaggtcgctgggtttgctccgtatgagaagcgtatcactgagcttctcaaggttggcaaggacaagcgtgccctgaaggtggcgaagcgaaagttgggtacccacaagagggcgaagaagaagagagaggagatgtccagtgtcctcaggaagatgagatctgctggaactggaaccgagaagaagaaatagagcatcccaggctcatgaagttgatggaaaatcttctgttctggtgtccggtttttactgcatgtagaacctgctagacttgaaactgttatccgccagctaaacattatgctatgttgaacctcctgtcttgtgagatttttgagctaacttgcaatgcatcgtttgccaccctatttctgagtttgcttctatgatctgtcagcttgattccaactgccattcttatgccagtggctttacaattggcgtatgtgtgcgtaatttctgtgatgtaggctcct

SEQ ID NO: 27947 - DNA, 1714 bp, Triticum aestivum
  Clone ID: PAT_TA_27947
cgtccgcacaccccctcctcccccacccgtccgctcccctctcgccgccgattgttctgcctgcgggaaccatctcatatctcggcgaagatgagggaaatcctgcacatccagggtgggcaatgtggcaaccagatcggtgccaagttctgggaggtggtgtgtgatgagcatggcattgacccaactgggcgctacaccggtacctctgacctgcagttggagcgtgtcaatgtctactacaatgaggcctcgtgtggtcgctttgtgccccgtgctgttcttatggaccttgagcccggtaccatggacagtgtccgcactgggccttatgggcagatcttccgccctgacaactttgtctttgggcaatctggtgcgggtaacaactgggccaagggccactacaccgagggtgctgagcttatcgattctgttttggatgttgtgaggaaggaggctgagaactgtgactgtctgcaaggattccaagtatgccactctcttggtggtggtaccggatctggcatgggtaccctcttgatatctaaaatcagggaggagtaccctgaccgcatgatgctgacgttctcagtgttcccctcaccaaaagtatctgatactgtggttgagccatacaatgcaactctctcagtccatcagctggttgagaatgctgatgagtgcatggttcttgacaacgaggctctgtatgacatctgtttcaggactcttaagctgaccacacctagctttggggacttgaaccatctaatctctgctaccatgagtggagtcacctgctgcctaaggttccctggtcagctgaattccgacctccggaagctggcagtgaaccttatcccattccctcgcctccacttcttcatggtgggcttcgctccattgacatcccgtgggtctcagcagtaccgtgccctcacggtcccagagctcacacagcaaatgtgggatgccaagaacatgatgtgcgccgccgatcctcgtcatggccgttacctcaccgcctctgccatgttccgtggaaagatgagcacaaaggaggtggacgagcagatgatcaacgtccagaacaagaactcgtcctactttgtggagtggatccccaacaatgtcaagtccagcgtctgtgacatcccgccgacggggctctccatggcgtccaccttcgttggcaactcgacctccatccaggagatgttccggagggtgagcgagcagttcactgccatgttcaggaggaaggctttcttgcattggtacactggtgaaggcatggacgagatggagttcaccgaggcggagagcaacatgaacgacctcgtctcggagtaccagcagtaccaggatgccactgctgacgaggagggcgagtacgaggatgaggatcaggagcctgaggaggacatgtaaggtgggatgtccatgtcgtgctttgctgggtgggggttctgggggcagagtttgatctgtttggtgctttgttataaatctgtttatcatcgcaactaccgcttgtacgccaccgccattcttcctgcctttcctaagctctgtatttcctatgttatggcaccttttcggtattgtatcacttgatgccgtgcggtatgttctgtgttgaggtttctggttctctctggtgctgaattcaggctttctgagttggtatttctgcggtaaaaaaaaaaaa

SEQ ID NO: 27948 - DNA, 855 bp, Triticum aestivum
  Clone ID: PAT_TA_27948
tgtttctcttaaacatgcactaaattgagaaatgatacaatacgcagtactaacatcacattcacgtcaggagaaaaatccaactttatcacaagaacaagcataagattctcccaggcgggcagataatttaaaagctcagacaattaaccattgtaccataatagcattcgatctacttcgaagtcttgcataacaaacacagggagggtatcataattcaaaactgtagccaaattctactaccgaacacgattgcatagaggggacttcatctgatcagaattcggcaggaacagttccagcaacctggtccagatcgcgccttccctgggaggtgatgagccttccacccttggggtcgacatcaatgatgcccatcttctgcaactcctggaggatgttgcgggaaacagcaccactgctcttgcaaaagtgcggtgggcgtgaaccgttcctctgacggccaccgtagatcttctggaagccgccgatcccgattccctgcctcaggtagatcttccttgccatcgaggcagccctgatgtagtaccagtcagcatcagaaggtggcagctccttgaaccttgcagtcttgacaatgtcaacccactctggaagctccatcttgccggagcgcttgaggtgcgcggagtaggccttgacgaactcgtgggggttgacatccttcaccgtgcgcgcggtggaggccgcggtctcggctgcgggagcggggacggtcgccatcctgtgctctggccgacggcggcgctgtcttcaggaaggagggagaggggtgcgcgccgctgcggctgcgagggctagggtgtttggaggcggcccgatacggccggc

SEQ ID NO: 27949 - DNA, 1754 bp, Triticum aestivum
  Clone ID: PAT_TA_27949
acgagccgccccacaaccactctctcctcgccgccacactcctcactccccactgcgctttctcgtcgcgctcgccactcagagaagatgagggagatcctgcacatccagggtgggcagtgtggaaaccagattggttccaagttctgggaggtggtgtgtgatgagcatggcatcgaccccaccgggcggtatgtcggcacctctgacctgcagctggagcgtgtcaacgtctactacaatgaggcctcatgtggtcgctttgtgccccgtgctgtccttatggatcttgagccgggcaccatggacagtgtccgtactggaccgtacgggcagatcttccgccctgacaactttgtgtttgggcagtctggtgctggtaacaactgggccaagggtcactacaccgagggtgctgagctcattgactccgttcttgacgttgtcaggaaggaggctgagaactgtgactgccttcaaggtttccaagtatgccactctcttggtggtggtactggatcaggcatggggacccttttgatatcaaagatcagggaggagtaccctgaccgcatgatgcttacgttctctgttttcccctcaccgaaagtatctgatactgtggttgagccttacaatgccactctttcggtccatcagttggttgagaatgcagatgagtgcatggttcttgataacgaggccctttatgacatctgtttcaggactctcaagctgaccactcccagctttggagatttgaaccatctgatctctgccaccatgagcggagtgacctgttgcctgaggttccccggccagctgaactccgacctccggaagctggcggtgaacctgatccccttcccgcgtctccacttcttcatggtcgggttcgcgccgctgacctcgcgcggctcccagatgtaccgctccctcacggtcccggagctgacccagcagatgtgggactccaagaacatgatgtgcgccgccgacccccggcacggccggtacctgacggcctcggccatgttccgcggcaagatgagcaccaaggaggtggacgagcagatgatcaacgtgcagaacaagaactcgtcctacttcgtggagtggatccccaacaacgtcaagtcgagcgtgtgcgacatcgcgcccaggggcctgtccatggcgtccaccttcatcggcaactcgacgtccatccaggagatgttccggcgcgtgagcgagcagttcacggccatgttccggcgcaaggccttcctgcactggtacacgggcgagggcatggacgagatggagttcaccgaggccgagagcaacatgaacgacctggtcgccgagtaccagcagtaccaggacgccaccgccgacgaggaggaggagctgtacgaggacgaggacgacgccgacctccaggagtaggggccagcgaggtctgttccgtggatcttccttgatcgttgcccggggctatttctgatggctccatgttgctactagtagtgtgtgtgtttcgcgcttgctggcccccgtcgtcttcggggtgtcgtggactggttgcttgtgtagtttgtctgtgtcgggttaatccggtagtcagtttgttggtgaacttgagatcttagtagcaggtttgtaatatgtctggctctgaatcctaatgcaatgtttgctgtttcttcacatagtttgtgatgattgtcattgtcaagtactccaccacctcgagggcagtggactggatg

SEQ ID NO: 27950 - DNA, 1181 bp, Triticum aestivum
  unsure (1)..(1181): unsure at all n locations
  Clone ID: PAT_TA_27950
ttgaatttgggggaacctttggaggggtttaaaattcccttaccggggaaattaggtttgaaccctttggggggcccccttttttttttttttttttttttttttttttcttttttttttttttttttttttttttttttttttttttttttttttttttttttttttttttttttttttttttttttttgtttttttttttttttaaaagtagttccataatcagcaaaatatgatggtatcccaggtaggctacaagcagtaaataataatatctttcaacacaagcgaaatcttaaaacaggcatcccggagtcacatgctagcttgcaaaaacaacgagacgtcataaaccctaggtaccctagacccttctcccgtcggcggcaacgggtgtcatcgtcgtcatcccccgcttagaatccgagcttggtgcggcgccagtgcctgcgcttggcgttgtacctgatggtgttgtcggtcctcatgcggatccagtaggggatggggcggttctggcgctgcttcttggccagcttctgcttgatccggaaggtcttgtgcgacggcatcgtgacggcggggaggaagctgcggcggcggcggcgcgaggcatgaaccaccgtcccagggtgcattcatatcataaaactgagattgggatctattattgtccacaaaagtgcttggggtcataggggggtgatgcccttctgcagctgttgtggaggccatagagtgtgatctctgccgctcatcgtcttgggttggcctcgccatataatccccaagtatctggatctgtttatttagatgtgcactgcagtgtataaccacagaaaatatcagtattaatactggtaaaccgagcttcataatatacacaaaaataatcagtaggcccaagaaccaaaccgctgttgacgaagctcttcagaatgttgaggattgagttctccagaaccatcaagaagtttattggatactgcaatcaactgatccttcatcccttgcaaatgataattcggctctgggcaaaaagctagctgcacaagttttgtattaacttgtgagttaacatgctgaaatagctactacctgaacagcatgaatgatgattcaactaatactttgcttaccttgtaaccatnactacaaatttcagagagttcttgngtaac

SEQ ID NO: 27951 - DNA, 849 bp, Triticum aestivum
  Clone ID: PAT_TA_27951
ccccccccccccgggctttattggccgcttcaaggggggttcccttttccctttagggtttgcaacttttttgaaaggggattggtttggggcttttttgtttttcccccacttgggaaaaggggatttttttccaagcgatttaatttgggtaaccccaggttttttccattcccccgtttttaaaaggcgggccattaatttaattttgggggcccttttaaaaaaattttacgttccattcccgggtttgttaaatttggttcttttaaagggcccccccctttttttttttttttttttttttttttttttttttttttttttttttttttttttttttttttttttttttttttttttttttttttttttttttttttttttttttacgcaggataaaaggggttccataatcagcaaaatatgacggtatcccaggtaggctacaagcagtaataataataatatctttcaacacaagcgaaatcttaaaactggcatcccggagtcacttgctagcatgcaaaaacaacgagacatcataaaccctaggtaccctagacccttctcccgtcggcagcaacgggtgtcatcgccgtcatccccggattagaatccgagcttggtgcggcgccagtgcctgcgcttggcgttgtacctgatggtgttgtcggtcctcatgcggatccagtaggggatggggcggttctggcgctgcttcttggccagcttctgcttgatccggaaggtcttgtgcgacggcatcgtggcggcgtggacgaaggcggctgcggcggcggcgcgaggaaacccttgccctcgtgccgaattgcctgcagacccggg

SEQ ID NO: 27952 - DNA, 1850 bp, Triticum aestivum
  Clone ID: PAT_TA_27952
agaattagaaatcagaaatgagatattccttacctgtatttattgactttatcgggcactcgtacatattcgcacggccattattacatggaaaatggaagtacaaatagtttagctttcgcgcggacatagtattacacttcagatagtattatggtcgtccgtggcatggcacgcatgcatatgatagagtagctcatcatgggcagaagacgacattgaacctcctgttgccgctgcaagctttggtcctgacgtcgttgggctggtggtaggcgtcggggcagctggggtcgcggcactggatgttgacgccggtgctgcaggagaagtccatggggaggttgtacccgtcgatcaccgagatgtcgtagaagtcctgcgagccgagggtgaactccgccagcgtcaacggggactggccggacagggtgcaggacagcgcgccgccgcagtcgccggtgctgcatctcccgctgttgccgttgaagctgcagcccgtgcggccccagatcctgccggagctggtgccgccggggatatcgaggttccacgtttcgcctctgttgagctgccggccaccgcccacgggggtggccgccggccacaccgtgaaggagcagcggttggtgatggagaagctggtggcgctggcaccggcgacgagccccacggccaggaggaggatgagcgccgacgacgaggcggccattgttgctcgtgccgaattcggcacgagctcgtgccgaattcggcacgaggtcattcatcactgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcaagcggaaaacatcgacgaagaagaggaacaccgacaagtggaagggtcttgcgtacgatatctcccgacgaccaagcaggacatcaccaagagggaaagggcatcgtgggactccctcttccaaggcgccccactgggcgacgggcacccacgagggccgttcctcaagctcaatacgaagtacgtcagccaaggggacctcaaagaagttacgacttcgacaacaccatgggaggcttctacatcgctcctgctttcaatggacaagcttgttgtcatctctccaagaacttcatgaccctgcccaacatcaagatcccactcatcttgggtatctggggaggcaagggtcaaggaaaatcctttcagtgtgagcttggcttcgccaagatgggcatcaacccaatcatgatgagttgccggagagctggagagtggcaaacgcccggagaagccagccaagctcattaggcagcggtacccgtgaggcttgcagacatgatcaagaagggtaagatgtgctgcctcttcatcaacgatcttgacacctacatgagccaggcagctctgggtgatgctaaccaggatgcgatgaagactggttccttctacggttagaacattctccatacacacccaccatctcttgctgcataggaggaggtaaaggggcacagcaaggtactttgcctgtaccggcaggatgcaccgaccagactgccaagaacttcgacccaacggcgaggagtgacgacgggagctgcctttacaccttttaagcatgccaatttaatatctgatgttttatcctttgtacctaagtaccgcatcgcatccaagcgattgctgggcattttgttatataaaaagata

SEQ ID NO: 27953 - DNA, 757 bp, Triticum aestivum
  Clone ID: PAT_TA_27953
caaggtaggagcttgtgaaagttctaaggctgagaagatggttctgaagaccgagctctgccgttttagcggccagaagatttacccagggaagggtatcaggttcattcgttcggattcgcaggttttcctctttgccaactcaaaatgcaagcgctacttccacaaccgcctcaagcctgcaaagctttgctggacagcaatgtacaggaagcagcacaagaaggacatccatgctgaggctgccaagaagaggcgccgcaccaccaagaagccgtactcacggtcgattgttggtgccactctggaagttatccagaagaagagggctgagaagcctgaagtccgtgatgctgcccgagaagccgctctccgtgagatcaaggagcggatcaagaagaccaaggatgagaagaaggccaagaaggcagaggtgaccaagtcccagaagtcacaggggggcaagggcgccgtgcagaagggttccaagggcccaaagattggcggcggcggcgggaagcgttgaaagtgcgttgaaagtcgattacgccaatagacatagagttgtgctgcctagccttgtttcctatcctactatcatagacctttgtcaagttattaccccgccctcttgaatttgcaccttatctgtgaggctgaatggtgttaacgttttggattgtctcgatgagtttatttataatgaatggtacttatgttggttccaaaaaaaaaaagaataaaaaaaaaaaaagga

SEQ ID NO: 27954 - DNA, 878 bp, Triticum aestivum
  Clone ID: PAT_TA_27954
gaatgcttccacaactagttgtgaagaatattcattgcagtgccaaataaagaaacttttcctgaattaataacagcaagacaatggtccgcgtgtttgtatataataaatatcacacaggttttgtatatgtgtagccggttctagaatttacatatgcatgctcgagaacctatgttcgtacatacacacacagaccatatagaatgaaaaatatgctctggtcgtccagcagagtggtggacaaaagttaagttcacaaaagaccttcatacataggccattgtttcaactcgtagtttaggccttgccagactcctcgcaacccggtggcctgaaggcgatgaagctgacgcactgcacctggcgcaggttgtcgaagccgatgacgcggacataggcgtcagggtactccttcttgacctcctccacctcgttgagcacctgtgtggcgtcggtgcacccgaacataggcagcttccacattgtccagtatcgaccatcgtagtacccgggggagctgttgtgctcacggaaaacgaagccaaccttgctgaactcgaggcagggcacccacttggagcggatcaagtagtcgacctgcttcaggagggcctccgtggagaggggtggcaagtaagacagggtctcgaacttcttgatgccctcaatcggccacacctgcatgcacctgatccttccgccgttgctgacgctgccgaggccggcgctgctggagcggcggctgacgggcaggcccgcggtggacttgagaccctggaagggtgcgacggaggtggccgaggaagccatcacagtgggggccatggtgttggaggagggaaggtggcaggctaagcttccgcgacccggccggc

SEQ ID NO: 27955 - DNA, 1113 bp, Triticum aestivum
  Clone ID: PAT_TA_27955
ctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagatcttcggagtttgaagctagaggtgtcagaaaagttaccacagggataactggcttgtgggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgacagtgtcgcgatagtaattcaacctagtacgagaggaaccgttgattcacacaattggtcatcgcgcttggttgaaaagccagtggcgcgaagctaccgtgtgccgggattatgactgaacgcctctaagtcagaatccaagctagcatgcgacgcctgcgcccgccgcccgccccgacccacgttaggggcgcttgcgcccccaagggcccgtgccattggctaagccggtccggccgaagtgccgcggtcggccgcctcgaagctcccttcccaacgggcggtgggctgaatcctttgcaagacgacttaaatacgccgacggggcattgtaagtggcagagtgggccttgctgccacgatccactgagatccagccccatgtcgcacggattcgtccctcccccacaactttccttcaccaagtaaggttcgaagatgccatcaaaatctgcaccgcaaaatcatgaggactagaaatggctaagtcccttgtaagatagacccttgtacccaataaggccagtggaaacaacactcaaaactatatgtgccaaatgcaaaagatacttggccgattcatgcggatgccgtcgtcagaggctacactgctaagtcatgctcaaggcaaatggtatagtcccttatatgacatatacaatcactcaataaggccagtggcgagcacactcaaaagtatatgtgccaagtgaacaagatacttgaccgattcattcggatgccttc

SEQ ID NO: 27956 - DNA, 587 bp, Triticum aestivum
  Clone ID: PAT_TA_27956
ttttgttgttgtgttgtgagttgttaccttaggtaggtgggtcgattgatttgttcctttactggttttgtccatttgtactttgatttcaactggtcaggccatttcaactcgggcaaaatacagagcttaagcaggataaaagctgttccataatcagcaaaatatgatggtatcccaggtaggctacaagcagtaaataataatatctctcaacacaagcgaaatcttaatcttaaaacaggcatcccggagtcacatgctagcttgcaaaaacaacgagacgccataaaccctaggtaccctagacccttctcccgtcggcggcaacgggcgtcatcatcgtcatccccggcttagaatccgagcttggtgcggcgccagtgcctgcgcttggcgttgtacctgatggtgttgtcggtcctcatgcggatccagtaggggatggggcggttctggcgctgcttcttggccagcttctgcttgatccggaaggtcttgtgcgacggcatcgtggcggcggagacggaggcggctgcggcggcggcgcgaggaaacccttggatcggaggttttttttttttatt

SEQ ID NO: 27957 - DNA, 1111 bp, Triticum aestivum
  unsure (1)..(1111): unsure at all n locations
  Clone ID: PAT_TA_27957
acgccatccccacatttcttataatcagaattctgttttgaacagaatgtgagtacaaatatgaagtgttccttgcaaagaaaggataaaccaccttggagtaacacctgaaagtctggatgacttaacatagctctaattttggtttaaaagcatgctactcatagacgagaaatgttacgacaggccaatcactaacatcacattcacgcaaggagtaaaatccatctttatgacaagaactcacaagcataagattctcccaggcgggcagataatttaaaagctcagacaataaccattgtaccagaatagcatgcgatctacttcaacgaagtcttggataacaaacacaggggggtatcataattcaaaactgtagccaaattctactaccgaacacgattgcatagaggggacttcaactgatcagaattcggcaggaacagttcctgcaacctggtccagatcacgccttccctgggaggtgatgagccttccacccttggggtccacatcaatgatgcccatcttctgcaactcctggaggatgttgcgggacacagcaccactgctcttgcagaagtgcggtgggcgtgaaccattcctctgacggccaccgtagatcttctggaagccgccgatcccaattccctgcctcaggtagatcttccttgccatcgaggcagccctgatgtagtaccagtcagcatcagaaggtggaagctccttgaaccttgcagtcttgacaatgtcaacccactccggaagctccatcttgccggagcgcttgaggtgcgcggagtaggccttgacgaactcgtgggggttgacatccttcaccgtgcgcgccgtggaggccgcggtctcggctgcgggagcgggcacggtcgccatcctgtgctctcgccgacggcggcgctgtcttcagggaggagggagaggtgtgcgcgccgctgcggctgcgagggctagggtttttccctcgtgccgaattcctgcagcccgggggatccactagttctagagcggccgccaccgcggtggagctccagcttttgttccctttagtagggttaatttcgagcttggcgtaatcagangaatcaaa

SEQ ID NO: 27958 - DNA, 925 bp, Triticum aestivum
  Clone ID: PAT_TA_27958
atcgcggcaccatctccccccacttccccccatccgccgccgccgcgcctcctcctcgcccaaggtaggagcttgtgaaagttctctaaggctgagaagatggttctgaagaccgagctctgccgttttagcggccagaagatttaccctgggaagggtatcaggttcattcgttcggattcgcaggttttcctctttgccaactcaaaatgcaagcgctacttccacaaccgcctgaagcctgcaaagctttgctggacagcaatgtacaggaagcagcacaagaaggacatccatgctgaggctgccaagaagaggcgccgcaccaccaagaagccgtactcacggtcgattgttggtgccactctggaagttatccagaagaagagggctgagaagcctgaagtccgtgatgctgcccgagaagctgctctccgtgagatcaaggagcgcatcaagaagaccaaggatgagaagaaggccaagaaggcagaggtgaccaagtcccagaagtcacaggggggcaagggcgccgtgcagaagggttccaagggcccaaagattggcggtggcggcgggaagcgttgaaagtcgattacgccatagacatagaattgtgctgcctagccttgtttcctatcctactatcatagacctttgtcaagttattaccccgccatcttgaatttgcaccttatctgtgaggctgaatggtgttaacgttttggattgtctcgatgagtttatttataatgaatggtacttatgttggttccaagcacatgaatacatggtccactgagtaatataaagtccacgcgacatcgcataaattccatatatacattatagaacaaggatggatattttatatctatacaagtgtatgcatgtcccatgcaatcaagaaagttcgatcataccg

SEQ ID NO: 27959 - DNA, 1124 bp, Triticum aestivum
  unsure (1)..(1124): unsure at all n locations
  Clone ID: PAT_TA_27959
ccccattatacacttaaaaattggatctccattcgccattcaggtgcgcaactgttgggaagggcgatcggtgcgggcctnttcgctattacgccagctggcgaaagggggatgtgctgcaaggcgattaagttgggtaacgccagggttttcccagtcacgacgttgtaaaacgacggccagtgaattgtaatacgactcactatagggcgaattgggtacacttacctggtaccccacccgggtggaaaatcgatgggcccgcggccgctctagaagtactctcgagttttttttttttttttttttaaagaaccttattcatgaattaataacagcaagacaatggtccgcgtgttgtatataataaatatcacacaggttttgtatatgtgtagccggttctagaatttacatatgcatgctcgagaacctatgttcgtacatacatacacagaccatatagaatgaaaaatatgctctggtcgtccagcagagtcgtggacaaaagtgacgttcacaaaagaccttcatacataggccattgtttcaactcgtagtttaggccttgccagactcctcgcaacccggtggcctgaaggcgatgaagctgacgcactgcacctggcgcaggttgtcgaagccgatgacgcggacataggcgtcagggtactccttcttgacctcctccacctcgttgagcacctgtgtggcgtcggtgcacccgaacataggcagcttccacattgtccagtatcgaccgtcatagtatccgggggagctattgtgctcacggaagacgaaaccaaccttgctgaactcgaggcagggcacccacttggagcggatcaagtagtcgacctgcttcaggagggcctccgtggagaggggtggcaggtaagacagggtctcgaacttcttgatgccctcaatcggccacacctgcatgcacctgatccttccgccgttgctgacgctgctgaggccggcgctgctggagcggcggctgatgggcaggccggcggtcgacttgagaccctggaagggtgcgacggaggtggccgaggaagccatcacagtgggggccatggtgttggaggagagaaggtgcggacgcgtgggtc

SEQ ID NO: 27960 - DNA, 936 bp, Triticum aestivum
  Clone ID: PAT_TA_27960
gaattcactagtgattagcgtggtcgcggccgaggtccgccgccgcgcctcctcctcgcccaaggtaggagcttgtgaaagttctctaaggctgagaagatggttctgaagaccgagctttgccgttttagcggccagaagatttacccagggaagggtatcaggttcattcgttcggattcgcaggttttcctctttgccaactcaaaatgcaagcgctacttccacaaccgcctgaagcctgcaaagctttgctggacagcaatgtacaggaagcagcacaagaaggacatccatgctgaggctgccaagaagaggcgccgcaccaccaagaagccgtactcacggtcgattgttggtgccactctggaagttatccagaagaagagggccgagaagcctgaagtccgtgatgctgcccgagaagccgctctccgtgagatcaaggagcgtatcaagaagaccaaggatgagaagaaggccaagaaggcagaggtgaccaagtcccagaagtcacaggggggcaagggcgccgtgcagaagggttccaagggcccaaagattggcggtggcggcgggaagcgttgaaagttgattacgccatagacatagagttgtgctgcctagccttgtttcctatcctactatcatagacctttgtcaagttattaccccgccctcttgaatttgcaccttatctctgaggctgaatggtgttaacgttttggattgtcttgatgagtttatttataatgaatggttcttatgttggttcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaggataaaaaaaaaaaaaaaaaataaataaaaaaaaaaggggcgcccccaagggg

SEQ ID NO: 27961 - DNA, 806 bp, Triticum aestivum
  Clone ID: PAT_TA_27961
ggtttttgagtaaaatccaactttatcacaagaactcacaagcataagattctccctggcgggcagataatttaaaagctcagacaataaccattgtaccatgatagcatgcgatctacttcaacaaagtcttgcataacaaacacagggtgggtatcataattcaaaactgtagccaaattctactaccaaacacgattgcatagaggggacttcaactgatcagaattcagcaggaacagttccggcaacctggtccagatcacgccttccctgggaggtgatgagccttccacccttggggtcgacatcaatgatgcccatcttctgcaactcctggaggatgttgcgggaaacagcaccgctgctcttgcagaagtgcggtgggcgtgaaccgttcctctgacggccaccgtagatcttctggaagccgccgatcccgattccctgcctcaggtagatcttccttgccatggaggcagccctgatgtagtaccagtcagcatcagaaggtggcagctccttgaaccttgcagtcttgacaatgtcaacccactctggaagctccatcttgccggagcgcttgaggtgcgcggagtaggccttgacgaactcgtgggggttgacatccttcacggtgcgcgccgtggaggccgcggtctcggctgcgggagcggggacggtcgccatcctgtgctctggccggcggcggcgctgtcttcaggaaggagggagaggtgtgcgcgccgctgcggctgcgagggctagggtttttctggagtttttttttttttttagggtggcaa

SEQ ID NO: 27962 - DNA, 1904 bp, Triticum aestivum
  Clone ID: PAT_TA_27962
cctgcaggtaccggtccggaatttcccggtcgacccacgcgtccgaaaaaaccttcgctgaaacccttcccgatggccgccgtcgtagccgcagccgcggccgaccagccgcgccgccggaagccgacgccggggcgcgggggcgtggtgctgcccgcggggctctccgaggaggaggcgagggtgcgggccatcgcggagatcgtgtcggagatgggcgaagctctcgcgccgcggggaggacgtggacctcaacgcgctcaagtcggccgcgtgccgccgctacgggctcgcccgcgcgcccaagctggtggagatgatcgccgccgtgccggaggcggaccgcgcggcgctgctgccccgcctgcgcgccaagcccgtgcgcacggcgtcgggcatcgcggtggtcgccgtgatgtccaagccgcaccgggtgcccccacatcgccaccacggggaacatctgcgtctactgcccgggaggccccgcctccgacttcgagtacagcacccagtcctgcactggatacgagcccaccagcatgcgcgccatccgggcaaggtacaatccatatgtgcaggccagaagcaggatagatcagctcaaaaggcttggacatagcgcggataaggtcgagttcatcttgatgggtgggactttcatgtcattaccggctgattatcgtgattatttcatcagaaatctccatgatgctttatcggggcatacttctgctaatgttgaggaggcggtttgttattcagaacatagtgctgtcaaatgtatcggtatgacaattgagacgagacctgattattgcctggggcctcatttgcggcagatgctatcttatggatgtacccgcttagaaattggtgttcagagtacatatgaggatgttgcacgtgacacaaacagaggccacactgtagctgctgttgctgattgtttttcattagcaaaagatgctggtttcaaggtggttgcgcacatgatgcctgatttacctaatgtaggagttgagagagatatggaaagtttcagagaattttttgaaaatccagcattccgagcagatggtctaaagatctatccaactcttgtgattcgtggaactggtctttatgagctatggaaaactggaaggtatagaaactacccaccagagctgctagtggatattgtggcaaggattctgtcgatggtaccaccatggacacgagtctatcgggtccagagagatatccctatgcctcttgttacttctggtgttgagaaaaggtaacctgcgtgagcttgctttggctcgaatggaagacttgggcttgaaatgcagagatgttagaacccgagaggccggaattcaggatattcatcacaagatcaggcctgatgaagtagagcttgtcaggcgtgattatgccgcaaatgatggctgggagacctttctttcgtatgaggatacacgacaggatatcctcattggcctgttgcgcctgcgtaaatgtggccgcaatgttacaggccctgaactcgtagggaggtgttcaattgtccgcgaacttcatgtctacggaacagcagtccctgtgcatggtcgtgatgcagagaaactgcaacaccaggggtatgggacgctcctgatggaagaagcagagagaattgctcgtaaggagcatcgatcaaagaaactggccgtcatctcaggagttggaacccgccactactaccgcaagctgggctatgaacttgaggggccttacatggtcaaatgtctggcatagggtatttcagcatcaaacggcacttgtattgcaactagaaaaatcagatgtgatcatgatgttaagtgtaatgtatttgtaaccttagtagttattttaaaaaaaaaaaaaaagggcgg

SEQ ID NO: 27963 - DNA, 1453 bp, Triticum aestivum
  Clone ID: PAT_TA_27963
gcacgagatcgcggactcgctcttctcaggcgcccacgggcgacggcacccacgaggccgtcctcagctcctacgagtacgtcagccagggcactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatcattccagtgcgagcttgtcttcgccaagatgggcatcaacccaatcatgatgagtgccggagagctggagagtggcaacgccggagagccagccaagctcatcaggcagcggtaccgtgaggctgcagacatgatcaagaagggtaagatgtgctgcctcttcatcaacgatcttgacgctggtgcgggtcggatgggcgggaccacacagtacaccgtcaacaaccagatggtgaacgccaccctcatgaacatcgccgatgcccccaccaacgtgcagctcccaggcatgtacaacaaggaggagaaccctcgtgtgcccatcgtcgtcactggtaacgatttctcgacgttgtacgcccctctgatccgtgatggccgtatggagaagttctactgggctcccacccgcgacgaccgtatcggtgtctgcaagggtatcttccagaccgacaatgtcagcgacgagtccgtcgtcaagatcgtcgacaccttcccaggacaatccatcgactttttcggtgctctgcgtgctcgggtgtacgacgacgaggtgcgcaagtgggtgacctctaccggtatcgagaacattggcaagaggctggtgaactcgcgggacggacccgtgacctttgagcagccaaagatgacagtggagaagctgctagagtacgggcacatgcttgtccaggagcaggacaatgtcaagcgtgtgcagcttgctgacacctacatgagccaggcagctctgggtgatgctaaccaggatgcgatgaagactggttccttctacggttagaacattctccatacacacccaccatctcttgctgcataggaggaggtaaaggggcacagcaaggtactttgcctgtaccggcaggatgcaccgaccagactgccaagaacttcgacccaacggcgaggagtgacgacgggagctgcctttacaccttttaagcatgccaatttaatatctgatgttttatcctttgtacctaagtaccgcatcgcatccaagcgattgctgggcatgttttgttaatataaaaagatattgagtatacctatttggtaaagacaaatagaactacttatcatttgtcactctctgtattcattccttcagtggagactgcttctgctttattgcaaacagaacaaaaaagtactaaaaaaaaaaaaaaaaaaggccccta

SEQ ID NO: 27964 - DNA, 1777 bp, Triticum aestivum
  Clone ID: PAT_TA_27964
ttcggcacgaggcagtcattcatcactgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccagcccaagctcatcaggcagcggtaccgtgaggctgcagacatgatcaagaagggtaagatgtgctgcctcttcatcaacgatcttgacgccggtgcgggtaggatgggcgggaccacacagtacaccgtcaacaaccagatggtgaacgccaccctcatgaacatcgccgatgcccccaccaatgtgcagctcccaggcatgtacaacaaggaggagaacccacgtgtgcccatcgtcgtcactggtaacgatttctcgacgttgtacgcccctctgatccgtgatggtcgtatggagaagttctactgggctcccacccgcgacgaccgtatcggtgtctgcaagggtatcttccagaccgacaatgtcagcgacgagtccgtcgtcaagatcgtcgacaccttcccaggacaatccatcgactttttcggtgctctgcgtgctcgggtgtacgacgacgaggtgcgcaagtgggtgacctctaccggtatcgagaacattggcaagaagctggtgaactcgcgggacggaccagtgacctttgagcagccaaagatgacagtggagaagctgctagagtacgggcacatgctcgtccaggagcaggacaatgtcaagcgtgtgcagcttgctgacacctacatgagccaggcagctctgggtgatgctaaccaggatgcgatgaagactggtaccttctacggttagaacattctccatacacacccaccatctcttgctgcataggaggaggtaaaggggcacagcaaggtactttgcctgtaccggcaggatgcaccgaccagactgccaagaacttcgacccaacggcgaggagtgacgacggcagctgcctttacaccttttaagcatgccaatttaatatctgatgttttatcctttgtacctaagtaccgcatcgcatccaagcgattgctgggcatgttttgttaatatataaagatattgagtatacctatttggtaaagacaaataggactacttatcatttgtcactctcagtattcattccttcagtggagactgcttctgctttgttgcaaacagaacaaaaaaatattaatttgagcttcagcttattaattattattgc

SEQ ID NO: 27965 - DNA, 981 bp, Triticum aestivum
  Clone ID: PAT_TA_27965
ggggcggtacaacagcaactagggtgcaaaccagtgagaccgagtgaaactcaaggacaactcaacttgtgacgatctcaagtcaaatctcaagctaaatgagacggtaaaaaatatataatatatggacattcagaataggaacaagacaacaatgctccggtaaagatcatatcgcatctgggcaaaacaaattcagcaccaaagaaaaaactgaccgtacaattttaagcaaaactattaatgatagatagattccacaagacatgttcagatcacgacattcttcggtttgacagaaaacacaggaatcaaatcgcaaaacagcagcagcctggtaggtttaagtgcttaaaacgtctgactatgaactactcatgaatcagagcctgggcttaagcagcgatgaaagccttcttcccgcctccggtggttccagctggaacgaccttcaggacattgaatctcacggttttcgacaggggcctgcactggccaatgatgacatggtcgccttccttgacacggaagcagggggagatgtgagctgggatgttggagtgcctcttctcatacctctgatacttcttcacaaaatgaaggtagttcctgcgaacaatgatggtcctgttcatcttggcactgtggcaggttccagctatgattctgcccctgatggcaacagttccagtgaatgggcacttcttgtcaatgtaggtaccatcgatcgcttcccttggggtcttgaaaccaaggccaacactcttccagaagcggttgccagccttgccaggcctctttgccttgtcagccttcttcgtgctgaggaaaacctttggctgcttgaggaaagacttctcggtctgctccgccatggctgcgaggtgggcttcgaggggctcggaggcggcggcggcggcgcggcgcggggatgcgggagcaaggctctgagaggagtggccctcgtgccgaatcctgcag

SEQ ID NO: 27966 - DNA, 1766 bp, Triticum aestivum
  Clone ID: PAT_TA_27966
attcggcacgaggcggtcattcatcgctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccagccaagctcatcaggcagcggtaccgtgaggctgcagacatgatcaagaagggtaagatgtgctgcctcttcatcaacgatcttgacgccggtgcgggtcggatgggcgggcccacacagtacaccgtcaacaaccagatggtgaacgccaccctcatgaacatcgccgatgcccccaccaacgtgcagctcccaggcatgtacaacaaggaggagaaccctcgtgtgcccatcgtcgtcactggtaacgatttctcaacgttgtacgcccctctcatccgtgatggtcgtatggagaagttctactgggctcccacccgcgacgaccgtatcggtgtctgcaagggtatcttccagaccgacaatgtcagcgacgagtccgtcgtcaagatcgtcgacaccttcccaggacaatccatcgactttttcggtgctctgcgtgctcgggtgtacgacgacgaggtgcgcaagtgggtgacctctaccggtatcgagaacattggcaagaagcttgtgaactcgcgggacggaccagtgacctttgagcagccaaagatgacagtcgagaagctgctagagtacgggcacatgctcgtccaggagcaggacaatgtcaagcgtgtgcagcttgctgacacctacatgagccaggcagctctgggtgatgctaaccaggatgcgatgaagactggttccttctacggttagaacattctccatacacacccaccatctcttgctgcataggaggaggtaaaggggcacagcaaggtactttgcctgtgccggcaggatgcaccgaccagactgccaagaacttcgacccaacggcgaggagtgacgacggcagctgcctttacaccttttaagcatgccaatttaatatctgatatttttatcctttgtacctaagtaccgcatcgcatccaagcgattgctgggcatgttttgttaatatataaagatattgagtatacctatttggtaaagacaaatagaactgcttatcatttgtcactctcagtgtccattccttcagtggagactgcttctgctttgttgcaaacagaacaaaaaagtattaatttgagcttcagcttatt

SEQ ID NO: 27967 - DNA, 1688 bp, Triticum aestivum
  unsure (1)..(1688): unsure at all n locations
  Clone ID: PAT_TA_27967
tagttggtagtaggatccattcaagtgttggatattcatacttcggagaagatggccttcgtagagcttgaacaggctttaaaccattgaatagctctgcacaggtgcattccccaagaagtcctaaagttcctcccccaattggtaaacagaatttccccaaagatttggtcagaggtggcatatgccaaccataaatcccacctgaagctaccggtataacacntggcatggatacccagtcctgagtgaaaaagataccgcgagcacgatctttttcaataaaatcatcgggccaattaaatcaacaaaaacttaagtcatttggcgttcccctttctaaacttaacttactaactgtaccggagtggatatgatctcccccagacatacggcaatgctttagctaatacacggaaatgcataccatgatttttctgtctatcaataactgcatgcattgcacggtgaatgtgaagaagtaggccattgtcgcggcaataatgagccaaagtagtatttgcgggtgaatcccccagttaagtagtcatgcattacaataggaacccctaattctcttgcaaatacagctctcttaatcatttcttcacatgtacccgcagtcgcattcaagtaatgccccttgatttcaccggtttcggcctgtgatttataaatagcttcggcacaaaagacaaaacggtctctccagcgcataaatggttgtgagtttacgttttcatcatctttggtaaaatcaagtccaccacgtagacactcataacacgctctaccataattttttgcggataatcccaattttggtttaatagtacatcccaataaaggacgaccatacttgttcaacttatctctttcaacttggataccatgaggcgggccttggaaagtttttgaataagtagggggaattcgtagatcctccaaacgtagagcacgtagggctttgaaaccaaatacgttacctacaatggaagtaaacatgttagtaacggaaccctcttcaaataggtctaatggataagctacataacagatccattggctgtcttccccagcaacaggctcgatgtgatagcatcgtcctttgtaacgatcaagactggtaagtccatcagtccaaacagttgtccatgtaccagtagaagattcggcagctactgcagcccctgcttcttcgggcggaaccccaggctgaggacttactcggaatgctgccaagatatcagtatccttagtttcatactctggggtgtagtaagtcaatttataatctttaacaccagctttaaatccaacacctgctttagtttctgtttgtggtgacataagtccctccctataactcttgaattaagaattctcacaataacagggtctactcgatgttaattaggcgtaaatgaaactttagcaaaaatctcgtaaaacaaaaaaaaaaaaaggatattcaattaatataatatcaactcattaaagaaaattgagggcatgcttaggttaatgaatatgtttcattcatatataatgcgtacaccctgtgtatgttctatcctataggaattccactataggaattcgataggaattgagttgttgttatggtaagttaacacggttcgttattaaaccatggatttgatcccacgcgtccgcccacgcgtccg

SEQ ID NO: 27968 - DNA, 605 bp, Triticum aestivum
  Clone ID: PAT_TA_27968
tttttttttttagaacgatgtcccgatgagcatgagcacatcttgttttatttgccgagtcatggattcaagcacatttttgtatatacacggcttattccaacttgctgtaaccggtgaactagttactcaggaccatcaccggccggccaaaggctaatgatacaatgacgatctactcgctgaactggaaacacggtagtattccgattttaactccacatgctgataacgtattgacgatctagtcggagtagctttattactgggcttccgatcaatttattactggtgctgtgtccatccacacacttcatcatggtagtgcattcttcatgctcctcgcatatgcctctagccttttcaatccttctctgggcgaagctgcttcacccaactgcctcaccatcgcactgccaatgatcaccccatccgcaccccatcctgcaatctgctttacgtgttcaggttttgatatgccaaagccaacagcaacaggtttgtcagtaaccttttttatctcttgaatgagggacttaacccgcaggttcacgttttcacggggacctgtaactccattgacgctcaccaggtaaatgaaacct

SEQ ID NO: 27969 - DNA, 687 bp, Triticum aestivum
  Clone ID: PAT_TA_27969
attaataaaatagatattattcagaaaccacacaaaatctactatttatatgtttaggattttctatttcatcaattaaggcaatggcataatcttcataacttatataactttgtttatttttatttaatattaaattatcttttccaattttatattttcctgttctttcaccatttggatcaaaaattgcagcaggactaatatatgtccaattaatatttttagatttttttaagttatctaaattttttgatgaattaatagatacattaagatactctttagggaaatcaggtgtatcatacaatttaattgttttttcatcattaataaataaacttccagcaccaccaacaacaattaatcttgtttttttattttctaataaaacaatcaacttttttccaaaaataacatgttcaatttcattaccaggggcagaatcaaatgcgttaactaaaacatcaatattttttaaatcatcatcatccaattcatttaagcttttttctattatattgcaatcaatatttattttatttttgtttctaactatagctgttacttcatgatttcttgaaattgcttctctcattataatgttacctgctttgccactagctgctataataccaattttcattttcgaatatatatgtatcggacgcgtgggcggacgctggg

SEQ ID NO: 27970 - DNA, 553 bp, Triticum aestivum
  Clone ID: PAT_TA_27970
attacacacaatctaacaatattcactatttcttctctttatgttttaagcatttccaacattgagaagcaagttggagccttgcttgttattaggtaaataagtaacattactagcttgagataatgtttgtgcaatttcctttgaagcctcaatctttctaaaggcaatgaatccatcgccagccttagaaagagcagaggaaatcatctcagcagcttgagagtcaccttcggcacgaatgatggctgcttgcttttcttgttctgcgcgttcaacaatgaatttagcacgttcagcttcttgctgagcaatttgcttttgttcaacggcgttagtgaactctctaccaaatgtcatgtgcgtgatagacacatcttccaatgcaatgttgaattctctagcacgcttatatagttcttcacgaatctttgcagaaacaacttcacgttgagtaatcaattcagaagcatcaaactgcgcaacaatggatttcaatacttcattaccaatagaaggtagaactctttcatcataatcttcacccaagcga

SEQ ID NO: 27971 - DNA, 604 bp, Triticum aestivum
  unsure (1)..(604): unsure at all n locations
  Clone ID: PAT_TA_27971
gcgcacctgggcccgggttcaccgtggcacatgtcgtcacaggagtggtcggtggggtcaaagatagacaccacgcatctcttgcaggtgggggcgcaccggtttacgttgtccagccagcgncaggccggcggcacggacctagtgcacagaggccggtcgcaacacctcccccacggcgtcgtctcctccgccaccgtttcttgatgagcaacgaccaccggaccacttgggacgtcgtcggcgtcgggctcggtgcagttggggccgggccagccatggtaccggtcgttgcagatgcgcttggaagggtcggacttggacgcctcgcagcgggtgcaggcctcgtcgcactgctccaccgcgtccatgcagcggcaccgcggcgggatggacctgctgcacaacgggctgtcgcagcacttccacggcctcttcttctcggcgccgatctccgttgccgcggtcgctacttcatcagcaagaccgttgctcggaagacgaatggtgtccacatggtcgtcggcggcgagaccgacgagggccccgagggaaagcactagcaggacggcagcaatggattctcttcatggactgcaggtcg

SEQ ID NO: 27972 - DNA, 966 bp, Triticum aestivum
  Clone ID: PAT_TA_27972
ccggccccgtgaccgagccctcgtacctggcccctgataggccggacgactcactttgttctatttgctatcaccccgtccaagactaggacaacacttaggtgcgcagctactccagtgcatccaagactccgtgactcggtacccagaccaggccactgaccggccggacgcctccctttatgcgatcccccatcacccagtgcaaggcggcatgccgcacgtagtgctcggcgttcatgctcatcctagctagaaaccgcggcggggctcgatcccgctgcacttgggcccgggccagccgaagtagcggtcgcggcacacgaagcgggaagcgtccgactcgtccttctcgcacttcttacaggtcttggcgcacttcttcaccttgtcgttgcaggcgcaggtcggcggggcagacctggtgcacagggtgtcgtcgcagcacttccatggcctcggcttctccttgccgacgacggcgctctcctcgctaacaacttcttcttcctccgctgccaccgcgaccggcggaccagaaactcccggaccacttgggatgtcgttcggcgtcggggttggtgcagctgggcccgggccagccgtggtaccggtcgttgcagatgcgcttggaagggtcggactgggacgcttcgcagcgggtgcaggcctcgtcgcactgctccaccgcgtccatgcagcggcaccgcggcgggatggacctgctgcacaacgggcggtcgcagcacttccacggcctcgtcttctcggcgccgatctccgtagccgccgtcgctacttcatcggcaagaccgttgctcgggagacgaatggtgtccacatggtcgtcggcgacggtagccgagaggcgcccggcggcgagggcctcgagtgaaagcaccagcaggacggctgcaatgcatctcttcatggctgcacaggcagatcgatcactcgtgccgaatc

SEQ ID NO: 27973 - DNA, 1144 bp, Triticum aestivum
  Clone ID: PAT_TA_27973
aaataaattcaaataatatctttaatcaatcaaatgataaacacccttcttcacttgtccttctcctttttcataaggaagatcaaatactgcgttactacggaatcttctcaaaaagtgaatagcaactgtttctaattgagtgggttcaatatacaagtctttaaaggttaatgctccaggcgtaggtttatcatccattttcaatctttcaattaaatcaggactgacttgttgattataaggtaatttgtctacaatagtagccatgaatttcaatacactatcaggcacattacgaataggaaggggttgcatagagatttcacgagcaagttcataaatctccttcatcttatattctttaggtccataaagttcataagtcttacccatcgtagattcagcagtcaacatcacttcaagggcttgagcaacatcaatcgcagaaacaggaagaatctttgtgttgccttggtttacccaatattgccaaccatcaccatctccaatcctgttcaagaaacgatcctcatgtccccacataataccaggacgaacaacagttgtctcagggataatttcacgggctaccttttctcctaaagcttttgtacgaagaaatttggaaggtgaatcttcagatgcattcaaggcagacacctgaacaaatctagccacaccattttctacacaagcttcagccaatgcccgagtgccatcgacatgaacattttcaaaggtaaagttttttgtctcataatcacgaccaatcaagttataaacaatatcagaatgacgaacacattctgctaattgttccttatttcttaaatcaaactccaagggaacaatctgacctaaatcaccagtcactttaagatgtctagcttcgtcagggtcacgataagcaaccacaacttgcgtgccttgttgagcgagtctgttgacaacataacgccccaagaaaccagtacatccaaagacagtagcaatgtgcccattggtggaagatcttccacctagaccatatctaatcatgggttgttcagtcttttttctaaaggttaaatcatgtacagaacgagtttgactgacagttgctactttggcaataacattggaacgtccaatttgttttact

SEQ ID NO: 27974 - DNA, 1098 bp, Triticum aestivum
  Clone ID: PAT_TA_27974
aaaactattatttgctttattatacaatctaaaaagattcttctttttatatataaaagggaagaaaagggtaaaaaaagcacatttatacatttggaaaaaaaaaacctctcttctcttctctcttctttaattatttttgattattattaacagttgttcctctgccttttcctgtattattattgttacgcgtattttgtccttgacggcgatggttattgggtctacgttcaaagttattatttgcgttattataattttggtttcttccttggttgttatagcgattgcctgattgattactgtttgtaaatcgacgttcttctgcaagcactgtacttccatttgaaagaggtattttatgaagagccaaagcctttggaacagattcagatgaagcaaattcaataaaggcgcagtttctaggtctagaaatgttgatatgtttcacagcaccaatctttgtaaaggcctccctaagctgatcttcattgattccttcatacacttgcttgacgaaaatttgagtgattgaatctttgttacgaggagcttgattcttgtgttgatgtgtttgctgttgtggttgaactggtttttcagtattactagtaacgggtggttcagctgcaggggtaacaggtacagacacttcagcaggagcgggggtaggagtaggagcgggagctggagtagtaggagcgggagctggagtagtaggagtggtagggacagcagtggcagcggtggcagcagtagcagtagtggcagtagtggtagtagcaggaatagtagtgaaaccgttggaagcagccgcagcagcagtcaaattggcccaggtctttgcagtcattttatttgattcatgtttctgctgagactgtttattgggttgttttgattcaaatttcttcttcttttcttcgtgctgctcctcttttatagatgccttggaagggataggtgaagcaatgacaggggcagaaacagattccgcagtagaaacaatctcaggttttttaacttcctgtttcttttcctccactttttcacttccctttctttacttcttccacaggttcttcctttttgcga

SEQ ID NO: 27975 - DNA, 951 bp, Triticum aestivum
  Clone ID: PAT_TA_27975
tccaactgaactgaaccaattccattccatatctccactccaaatcccaagaagcctcgcgtacgttcgttcccaccaccagcgcgcacgccatggccgacgctcccgccgtcgacgtggagaaggccggagcgccggctggaggggcccccgacggctccggcggaggcggcgcggtgggcgcgatcgtcgggcgctggcggcggcaggacctcctggacaaatccgggtcggcgctgcgggcggcggcgtgggcgttctccctgctcgccttcctcgtcatggtcgccaacgagcacggcgactggaggcagttcgaccactacgaggagtacaggtacatcgtggcggtggggctgctggcgttcatctacaccacgctgcagctggtgcggcacggcgtccggctcagcggcggccaggacctgcagagcaaggtcggcctgctcgtcgacttcgccggggatcaggcaacggcgtaccttctgatgtccgcgttgtctgctgcaatcccgatcacaaaccgcatgcgggagggctcggacaacgtgttcactgactcgtccgctgcctcgattagcatggccttcttcgcctttgtttgcctcgcgctctcggctctcatctcaggtttcaagctgtccaagcagacctacatatgacgcttgtgacatatgggcgaggtctgcttcatcggtgcccatttggttccctctcgacgttgtacagtccatttggttcttcttgatgtatacatatatcttgggtttcttttgtgctccagactaatggctgcttcttttacgtgcgtgcttatttaggtgtttatatcgtcgcgccaaagtatgtaattatgtttcacgcaaatgaatgagagtgtgtgctcaaatgattcttgcaaatcaaggaatgtgtgttctgctgaaatattctgttgcgaagattatgttc

SEQ ID NO: 27976 - DNA, 635 bp, Triticum aestivum
  Clone ID: PAT_TA_27976
atccatcgttagaactagcctggtcacaccgaaaggataaggacgagcgaccagagatctccagcttcttcgatccccaatccacccgacatagtcggagtcccccacggctcccggtcgcgtgtaatgcgacgggcggagactcgtgctcgtccacggaggaggagacaccggagagatgggtgctgggtgcgacaccgaccgcgagcccgagcgtcgccgggctccatgccggtgcgggcggagcggctgctccacggcgggacgtcaagggccacgggacgacggcgagcacccgtgcccggcgaagaaggtgggatggccggcgttggagaggatggctactgcctccgccgtaggtacgggcatcgggtccgtaggcggccgcacgcgctgggcgccgtcgccaatgggccaaggtcgcctcctcggtttgatgcgacgccagggccgccgccgacttaggtcgcctgaaggacaaggcaaccggagcgccgtgccgacgcggacggcgtggctgcagcggtgctgctgccggcgacgtcgccaagtgcgaacagtacagaagaaattgatgggggtaaaaagcatgttgctttgcctttcttctgcttttccattcttacctttcttct

SEQ ID NO: 27977 - DNA, 652 bp, Triticum aestivum
  unsure (1)..(652): unsure at all n locations
  Clone ID: PAT_TA_27977
ccccgacgcaccgaggcagccgcagctgctggcgatccgcgggcgctccggcacggcccgaacatgcatacatcgatggcgatgaaaaggacctgcaggacggcccttgtcgcagcggtggtggtgatggccctggcggcgatggcgccgccggctgtgtgtgagagcaagactagcaagcagcaggagaagaaggggccgctggcgacggcggtgatcgtgttcggcgactccatcatggaccccggcaacaacaacggcctccacacggcggtgaaggcgaaccacgcgccctacggcaaggacttcgccaaccacgagcccaccggccgcttctccaacgggctcatacccaccgacttcatggcccagggccttaacgtgaagcaactacttcctccgtacctgggggtggagcacaccccagaggacctcctcaccggcgtcagcttcgcgtccggcgccaccggattcgatcctctcacccccgtcatcgtgaacgtgatctcgctggagcagcagctggcctacttcgacgagtaccggggcaagctggtgggcatcgccggcgaggaggagacgcggcggatcatcgacggcgcgctgttcgtggtgtgcgcgggcacggacgacatcgncaacacctactaca

SEQ ID NO: 27978 - DNA, 891 bp, Triticum aestivum
  Clone ID: PAT_TA_27978
cccacgcgtccgcccacgcgtccgcccacgcgtccgataccaaaagagaatgcagatcaatggctcaagtatttacgtaatgaatatccagctattgctttcaaggcatccactcaacatcagcgtgagaaactcaagcaatcgaatgtgtctacaaatgctgcgagcgagagtcttttgaatacatcagaatgtttgggtgctgatgatttaattaaattgttaaagaactattgtcgaaatttgaatttgaagacatctatcacagtaggcatcattggttatcctaacgtaggaaaatcatcagtgatcaactcactcaagagatccagagtatgtggtgtcggagcaacaccaggatttacgaaagttgctcaacagattacattagacaagaatatcaagctattagattgtcctggtatcgtatttgctcaacaaggacaaggcgatcaaaatgaagcagagattacattaagaaattgtgttaaagtagaactgttggaagatccagtcactccagtggaagtcattttatcaaaatgtggtattgagcaattgagaaaaacatataatttatcattcttcagtaatgtacatgaatttttggtgttattagcacagcaaagaggaaaattaaaaaagggtggaattccagatgtagatcaagcagcacgacacgtacttaatgattggaacggaggaaagattccattttacagtgttccaccttctagcaaacaaagccatattgatgcggctgttgtgaatacatttgcacaggaatttgatgttcagtcaattgcacctagtaatttagacagtgctatgtctattgattagaaaatgaaattattctttttattaaacctgacctattgaattttattt

SEQ ID NO: 27979 - DNA, 516 bp, Triticum aestivum
  unsure (1)..(516): unsure at all n locations
  Clone ID: PAT_TA_27979
ccgggtcgccccagccgtccgcgnattttatctgggtaagggacaacctanggtttngacgctgctcgtaagctccgtattcaccgtcgtgatcaacgttgggctgataagcaatacaagaagagagctcttggaactgctttccgctcttctccctttggtggttcttctcacgccaagggtatcgtccttgaaaagattggtgttgaagccaagcaacctaactctgccattcgtaagtgtgttcgtgttcaattgatcaagaacggtaagaaggttactgctttcgtccctaacgatggttgtttgaactacgttgatgaaaacgacgaagtcttgattgccggtttcggtcgtaagggtcgtgctattggtgatattcctggtgtccgtttcaagattgtcaaggtcgctggtgtctccctccttgctttgtacaaggaaaagaaggaaaagcccagatcataaactttcttttgcaaaatcgcttttttgaaaataaaggcttgtttctct

SEQ ID NO: 27980 - DNA, 550 bp, Triticum aestivum
  unsure (1)..(550): unsure at all n locations
  Clone ID: PAT_TA_27980
gatataaacaatggagccaaacagacatttttacttgaagcagatacaaagaggcttatatgttgatgttgaaaacaacagcgttgatgttgatgcttatattgttctcaaggacaagaccgataacgactgggaaggcaaacaagtgtggtactttgatgaaaaggagcaaattgtcaatgtgcagtctggaaaggtcattggttttttggaccacgaccctaacactagcaatcactatactttggttcaaaaggaaaaccagcagaatcctgaattccaatggtggtatgaagaggaaaggatgattatttatagcaagttattgggacctgcctataaccttggtccacacgctggtaacgcatttgatggggccaagctgtgtatggaacaaggaacccctgcgccaggtccatcagaacgctttgaagttatctataaataaatgaattagcttgaacacttttttctattatctttgcgaaataaagtctgctttgttaagcttttaaacctagnnntgggangnngaatgtagtgggtgatt

SEQ ID NO: 27981 - DNA, 996 bp, Triticum aestivum
  Clone ID: PAT_TA_27981
cccctgaccgggcccacgtccatcggcctggccatcggggcggccttcatggggcaccgcgctcgtgctgacgatgccatcatacaccagcctcgagaggagggtggtcgtgaaggcctccggtgcgcagctcgtgctcactgacccggccaaggggatgggaggcaccgtcaggaaagcaacccagcgccatccgaaccctcccagcgccttcatgccccagcaatgcgcgagtcccgccagagtccagctgccctacgagactaccggtccggcgctggcggggcgacatcttgggcagggcaacagcttcgtgatgggaatcggcaggggcgccaccgtcaccggagtcggcaaagtacctcaaggagaagaaccccaacgcaaagatctatggagttgaacctgccgaagcaaatgtcctgaacggtggcaagccagggcctcacctcatcactggaaatggagttggatttaagccagatattttggatatggatataatggagaaggttctagaggtgaaaagcgaggacgccgttaagatggcgcaacagttggcactgcaggagggcctgctggtggggatatcatcaggagccaacacagtggctgcgatcgaactcgcaaagaggccagaaaacaaagggaagctcatcgtgactgttcatccgagcgcgggagagcgatacttatcgtcggcgctattcgagggtctgaggaaggaggctgaggcaatgcagccagtgccagtggactaagttggagctatacaatgcatgtagaataaattcactgcaaccatgttgcaagtgctagtcatacctcatttgtgattcttcagtttgttcatcatgtggaagtcgtgtaaacaacagttgaaatggttgaaaaaaggactttacctctctggaaaacaatgaagccctacatgtgttcttcgtctcggccgcgtccacgcggaccgctagcgggttcaattacccttaaaaccct

SEQ ID NO: 27982 - DNA, 361 bp, Triticum aestivum
  Clone ID: PAT_TA_27982
gagggcgccgcctttggcttcttcaacggcgaccgcgtgggggagtggtactcggacggcatggccatggagtgggacgaagggagaagctactgctccttttacccttcctacggcggcgaggcgtgcgcggagcaaccgtacatcagtccattgtgggagtgaactagttctctatcgtgacaaaaaaaaagtctagtagtctggctagaagtgtgtgtgagccttttttttagctagaagtgcgtgcgagcctttttcttagctagaactagaactagaagtgtgtgtgagcctttgttttttgagccaaaattgtgtgtgagcctttttttggagccaaaagtgtgtgtgagccgtg

SEQ ID NO: 27983 - DNA, 272 bp, Triticum aestivum
  Clone ID: PAT_TA_27983
ggccttagcgcaggcattgatgtacagaatcgttcgacagaagatgcctcaggccgacggaggtatcagccggatgcgttggcggcactatgtgtggtgcgtgatcaaggcggtgtttgtctggcaagcgtactgcgagcgcgcacgtaggttgatgtgcctgcgtacacagcaagtgagcgttgatactacaaggacagaggagggcgtccgaatgtatcaggtgggctgagaggagtctgattatcaaaccatcatctagacatggcgtg

SEQ ID NO: 27984 - DNA, 707 bp, Triticum aestivum
  unsure (1)..(707): unsure at all n locations
  Clone ID: PAT_TA_27984
ggnctgcaggnaattcgggggggaaactcgccgcgccctcgccggttatccaccacaattcctcccacgttccagcgaagcctcgcacaccacaccagagcaccttcccccgtcgccgccgccgccgcagcagcagcagtatccatggcgccgaaggctgccgagaagaagccggtggagaagacccccgcggtcaagaagcccaaggcggagaagaaggtgccgacgtccaaggagggcggcgagaagaaggggaagaagaagtccaagaagagcatggagacgtacaagatctacatcttcaaggtgctgaagcaggtgcacccggacatcggcatctcctccaaggccatgtccatcacgaactccttcatcaacgacatcttcgagaagctcgccggcgagtccgccaagctggcgcggtacaacaagaagcccaccatcacatcccgggagatccagacctccgtccgcctcgtcctcccaggcgagctcgccaagcacgccgtctccgagggcaccaaggccgtcaccaagttcacctccgcctgatttggcacgtcgtctgtgtcttctttggcagatcagatcgatggcgctcgctctgtagttagctgttcgtgctatgtcgtcttgtaacttgtgctggttcatgatctggagaaatagtaacagcgcttatttcggttctttcaaaaaaaaaaaaa

SEQ ID NO: 27985 - DNA, 677 bp, Triticum aestivum
  Clone ID: PAT_TA_27985
gaagctgaaagaacttatacctcggcaaatgtttaaaatacctattcaagcatgtattggtgcaccggtcgtccgcccacgcgtccgatcagccatcaggaaggatgtcttgtcaaaatgctacgggggtgatatatcaaggaaaaagaagttgttgaaaaaacaggcggaaggaaagaagagaatgaaagcaatcggaagggtcgaagttcctcaggaggcattcatggccgtgctgaaactggaaaaggaggtgctttgagttgtgaaagacctccagattctgtgtcatttgggcgagcggcgccctgaagctaatgcgttttgagacaaagaaaaaagcaggtcaatggaaccaaccgaagaactgagctgctaatctggtatttatttgttggcatgtcaggttatgaagctaaaagatgccgtgcaactcgagtgatctgccggtctgtgcagttatttgcgtgggttggtaaacgaacgatgtcaatctcatcatgtaacctgggcaggatgtatcattttggtatatcttttcgccaaggatggctgccaggcctgtagtatcctgtacagaaaggttcggcttcacaaaagttttttggttggaaaactttgggctcaggcggatgctcacataaacctcgtcccgttttcccttgaaaaaaaaaaaa

SEQ ID NO: 27986 - DNA, 758 bp, Triticum aestivum
  unsure (1)..(758): unsure at all n locations
  Clone ID: PAT_TA_27986
nntccgtgctcttagttgctgctgttcaaattcaagctgctgtcaaccctaaactgctgctgcttccaagtgcatttctggctcctctggaagggtaatggtgatggttacaaggggctnnactgctgcaaggggacagtgatgnnattgggttttaatgcctgcgttaagggtgtctgcaatggatcttccaagcctgatcctactcctactcctactcctggaggcaagtgcactcccggatctaagggacttggtaatggtgatggctacaaaggatactgctgtgatgatagtgatgattgtatcaacagctgtgtaagcggcgtctgcaatggtcctaccaacacagcaaccaagactactactacgaagactactacagccaccgctactgctaccccaggcaagtgttcccctggatctcaaggtctcaagaatggcgatggctacaagggtgattgttgtgataccagcgatgattgtgttaacagctgtgtaaacggtgtctgtaatggcgaagttaatcctaatcctaatcctggtaaatgtattcctggttacaaggacaaaggcaatggtaagggtcccttcaatgcatgctgttccgagaatgacgactgtcaagaggcctgtgtcagaggcagatgtaccaagccttaaatgcatttttataaacatttcctctttcttaatttgaccttgttatcatgcttcacaataaacaactaatcataaattttgtaaaatcatatctc

SEQ ID NO: 27987 - DNA, 798 bp, Triticum aestivum
  unsure (1)..(798): unsure at all n locations
  Clone ID: PAT_TA_27987
gtcgaccagcgtccgggcacaaaaaggacaagaacgtcatttgcaaataattttcgatgccgtacgaaccnaaggagcctatncgaagcttttgatgagcgtacaaaagggttgaaaaaaaactngancaaaaacatncgtnatnntcttcttctgccggaactgcctatgtgacgtttgaaaaagtaaaagtgcctgtagagaatttacttggccaagaaaacaaggactttttgttatcctctctaattttaatcatgaacgctggagcatgcttacaagcgctacgatgactgctcgtgttgcagtcgaagaatgcttcaaatgggcacatcaaagaaaatgtttggtaaacgattaatagaccagccagtgatccgttttaaattggcacgcatgatttcctccgttgaaagtgttcatcactggttagaaaacttgacttatcaaatgaatcatatgagctacaaagaacaagctacaaagctcgctggccccatagccctttgtaaatacaaggtgactagaatgttgcatgaggtttctgatgatgcttgtcaaatattcggtggcagagccattacaaaaacgggaatgggtagacagatcgaaacattgcaaagaacatacaagtttaccgctatccttggtggcagtgaagaggtgatggctgatcttggcgtacgccaggcaatgaagaattttccaatgggggctcgtttgtagcttgtatgccttggtaaacaaaacaatggtatattgattctctttaaaataaaagatagaatatacaacaat

SEQ ID NO: 27988 - DNA, 1184 bp, Triticum aestivum
  Clone ID: PAT_TA_27988
ataaaaagggtcttcttgatattgttcctgctggtgttgttactggtaaaaaccttttgaagctctttgaatatgctcgtgaacacaaattcgctattcctgctatcaactgtacttccaccagtactgtaaatgctgctcttgaagctgctcgcgacatcaagtctccaatcatcattcaattctctcaaggcggttctgctttttttgccggtaaaggtttggataacaaaaaccaagaagcgtctatcattggtgctgttgctggtgcccagtatgttcgcgctgttgctaaagcttacggtattcctgtcgtcgttcattctgatcattgtgccaagaagcttttaccttggttcgatggtatgcttgatgctgatgaaaaatattacaaggcccatggtgaaccccttttctcttctcacatgctggatctctctgaagagcccaaggaagaaaacattgagatctgtctcaagtatctcaagagaatggctgctattgactgctggcttgaaatggaaattggtatcacaggtggtgaagaagatggtgttgacaactctggtgttgacaacgctgctctttacactcaacctgaagatatttgggatatttataaagcctttaaggaactcagccctctcttctctattgctgccggtttcggtaatgtccacggtgtttatgctcctggcaacgttaaattacaccctgaactcttgggtaagcatcaaggttatgtcaaggagcaactcaagaacaatgatcctaaacctgtgttctttgttttccatggtggttctggctctagcgaagaagaaatcgctgaagctgttcgtaatggtgttgtcaagatgaatgttgatacagacactcaatgggcttactggaagggccttaaggaattctatgaaaataagaaggattatcttcaatctcaagttggtaatcctgaaggacccaacaaaccaaacaagaagttttatgatccacgtgtctttattcgcgaatctgagaaaaccatgattcagagagttcaacaagcttgtaaagacttgggcaatgttaacacattgtaaataactccattgcttaatctgtttatcctatctttaaaaaaaatcaattttttttgtattccaataaaaaaacatgtatgcataaataaataataacgcatt

SEQ ID NO: 27989 - DNA, 593 bp, Triticum aestivum
  Clone ID: PAT_TA_27989
aaaatgtctttatccaacaaactttccatccgtgaccttgacctcaagaataagcgtgttcttattcgtgttgacttcaacgttcctatgaaggatggtgctatcaccaacaacaaccgtattgttcaagcacttcctactgtcaagtatgctcttgacaacggtgcttctgctgtcatcttgatgtctcacttgggtcgtcctaacggtgaagctgttgccaagtactctcttaagcccgttgctgctgaagtagagaagctgttgggtcaacctgtcgaattcctcaacgactgtgtaggtcccgatgtcgaaaaggcctgtcaatctgccacgggtggtaaggtcatccttttggaaaatcttcgtttccacatcgaagaagaaggttctgccaaggtcgagggtcaaaaggtcaaggcggatgctgaagccgtcaaaaagttccgtgcctctttgactgctcttgctgatatctatgtcaatgatgccttcggtaccgctcaccgtgctcactcttccatggtcggtgttgatcttcctcaacgtgctgctggtttccttatgcaaaaagaactcgagtactttgccaa

SEQ ID NO: 27990 - DNA, 607 bp, Triticum aestivum
  unsure (1)..(607): unsure at all n locations
  Clone ID: PAT_TA_27990
agagtgaccagaagggagagagagcaatggcggctcaggcacagaccatcgaggttcccacggacgctgagctgctgcaggcacaggctgacctgtggcgccacagcctctattacctctcctcaatggggctccggtgtgccgtcgagctcgagatcccgactgccatccaccggcttggtggggccgcctcgctgcccgacctgatgtccgcgctgtcccttccctcggttaagatgccatttctccgccgggtcatgcgcgtgctcgtcacgtcgggtgtcttcgcagccgacaacgagtccgggtccggcatggcgatctaccgcctcaccccgttgtcccgcatcctggtgcacggcgtcgtggcggatgagcaccacagccagaggtattttgtgattggtgtcacctcgccgcattacacggaggcggcgctggggctggccggctggttcaagaaggacaccgagccaccggtgccgtcacccttcgaggacatcttcggggtgccgctctgtgatgacagaacgccgctccttgacgaggagctcgacgatgttgtcacacaaggcgtagctgcccatgacaacctgnggattgccac

SEQ ID NO: 27991 - DNA, 1376 bp, Triticum aestivum
  Clone ID: PAT_TA_27991
gcagaatgggacgggcaaaggcagagagggcgcaatggcggctcaggctgagaccattgaggttccctcggacgctgagctgctgcaggcacaggctgacctgtggcgccacagcctctattacctcacctcaatggcgctccgaggccccgtcgaccttgagctcccgccggccagccgccgcctcggcggggccgcatcgctgcccgacccgatccccgccctggcccttccctcggttacgatgccggtccttgcccgggtcatgcgtgtgctccgcaacccgcgcggcctccccgccggcgacgactgcgagccccgcgcggagctctaccgcctcaccccgctgtcccgcgttctggtgcatggcgtcgtggcggacgagcaccatagccaaaagtatttcgtgcttggtgtcacctcgccgcactacacggaggtggcgctggggctggccaactggttcaagaaagacatccagccaccggtgccgtcaccttccgaggggcgctccgggatgccagtccctcgcgagaaaactggccgctgcgcccactcgccgctcgccggttcccgacccacggcggcctgcgccttccaccagcgagggggcggcgccatgccacgtgcgagcggcgacaccttctgacgggctcgggccccggactgggtgcggcggcgagagccatcatcacggcttacccccacaccaagtgcactgcgctagacctgccgaaggtggtccgccaaagccccagcagatggcctccgttacctgtgtcgcaggtgacttgttccattccgtcccatcatcacaagttgtggttgttcaaccttgtgctacacttgtggaagctgtgaagattgtagcgaaaatcataactcactgcaagaaggccaagccggccgcgtagatggagggaggaaagataataatcattgaaattgtggttggaccttccttagggccaatattgtttgaagcccaactccgttagtggatatgctaatgatggtgaactcaaaagggcgtcaacgggatgaaaatgactggagcaaactgttcgctaaagcggggttcacggactacaaaattgtgaagaaactaggagctcgatgtgtcattgaggtctatccataagatattgtgctatatgcacattaataaagggagtacctattactataaatgtaagttgcatggacagtaagtagtttataagtgcccagcttaattcattgctttatggtccatgcaatgttggctttgggaagtaataaagcacttggtgtgcatcttctatcatgttgctaaagatggtttgttgtatgtcatcgatctattatatgtttttttaagaaaaacattcttgacc

SEQ ID NO: 27992 - DNA, 410 bp, Triticum aestivum
  Clone ID: PAT_TA_27992
cgaaaatatcaattcaaatcacagctgaacctttcccaatcatgacgactatcaccctcctccccactcctgtccccacaacaaccgccgcagacctcgctttcgagcgggagaaagccgccataacttcttacgaagaaggttgggatcgatgggatggaccgatttatccaatcggctatgcgcagtgtcggatgcaagaagatggatatgttgcgccgagcaaaatcgaggagatgaaggcggaaggcgtggatgttacggtgaccgaggtcagcgaggagtgaaggcgcgttgcagattttggaatgatgatttcttgggtgttgcggcgcttgggacgcgaacttgttacatggcctagctttatttagctgtgtatttcacctatcgattttacctctggtgtt

SEQ ID NO: 27993 - DNA, 253 bp, Triticum aestivum
  Clone ID: PAT_TA_27993
acgacggcggcggcaacatcttcccacttctctagaggaagctacctacccccctcccccctgctgttccggggcatggtggcgctctgatcccgtctagctgtatattaataagcagactgtatgttgtcaatgtggaaggtcggcagtatatatgtgtatgcagatgtatgtaaatagcataagcccagtggataataatgatgataataacaggatacaaaacattttttctatgcgtccgcgcttcctt

SEQ ID NO: 27994 - DNA, 942 bp, Triticum aestivum
  Clone ID: PAT_TA_27994
gccgccgggccgaaaaaaggggaatccgctcgccgccgcgcgagtccgtcgcgatcgccaccacctcccgcgccctgccgccgcggttcccctccgccctgctccggcgccggcgccgcgccgcctccttcgtcccggtcgcgtccgcctccaagcggagagacggcggcgagggggaggacgccggagcccacaagccgtccaggcggccgtcttcgtcctcggggggcgagcccacgggcctcgcgccctacggcctctccttctcgcccttctccaaggacgcggccatggggctggtgatgagcgcggcgacggggagcggctggacgacgggttcggggatggagggcccgccgatggccgggggcgccgcgaaccggccggaggtgtcgacgctgccgtggtcgctcttcacaaagtccccgcggcggaggatgcgggtggccttcacctgcaacgtctgcgggcagcgcacaactcgcgccatcaacccgcacgcctacaccgacggcactgtgtttgttcagtgctgcggctgcaacatcttccacaagctggtggacaacctgaacctgttccacgagatgaagtgctacgtcggccccgacttccggtacgagggggacgccccgttcaactacctcgacggcggcgatgatgatgacaccggcaacatctttccgcttctctagggtggcgaggcggaccccttccttccgccctggcgcatggtggccatgggagccctgcgatcccggttagctgtatgttaataagcagactgtatgttgtttatggtcgatgggcgcccgtaaatatgtgtgtgcagatgtatgtaaatagcataagtgcagttgataataataatgataataataataagaatcacaacatacagaagttaaaaaaaaaaaaaaaactcggtcgacgcggccgcga

SEQ ID NO: 27995 - DNA, 626 bp, Triticum aestivum
  Clone ID: PAT_TA_27995
tgtgcctcaacgggtcttcttgttttgtttggtgctgaaatacctcactccgcctcaattaagctatctctgattgatcggccgtccgcgcgtccatcagctcggagaagaccgtccattaatcgttatcaaccagtgctacgaagatgagttcctccgacgacctcgccggtggaaagaagacttcgtggccggaggtggtcgggctgaccatcaaggaggccaaggagatcatcctgaaggacaagcccgacgccgacattgtcgtggtgccggtcggctccgccgtgaccgaggacttgaggcccaaccgtgtccgcatcttcgtgggcaccgtcgccgagaccccccacgttggataggtggatagctcttgctggcttgctgtggcctgcatacatagatgctggctcacgaatgaatgaatatggagaaataaagaagtatgcaggtcatgtgtgcttaatcggtgcttaaagtgtgtgcttaatcggtgttgtggaaatttttattttattttaactcgttttgcgaacttgtatcgaactatgtatttgatggctactttgtataataatatggatgcatgcatcgttttgatgcagagaccggggtaatccttcttt

SEQ ID NO: 27996 - DNA, 921 bp, Triticum aestivum
  Clone ID: PAT_TA_27996
cccacgcgtccgcaaataaactacacaaaagctatttacatcaaagaagacgtcctagcgatataacttggtgaaatgtacgcgattgtgagagatgttcctacaacttttgataagtgtgtgacaaccgttgacaatacagtaagtccaatcgacatcagcttggcaaagaaacaatataaagaatatgtaaatgctttgagagaacatgttgaccatattgttgaaatacctgcagatcctttacatccagattgctgcttcatagaagatacagctattgttattgaagacacagctgttgttaattgtttaggagcagagtctagaagaaaagaaatttcggcggtggaaaaagccttgagaaagatacctgttattaaagatgtcgttcgcatggacgagattgacccacaagctactttggatgggggtgatgttttgtataccggtgaacacctcttcgttggactttctcatcgtacaaaccaacgcggggcagatgttttaaaaaaagtattttcagaaaaatgtccagtttatactattcatagtttattagcccacaatttacttcacttcaagtgtatagtgactatgttaaacgacaagacgttactagtctatgatcacaaggcaggtttggatgtagtaagtgagatcgagggctacacaaaggactggtacaatattatcaagatccctgaacaaatcccctcaaatatcgtcagcttgtctcatgggaaggttgttatttaccaacaaggcttttcagaatcagaaaatgtactaatgaaggagttgaaagaaaagagaaatgtaaaactaaaatcattaaatatgagcgaatttattaaggctgatggatctttgacctgctgttctattcttgtttaataaaatcatacgacatataatatg

SEQ ID NO: 27997 - DNA, 595 bp, Triticum aestivum
  Clone ID: PAT_TA_27997
gctcctcagctgcgctagctagctagttgccgtccgaatacgtctgtggactcttgtcctcagctcctcagctcctcgatgctacagtgcgagcatgggaggcgaggacgcgccgggtcggctggagagcatcctgacggacacgtcggcgccgctggcggagcgcgcatgggcggcgggggccgtcgagctccggatgctggcgcgcctggctgcgccggcggtggtggtgtacatgatcaactacgtcatgtccatgtccacgcagatcttctccggccacctgggcaacctggagctcgccgcctcctcgctcggcaacaccggcgtccaaccgttcgcttacggcctcatgctgggcatgggaagtgcagtggagaccctctgtgggcaggcctacggtgcacacaagtacgacatgctcggaatctacctacaacgatctgtcattctgttgggcttaaccggcataccacttgctgtgatgtacgctttctcggagccactcctcttgttgatggcacagtcacctgagatagcccgcgccgcatcgatcttcggtaatggactgattcctcagatcttcgcgtacgcc

SEQ ID NO: 27998 - DNA, 618 bp, Triticum aestivum
  Clone ID: PAT_TA_27998
caaaatgcccggaggaggagaaatgccagaaacaaaacaaatcccaaagaataaggcatgtcttatctgtattgacggatggggtatctctcccgaagaagatcataaaggcgatgctatttacaatgctgaaacacctgtcatggacaaattagaaaaggagcatcctttcacaagtattgccgctcacggattggcagtaggtcttcctgatggtttgatgggtaactctgaagtgggtcaccttaatatcggcgctggtcgtgttgtatatcaagacattgttcgtatcgaccttactatgaaaaaaaaagaatttggacaagtagaaaatatcaagaacgcctttgagcgtgccaagagcaccaatggacgacttcattttatgggtcttgtttctgatggtggtgtccacggtcacattaatcatttagtttccttgctggaggctgctagagatgctggtgtccctaagtcctttattcatttctttggtgatggacgtgacactgcacccaaatctgctgcaggatacatgaagcagcttcttgaatctttggataagcttcaatatggtaagattgctgatgtcactgggtcgttactacgccatggatc

SEQ ID NO: 27999 - DNA, 589 bp, Triticum aestivum
  Clone ID: PAT_TA_27999
cccacgcgtccgcccacgcgtccgctcccctccccaccttctccctccgcctcgccttctctcgacggtcgacgctatagcttttcccaaagtgcacgcgccatggcgagatcacgagacaccaggctcaggctcaggctcacgctcctcctcgtcacccttcttctgctagtagacatggcaagcgtcagccatggccgacggacaccggacgtggatgccatggccctcgtcggtggcggtccaccaccggcgaaggcctactcctccgagcagtcgtcttcgtcgacttcaagggagcatacggctcgtgtttatcggcgcatgcacagggtgtccaagaggttggtgccccaggggccgaacccactgcacaactgagactttcttctaccctgcaagaggaaaactagatatgcagtttgtgctttcagtcaccttcatcgagtgatgtgaattatatatagaacacctaggagtatagaagtaccgtatgtaatatctggcacttcaacatgtaaaatggggcaccctgactctccgggtgtccatggtaaaaaatgcactgaaatgtatgcagatgtgtaat

SEQ ID NO: 28000 - DNA, 1139 bp, Triticum aestivum
  Clone ID: PAT_TA_28000
cggccgaggagctgatgcggaccctcatccgggtcaacgtcgagggcgtcacgcgggtcaggccggccgtcccgtccgccgcggtctcggggccgcccgcccgcgccttccacggggcccccacgccgtgctcccgggcatggtcgacaggaagcgtggcgcaatcgtcaacatcggctccggtgctgcctccgttgtgccgtccgatccactctactccgtctacgccgccaccaaagcgtacgttgaccagttctcaagatgcctctatgttgaatacaagggcaagggcatcgatgtgcaatgcccaggtgcccttgtacgtggcgactaagatggcatcaatcaggaggtcttccttccttgtgccatccgcggacacctatgctcgtgctgctattcgccacattggctatgaaccaaggtgcacaccgtactggccacactctgttctgtggttcttgatctcccttctcccagagtcacttgtggacagtacacgcctcagcatgtgcatcaagatccgcaagaaggggcaggctaaggatgccaaaaagaaatcgcagtgatgattccgctgctagttcattgttgagatctaccatgtttcttcatcatgtgtaatggactagtacttgtagctctgttgtcggcatttcagtatcattacgttcccatcacactaggttgagactgttgttgttgttgttctttccactgttacgaagtacaagcctgtaataccttgtcgccaaatgaatgtaacgccagctgcactcaaagtgaaaatgaaactaactaaattttttgctggctttctaacgaaaaaaacacaaaagaaaaaaataaaactaactaaattttttgctggctaccaaaaaaaaaaaaaaaaaaaaaaaaaaaaaaaaaaaaaaaaaaaaaaaaaaaaaaaaaaaaaaaaaaaaagggggggccgtttttaggggtcccagttttacttccccggccttccaacgtaaaattttttttttggggcccccaaattaaaattccttggccgggttttaaaaccggggggctgggaaaaaccttggggttcccaatttaaatggcttgggggaaaatccccttttccccacgggggaaaataccaaaaagcc

SEQ ID NO: 28001 - DNA, 574 bp, Triticum aestivum
  Clone ID: PAT_TA_28001
caacaagcgcaccgccgtgtaccgctcgctcgacgtcggcgtgtggtacggcggcacgtacctgggcggcgccgaggtgccggggttccgccagccgccgcgcaacgagacgaggatcgtcgtggcggctccggcggcgcgggaaccgctgccgcgggacgtggagcgggagatgaagaaggaccggtccgccgggaggctgccgctggacgtgcacgtccggggcaaggtgtggttcaagtacggcctggtgaggacgcggcggtacaagatgcgcgcgagctgcccgctggtgcccgtcgagttcgcctcgcccagctccttcgaccgggtctactgccacgtgcatatctgagtcccgtgcacgtacatattatacggtgtgtgtctgctttgcttgtgtgtttggtcagaggattcgttccccatgcttggattattggtttgatggtacatgttgtttttattcaatcttcatttgtattacgattgggtttgtgtattctttgatgtaactaatcagacctcccatggactgtcacatatttttaaatgccaaattcttcatggaaaa

SEQ ID NO: 28002 - DNA, 929 bp, Triticum aestivum
  Clone ID: PAT_TA_28002
ctccttcctttctccatcccctaatccacatcttccagatcttccacttcctccctcccctcacccaaggcctccatccccaatgagtccaccacgcccaggccgccatcgaacccattgcggttgccgcgctgggccgccgaggggtatgcatcgtccggttgccgggcagcagccggctcccggacgctgccaccgaaggccaaacggcgcgatggcggacgcggtctacagcgccagcgggatggcttccgcttcagccgcgaccggtgcccgtgtagctgcagggcgcttgccgcctcgacgacggcctcgtccatattcggcggcgacgcccctgaaggccgacctggcgccggtgccgttgctgtgtcctgtgcccgagtcgctgcagggcgcgagcggcgccctcgggcgcgggccggcccggcgccaccgcgacggcctcgcgcccgcgcatgggccccgcccgactgggtacccggccggcgtgctcgagggcgccaaggtactgcggcggcgacgggctcgtgaccccctccacatccacgcatccaaactacaggccggcgcggacgcgagctagatggctttggaaaccgaagcggtggcgtgctcgtgatcccctcccatgcgtgtttgaggagcgtgaatccaggggcagcatacgcggcgagatcccatcctaggcgtccttccgtggtggaagatgatggctggtagtggatctggtggatcctagcctaataagctcgaagccgtgatgttgtactctgctttcatatgaatacgactacgctctctcaagaaaaatcaacgtgcttacttggctgtgatttgtgtttttgtataattttttagtgggtttcattttcctttacttttggctgtaactctaattttttattttaatggtatgagcagaaatc

SEQ ID NO: 28003 - DNA, 811 bp, Triticum aestivum
  Clone ID: PAT_TA_28003
cctttgaaaaatgagcaaagttagcgcttctgccgtcagagacattgttagtgaaatcctcaagggttccgaagaaaagaaacgtaacttcaccgaaaccattgaacttcaaattggtttgaagaactacgatccccaacgtgataagcgtttctctggtaccatcaagcttccccacgttgcccgtcctcgtatgactgtttgtgttcttggtgatgctttccactgtgatcaagccaagggtgccggtatggaattccaatctgttgatgacttgaagaagctcaacaagaacaagaagcttatcaagaagctcgccaagaagtacgatgctttccttgcttctgaggccttgatcaagcaaattcctcgtcttttgggtcccggtcttcacaaggtcggtaagttccctactcccgtctcccacaatgactctttgaccgataaggccaacgaaatccgtgctaccatcaagttccaattgaagaaggttctctgtcttggtgtcgccgttggtcatgttgctatgactgaagatcaattgattgctaacattatgttgtctgtcaacttccttgtctctttgttgaagaaaaactggcaaaacgtcaagtctttgtacttgaagtcttccatgggtaagcctccccgtttattctaagcttgctttttccgaaaaaaaaatgttaaagtaatgaccaattattatctgacggtgaaccaaggttttggacataggggccatcatcatttgggagctcataactttaacattttttacttataaaataaagaaacttttttattttat

SEQ ID NO: 28004 - DNA, 829 bp, Triticum aestivum
  Clone ID: PAT_TA_28004
gcttcgcgcccttcgtcgcctacaacgcgcggtggcgcatgccgcacgaggagagcggctccgcctccaacctctactactccttcgacgcgtggggcggcgcggcgcacgtcgtgatgctgggctcctacgccgagttcgaggaggggtcggcgcagcgcgcgtggctggagcgggacctcgccggcgtggaccggcggaggacgccgtggctgctggtgctgctgcacgcgccgtggtacaacaccaaccaggcccaccagggggagggcgaggcgatgcgcgccgccatggagaccctcctctacgaggcccgcgtcgacgtcgtcttctccggccacgtccacgcctacgagcgattcacgagggtctatgacaacgaggccgacggccggggcccgatgtacataaccatcggcgacggcggcaacagagaagggcttgctctcaagttcctggaggatcacaagtcggcgcacctgtcggtgttccaggaggcgagctttgggcacggccggctgaggatcgtcgacgagacgagcgccgtctggacgtggcaccgcaacgacgacgaatacgccaccgtccgcgacgaggtctggttggagagtttggctagtccaaagctatccatggcagccgccggcagtcacgacgaggagttgtagaatgttgcagatcagtacacaccctactgttgggaccgccgggaaatcaaactctttaatcaggtcataagacagcactttgcagaatgctctacagaacactttacagcaaaaggaccattttaagaatcattcattcgctaaaaaaggctcaaaaaaaa

SEQ ID NO: 28005 - DNA, 1242 bp, Triticum aestivum
  Clone ID: PAT_TA_28005
ccggcggggcgagggagacgcggtcggcgggcgagacgccagagacaaacccaacggagtttcccccccctgccgccgaccccaaaccctagccgctcctaccagccccagcctctcctaccgaccccagccagccgcgccggaattctcctgggtgttctattggcttttctcaagcctgtagcttcatcgcggcagcatgagctctgctggttctgcaagggttccaaagaggagacggactaccaagacgtcggaggctgcagaccggcaacttcaggagcgacagtttctggacctgaacttgtttccagctgttgaagtagccagcactgggggttcactctccatcaatgagcctgtctcacacaggcagccccctcctacggtggctgccctgctttacgagaccacacaggtcgtggtgtcatctgctgctgcagagtcaaacattggcatgaatagtttccccatcaacgtggaagtgattgatgatgatgttgcgatttatacctcagggccgccccctcaagctaggcaacagtcgtccaggacaggacctatcactgtgataatagatgatgattctgaaactactgctggaccagcaggggaagctcttgatgagcatgtgaacactctgctgtctctgggaatgaacccgaggcacaatccctcgagagcacaacccaacaccgaccttgtaataaacatagtagacacacctgagaccaacaacataccgcccaaggtggtgcaggctgtccctgaacctgtgaaggagatcccaaaggaaacaaagttcagctgtccagtctgcatgaatgagctggtcaatgcatcatcgaccatctgtggccacatcttctgccagaagtgcatcaaggcctccatccaggctcaaaagaagtgccctacctgccggaggaagctgaccatgagcaacttccaccgggtctacctcccgacggcagataattaaacctatccgccattcttggagcattagagccgtggcagctgtgacccttttttggcaccggcattgtggtgattgtatctgagctattcttcacagggtcatcatgaacattcagttttttccccaacaatttaacaagtgctcgagacgtgattaccaatctgcatacctggtggtagtggacactgttagtagtctttccttgtgggaaagtggaaacctgtgcttggtactgtgagattaatgcttgaaaatatttg

SEQ ID NO: 28006 - DNA, 1394 bp, Triticum aestivum
  Clone ID: PAT_TA_28006
tccggctagaggccccggagtcaccgggcctcaagggattttccgcataagcggagcttcccccccggccgcccaagccaaacccgatccgctgccacggacccaagccagacgccggcagtctcccggccgctgcctttggtctcggactgtgtcaggctcggccggcgccctccgaacattgcgcccacggatagggtccgtagtgctggcgcgggtacgccgccgcggcaaaatgcgatgcgggatgtggcggaccgctcagcaggggtcgatcccaatttcttcgtgctgcgcaacagtattcgacagaagatgttcgagcacatagaaaggaagcaaccatcggctatctggcggtggcggctgccggaccttgcgaggcggctcgaggaagtcttgtttagagaatacccaaacaagagggagtactacaatatgacgaaggggccgattgagcgccacttgcagtttgccatgaagctctcgagtgttcggaatcggcaacgacaacagaaccgacaattgtcaaggcagataacatgttccccttgctatgggataatgattgtgacacctggtatcacgcaaggcgcaagtgagaattctcgaatgtctttcgtgacacgctgcactggccctttgtcgtcgggtgcaaacatggttccacagaacaccaacatggggaccttgttaccaggggaagctcccaatgagcatgtgaacacactgctatctctgggggatgaaccctccccaccatgactgctcggaagcgtgcaacaaccacggtcaaatacacagtggtcaaagcaccggaggccaacacactcttggcaacccatgcacccgtgaacggaggtagcaacgaaaccgacttccagctggcccgtctgcaggaaccagctgaccgatgcgtcatcgaccttcggcagtcacaccttctgtccatcactgcggcgaagaatcaatccaggcccagaatgatgtaccctaccatgcggtgcagccgcggccctttattggcaccggcattgtgtccatcgtatcggcgatattctgcacatgatcatcctaataagggcgtagcttaccctcaggctcccgtagttcttctcctcgcctgcattgcgtccattctatgtactcagggttgcttctaccattcagtttcctgccccaactgtgtgactggcatacagttttgagacatcgttaccaatcagtctgtatccctagcgctcaataatgccgtactctcgttgttcgggtttataataggtctgttgcttttgtcttaagtcaaaactccttgagttctgtatatacaaatgtcaacatttgtaataccataaaatatgtttttcttaatgttttcccaaaaaaaaaaaaaa

SEQ ID NO: 28007 - DNA, 2012 bp, Triticum aestivum
  Clone ID: PAT_TA_28007
cagccacgcctctgatcgccaccggcgcgaatctgcaagtgggcgcagagacagaactttggggctgcccagcggccgagccaggcgctctgcctctagccgcctccccacacactccacccttgaaaaggaacctggctgcgaggctgcaatagccgaggcgcgtcgacaacaccgttcctatgccgaacggggcgggcccaaagcccccaaaccttcgggagaccggagccaagcttaaccctgcaagattccgatcggagggacccgaccatcctgcaaggagtgcgaaagcccgggcccggaccctgacgttcctggccaagaatcatagaggccaaaggtcactggccgtagttgcaacaaccgacacgtcaaggttgagggttgggaactttgatgggtcattccggataagggctcgcctatactccggtaccgtcctccgagtgcacaagccctatgcacagttcttggttttcaagtcaattggtcagtcccatttccactcatcaattaagtatggtgtttggtcttagttccttccagtggaaatagcaagctggattgcgcatatagggatgctgaccgaatagctaagcggaattctacaaagtatccaagtttttctgttcttttctgtgaagaatagcgggcacttttgtggcatggtgctggacattggtcgtcaaaaatgatcgagaacggagataatatttctggggccaggatcaaattggtggtagctgtcgtgtattctagcgtagagaaagcgaggtaccttactatactttgcagaacatcgcagttcaaaaaaatgagattcaagcctgttacagacaccattgataccgttgacgatccatatgtacctggcatatctgtgctcgaggttttcaaggatatcatagttaaggagtgcctgtctgacgattttttgtgatacaaggatgaggaagcaagaatggaacagactaagatggttcaagttgactggcaaagcaacacggttttgtgccggtatcaaaggctgtaacgagcgatgactctaaagtttagatgccaaaatttggtggtgtgctgataggacatgaacattggagatacagaacatgtcagagaagccacatgattgtaatggcatcaaacaacaggatgctgttgaaaaacaagttggtattgaggctgggaaagaaaatgggcatcaagaaaaccgtttttatggcaagcaggataatgaaaaagcgcctagatcttcaactagccagccacaaacttcaaccttggaaatgagcatggatgggaagcaacaatactggaagaaggtggttcaccctataccgggtcctgatggggctgggcatggatcgtcaaaattgcgtgagaacggagttaatattagctcggcaattgtcagattggaggcacctgaagatgattcaattgttgcgaaagttggttctcttacaatcagttccaagacaaggaaggctgaagataagagtcccttggttgatgttgtgaccattggctcgttgccaatccgggtcaacaaatctgttgcttagtgggggctacctttttgcgtttctcttcctggtcctgctccagttgttattccagctttacgggcgatgaaaaagaaaagactacttacattctagtttcctggtcaagagaacagttgttttattttggaaaggaaggatggaacatggaaggacagtacaagctttcctcggtgcgaaaatgaacgtgggttgactgatgatctaaaacggatatcggtgggcattgaggatgtggatgacctcatagctgatcttgattacgcgctcaggtccggtccagcatagatcatacaaaatctggactatggcgcttcgggttctagttaatcaagttgtagatgtgatatgcattggtgattcatttgttaagctgcaacagtaataataaacttctgcacgagtattttctgaaatgacgagcccacggttgtaaaaaaaaaa

SEQ ID NO: 28008 - DNA, 622 bp, Triticum aestivum
  Clone ID: PAT_TA_28008
cggacgcgtgggttttctaagcgtccatggaaactatcactaaagcagctgagccttggtgtagttcaaaagataattcaaacaattcaatattgtcaaatagccctgaagaaacaaagggatttacgatgcattcagatgaccttcaacccacttcggctctacattcttctattgctcaaccgttcgactctcgtttggttgttgttgggagctacaaaaagccagtgacactaggtcgaggaggtgcttcgaccatcaagattggtcgtcgcaaccggcaaatcagtcgtattcacgtttctatcgaattcaatgcagaatctcaatgctttcaactgaccattttaggtctcaatggtgccaacattgattatgttggttataaccaaaatgctattgttgtgcttgaggataaaagtttcattgatgtgttaggggaccacattgaatttagagtcccacctcgtccaacggaggaagaaaataatgagactgtaccgagcaaagcgtcactacaagatcagaaaagcggtaaatatgatgtgaaagcagagttagattatactgtgattgagcataaaggaagaaaacacgtgttgtttggatgtttttaaacacc

SEQ ID NO: 28009 - DNA, 1182 bp, Triticum aestivum
  Clone ID: PAT_TA_28009
cggacgcgtggggcgatctcttactctcttagcaactttggccttggtttgtctctttggcaatacttctgctgctgtcattcagcgagatattgttgttcctgaagtcgttggaaatggtatcagtgttctcaaggatgccaagactgatgtcaacgtagaccacaacaaagtaggcaatggaaacaaactagagctccgcaagagaggtattgatgttattcctgtggtcgatcataatatcgtcagtgctcttgatggtgccaagactgatgtcaacgtagaccacaacaaagtagccaatggaaacaaagtagacctccgcaagagaggtattgatgttattcctgtggtcgatcataatatcgtcagtgctcttgatggtgccaagactgatgtcaacgtagatcataaccaagcaggcaatggaaacaaagtagagcttcgcaagagaggtattgatattattcccgtggttgaacataatacggccagtgttcttgatggtgccaagactgatgtcaacgtagaccacaacaaagcactcaatggaaacaaagtagacctccgcaagagaggtcttgatgttattcctgtggttgaacataatactgtcagtgttcttgatggtgccaagactgatgtcaacgtagatcataacaaagcactcaatggaaacaaagtagagctccgcaagagaggtattgatactatccctgtggttgaacataatactgccagtgctcttgatcatgccaagactgatgtcaacatagaccataaccaagtaggcaatggaaacaaactagacctccgcaagagaggtgttgatattattcccgtggttgaacataatacggccagtgttcttgatggtgccaagactgatgtcaacgtagatcataaccaagcaggcaatggaaacaaagtagacctccgcaagagaggtattgatattattcccgtggtcgatcataatatcgtcagtgctcttgatggtgccaagactgatgtcaatgtagatcataacaaaataggcaatgataatcactagttttctttttaaccttcagattcttaatcttagcagcttaattcgctttcaagttaattaataccttgaggtgtaacacttaatatcatgtctttataaaaataaaaacccaatctctttaatgtatc

SEQ ID NO: 28010 - DNA, 946 bp, Triticum aestivum
  Clone ID: PAT_TA_28010
attttactcaacatcccggcgatctcttactctcttagcaactttggccttggtttgtctctttggcaatacttctgctgctgtcattcagcgagatatttttgttcctgaagtcgttggaaatggtatcagtgttcttgatcatgccaagactgatgtcaacgtagaccacaacaaagcactcaatggaaacaaagtagacctccgcaagagaggtattgatattattcccgtggtcgatcataatactgtcagtgctcttgatggtgccaagactgatgtcaacgtagaccacaacaaagtaggcaatggaaacaaagtagagctccgcaagagaggtattgttgctatccctgtggtcgatcataatatcgtcagtgctcttgatggtgccaagactgatgtcaacgtagaccacaacaaagtaggcaatggaaacaaactagagctccgcaagagaggtattgatattattcccgtggttgaacataatactgccagtgctcttgatcatgccaagactgatgtcaacatagaccataaccaagtaggcaatggaaacaaactagagctccgcaagagaggtgttgatattattcctgtggtcgaaggtgatactgttactgttctcaaggatgccgacaccactgttactgtaaaggataacaaaatagccaatgataatcactagttttctctttaaccttcagattcttaatcttagcagcttaattcgctttcaagttaattaataccttgaggtgtaacacttaatatcatgtctttataaaaataaaaacccaatctctttaatgtatctctttaaccttcagattcttaatcttagcagccttaattcgctttcaagattaattaataccttgagagtgtaacacgttaatatcatgtctttataaaaataaaaacccaatctctttaatgtatc

SEQ ID NO: 28011 - DNA, 743 bp, Triticum aestivum
  Clone ID: PAT_TA_28011
ccgccccaggccggcggtggcccgcccgccgggcgaaagccagcctagctagtgccaaccaagctcaagctcgatccatcgatggccgggacaaaggtgacgatggcgagcgcggtggccgtggcgctgctgctggccatggcggccgtgtcgggcgcgggcgcggcgcccggcccgctgatgatgtgcaatgtggacgtgtaccgcatgatcggcgcgtgcaggtcgtactgcgcgagaggcagccgggaggctacgccgagcgggcagtgctgcgccgcgctgaggggagccaacctccggtgcgtgtgccagaagaagggcctgctcgcgtccgcgggcaacatcgacgcccgccgcgccatgcagatcccctccaagtgcggcatcggcaacgtgcccagccggtgctaggtccgtcggaccggctggtgatccatccacagacgcgcgcattccttctgtttttttttcattataagcaaataacggcgtgcgtgagtgcgatggatgatcgatcgatcggccacactgtagttcgcggttctcgatttagattgagctttctttccgtacgttcgtgcatgtgctaatcgagctagtcctgcaaagcgtacatgtatcctctcgtgagtcagtcctttcttttgtcgccggctgtaccgtacatgtttagggcacagtcgccgcccctaatctgaaacacaacgcaaaaaaaaacggtactcatcaaaaaaaaaaaa

SEQ ID NO: 28012 - DNA, 575 bp, Triticum aestivum
  unsure (1)..(575): unsure at all n locations
  Clone ID: PAT_TA_28012
gaaacataataaaatgtctaatttagttgttgaaactatcacatcaaagggactcaagctcaagcttcaaactgggttgtttatcaacaatgaattcgtcaaaggttcagacacactcgaaactgtcaaccctgctacaggcaaagtgattgctgctgttcaagctgctgaggcaaaggatgttgatgctgcaggcgaagctgccgaaaaggctttccacggtccctggggagaaatgcgcgctcttcaacgtgctgccttgatgcacaaacttgctgaacttattgacagagacaatgaagaactctctcaaatcgaaagtcttgatagtggtaaaggtatcactttctctcgtttctttgacgccaaacaaatctctcttacccttcgttactttgctggatttgctgataaggtccatggtaaggtgattgataccgaatgttgtctctcttacactcntcatgaacccattggtgtttgtggtgctatcattccctggaatttccctttgttgatttatggtttgtaagctttgaccttactctttgctacctgggcttaccatgtttttt

SEQ ID NO: 28013 - DNA, 607 bp, Triticum aestivum
  Clone ID: PAT_TA_28013
gcacgaggctagcatgtatcccgcgcccagacccgcgccgcgacgggcacacgcgagccagcagcagcaaggccagcaccgtgcgagatagggagggtgggaaggaaggagatgggttgctatcccctgcgcgtgatcgtctccaaagcgcttgggaaatgcaacgggcgcgaacgatggatggaggaccagaggatggactacgccatggcataccctcccggcccacacccagagacgctctacatgcggcccgtggcgcgcaccgtcaccttcagcggcaccaactccgtgcacatgatcccgccaaacccgccaccacagcagcagcaacacccagagccccaagcgccaccgccccagcacgagccccagccgcagcccgagcagcccgctcccgcgccggagcaaggcgcgccgccgcccgagcagcagccgaggcagccgaagcgaggcaagaagaagccgccgcgccgcgtccggttcggtcccgagccaccgccaccgcagcagcagcaagaagaacaccaggagcaacagcagcagcagccggagcacgcgccgagcagcaacccgggcaacggcgcgccgggccaccacggccagc

SEQ ID NO: 28014 - DNA, 978 bp, Triticum aestivum
  Clone ID: PAT_TA_28014
cccccttttttggggtttttttgtttttcatctttgctcggaaaatcacatatgttttatctctcacactgaccaggtggaaatccctggcactacagcatatgtgcgtacaaaaatgaagcaaaaatgtacagatggacattgctaaggtgattccagcgtgctggcaaatagactagaagatcaccttctccttcttcaccaggatcggggggtcaacatcgatgcccatgttagcggcagtgcccgctatgattctcatagcggattcgatggttttgcagttcaagtcaggcagcttctcctgggcgatcgtgcgtacttggtccactgtcacctttccaactttctcgcgctgtggctcctttgagcctttttcgacgcctgcagccttgaggagcagcactgaggcaggaggcgtcttcaagataaaggtgaagcttttatcatcgaacacgggttatctcgactgggatgatgttgccgggcttgtcggccgacttggcattgtaatccttgcagtatgccatgatgttaagatgcttggcttatcatcgagcacggtcaggctcgacgggcgtgatgtagccgggcttgtcggccgtcttggcattgtactccttgcagaaggccatgatgttgacacccttggccccgagcgcgggcccgacgggcggcgccggcgtccccttgcccgcctccagcgccagctttatgatgccgaccactttcttgggcttggccccgggcttcggggggcgccatggccctgacggcgaacaccctccgcgtgggcgtggccgcggccgcgagggccgccgggcggaggaaggaggagggggcgccgaggaaggaggaggtgagcttcttggcggtcggggacgggagcccgtggagggataaggttgtggtggccatggctgtgcgctggagggaggaggagtcggctgctctctgttctgctctgctctcctcttc

SEQ ID NO: 28015 - DNA, 570 bp, Triticum aestivum
  unsure (1)..(570): unsure at all n locations
  Clone ID: PAT_TA_28015
acgtgctcgccgcaccgctgcggttccgctccccgctctcgctcctgttcgccagcatcagcaaggggaacgtgtgcgtcgccggcgacgcgctccacccgacgacgccggacctggcgcagggcgcgtgcacggcgctcgaggacggcgtcatcctcgcccggtgcctcggcgacgccatcgtaggtgccggctccggggagcagaaggagagggccatggctgccctgcgcaggtacgctggcatccggcggtggagaagcgcacaggtgatcgcggtgtcgtacgcggtggggttcgtgcaggagagcgaccactccgtggtgagcttcgtgcgggacaagctgctgtccggggtgctcgccaagacgctgctcatgatgccggactacgattgcggcaagctctgaagtagtactacatatgtagggaaatactcattggttcctgggacatctgtccccggaatctcaccccacatccgagcctgcctattagtattttcctgtgccatcgtttcgtattgcaacgttctctcccgcgatcccgtgnnaaaaaaannnnnnnnna

SEQ ID NO: 28016 - DNA, 980 bp, Triticum aestivum
  Clone ID: PAT_TA_28016
cccacgcgtccgtgaaatttttctctagtaaactacttttatgccttttagcattatcagcatcaactatttttgcttcaccactcaaagatatatcaaccacttcaattgacctttctgaaaaccaactcaatacaaaaggtgatgaaacactttttgtcactgtgacaagagttgatgatcttattgatgatgatggttctcttttggccgaaagagtgatggctgtacgtgtgacctttgaagtttttgaaaaccaattgatgtgtaacggtcatcctgttgaaatcggtgtgtctaacattcaagttgaggctcagatggcttctaatcctgaaaaattaacgattacaagtgaagaagatgctgctattctggctgatagtttcgatgtgggtcttgtcactgttgaagttactgctactcttttggatgaattaaagacggatgatggtatgaccttccgtcgtttgggtgtgaaagaattaattaccgaaatcaatggtctcaaggttgttcaaactgaggctgctcagcaaattttggatgtctttgataacggttcattgaccaaatgggctgtagatcctcttactggtttcatgcttcctgctgaagatgaaagtactccaaccatcacatttgtagacgattcattttctgaccgtgcttttggttggtgggatagacaatctactcttactcaaggtttacttgctggaatcgcttgtggtttcactagcttatcatttatatttgttgtagctcacaccattcttaagagaagaagagcatctcaatacatggctgttcatgaacaagaggaggaagagattaaggagcaacctcccgcttatgttgaacaaggcaaaacgatgacagaagaacatgaagaaaagaagcctttcttggcataagatcatgtgtacatcacaaataataataaaaaacgtaatgttttttttttctttattgttatt

SEQ ID NO: 28017 - DNA, 805 bp, Triticum aestivum
  unsure (1)..(805): unsure at all n locations
  Clone ID: PAT_TA_28017
tcgagcnnncgcccgggcaggtgcacagttcgctagtcttgacttgaagaggttcttcaaaatggcaataactgttcaaaccacaggttcttctgctatgtccctcgaaaaaatgcaggcgagcaacaagcaaataacgttgccttcttggctctctgaggaggatgtcagttacctcgcaagtgtatatgcaaaaactggcttcgctggtggccttaattcccacgcgtccgcggacgcgtgggcggacgcgtgggcgccatggactggagcgaaagtgcaagtgccgaccaagttcatcgtcggggacggtgacctggcataccatcacccaggagtcaaaggctacatacacaagggtgggctcaagagagacgtgcccatgctcgacgaggtggtggtgatcaaaggtgccgggcacttcatccagcaggagagagcacaggagatcagtgaacacatctatgaatacatcaagaagttcagcacagacccgacacgggaattatcgaaattgtgaggtcatctgttgatgtacaaagttaataaagagtatgtggccttgagacacttgtaagttgtatgcaacttgtataactttcaaagcctgctggttcatgcactgaaatgctcacgtggatagcatgagccatggttctacacctgtcgatatgttatttgattaagagaatagcatttacaagtttcttcaccagtacctcagtttcgtcgtagctggggaaaaacgatgatttattcaacatactcgcaaaaaaaaaaaaaaaaaagtcaaaaaagggggcct

SEQ ID NO: 28018 - DNA, 339 bp, Triticum aestivum
  Clone ID: PAT_TA_28018
tggaggtccatcttgctcgtggtggtggtcgcgctggcgctggcgccggcgccggcgctggggatcccgttcaccgagaaggacctcgcctcggaggagaacctgcgggggctctacgagaggtggaggagccactacacggtgtctcggaggggcctcggcgccgacgcggaggagcgccggttcaacgtgttcaaggagaacgcgcggtacgtccacgagggcaacaagaaggacaggcccttcaggctggcgctcaacaagttcgccgacatgaccacggacgagttccggcgtacgtacgccgggtccagggtgcggcaccacctctccctcagc

SEQ ID NO: 28019 - DNA, 850 bp, Triticum aestivum
  unsure (1)..(850): unsure at all n locations
  Clone ID: PAT_TA_28019
acaactttcactggngaatcaggtattaaaacggttgaagaaaatccatgcagatgacagacaacaacagaagttagtggaagtatcatgtggcacaactgatcctgtccatacccatcattctagacattgtcttgactttatttctggaaatggagatgactcagtacatccaaccaaattgaagatgttacatcaactagatgcaaatatcatggaggatgaatttgcctccagccaaaaacataatggctgcaactacctatctccatctgtagagcttgggccaaagcgcttgaaaattcttggcccatcatttcccagagggaatcatgagctggaaatctcttgtagattccaggaggacagtgacttggctagtcaccatgctcgatgaagtataacaaggcaattggtgctaacaccacatatgttaacaaacatcagtcttaacttctggaagctgacaactccttcgagccaaggtttcctgtttgttggtaggtcagtcggtaatggatggttcagaagcaattctttccgcaggcctccaatagaggcactgtcttggctggattcttgattgcatttgccaggttacctttgtggtaggggacctgaaaagagtaggcagacagtttctgatgttgtttagttgtacatcttcacttatctccttttttctaggctttccactgtaaagaggttagtctataacttttacagtttctttcattctttttccacagacacacatgtacctagaatgcttaaatagatgcaaatatgaaattactgtatatctcctgacaagccattctactttctacttgtcttcacactttgtgta

SEQ ID NO: 28020 - DNA, 631 bp, Triticum aestivum
  Clone ID: PAT_TA_28020
gacgcagtgaatacgaaggaggacgtcctcaacatgatggcattattcgttacggtgatcatgtttcgcttaaacatgtagctaccaatcgttatcttacatccagaccaggctcatacgatggtggttcttatcaacaaaagattttcactgtcgaatgttctcctgaagaagaaagtacctggattgttcttcctcctgctgaaacagaagaagagcccggttacgaagtaggctgggatgaccctgttcgtctcaagcacgttcctacacgtgtcaatttacatacacatggtattcaaagtcccgtttcaggtcagcaagaggtctctggttttggtgatgatgagacttcagatgaaaatgatgtctggaaggttcaacaatacaatgaagacgatgaacaatacgatgatttttggcgtgttggtcaaccttttgtccttcgccatgttgaaacagacagacttcttcactctcacgaaatgcttttggaagaaggtgcaaatgaagtgactggctatgaagagaatgacgaaaacagtatgtgggttgttacctttgactaaatccctttttactctttctatttaatttctaagagtgatttacttgaatcattcgcattaat

SEQ ID NO: 28021 - DNA, 586 bp, Triticum aestivum
  Clone ID: PAT_TA_28021
ctttttagtttgaagcaaagaaaaaaataataaaaagaataaatgtctggttacgatcgtgctttaacagtcttttctcctgatggtcacttatttcaagtagaatacgcttctgaagctgtcagaaagggtacttgtgcagttggtgttcgtggtaaaaacgttgttgttcttggtgtcgaaaagaagtctgttttgaaattacaggatgctagaactgttcgcaaaatttgtatgcttgatgatcacatttgcatggcttttgcaggtttaactgctgatgctcgtgttttgatcaacaaggcaagaatcgaatgccaaagtcaccgtttaactgtcgaagatcctgcatctgttgaatacattacacgccatattgctcaaattcaacaaaaatatacccaaagtggtggtgttcgtccttttggtatttctacacttattgtaggctttgatcacaatgaaccgaaattatatatgactgaaccttctggtatttatactgcatggaaagcaaacgcaatcggtagaagctctaaaacggttcgtgaatttttggaaaagaattacaacgaagatatggaag

SEQ ID NO: 28022 - DNA, 596 bp, Triticum aestivum
  Clone ID: PAT_TA_28022
gcctgctctccgcgggggccaagcgagtggccatcatctccatgccgcccatcgggtgcgtgccgtcccagcgcacgctctcgggcggcatggcgcgggactgctcgtcgggccacaacgagatcgccgagatgatcaacgccggcatgggcaccaccgtggagtcgctcaaggccaagcacccgggggcgagggtggtgctcatggacatatacgggtacttgttggacatgatgatgcgcccggaggggtacgggttcaaggagtccacgctgggctgctgcggcacgggcatgatggaggtctccgtgctgtgcaacggcgtcacgtcggcggtgtgcggcgacgtcaccgactatttgttctgggacagctaccaccccacggagaaggcgtatcgtatcctcgtcgacttcgtctacgacaactacctcaaggagctcatcgactgaccagagagctttgatgccctagctaccttgcacgtactgtttgtgattgatatttcaaattcattgtgtttgtgttgtgcacgcacctatgtacgtaggttgtgaaaaaaaatgttgaattattattgcagtttagctggatgt

SEQ ID NO: 28023 - DNA, 556 bp, Triticum aestivum
  unsure (1)..(556): unsure at all n locations
  Clone ID: PAT_TA_28023
ccccggttccccccccccgcccgccgccgcgatcgcgggcccccgttccccccggcccggtcgccccggcgcgcccgttncttgccgtcacgtgcgcgcggcccttcgcccggcgcggcgagcgggcgggcgactcttggagcacccagaagtggtcgggtgcccaacttgctatgccagggtgctcaagaccgtgcagggcggcatgtcctcaaccgcagccatgggaaaaggggctacggaagagcagttctggactaatgcctggaagtgagagcaataaccaggcacgctcttgccaagtccaggatgtgatgaaggttggacaaggaataatgattaagaagaaagctctgagataattgggatagaataaaagcggcacgagggcacatcagctcctggaaatagatacgcaattggatcactatcattgggcatgagaattgcctagctatatatactccccacccaaatgcctggctccacacaaccctacgaataagctccagctcccgcccggggcccggcccgccccccagtgcgccctatagtg

SEQ ID NO: 28024 - DNA, 1087 bp, Triticum aestivum
  unsure (1)..(1087): unsure at all n locations
  Clone ID: PAT_TA_28024
cccacgccgtccgaacaataaaagctcagcatttgngagaagagtatttagattattggaacgcaatggaagaagtggagcatgaatcaagattgagaaagagggcgttggaattggaagaaaatgcccaaagaagagtaattcatcgagtattgaagagttgtaatggtgatcccacttgtcagaattacacagctaagaaagaagaaaaagaaaaggattggacgaaggtaatgcagcatgtattggatgatactgaagatatgccgtcctacatgtgaaaaaatatgagcaaccttttggcaaaatcgacttttttgctatatcaaaaagtacatgccaactaccggcttgggacccccatggtatgttttcggggtcatgtgtcttgaaacacttgaatattctagagtttaatggttcattggtttcaaacgagtactacaaaagaatgtgcgctttgtcagtgttgagtgccctcttcatgaagtttcgctcgctctccacaaaatggtttgaaattcaaacgaattttgcgaacaggcatctatttgatggtgttattttttacgatggtattctggaaccaatggcacttgcagagtttggcggagcaaagtgcaatgatgacanagttaatagtgatactttggaggtatatcgaaatgcattaagaatattaaacgagatagctgcaaaaacaaaaaaaggggagacaccaaaagtgtttattgttttatttcataaagcaatacttcgctttgaaacattagcgttactggataattgcatgtatgtacgtaccaggcacgccaaaatacggtctcccagaacatctgaagaattgaagctggtttttcctgaattgagaaaggctatttcttggcgtgacgctttggtcgaaaacgttgatcatttgcatgttgatagttccgaaggttcttccccggattgcatctatgaaacctcctccgtatgtagcacaccttggtgcaagctactattattatgattatgattattttattgtgaaatatatttaatatgaagaattaaatgcattattaaggaatcatagttctctaat

SEQ ID NO: 28025 - DNA, 819 bp, Triticum aestivum
  Clone ID: PAT_TA_28025
ccccgcgtcttatgaaccgtaaagtcaaattgacacacaagaaacgtccaccacttgttcgctcaccttctttatctaccattcaatctggtaataaacccaaaaaatcggttcggtttcgagatagcggttcattggaagatgttcgtctatttttaaaatcagaaatgcctatcgcctgtcaatcggatccaacctgttcaattcaatacgtctatcaccttcgacatctcaattggccttcagtgaggcatcatgaaggaggacttgcggtctgcgtggaaaatattcagtttgatgcgtctgatttaattggcacctgtcaagtggctaatttagcctatgaaaagaaaattaacattcgttacagttttgatgactggtcaacatgtcatgaagttcaagcgaattacaaggaatccatcattgacacttgggatcgtttctctttcaagatcaaatgtcatcctttcgtacgtcatttggattttgccgttcaatacttggtcagtggccgagaattttgggataataacaagcagcagaattatcaattggatattacaaccaatgctcaaattatgaatgaagaagatgatgaaagtagcagtagttcttcagaagatgaacctgttgatatcctctggccaactcatacacctgtttgctttgaccaaagaaaaacgtcatccaatgagttactacaacaacaacaacaacaaattattttgttgtaaaaaaaaaaaaaaaaaaaatcaaagttagggttcaaaagcttaactttctttctattttgtatgtaaatatatttattccaag

SEQ ID NO: 28026 - DNA, 654 bp, Triticum aestivum
  Clone ID: PAT_TA_28026
gggtgatactgctcctgattttgaagcaaagactacaaagggtgatatcagatttcacgaatttattggtgataactggacaatccttttctctcatcctgctgattttacccctgtgtgtacaactgaacttggtattgtagctgcccttcaagatgagtgggatgctcgtaatgtaaaagtaattggtctttctgctaatggtcttgaagaacatgaaaaatggattgcagatatcaatgaagtgagtcaagtcaagcttaatttccctcttattgctgatgcagatcgtaaagtgtctgctctttatgacatgttggatcatcaggatgctactaatgtggatgcaaaaggcatcgcattcactattcgttcagttttcattattgatcccaaaaagaccatacgattgatcctcacttatcctgcatccactggccgtaactttgatgagatcttgcgtgtggttgattctcttcaattgggcgataaatatcgaataacaacacctggtaactggaaaaaaggagatgatgtcattgttcatccctctgtttcaaatgaactcgctcaagaattattcccaaagggcattaaagtcatcaaaccctatttacgtctaactccttctcctttttaataaatcatatttac

SEQ ID NO: 28027 - DNA, 439 bp, Triticum aestivum
  unsure (1)..(439): unsure at all n locations
  Clone ID: PAT_TA_28027
cggncgcgtgggggcacggcctcaccgccggcgagcccgacgacaatngtggnagnnctggtcnntttgccgnacnnatcgtcgctttgggcttcgacaagggcgcagnnccatcannccgcaagggcctgnaacgnncggnncggcncggnnngtaacaaagnncgccncgtcggaacctgcaaggtaccaacggcggcctgtttccggcagcaccggcatggacagcccggtgtcgatgcctcggcggcgaggcggcttcctctgcgggcaatgtagaatgtaaacatggaactgtttgcaaggaaaaagaagcagcagatgatgaaagcatgtaaatagtgcgctgcacgaatgctcagtaaactgaataaagttttgctccactctaaaanaaaaaaaaaaaaaaaaaaaaaaaaaaaggggcggcccgttctag

SEQ ID NO: 28028 - DNA, 1510 bp, Triticum aestivum
  Clone ID: PAT_TA_28028
gccggatccacccacaggcacagcacacaaaacaagtctcgtggtatagagaaacggagctaaggaagctagccagctcgaccatgggtggtgttcggcagcagctcatggccgccgtcctcgtggcggtggcgctgatggccacggcggcggaggggtacatcactcagaagacgtggggcgccatccgccgggcgaaccgcgccgggccgttcgtcggcctcgtcgtgcccaacacatacgagatggtccccgtgctcgagtcgcccagcttcgtggccagcaagagcatccctaacatggacatccaagggcgaaggtttcgcttcggaaccatcgaaggccaaagcgtcgtcatggtcatgactggactgagcatgctcaacgctggtctgaccacccagatgctgctgagcctgttccgggtgaagggcatcgtccactggggcatcgctggcaacgccaacgaggacctccagatcggcgacgtcaccatccccgaatactgggcccacgtctccctctggaactggcagcggttcggcgacggcaaggataacgagctgtcactggaggccgccggcgactacacccgggagtacggcttcctcaacttctccgactacaccgtggggcagagcaacccggcgctatcagccaaccagctcaacagcatctggtaccagccggaggagatcttccccaagtccggcgagccggaggagcggcagcacgcgttctgggtgcccgccagcaagcggtactacgagctggcgaagaagctggagggcatggagctgccggcgtgcgtgaacgcgacgacgtgcctgccccgcgcgccgcgggtcacccgggtcagcaagggctgcagcgccaacgtgttcctggacaacgccgagtaccgccagttcctccgcaagcagttcgggtgcacccccgtggagatggagagcgccgccgtggccctcgtggcgcacacgcagggggtgccgttcctcaccatccgctcgctctccgacctggccgggggaggctccgcgctcgggaacgaggccagcaccttcctcgacatcgccgcgcagaacgccgtcaccgtcatgctcaagttcgtgccgctgctcggcaagagcggcagcgagatggacgacggcgcggccgctgacatgtgagccagtagccacttgtccatgcatgaataatcgggtgcccgtgcgtggtgtattgtctctctttccctttttcctttttttcttgggccgcgctatcggtaaggcttgcgagccctagctcaaatcccagttggtgagcccacgagttgcagagatgaataaataaatcaaataatccgtcgtaaaaaaaaaaaacaagaaacgcaagggtgtgtaatttaatcaaacgcacccattgtgagcacgcctctgatgtacgtatgtgcttacatctacgtgatgctagtacaatgttagtactctcaccgtttcaaaaaaaaaaaaaaaaaaaaaaaaaaaaa

SEQ ID NO: 28029 - DNA, 520 bp, Triticum aestivum
  unsure (1)..(520): unsure at all n locations
  Clone ID: PAT_TA_28029
aaaattatgaagtccttcttaagtctcctttgcagcgtcttccttttacccttagtcgtacaatctgtgcctgtcatcaagcgagcctcggccagcgactgggagaacagagtcatttaccaattgttaactgatcgatttgcaaaatcgactgatgataccaatggctgctctaacctgagtgattactgtggcggaacatttcaaggaatcattaatcacttggattacattgccggaatgggatttgatgctatctggatatcacctatccccaaaaatgtgaatggaggttaccatggctattgggcttctgacttttctcaaataaatgagcattttggaactgctgatgacttgaaaaagttggttgcggctgctcatgcaaagaacatgtacgttatgctggacgttgttgctaatcatgctggcactccttcatcaggcggcgactattctggctacacgttcggtcaaagctttgaataccacagnagcctgtgnattatcaaattacaac

SEQ ID NO: 28030 - DNA, 595 bp, Triticum aestivum
  Clone ID: PAT_TA_28030
gcgtcgtgcccgcggcacgaggttgcagaggagtaggacgcagagagctcccgttgctgctggtctattgaactggggccatttgctgaaattgagctaggttgctgtggttggctaggattggagttttgtgattggctaggattcgaggcgtcacccactcgtgcgtgccggtgtgggcgtcggtgggcggggccgggggagaggccatcggggacggcgcggatgcggtcggggacgacctcgtcgggggcgccggcagcggggccatcttgggcgccggcatgggaccctgcgcggcggcggcgatggccaggagggcgacgatggcggcgaccacggcgaagcgagccatttggttggtgctggtgggcggaaggaaagctggctgagcttcgcagacgacggacggagtgctctggccggctctctgtgtagaagctgtgggagggagaggtgtgcgtttttttttctgctttgattgtatttttctcgacattatattggttcccaattgatgatttccatcagtagagtggtggtcatatgtctgtttatgaatagtcgagtttgtgctcagctcaagttgcatctc

SEQ ID NO: 28031 - DNA, 895 bp, Triticum aestivum
  unsure (1)..(895): unsure at all n locations
  Clone ID: PAT_TA_28031
cccacgcgtccgcccacgcgtccgcccacgcgtccgcgcctcgcctcagcgcgtcaatcccagcagatcgatccatccatccatcctcctcctcctagcgagcgagcgatcaagagcaaaccctagcgccgccgtcgcccccgcggtctctccacatccgactgaacgccggcgtggggtgcccagcctccacaaccggcgacgcgaccctccccgccgcgcgccccccgcccgcctgcaacttttgcgggggtagccggggctccggcctcggcggctttctaagcccccttccttacaacaggatccaaaatcccgtcctagatttcttctacctccccttccagaacttcctcttttggcatcagtaatcctcggaatctcatcaccctagattgatttcgattcttataattactgactttttcaccgttattttcttcttcgctgttcgtcgatcgatctacagccccttttcgcctcatacaattcttttcttcgattttttcatcgccgccgccgccagaaacgaatagcagagaaattcctgactgcatacggcacaaagaaacagaaaaatttctgacttttccccccccccgactggctttccccggtccgggtgtccgtgacnagatgcctgcgctcgctgtcgacnctgccgcccccgtggcccacgccttcccccgcgttgcggaagacgcctcgcccgccgcttcnccggnccgcgccactggntgggccccccgccggtcgcccgttatccgccnggccgctgctgcccgaacaaagccccaanaatggccgcctggttntggccgannctnctccgtcgggngntcctaacaaaacgttcaaagggtggggggggnnnccccaaaattcttcgtcaaac

SEQ ID NO: 28032 - DNA, 696 bp, Triticum aestivum
  Clone ID: PAT_TA_28032
ctggccatcctcttccccgactggtccttctggggctggccggaggtgaacgtccgcccgtgggcgccgctcatggaggagctcgtccgggagaacgcgcgcctcccgtggccggagagggagccctacgcgttctggaagggcaaccccgacgtgtcggaggtgcgccaggacctgttccggtgcagcaacgactccgccgccggcaaggagtggaacgcgcggctgttcaagcaggactgggacgccgccggccggaacgggttccgggactcggacctgaccaagcagtgccggtacaggtacaagatgtacgtgcaggggcacacgtggtcggtcagcgagaagtacatcctcgcgtgcgactcgccgatgctggccatcgacacgcccttcagggacttcttctcgcgggggctcgtcgccggcaagcactactggcccatcgacccggccaacaagtgccgcgccgtcaagttcgccgtcgactggggcaacgcccacccggcgccggcgcggcgcatgggcgaggaaggcagcgggttcgcgagggaggagatgggcatggactacgtgtatgagtacatgctgagcgtgttgacgcggtacagcgccctgctcggctgctccggtacaagcccgccgtgccggagaaggccgtggaggtcagcctcgagtccatggcctgccccaggc

SEQ ID NO: 28033 - DNA, 542 bp, Triticum aestivum
  Clone ID: PAT_TA_28033
ccgtgtccggcgaattcggggggagcccggtgagctggtccggtctcctctcgctcctcgtcccctgcctcctctccttcgtcctcctccgcttctccgccctgctggaccccggcgccgccgtgccccgcgtcaagaggtcccctcccctgcccctccgcttccgccatgacggcgccttcaagatcctccaggtggcggacatgcacttcggcaacggcgccgccacgcgctgccgggacgtggcgccggaggtcggcggcgcgcgctgctccgaccgcaacaccacgcgcttcctgcgccggctcatcgaagcggagaggcccgacctcatagccttcaccggggataacatatttgggggcaagtgcaactgatgcagcggaatcactgctcagagcaattagccctgctattgaagtacaaggtaccatggggccgccatattaggaaatcacgaccaggaatccacaatgacgcgagaggaactgatgatgttcttgtctttgatggattactcagtatctcaagtaaaccctcct

SEQ ID NO: 28034 - DNA, 1050 bp, Triticum aestivum
  unsure (1)..(1050): unsure at all n locations
  Clone ID: PAT_TA_28034
gngnaaaaacaacaacaaattcatcatcgatttccttatgggtggtgtttccgctgctgtctccaagactgctgctgctcccatcgaacgtatcaagcttttgatccaaaaccaagatgaaatgatcaagcaaggtcgtctctctaccccctacaagggtattggtgactgtttcgcccgtaccatgaaggacgaaggtgccatctctctctggagaggtaacactgctaacgttatccgttacttccccactcaagctttgaactttgccttcaaggacaagttcaagcgtatgttcaacaaggacaagaacagagatggctactgggcctggttcgccggtaacttggcttctggtggtgctgctggtgctgcttctctcttcttcgtctactctttggattacgctcgtactcgtcttgctaacgatgccaagtctgccaagaagggtggtgaacgtcaattcaacggtttggttgatgtctacaagaagaccttgaagtctgatggtatcgccggtctctaccgtggtttcaacatctcttgtgttggtatcattgtctaccgtggtctttacttcggtatgtacgattccatcaagcctttgatgcctcaaaaccttcaagactctttcttggccaccttcgctttgggttgggctgttaccaccggttccggtcttgcctcttaccccattgataccgtccgtcgtcgtatgatgatgacctccggtgctgctgtcaagtacgactcttctcttcactgtttccgtgaaatcttggctaacgaaggtgccaagtctctcttcaagggtgctggtgctaacattctccgtgccattgctggtgctggtgtcttgtctggttacgattacctccaagtctggatgttcggtaagaagtactaagttgcttcttaacacaatctagttcttaattgtgcctgcttgattttattgtaattttatttataaaaccaaacaccatttaaaccaaaaaatacattttaaatgaaggaaaataaaaagtcttgtgcttttgtgtttataag

SEQ ID NO: 28035 - DNA, 299 bp, Triticum aestivum
  Clone ID: PAT_TA_28035
cgtcatcaccactggcggtgtgactgctgggctcgatgccagtctatacttggtgggttctttggcttcgcacgactcggctctggaggtcgctcgtgctatgcagtattcttgggtcaagggcgttacggtcgatgcgatcgatgtttgagctacggctcccgcgcgacaagcgaaggcgtttacgaggaagggttgaacggagatctgagaaggtcatctggaacatgtcgggaatcatagagatttaccacgacgaatcatgtgaggattcattcgagagtatgtaaagaatcaag

SEQ ID NO: 28036 - DNA, 756 bp, Triticum aestivum
  unsure (1)..(756): unsure at all n locations
  Clone ID: PAT_TA_28036
ctcgtgccgaattcggcacgaggcgtggcgtacgcgagcgcctccagccaccatacacacacaagcgctcgtgccggcccgctcgatcgacaggagagagtgagctagctagcatagatggagaggagctcgaggctgttcgagacggagacgcacgggggccgggcggcgtacaggctccacgccgtcacggtggccgccgggatcctcctgctgctctactaccgggcgacgcgcgtcccggccgccggcgagggcagggcggcgtggctgggcatgctggcggcggagctctggtacgccgcctactgggtggtcacgcagtccgtgcgctggagccccgtccgccgccgccccttcatcgacaggctcgccgccaggcacggagaaaggctaccttctgtggacatctttgtgtgcactgcagacccctattcggagccgccaagcctcgtcgtctccaccatcctgtcgctcatggcgtacaattacccgcccgagaaattaagcgtgtacctttctgacgacggaggctcgattctcacttactatggcatgtgggaggcctccttgtttgcaaagcactggctgccaattctgcaagagatataacattgagccaaggtnaccggncgtttacttntnacagtnagatggggattaagaattgtggantnnaaaagaatgtgtattgttcaaggacatgtttgtagaaatgattgagtgaatatggaaggttgtgatgtgggggaaaat

SEQ ID NO: 28037 - DNA, 1004 bp, Triticum aestivum
  unsure (1)..(1004): unsure at all n locations
  Clone ID: PAT_TA_28037
ccccgcgtccgngatatggaaaagatctggcaccacaccttctataatgaacttcgtgttgctcccgaagaacaccctgttcttttgactgaagctcctttgaaccccaagtctaaccgtgagaagatgacacaaatcatgtttgaaaccttcaacgctcctgccttctatgttgccattcaagctgtcctttccttgtatgcctctggtcgtactaccggtattgttcttgactctggtgatggtgttacccacactgttcctatttatgaaggttatgcccttcctcacgccatcttgcgtttggatatggccggtcgtgacttgactgactacttgatgcgtatcctcgctgaacgtggtcactctttcactaccactgctgaacgtgaaatcgttcgtgatatcaaagaaaagctttgttatgttgctcttgactttgaacaagaaatgcaaactgctgctcaatcatctgctcttgaaaagtcctatgaacttcctgatggtcaagtcattactgttggtaatgaacgtttccgtgctcccgaagctcttttccaaccttctctcttgggtcttgaatctgctggtattcacgaaaccacttataattccatcatgaagtgtgatgttgatatccgtaaggacttgtattccaacatcgttatgtctggtggtactactatgtatcctggtattgctgaccgtatgcaaaaggaaatcactgctcttgctccttcttccatgaagatcaagattgttgcccctcccgaaagaaagtactctgtctggattggtggttccattttggcctctctgtctactttccaacaaatgtggatctcaaagcaagaatacgacgaatctggtccttctatcgtccacagaaagtgtttctaagcagctcattttttttacttttattctctccctttttcttttgtctcaaaatatatctttttttttattaaaagcatgaaaagaaaataaataatatacacatc

SEQ ID NO: 28038 - DNA, 168 bp, Triticum aestivum
  unsure (1)..(168): unsure at all n locations
  Clone ID: PAT_TA_28038
aataggtgttgtccagaagtagttctggtgatgtgattgtggtctggtagactggtaccatacgtgtaaaatatcacttttgttctattctttctttctttgctggaattgaagcaatagcaataaatctcccatgttgtgaatttcgcgccctctaaaaaaanaaaa

SEQ ID NO: 28039 - DNA, 1512 bp, Triticum aestivum
  Clone ID: PAT_TA_28039
cgcgcttgctccaggcagccagcaacagaccagcagccagccgagcgctccgaggagggagagggagagactgccttgccttgcagagattcctctcggagtcgggctcgggggatctcgtcggccgccatggagggggaggacggcggcggcggggtggactgggacagcctggccgaggcggcgtcgggggccgtcggcgcgctcgtcagcaccaccgtgctctacccgctcgacacctgcaagaccaagttccaggccgacgtccagacggaccagggcgcgcacaagtacaggaacctttcagatgtcttttgggaagcaattaggaaaaagcaatttttgtccctatatcagggccttaagacgaagaatatccagtccttcatttcgcagtttgtttacttttatggctatagctatttcaaaagactctacctggagaagagtggagctaaatctattggaacaaaagccaacttgctgattgcagccgccgctggtgcttgcacagttgttgtgacacagccattagatacagcatcttctagaatgcaaacaagtgctttcggaaagtccaaagggctgcgagcaactctcgcggaaggtacttggcttgaggcattcgatggcttgggcatttcccttatgttaacatgcaatccttcaattcagtacaccgtgtttgaccacgcttaagcagaagctaattctgaggcagacgcgtaaaaatgcagaatcagcaggtgattcttccccggttgctctttctgctttctcggcatttctccttggtgccatctcaaaaagtgttgcaacaatcttgacttacccattaatcaggtgcaaggtcatgattcaggctgcagaccccgatgaggacgacgaggacgaatctgaaaagccaggcaattcaaggcctcccaaaacaatgttgggcgccatgcatgcaatgtggaacaaggaaggcatcccagggttcttcaaaggattacatgctcagatactaaagacagttctgagctccgcattactgctgatgataaaagagaagatttcaaagttcacttggatctcggctgcttgccctgcggcgatacctctttgtttctcggaagagaatcaagagtgcataattgtatcatacatatgtcagacctgagaaaaccagtctaatcgtccactggtatttcttagatcttatactaccaaataacagaagtacagaagcagaacagcacgaatcatctagagaccatcaaaggaattttctgaataaatttacttgtttttatctagtagctcttgagcatcctgattcctacttggaatataaaagaatgaatggaaacaggccatgaaaataattctggctattggtgtggtggtcctggtagacaggtataacataactgtaaaatatcactcttgttttcttctctttctctttgcgcgagtggaggcgatagcaaaaaaaaaaaacatgttgtaaaaaaaaaaaaaaaaaaaaaa

SEQ ID NO: 28040 - DNA, 613 bp, Triticum aestivum
  unsure (1)..(613): unsure at all n locations
  Clone ID: PAT_TA_28040
gcacgaggcctcgaatcatcagcctcagctcccatggcgcccaaggcggagaagaagccggtggcggggaaggccgagnaagaccacgacggcgaagaagaccaaggccgagaagcggccgccggcgtccaaggagggcggcgagaagaaggggaagaagaaggccaagaagagcgtggagacgtacaagatctacatcttcaaggtgctcaaacaggtgcacccggacatcggcatctcctccaaggccatgtccatcatgaactccttcatcagcgacatcttcgagaagctcgccggggagtcggccaagctcgcccgctacaacaagaagcccaccatcacgtcaagggagatccagacctccgtccgcctcgtcctccctggcgagctcgccaagcacgccgtctccgagggcaccaaggccgtcaccaagttcacctcctcctaggcttcatcctcgtttctcaatccgttggattctgtatgtagttagctgcaagattgtgttctgaatgtgtaatcttgtgctgctggtgggtctgaagaaatattcatgggactgcttaatgaatatttttgccgctnnnnnnnnnnnnnnnnnnnnnnnnnn

SEQ ID NO: 28041 - DNA, 868 bp, Triticum aestivum
  Clone ID: PAT_TA_28041
ggtaaagccggccgaagaggcaaaatctgcaaccatgaagatgaagagatgcgtcattcctagcatcctgctgatgctcgcacttgaggccgccgtcctcgtcgccggccacccctccgctatggccgtcaccaacgacgagggtaccattctcctgccgagcgaaggcaaagatcaagtaggaacggcggcggcttccaggccatgggattgctgcgacaacaccatatgcaccaggtccttgccgcctatctgcatctgtctggacgaggtcgacgagtgcgcctccacctgcatggcctgcgtgccgtccgtctcaaaccccttccgccgcgtctgcggagaccagtacttcggcgatcccgggcccaagtgcaacgatgacgtcctcaaagcccaaggtgatcatcaagtgagcgtagcggcggtggcggcggagaagaacggggcagaggaggagaagccgtgggagtgctgtgacatgcctctgtgcaccaggtcatacccgccgatgtgccgctgcgtggacgaggtcgagcagtgcgccgcaacctgcaacagctgcggggtgtccatcttgaacccgttccgccgcgtctgcaacgactggtacaacggcttcccaggtcgcaggtgcactgaggccgccggcagcggcggtaataactagcaccggcgttgatcgcccgatcaacgccatcaaccgtgcacttgagttgctcctgcatgcactgtgtgacaataaaataagaaatggatggccggctggcctgctatcgctactgcttgcctgaatggtgatcaggcaaccatgcatgaataaatacaagtcgatcgagctagcgtctgtatgttgcaacgttttaat

SEQ ID NO: 28042 - DNA, 915 bp, Triticum aestivum
  Clone ID: PAT_TA_28042
gaagaagcaaagctgactaatctgcaaccatgaagatgaagagatgcatcctgctgatgctcgcacttgaggccgccgtcctcgtcgccggccgcccctccgctgttgccgtctccaacgacgtgggcaccattctcatgccgaccgaaggcaaagggcaagtgggaacggcggcggcttccaggccatgggattgctgcgacaacaccatatgcaccaggtccttgccgccaatctgcatctgtctggacgaggtcgacgagtgcgcctccacctgcatggcctgcgtgccgtccgtctcaaacccattccgccgcgtctgcggagaccggtactacggcgaccccgggcccaagtgcacctacaacaccgtcgccggcgacaacaacgacgacgccctcgtagcggcggcggcacaggaggagaagccgtgggagtgctgtgacatggctctgtgcaccaggtcatacccgccgatgtgccgctgcgtggacgaggtcgagcagtgcgctgcaacctgcaagagctgcggggtgtccatcttgaacccgttccgccacgtctgcaacgactggtacaacggcttcccaggtcgcaagtgcaccgaggccgcccacgccggcggtaataactagcacctgcgttgatcaacgccatcaagagtgcacttgaatttcccctgcatgcaatgtgttacaaataaaaatgaatggccagctggcctgctaccgctacttgcctgactggtgatcaggcaaccatgcatgaataaacacaagtcgagcgtctgtatgttgcaacgttttaatgaatggtgtgattttttttcccgtcaattttaagttgcttaccacgtgttccacgtggtgaatggtgttaaaaaaaaaaaaaaaaaactcgagggggggcccggta

SEQ ID NO: 28043 - DNA, 1050 bp, Triticum aestivum
  Clone ID: PAT_TA_28043
cgagtttttttttttttttttttgtcgcgaataaacatgccagcttctttcatttcggtcacacataagacgcgcgaccagctccggcgggcccagattcttacgaggcggcaacgtcggcgaataaacatgccagtttattttatttcggtcagacataagacgcgcgaccagctccgccggtcctataatcaagcgacgcggcggcagagcgtgatgccatcggcgatagggagctgcacggggtcgacgcgcgtgtcggcggcgatcatggcgttgaaccccctgagggagtcccgtttcttgcggtcctcctccgtgagcggcgtttcgtcgggcatggccacggtgccgccccagagcgtgttgtcgtaggcgagcacgccgccggacgcgcacgagccgcagcagctgctcgtggtagttgccgtagttgtacttgtcggcgtccacgaaggcgaagtcgaagctcccctcgtcctcgtcggccgatgagcttgtcgaggatggggccggcggggccctcgcggaagtcgaccttgtgcgcgacgccggccttcttgatgacggggaggccgaggtcgaagtactccctgctgacgtcgatggcgacgatcctgccgtcgtccgggatggcgagcgcggtagcgaggacggagcagccggtgtagaccccgacctcgatggtcctcttggcgcccatcagcttgagcagcagcgacagcaccagcccctcgtccggcggcgacgacatgaacccgaagatgtgctcgttggtgatctgtcggagctcgcgcatgaactcgttctcccgcgggtacaccatcgtcttcaacatgtaatcgtagaggtcgttgctcttgaggagggtcttggtggtctcgctgctgtggacatccctgacctcgccggcgctcccgttggaagccatgtctatgaacgagcgaaatgcgcgcgcgcacacacacgcaccgactaaaaaaagaagaggagtgggaccagggtgagtggcgccgtgacggtgccgggtgcggggcagctgggggtgac

SEQ ID NO: 28044 - DNA, 305 bp, Triticum aestivum
  Clone ID: PAT_TA_28044
tcgagatgaagcttgtcgttgtgctctcggccctgctcctgctttctctcctcgccgtctcctccgccgaggaattcgatttcttctaccttgttcagcaatggcctgggtccttctgtgacacgaagaaggggtgctgcttgccgttgccgccgtccgtcggggtgtggtgcggcggctgattggctcgacgcggcccggccggccgcctgcacagtgcgcgggtggattacgtgatggatgtacctttgtgtttgctattggttcagttaaaatgccgtcacagtcccgagttctgggcatcg

SEQ ID NO: 28045 - DNA, 476 bp, Triticum aestivum
  Clone ID: PAT_TA_28045
atagcaactcatttgctagtcataatttcgaatatggcatgccgatacaggacaagataccagtaacttcatttggatacatctttgcacagaactttatgccggcgagacgcagctgttccaggtgtaccagtgcatcgaccgcgccgggaagaacctcatcgactgtccgctgccgatgcagggcaactgcaaagacagggtccagctgccggccttctgattaaatttgagttctaattgaacacccgttgccggcgtccgtcggggtgttgtgcggcggctcattggctcgacgcgccccggccggccgcctgcacggtgcgcggctggattacgtgatggatgtacctttgtgtttgttattggttcagttaaaatgccgtcccagtccggagttctgggcatcgacgtaacgtttactattaattcctgatctgatcatcaggccaataaagactttaatcttgcctttt

SEQ ID NO: 28046 - DNA, 1035 bp, Triticum aestivum
  Clone ID: PAT_TA_28046
gatcccacgcgtcaggcttgtcgttgtgctctcggccctgctcctgctttctctcgtcgccgtctcctccgccgaggaattcgatttcttctaccttgttcagcaatggccagggtccttctgtgacacgaagaaggggtgctgcttcccggacaccggcaagccggcgacggacttcggcatccacgggctgtggcccaactacgccaagtgcaagacccgcggcgagctcgacggcgccctggagatggtgaccaagcgcaagaagaagtgctggccggagaactgcaacagcgagcgcctcaagctctgggagatcaaggacctggtgacggagctggacgccaactggccgacgctagcgtgcaagggcggcaagagcatcgagttctggacccacgagtgggagaagcacggcacctgctccaacctggaccagcacggctacttcgcgacggcgctcggcttcaaggcccgccacaacctcaccggcatcctcgccgacgccgggatcgtgccgtcggacagtgagacctacttcctcagcagcatcagggacgccatcaagcaggggaccgggttcacggcgaacctggagtgcaaccgcggcgtcgccggcgagacgcagctgttccaggtgtaccagtgcatcgaccgcgccggggagaacctcatcgactgcccgctgccgatgcagggcaactgcaaagacagggtccagctgccggccttctgattaaattttgaattctgattgaacacccgttgccggcttgccgccgtccgtcggggtgtggtgcggcggctgattggctcgacgcggcccggccggccgcctgcacggtgcgcgggtggattacgtgatggatgtacctttgtgtttgttattggttcagttaaaatgccgtcacagtcccgagttctgggcatcgacgtaacgtttactattaattccaaatccgatcaggcgaaataaagacttttgggagaaaaaaaaaaaaaaaaaaaacaaaaaaaaaaaaaaaaaaaaaaaac

SEQ ID NO: 28047 - DNA, 556 bp, Triticum aestivum
  unsure (1)..(556): unsure at all n locations
  Clone ID: PAT_TA_28047
gncaagggacacttgcctggctcgcgaaaaatagtgaattgatcgaagccgacatccggatatacagccgtgtttcggagtgccacaaggatggcaagatctcgggtgccgttagatcatttacccttgtcgagggcgaatatcgagagacgcgcccagaagcagcaagcaagcaagaattcgaggagaaatttttgccttttatcaaaaccataccaactaatctgcaccgcgagagatatgtgctggaggacgagtggtggagtgccggcggcagcctgtacaatcgagaccatctcgacatctacggcttcgacgaggagaagccagaccactccgtctactttgcgaagctgcttacccacccgaacgcaccgcgcctggagaactttagctttgaggtcaagacgttcacggtggttcgcaacgtcccggctgaggggtgtagataagctgtcgacgcgggaaggctcaatggtcaattcaatgtaacgtatattcattgataccaaaaatttatacttgctttctttcccngngggaatggggaggggtg

SEQ ID NO: 28048 - DNA, 640 bp, Triticum aestivum
  Clone ID: PAT_TA_28048
attctcgtggcctgtttgttattcggcatcagcaacagaggcagtgcagcagggtgcagaacttcagatcttgttgtcacctcgcacacctacccggatccggggggaaggccagtgcaatacaagaagctggtgaacaactgcgattgcacgcagaagaacgtgaagctggcgtgcccaaggttcaactcttccatcgaggtctacccggacacagccatcaagccggacggccacggcattctttgctccctctatgccggccgcccggttgggcctaaggagaaggtcttcttcgacatccactcaagtacccagttcagcttccagcccgtctcctctaccattgtatgttagatactgcgaataaatgatgtcatggccatatcagaaatatgcctccatagcgacaaaaacggtgtatttctgaataaagttcttagttcttaccatcgtactgtattaaattcagatcaaaaaaagccagtgatcatctcgttgaagtagtaacagtttatcgtcctaccttgagaccctaaagtatgattttgtcattaccgtgtcatgttatcgattatctggagtctgagacatcgtatgctgttttgctagctgtttaaaaaaaaaaaaaaaaaaaaaa

SEQ ID NO: 28049 - DNA, 556 bp, Triticum aestivum
  Clone ID: PAT_TA_28049
ataaactcatagccgagattttcaacatcatcatagccgagattttcatcatcatcatggtgttgtatttacatcgatcatggggttgtcgcctaagcacaagctgcgacgaacacaacaccactaagctactagtactcctaatttgggccccaacagctgaggtacatcatggtcctcagcccctcctcggccttctctgcccgtcgcctctcggccaccgccgcagcagaggccgcaagctgcttggggccctgcgagacgccgccgcggacgttggccctggccttggctgcccggtggatggagctgagcgcatagttccagcggcaaagccccgcctggtccttgagggcctccacagcgcccacgctcatggccaccagccacgacgccttcgccggggcagccatccctccttgtccttgttcttcttgctgcgctgctggagagtggacactgacttgtgatccttctgtatggcagtagaggacttgggaagttgcggtactgaaagaacagagctgattcttttggactatctcgctgaattgac

SEQ ID NO: 28050 - DNA, 302 bp, Triticum aestivum
  Clone ID: PAT_TA_28050
ttttttttttagaagataggtgagcccattgattagatcgcagaaaaatggagacaatgcaggtcacagagtagcacagtacaggtcccagtaccaagagaaacacagacgagttactacatcaaagttcagacttcagaatcatggtccctctcctcactctctccaacactctcttcttcctcgcagaaacgccggctcaatcattcaatcacaaggcgacacacgacccccctcgctccctccatctctccggcgaccaccgtagtaccaccctaccccgtcctcccctcgtccgaatt

SEQ ID NO: 28051 - DNA, 518 bp, Triticum aestivum
  Clone ID: PAT_TA_28051
aaaagcatcacaactgccgcttattcgggattcgaaacccccatcatttttaatccgggggggacaaaactggctcaaacaacaagtttagcgggtctacaaggcaaattcttgggttcaccccgtagtaacccccctttggttgaaccttcggaccctggtggaggcaatttaacattttattgggaagggggtgcaatgttatcattcacttcagttttgaaaccgcagcatgtatggcatctgcaaaatggggtacagtcctggagctcaaaccggccatgctgatccccccataaaatgtcatggaaatgggatattcccgcctcaagaaggctacttgctcactggtgagcccagggaaaggaaacaccccaatctgcttaatgatgggggaccaatctccaggggtttctctgattttcagcgcatcaaaaagctgccccctcatgctaattatcctatcagccatggccttcagctccacgggccattcgtcgaacatagcactgtcctta

SEQ ID NO: 28052 - DNA, 399 bp, Triticum aestivum
  Clone ID: PAT_TA_28052
gcccgtggtccacgaaccatttcccaaaatttccccactcgcgaaccctaacttcgaccagcctctcgccccagatcccctccccctactctcaccaggagcagaacccacccgctcggaccgctccgcgtaatcgccatgtggggcggacgaggaacccgttgatcccaagaagtatcttgaggagcggtgcaagccacagtgtgtaaaaccactgtatgagtatgagaaatgtatcaagagagtcgaggccgatgatactgggcacaagcactgcactgggcaatattttgactactggtcatgcatcgataaatgtgtagcaccaaagctctttgaaaagctgaaatgatattggggcgctactttcagtgagtgagcctggtcattggccagaac

SEQ ID NO: 28053 - DNA, 570 bp, Triticum aestivum
  unsure (1)..(570): unsure at all n locations
  Clone ID: PAT_TA_28053
gagagagagagagagagagagagagagagagagagagagagagagagagagagagtgagtgagggaggcgccgccgcgccgacgccgagtcctttctccatcctgcatctgccgctgtttccgacaggatgtttctcacgaggacggagtacgaccgcggggtgaacaccttctctccggaggggcggctgttccaggtcgagtacgccatcgaggccatcaagttgggatccactgcgatcggtttgaagacaaaggatggctgttgtactcgccgttgagaaacgtgtgacctcaccactgctggaaccaagcagtgtggaaaaaataatggaaattgatgagcacataggctgtgccatgagtggacttattgctgatgctagaacactagtggaacatgctcgtgttgaaactcanaatcatagttctcatacggagagcaatgactgtagaatcttcgacacaagctatctgtgactaactctcgttttggcgaagtgacgaanatcatgtccggcattgagtcctcnctaatgcngncatatgaaatggactaccttcacactg

SEQ ID NO: 28054 - DNA, 505 bp, Triticum aestivum
  Clone ID: PAT_TA_28054
gtcattttggttttgccagtaatttctgaaactctctggagagcatgacagagtgattgctgtggagactgtcatgaaatcagagccaacaggagaaatcaatcctgattgtgtcaatgcatccaatccgtatcataaatgtggagaatattgcaaaagaaatggcaacagatagagacaaggctgtcaagatatcgtctctcaagatgaatagatgatgatggtgaaaaataagtgatgctcgcgacattagcctttttaagttgcagtaagtagtagctgtgccttgtccggctcattttgtagtttggctgcagcggctccgtctttccggtgcttgcatatttttctacatccatagtactactatatatatattcttcatggtgttcataccagagtaatgagtttgcatatgtaggccagtgtaaggtattacccgaatacgcatagtagtcatattcttttgtaatacatcgtcattaagcatgttttgcccccttcc

SEQ ID NO: 28055 - DNA, 562 bp, Triticum aestivum
  Clone ID: PAT_TA_28055
gaactcgaagtggggaaaggtttcatcatcatcatcatcgtgatactccgtacgtatttacaatcggcagggaattaaccagccaagttgttgctaaacagaggctggagcctggagctaggagaaaacacctctttgtagctagtactaattgggaccccagcagctgaggtacatcaccgtcctcagcccttcctcggccttctcccctcgccgcctttccgccaccgctgccgaagccggaagctgctttgcgccctgcaagacgccaccgcgaacgttggccctggccttggctgcccggtggatggacctgagcgcgtagttccagcggcagagcccggcctggtctttgagcgcctccacgccgcccacgctcatcgccaccatccacgacgccttcgccgcacctgccatgatctctctgcaactctgttcttctcgccgcgtggaggagatgacgccgctgaatggcctgcctgaactctgtgatgcttgaagtttgatagcagtggagtgtggattttcgtggtggtgaaggaactgagctgcaagcgaaagc

SEQ ID NO: 28056 - DNA, 503 bp, Triticum aestivum
  Clone ID: PAT_TA_28056
actgtttctgatcatttgaacgaagcgccaccaacacctacaagcargccagactcaagaargggaaaggctgtcatgaaatcagagctaacaggagaratcaatcctgattgtgtcaatgcatccaatccgtatcataaatgtggagaatattgcaaaagaaatggcaacagatagagacaaggctgtcaagataccgcttctcctccagatgacgrtggtgaaaaataagtgatgctcgcgacattagcctttttaagttgcagtaagtagtagctgtgtcttgtccggctcattttgtagtttggctgcagcggctccgtcttcccggtgcttgcgtgtatatttttctacatccatactatacatatattcttcrtggtgttcataccagattaatgagtttgcatatgtaggccagtgtaaggtattgcccgaatacgtatagtagtcatattcttttgtaatacatatattggcattaagcatgttttgcccccttc

SEQ ID NO: 28057 - DNA, 607 bp, Triticum aestivum
  Clone ID: PAT_TA_28057
ctcgtgccgaattcggcacgagctctcctctctactagtacgtacttggttcccaagaagaaacaccaccaagcacccaccccgtgtagtagaaatagaaaaagtgcttcgaattccgatccgcatccgccgacacgatgtttctcacgaggacggagtacgaccgtggggtcaacaccttctccccggaagggggcggctgttccaggtccgagtacgccattgaaggccatcaagttgggctccaccgcaatccggcttggatgactaaggatggtgttgtactggctgttggagaaacgtgtcacctcaccgctgctgggaaccaagcagtgtgggagaaaacatggaaattgatgagcatgtcggctgtgccatgagtggccttattgctgacgccagaatcataggttctcatatggggagccaatgacagtagaatctaccacacaagctatctgtgacttggctttgcgctttggtgaaggtgatgaagaatcaatgtcacggccgtttggagtctctctccttattgctggtcatgatgaacatggacccagcttgtattacacagacccatcggggaccttttggcagtgcaaggcca

SEQ ID NO: 28058 - DNA, 652 bp, Triticum aestivum
  Clone ID: PAT_TA_28058
aaaatggtaaaagaaaaagggttctattgcttatggcgaattcacatcgggccatcccggcatccagtactggaaaacaacgagtacgcactccatggcattggattcacatcggtcggtcggacgatatcttgatatatgtacgcgtttgcattcgcatgtatatataggagttaaccgctggggaagatttactgctcccatgtctcgaacttgccggagacgaagtcgtaatggccgccgacgagcttgagggttccgttggacacaccctccttgacgaacgggtaggtcaggaggcgcactcagtctgcaccttcttcttggccgggaagccgatcctgacccagtcctcgacgaagtggaaggagtcgtctgcgccatccttgagtgagagcagagccttgattccaccgcagcggctgtggccaatcaccacgatgacctcaacctttgagagcacagacggcgtattcgatggccgatccaacacccggcgtacttgttcttgcagtaggaggggaccatgttggcgatgttgcggatggtgaaggcctcgccgggctccaggcccagggtgaccgatgggcacacacgcgagtcggcgcacgcgaacaccatgtacttgggcgcctcctcgtgccgaattcct

SEQ ID NO: 28059 - DNA, 372 bp, Triticum aestivum
  Clone ID: PAT_TA_28059
ggtgagcccattgattagatcgcagaaaaatggagacaatgcaggtcacagagtagcacagtacaggtcccagtaccaagagaaacacagacgagttactacatcaaagttcagacttcagaatcatggtccctctcctcactctctccaacactctcttcttcctcgcagaaacgccggctcaatcattcaatcacaaggcgacacacgacggacgcacacagacaccattgccacacatcgcacacggttttatttggacacagcaacattattcgctaccagcggcagaggactactacgacgacgatggacggacggacgacgactcggggcgggggggcttgtcccacgcgtccgcccacgcgtccg

SEQ ID NO: 28060 - DNA, 397 bp, Triticum aestivum
  Clone ID: PAT_TA_28060
tagcgtggtcgcggccgaggtattgaactggggcatgcaaaccgcaagccatgaagctagcactgctgcgcttaattacctaataatggtttttgcttacggtgttgctccatgtatggggctctctgacgtgaatctttatggcctctgatgctgtacaccggcaccggccccatcgacaacctcttcgctcacctcgccgaccccggccacgccaccatcttccgggcattcgcccccaagtaagggacacgttgggagttagcaactaatccgaggagtgtgctaccacggggaagaagatcgctggtggaacttgatttttttcccgtggatgatggtatgtaattgtggagcaatgcatgcttgttggatgtgtacttgtacctcggccgcg

SEQ ID NO: 28061 - DNA, 534 bp, Triticum aestivum
  Clone ID: PAT_TA_28061
ttttttttttttttttttttttttttttgccctcaagccatgtctgcttgctaggttactcttgctgcaacgaacacaagcatctctaggccctagctagctactagtactcctaatttggcccccaacagctgaggtacatgactgtcctcagcccctcatcggccttctccactcgccgcctctccgccacggccgccgcggaagccgaaagctgcttggtgccctgcgaggcgcctccgcagacgttggtcctggccttggctgcccggtggatggagctgagcgcatagttccagcggcagagcccagcttggtccttgagggcctccacggtgcccacgctcgtggccaccatccacgatgccttcgccggagcagccatctcttctcctccaccttgttcttgctgtgctgctggatagtggagactgacttgtgatccttctgtatcgtagtagtggacttgcgaagttgcggtgcaaagaacagagcttattttcttgaactgtctcactggattgatgcttgcct

SEQ ID NO: 28062 - DNA, 776 bp, Triticum aestivum
  Clone ID: PAT_TA_28062
tcacacccaaggaaggatttccagcgttggttctctccttcaaccactcccacaggacgatagtcgtgccgtcgtgcacgccaccctgccctcgccggcgtcgagggcgtcaaagttgaggtggatgttgttcaccatgcggacgcagcggaagccgtcgccgacgtcctcgctctccgtccacagcaccgactcgtccaggtactccgggtcgtagggcacaagccgaacagggtggctctctccaagggaatgcttgatggcttcgccggtgagcttgttcaccagggcgaacgcagggtacccatcctcgtccttgatgctggtgctgcgccgcatgtccttcacccagtgctgcgagtcgtcgccggggtcggtaggagcgaggcacacggttccgtccctcgcggcgacgctgtactcctcgccgccggcgctgcagaagatgcggacggtgcactcggaagacagcgcaggaggcaagccaccgtcgtacccttggccttggtcctgtgataccgcatcgtctccgccgtagctgaaacgcgcagtctcctggtcctggccgccgtggtacccgccgaactcgtcgtcgtccccgtaggctgctgcaggtggtggagcgtcggcgtcggtgccccacggcaggatcttccagcactggttccccccctcgttccactcccacagcccgacgacggtgccgtcctgaaggtccggctcgccctcgaaggcgtcaaagttgaggtagatgttgctgaccatgcggatgcagc

SEQ ID NO: 28063 - DNA, 734 bp, Triticum aestivum
  Clone ID: PAT_TA_28063
tagcgtggtcgcggccgaggtacatggtgaaacgagtgaattcagatgagcttcttcttctggaagaatccttgcaaatgccatagctgcagagcggagaccacaacgcacacgcccagtgacaagatgctgaaccaggcaacccttgaatttgttttctcactcacttcccgcatctccgcttcccttgctttgagatataacaagttatgatgaatggattccactgcagcttcaagtttcacgagctctaattcaacaccctcaattttctccttcttggcaacagagtcccagtcctttgtcgcaatccctatcttccaatcaagatttagagatactcctgatcctttctctgcgctgtctagccagaagcaagcaaggtagtttccagcttctgaagttgtaaatgcaaattggcccactgtggcattttctttgtgatgtactgccagagaagtttgaattctttggacagaacattgacctgagcccgttgagcggcatatttacttcgatcgagaacgcggcgtcctccgtcgccaagaccatctccggtcagcccccactgaagatacctttcaggagcgagassctggggtcctggctgctcacaacctaccttgatgccgagcttagaatctccagaggagatggcagcagcatctttgtgctgttcaaggaaggagctcgctgtcgatataggcgagcgtacygcccgggcggcgctcgaa

SEQ ID NO: 28064 - DNA, 547 bp, Triticum aestivum
  Clone ID: PAT_TA_28064
ctacgagggagaaattacgcattctgccaccaccgggaaatggacagcaaatatacgagattgacccaacgctccgagactttaagtaccatcttgagtatcgatatagcctatacaggagaatacgttcagacattgatgaacacgaaggaggcatggatgtattttcccgcggttacgagaagtttggatttatgcgcagcgctgaaggtatcacttaccgagaatgggctcctggagcagattctgcagcattagttggcgacttcaacaattgggatccaaatgcagaccatatgagcaaagtatgcatgtagtttcacaaataatattttctttgtagattagtttttttttagattggcctatctatttaaatgtggttgaatatacaccttatatgtattccagagttgagctgtaaatatagttggaagtgtttaggagtattaaattcactggatctttctttcacttgcctgttgcgcgagcccattactagatatcaatgttaaaaaaaaaaaaaaaaaaaaaaaaaaaaaaaaaa

SEQ ID NO: 28065 - DNA, 734 bp, Triticum aestivum
  Clone ID: PAT_TA_28065
gcctcgccgacgtcgaccgctccgcccgcaagaagaacagcctcaggttggatgactgggtgctgtgccggatctacaacaagaaaggcgcctcggagaggccgggcgccggtgaccggacggcgagcgcgagccccgggcacgcggccgtcggctcgccgccggagcagaagccggccctgctgccgccgtacgcgccgcagccgttctcggacctggcggcgtactacgaggtgaggccgtcggactcgatgccgcgggcgcacgccgactcgagctgctcggagcacgtgctgacggcgtcgtgcgagcggccggaagtgcagagccagcccaggatctccgagtgggagcgcacgttcgcctccgccaccccgggcgtcaacccggcggccgggctccccgccggcgacccgctcctccaggacatcctcatgtactggggcaagccgttctgaggctccggctccgttgctgtacgtgtggggggggtggggcttgggagggaatcgatcggggtgactcgggcgagccgccggccggaatctatcggcaggagacactcgtggccgttggatggaaggtatcaatagtgcacaaggagttacggacggcggcgatgagacgcgggagccccggtgtgttccacgagggacgcggagagtactgcacttggtcttggtgtataccgatttgaactaagctgtgtatatgcgattgatttggaaaaaaaa

SEQ ID NO: 28066 - DNA, 650 bp, Triticum aestivum
  Clone ID: PAT_TA_28066
tcggcaaaaacgttacggacacaagtaacactggacacgcatcaacgtgcagcattacggtataactgccacttcatggactgtgcaaggtgtctacacgagctaaatgacatcagaatcagcccatgccaaaccgaaaaatgctaagaatggtcatgcgacccgttattttggtaagcttccgccgtcgaaacctagaactggaactgcatctccttggtgtagccaaggtcatccaggtttgcagccatggctttattcattggaggaggtccgcatctcaatatctgaatgtcgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgc

SEQ ID NO: 28067 - DNA, 714 bp, Triticum aestivum
  unsure (1)..(714): unsure at all n locations
  Clone ID: PAT_TA_28067
gcatatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttccgccctcgccgccaccgccgtcccggctatcgtcaccgcccgcggccaccgcatcgagtccgtccccgagttcccgctcgtcgtctccgactcggccgagggcatcgagaagacctcccaggaaggagaagatcaactccaagaggaccaagctcagtgcggaggaggcatctaagatcaaggctgctgggaaggcctggtaccagacgatgatctctgacagcgactacacggagttcgacgtcttctccaagtggcttggcgtcagccagtgatcatctcgttgtagtagcagtttatcgtccctaaagtatgattttgtcattaccgtgtcatgtaatcgattatccccgagtctgagacatcgaatgctgttttgctagctgtttatnctggagtgttttatnctgggacgcattttgcgagaca

SEQ ID NO: 28068 - DNA, 888 bp, Triticum aestivum
  Clone ID: PAT_TA_28068
aatatgcatcacatagtaataatttttacaatagttccgcgtcgacagatttgatcccttattacaaaattgacatctggccatccggcgttcactactgctggaaaataacgagcaggtgcatgctccatggcgttcacatcgatggatcggtcccacagtatatttgatatgatatatgtaggagatgagcgatgggttgcgagattatttacagcgcccatgtgtcgaacttgccggagacaaagtcgtagtggccgccgaccagcttgagggttccgttggccacagcctccttgacgaacgggtaggtgttcagattctggagggacacgttgacggcctccttttccaagacgccgcactgctcctcgggagacatttctgagcactcatccttgaccttcttcctggctgggaacccgatcctcacccagtcctcgacgaagtggaaggtgtcgtcggcgccatccttgaggttgagcagggccttgatcccgccacagcggctgtggccgatcaccacgatgacctcaaccttgagggcgcagacggcgtactcgatggccgacccgacaccagtgtgcttgttcttgcagtagcacgggaccatggcagcgatgttgcggaccgtgaaggcctcaccaggctccagacccagggtcaccgacgggcacacgcgtgagtcagcgcacgcgaacaccatgtacttgggtgactggtgggccttgaggggctcgaagagatccggcttctggtcgtagacctcggtcttgaacttctcgaagccggtcttgaggcgctccacggcggggtccatctcgagcagggagggtgggggaggatgtgaggaagagagagaaagaacttgctgagggtgggggaggc

SEQ ID NO: 28069 - DNA, 557 bp, Triticum aestivum
  Clone ID: PAT_TA_28069
ttttttttttaaactcataaccaaaattttcatcatcatcatcgtcgtgatatctttacaatcgatcagggggcaaccagctcagtctcaggacatggctgcatgcttatactaatactaaattacttgctgcaataaacacaacactcctagctactaccactcctaatttaggccccagcagctaaggtacatgacagtcctcagcccctcctcggccttctccgctcgccacctctccgccacggcggccactgtggcaggcagctgcttgttaccctgcgagacgccgctgcggacgttggccttggctgcacggtggatggacctgagcgcgtatttccagcggcagaggccggcctggtccttgagcgcctcgagcgcgcccacgctcatcgccaccatccacgacgccttggctgcagctgccgtggtctatgcttcttgccgcgttgcttgctggagagtggagagcgatttgtgtagtggactcacggagttacagctacggtaccgaaggaactaagctgatgcttgtctttcttgctggactgctc

SEQ ID NO: 28070 - DNA, 479 bp, Triticum aestivum
  Clone ID: PAT_TA_28070
ttttttttttgacaaggagggtgatatatattcatcatcatcatcatcatcaacaaactcaacacccctaagctactagtactcctaatttggcccccggcagctgaggtacatgacagtcctcagcccttcctcagccttcgtcgctcgccgtctctccgccacagcagccgtggaggccagaagctgctcggtgcccagcgagacgccaccacggacggtggccttggccttggcagctcggtggatggacctgagcgcgtagttccagcggcaaagcctcgcttggtccttgagcgcctccacagtgcccacgctcatggctaccatccacgatgccttcgccgcaatagccatcgcttctcctatactttttgtttttgctgtgctgctggagtggaaactgactggtgatcctggagtggacttgcgaagttgaacagagctgatttgattttattgaactgtctcagtgagtt

SEQ ID NO: 28071 - DNA, 592 bp, Triticum aestivum
  Clone ID: PAT_TA_28071
gattcggacgaggcggaggaccagtacgatttcgacccgctcgacgacaccaagacatggccggaggatctgctgccactccagcccgtggggaggctggtgctggacaagaacgtggacaatttcttcaacgagaacgagcagctggcgttcggaccggggctggtggtgccggggatctactactccgacgacaagatgctgcagtgccgggtgttcgcgtacgccgacacgcagcgctacaggctggggcccaactacctgatgctcccggtgaacgcgccgcgatgcgcgcaccataacaaccactacgacggcgccatgaacttcatgcaccgggacgaggaggtggactactacccgtccaggcacgcgccgctccggcaggcgccgccggtgccgatcccggcgaggccggtggtggggaagaggcagaaggagaccatacggaagccgaatgatttcaagcagcctggggagaggtaccggagctgggacgccgatcggcaggagaggtttgtgcggcggtttgctgactcgctggggcatccaaagggtagccaggagctcaggtccatctggatcgacctcc

SEQ ID NO: 28072 - DNA, 518 bp, Triticum aestivum
  Clone ID: PAT_TA_28072
agcacaggacagggcccagtaccaaaaaaaacacaaacgagttactacatcaaagttcaaacttcaaaatcatgggccctttcctaactttttccaacactttttttttcctcgcaaaaaccccggctcaatcattcaatcacaaggggacacacgacggacccacacaaaccccattgccacacattgcacacggttttatttggacacagcaacatttttcgctaccagcggcagaggactactacaaccacaatggacggacggacaacaactcggggcgggggggcttgtccccggactaatccatggcgatgtgtcgatggcaatgcaaaagctctcctggcatttcatttaccaggggaggatcttccagcgctggttgtcgccctcgcaccatttccaaaacacaacctcggtgccgtcgtggaccccgccgtgggccttgtccccgtggaaggcgtcaaaattgaggtaaatgttgttcaccatgcggacgcaggggaagcccttgccca

SEQ ID NO: 28073 - DNA, 642 bp, Triticum aestivum
  Clone ID: PAT_TA_28073
tttttttttttccttttaaagcatcaattcatatttctcatcaagataacaaaaggcaaatagataaggagagtaatatgaactgaagtaacagaaatatgttgtcatcatcatcatggtggtattttacaatgggcgattcaacgggaagccacacaggtttgaggccatggttgttgcagcaacagagacacgcctagcagttgaggtacgtcaccgtcctcagcccctccccagctagcagcaagttgcagctgctaattgggaccccagcagctgaggtacatcaccgtcctcagcccctcctcggccttctccgctcgccgcctctcggccgccgccgccgcggaggctggaagctgcttggcgccctgcgagacgccgccgcggacgttggccctggccttggcggcccggtggatgatggacctgagggcgtatttccctcggcagagcccatcctggtccttgagcgcctccacggcgccgacgctcatcgccaccatccatgacgccttcgccgctcccgccatgatctctcttgcgttggtggagacagcactgtgattgatgtgtctgaactatgtgatgcctggagattggtagctgaagtctgagtgtggagtatggaatgaattttga

SEQ ID NO: 28074 - DNA, 656 bp, Triticum aestivum
  Clone ID: PAT_TA_28074
acaaaaaaacagacagacaaggggagtaatatgaactgacgtaacagaaatttatcatcatcatcatcatcgtggtttttacaatgggggattccactcgaagccggctagtaccaagtttctacatcgtggtttcaggccatagtactaaccacagacacgcctagctagtactccctccgttcggaattaattgtcgcgaaaatagatatatctagatgtattttagttctaaatacgtccatttccgagacaggtaattccaaacggaggaaataccaagtaggcagcttctaattgagaccccagcagctgaggtacatcaccgtcctcagcccctcctcggccttctcctcacgccgcctctccgccaccgccacagcagaggctggaagctgcttagcgccctgcgatatgccgccgccggacgttggcgctggccttggctgcccggtggatggacctgagggcgtagttccatcggcagagcccaaccctggtccttgagcgcctccacggcgccgacgctcatcgccaccatccaagacgccttagctgcacccgccatgatctctgtgtgttggcggtatgaaactctgaagtaggtgaggactgagatgaaggtgaaggctgattgtgaatgaactgagatgaag

SEQ ID NO: 28075 - DNA, 906 bp, Triticum aestivum
  Clone ID: PAT_TA_28075
aggtcggctccctccttctccaaggtcgcacgacgggagaggactcagccccgatgctctgcctctccatgtgtctccgcaagccatcgtctgatgccgtcgttgcccgccatcatctttctcgctgcctgcttgctagagagccatggctttcctcgctgtggctgatgcttatgcgttcagttagggtaaggacgtgcatccccttccaacagatcaatttctctcatcgctcttcaagcactgatttgttcttccctttctcttctaattttcttgttgttcatacaaccgctgctcggtttcttgcttctgcctcttccgtatgcatgtccgcaccgtttgttccaagaagcgaaggcggaggtggagatgcgggagaggccgagtccgaggtggcagaggacgggcgatgaaaatggcacagagtggtcgcgggctcattccggcggccggcgcacgcagccgtgaggggtggggtggatgagcaagcggcgtcgccgccgctgcctcgtgcctgcgggcgagaaggtaagaggcagatggcatgcatatgttgatgtaccaaatatcaaggcattgctatagcagccattgcttttgcctagctgcgattccatcttgcattgagtacacaacatctattatgaagcagcagatcgccacctcctacccccacagtttacagcaagcagcaacaagttcatagtctggccgaggagcaagtaccaccgaggccttcatcgagctcaagatggtaccctggaatgtgtataatgcaaccatgccagtgacagggagaaggagcaggcgttgagttgtgcaagcagcaggtcgcacccttccaagaaaagtgagcatgggtcctgttcttggtggatttatctcaagaacaactagcacgcc

SEQ ID NO: 28076 - DNA, 672 bp, Triticum aestivum
  Clone ID: PAT_TA_28076
tcgagcggccgcccgggcaggtacagagacaacaagatacactcccaacatcaaccaccctcactttggggcgttcctgatgcatcacaacagtatcccccgtctttcggggtttccccgctggcggcgggcatactgcactacaaatacataaatatgaagaagaacatacacatcaccgagattacggacagacggcaccgacacagacaggctgtggagaagttgggtagtaccctggttgcccttgtcccagttgttgcccttgtcctgactgttgcggagaagttgggtagtacccttgttgtccttgtcctggttgttttccttgtcctggctgctgcccttgttccgactgctgcgaagttgggtagtaccctggttgcccttgtcccagttgttgcccttgtcctggctgttgcagagaagttgggtagtatccttgttgtccttgtcctgattgttgtccttgtcctggctgctgcccttgttgcccttgtcctggttgctgcccatgtcctggttgctgccattgtcttggctgccgcaaagaagttgggtagtaccctggttgcccctgtcatgatatggtgcccttgtgcgcgctgttactggagaaattgggtagtaccccttgttgtccttgtgtctgcgtggttgccatagtccaag

SEQ ID NO: 28077 - DNA, 725 bp, Triticum aestivum
  Clone ID: PAT_TA_28077
aaggccgagcgccggtgaccggaccgcgagcgcgagccccgggcacgcggccgtcggctcgccgccggagcagaaaccggccctgctgccgccatacgcgccgcagccgttctcggacctggcggcgtactacgaggtgaggccgtcggactcgatgccgcgggcgcacgcggactcgagctgctcggaacacgtgctgacggcgtcgtgcgagcggccggaggtgcagagccagcccaagatctccgagtgggagcgcacgttcgccacagccaccccgggcgtcaacccggccggcttgatgctcgacccggcggccgggctccccgccggcgacccgctcctccaggacatcctcatgtactggggcaagccgttctgagaatccggctccgtggctgtacgtgtggtttggcgctgggatgaaatcgatcggggtagcggccggaatctatcggcaggagatactcatagccgttggatggaagatatcagtagtgcacaaggagtcacggacggcggcgatgagacgcgggagccccggtgtgttcgaggagggacgcagagagtactcttggtgtatacggatttgaactaagctgtgtatatgcgattgatttggaaattgggttttttgtttacattgcttttttatacctttgtcttgtttgggagatgtgcatggtatcggtaccattggaacaggaatatgtatacttataatt

SEQ ID NO: 28078 - DNA, 278 bp, Triticum aestivum
  Clone ID: PAT_TA_28078
tagcgtggtcgcggccgaggtacaccggcaccggccccatcgacaatctcttcgctcacctcgccgaccccggccacgccaccatcttccgggccttcgcccccaagtaaggaacacgttgggagttagcaactaatccgaggagtgtgctaccacggggaagaagatcgctggtggaacttgacttttttttccgtggaagtaaaccggatgatggtatgtaattgtggagcaatgcatgcttgttggatgtgtacctgcccgggcggccgctcgaa

SEQ ID NO: 28079 - DNA, 550 bp, Triticum aestivum
  Clone ID: PAT_TA_28079
atgcagttattgcacggcctgaaacatctctagccacgcattcaccaccgcaactactaattgaacagcaaatccgacacaacgcgacacgacagtacaatagctccttggagcagatgataactaactagcagctgcagtacgactaagatcaccgagcagcaaacttattaaacacacccagcagctggatctaggggttgtagtagacgatcttgatctcgtcgacgccgtggcacttgccgccggggacggagtgctcgaagcagtggccaccgctgttgcagccggcggtggggcagtggtctttcagggggtggccagggctgtagagcagcttgctgttggccagcggctcgatgccgaggtaaaggtccttgccgcacaggttctgcaccgtaaccttgcggctcggcttgcagttttggggatcctgaccggcggcggacatggcagtcgctgccagcgccacggcgaggaggagagccgccacgggcttggagaacgccattggctgttactcgctggttaggagtgaagaggagtgacc

SEQ ID NO: 28080 - DNA, 762 bp, Triticum aestivum
  Clone ID: PAT_TA_28080
tggctattactagagtatcaatttagttgtgtattaactctgctttgttttactgcagatttcggtgtggaagaaattcaacctgatcttcctcttcttcctactccggaagctcatactacccttctactccttcacgctcttctgcatcatcctcccgatgaccatgtttgtgcccgaagccgagctcccggactgggtcgtatgctacatccctgcccttatgtccctgctcaacatcctgccgtccccgaagtcgttccctttcatcatcccatacctgctcttcgagaacaccatgtcggtgaccaagttcaacgccatgatctcgggcctgttccagctcggcagcgcctacgagtgggttgtgaccaagaactcggggcggtcgtcggagagcgacctcatctccctggcggcggcgccgcccagggagctgcggcaccacccgaagaccgggtcggcgccgagcatggaggcgctgatggtgctcaaggagcagccgagcccgaagaaggaagggaagaagcagcagaagaagcacaaccggatatacaagaaggagctggcgctgtcgctgctcctgctgacggccgccgctcgcagcctgctgacgaagcagggtatacacttctacttcctgctgttccagggcatctccttcttgttagtaggccttgacctcataggcgagcaggtcgaatgaaaaaagaaaaatgtaaacatggacacgatagattttaaaaggcagtggttggcccc

SEQ ID NO: 28081 - DNA, 912 bp, Triticum aestivum
  unsure (1)..(912): unsure at all n locations
  Clone ID: PAT_TA_28081
gtctcttacttgatgctggtgaatgatctaattcatgggctttatcctgaagccgtaactatcggtgaagatgatagtggaatgcctacatttgcccttcctgttcaagttggtggggttggttttgactatcgcttacatatggctgttgccgacaaatggattgaacttctcaaaggaaacgatgaagcttgggagatgggtaatattgtgcacacactaacaaatagaaggtggttggaaaagtgtgttacttatgctgaaagtcacgatcaagcactggttggagacaagactattgcattctggttgatggacaaggatatgtatgatttcatggctctgaacggaccttcgacacctaatattgatcgtggaatagcactgcataaaatgattagacttatcacaatgggtttaggaggagagggttatcttaactttatgggaaatgagttcgggcatcctgaatggatagactttccaagaggcccacaagtacttccaactggtaagttcatcccaggaaacaacaacagttacgacaaatgccgtcgaagatttgacctgggtgatgcagaatttcttaggtatcatggtatgcagcagtttgatcaggcgatgcagcatcttgaggaaaaatatggctttatgacatcagaccaccagtacgtatctcggaaacatgaggaagataaggtgatcgtgtttgaaaaaggggacttggtattttgtgttcaacttccactggagtaatagctatttcgactaccgggttgggctgtttaaagcctgggaagtacaagggttgtcttagactcagacgccggactctttggtggatntggtaggatccatcacactgcagagcacttcacttctgactgccaacatgacaacaggccccattcg

SEQ ID NO: 28082 - DNA, 581 bp, Triticum aestivum
  Clone ID: PAT_TA_28082
gtaaaaaagcttatttctggaaagctgataagctgttgtctcctatactcggcaaaaaacgttacggacacaagtaacactggacacgcatcaacgtgcagcattacggtataactgccacttcatggactgtgcaaggtgtctacacgagctaaatgacatcagaatcagcccatgccaaaccgaaaaatgctaagaatggtcatgcgacccgttattttggtaagcttccgccgtcgaaacctagaactggaactgcatctccttggtgtagccaaggtcatccaggtttgcagccatggctttattcattggaggaggtccgcatctcaatatctgaatgtcggcagcaggcgctgggcagtgagcttggatcatttcctttgacacaaacccgacaccaccatcccagacttcaggtggctgattcaagacatagtagatcttgaagcgatcaggatagtttttagccatattgtctagttcttccagcagaagaatgtcgtcatatgtgacattagcgtagatcaagtgaacttttgtattgtcatttgggttctcaagaattgcccttgtgactt

SEQ ID NO: 28083 - DNA, 937 bp, Triticum aestivum
  unsure (1)..(937): unsure at all n locations
  Clone ID: PAT_TA_28083
gcggctgcctgctcgattccccaacagcagggttggtttgattctcatcatcccttctgcttgcttccgatttcgtttctccccgtgagcctcagattttggatcgcggcgttcccccacccccccttgctcgagctttccgattcgttcggtgtcatcgcgccttctccgatcgatccgcttcctcctcctgttgatgattctgttgacccggcccggtcgactcgatcggctttaccggtcaacgacagtacctatcgcgcgatgggtttgggactgagattgccgttcttcctactcctcttgctgctggtcagcctgggagccgcacaaggccggagcacagtttttcttgatatcaaggaggctcgagaccctgatcaaatcttgatggatcagataacttcgagcaaaactcccgttcgtgttgagaggggtagcccactatgcccagcttgcgagaagtttacagatgaagctcttagctatcttagtcaagaaacaatcacaagataagatgatggaaggtccttcatgaagcttgttctcagacattctcgttggaaaagaagtgtgtttgattggtggctccctatgcaacctcttaattgccaagattgctgagattcaagccggaagattctgcaaacgaatggctctgcaaggacaatccctctgtctggtgtnagaagtgagacacattgtgtttgccacacctcaaggatgaattttgtccaaacgaaaatccgatgctgattcnaaatatcaaatctctcaagatgcaaaagttaaggcacaacacatgcaaagattgtcctcaaactcctccatctggcaagggaaantcctcaggggggccgtacaatcnccaaatnatctatancccnaangctcttnactcnacngaaaccnggtacactacctgagaatccttcag

SEQ ID NO: 28084 - DNA, 555 bp, Triticum aestivum
  Clone ID: PAT_TA_28084
gcggccgcgtcgactttttttttttttttttgaggccaaaattttcatcatcatcataatcattatggtatcttacaatcgtggggaaagggcaatcagccatggttgcttactttgctccgacgaacacaacacctctagctactagtactcctagtttgggccccagcagctgaggtacatgaccgtcctcagcccctcctcggccttctctgctcgccgcctctccgccacggccgccgcaaaggccggaagctgcttcttgccttgcgagacgccgccgcggacgttggcctttgccttggcggcccgatggatggagctgagcgcatagttccagcggcagagccccgcctggtccttgagcgcctccacggcgccgacgctcatcgccaccatccacgaagccttcgccggaccagccatctcctcctaagttgctggagagaagatactgaattgtgatctccgtgtctatagagctactgaacttgcggagctgcggtggtgaagaaagtgtgctgatgcttgtttttcttgctcgactgcctcaaa

SEQ ID NO: 28085 - DNA, 645 bp, Triticum aestivum
  Clone ID: PAT_TA_28085
gtctagctgcaggcagagcagagttgagcgtgtgggagtcgaaggagatcgagatggcaactgcatatgctcctccgatggcgagccaggtgatgaagagcggcttggtgagctccaagccgcgggggctgtccggcgcctcactcaccaggaggccccgcttcgtcgtcagcccgctcctccgcggcatcgaggtcggcctcgcccacggctatctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgcgctcacgctcaccggccgcaagaaggaggccgacaagctgcagactgcggaaggctggtcgcagttcaccggaggcttcttcttcggcggtgtctcgggcgccatctgggcctacttcctcctctacgtgctcgacctcccatacttcttcaagtagatgattattgtttggcatgtacgatgggtgcagatgatgtgatctcttcttgatggttgcttgaaagagtctatgtataaatgaatttacgtattcctcaaaaaaaaaa

SEQ ID NO: 28086 - DNA, 573 bp, Triticum aestivum
  Clone ID: PAT_TA_28086
ttttttttttggatccaactagctcacgtttagttaactcagtaatgtggtataacctggacctgaatcacgttcagttgagcgtgtcggttcagcaaattgtagagcgaagaaattcagacagaaccttcacgaacgatctcaccccacaggaagcacttgcacttgcaaccaattcatagcacaacatgtattctgcaccccccagcagctgaggcacatcaccgtcctcagcccctcctcggccttctccgctcgccgcctctctgccacggccgccgccgaggccggaagctgcttcttgccctgcgagacgccggcgcggatgttggctgcccggtggatggatcgcagagcatagttccagcggcagagcccggcctggtctttgagcgcctccaccgcgcccacgctcatggccaccatccatgacgccttcgccgcaccagccatcactgctctccttctgcttgctgggctggtggaaaatggttgaactgagactgatttgtgattgcttgtgtctagtagtggactttcagtgataaaagagctgagctgatgcagggctgc

SEQ ID NO: 28087 - DNA, 455 bp, Triticum aestivum
  Clone ID: PAT_TA_28087
gcagcggtgatccttgtggcctgtttgttattcggcatcagcaacagaggcagtgcagcagggtgcagaacgtcagatatttttgtcaccacagaggcctacccggatccgggaggaaggctagtgcagtacgtgacactggtgaacaactgcgccaggtgcacgcagaagaacgtaaagctggcgtgcccggggttcagctcttccatcgaggtctacccggacactgccatcaagccggatggcgacggcaagctctgcaccctctacgccggccgcccggttgggcctaaagagaatgtcttcttcaactacgtgcccgtctcctccaccattgtttgttagataatgttgatcatggactcacaaatatgtttccatagtgactgaaagataggacatctctatcattcaggtaataaaagatttggagtgtctgttttttaaaaaaaaaa

SEQ ID NO: 28088 - DNA, 589 bp, Triticum aestivum
  Clone ID: PAT_TA_28088
ttttttttggcaattcaaagctttttctgaagcaggataatgtgaactcgaagtggggaaaggtttcatcatcatcatcatcgtgatacgtatttacaatcggcagggaattaaccagccaagttgttgctaaacagaggctggagcctggagctaggagaaaacacctctttgtagctagtactaattgggaccccagcagctgaggtacatcaccgtcctcagcccttcctcggccttatcccctcgccgcctttccgccaccgctgccgaagccggaagctgctttgcgccctgcaagacgccgccgcgaacgttggccctggccttggctgcccggtggatggacctgagcgcgtagttccagcggcagagcccggcctggtctttgagcgcctccacgccgcccacgctcatcgccaccatccacgacgccttcgccgcaccttccatgatctctctaactctgttcttctcgccgcgttggaggagacgatgcgctgactggcctgcctgaactctgatgcttgaagattgacaacagtggagtgcggattttgtgggaggaaggaacggagctgcaagctga

SEQ ID NO: 28089 - DNA, 689 bp, Triticum aestivum
  Clone ID: PAT_TA_28089
gccggggagcaggagtacttcacccgacaccacccaccctcttcatcgtggagctcatcctcatcggctgggccgagggccgccggtgggcagacatcatcaagcccggctgcgtcaacaccgaccccatcttccccaacaacaagctcaccggcaccgacgtcggggtaccccggtggtctgtggtttgacccgctcggctacggcaccggctcgcccgagaagctcaaggagctccgcaccaaggagatcaagaatggccgcctcgccatgctcgccgtcatgggcgcgtggttccaggccgagtacaccggcaccggccccatcgacaatctcttcgctcacctcgccgaccccggccacgccaccatcttccgggtacgcatatgatacacattacattacattggtactatatatgtatgtatgatttggctactgatgtatgaccctttttggtgttacgtttcaggccttcgcccccaagtaaggaacacgttgggagttagcaactaatccgaggagtgtgctaccacggggaagaagatcgctggtggaacttgacttttttttccgtggaagtaaaccggatgatggtatgtaattgtggagcaatgcatgcttgttggatgtgtacttgtaccctggtgttgtaaccgatgtaaagaatgaatacccttttgaacctt

SEQ ID NO: 28090 - DNA, 884 bp, Triticum aestivum
  Clone ID: PAT_TA_28090
tatgacgatcaaattatgcatcacatagtagtacaataattctgcgtcggaaaatactatcgcttattacaaaaattgacgtcaagccatctggcattcactactggagaataacgagtaggtactccatggcatttgatggatcgatatatcttgatatacgtacatatgtatatatatttcgcgtttgagcaaagggagggaagattgatttacagctcccatgtgtcaaactttcctgagacgaagtcgtagtggccgccgattagcttgagggttccattggccacaccctccttgacgaacgggtaggtgcttgaggttctggagggacacgttgacggcctccttttccaagacggcacattggtcctcgaaaggcaggtcacaacactcgtctttcaccttcttcttggccgagaacccaatcctaacccagtcctcaacgaagtggaaggagtcgtcttccccatccttgagcgagaggagagccttgattccaccacagcggctgtggccaatcaccacgatgaccttaaccttgagggcacatacggcatattcgatggccgatccaacgcccggtgtgcttgttctttgcagtagcacgggaccatggcgccgatgttgcgaacggtgaaggcctcgccgggttccaggcccagggtgactgacgggcacacgcgcgagtcggcgcacgcgaacaacaagtacgtgggttcctggttgtccttgaggggctcgaagagatccggcttcttgtcatagacctcggtcttgaacttgtcgaagccggtcctgaggcgctccatctttctatcttcaagagtggttgaagaggaggaggacagagacggaccttgtggaggatggtgggtgggctt

SEQ ID NO: 28091 - DNA, 331 bp, Triticum aestivum
  Clone ID: PAT_TA_28091
tagcgtggtcgcggccgaggtacaccggcaccggccccatcgacaacctcttcgctcacctcgccgaccccggccacgccaccatcttccgggcctttgcccccaagtaaggaacacggtgggagttagcaactaatccgaggagtgtgctaccacggggaagaagatcgctggtggaacttgatttttttctttcctgggaagtagaccgtggatgatggtatgtaattgtggagcaatgcatgcttgttggatgtgtacttgcgggcgaggtcgtggtaaagggcagcaaggccgaagaggccgcaacacctcggccgcgaccacgcta

SEQ ID NO: 28092 - DNA, 448 bp, Triticum aestivum
  Clone ID: PAT_TA_28092
ttttttttttttgttaggaatgggcaactaactttactgagggccaaaggccaatacatatacatgtatggtaaagtgcagaaaaccccttatacaatggggataaaccagaaagagactatacacatctaacaattgggaccccagcaaccgaggtacatgacggtcctcagcccctcctcggccttctccgctcgccgcctctccgccaccgctgcagcagacgccggaagctgcttcgtgctctgtgaggcgccaccgtggacatttactctggccttggcggtcctgtggatggacttgagcgcgtagttccagcggcagagcccggcctggtccttgagcgcctccacggcgcccacgctcatcgccaccgtccatgacgccttcgccgcacccgccatgatctctctcttcttcttgtcgcgctggtggaaaactctgtgat

SEQ ID NO: 28093 - DNA, 660 bp, Triticum aestivum
  unsure (1)..(660): unsure at all n locations
  Clone ID: PAT_TA_28093
tttttttttaaacagcagcacaatcaaaagcgcggttcagggagcgcaaatgcgcagttttcccatcctcttgtccccataatatttaataacttattcttatgcaagtcttggtaaatgaataagaagaatcaggtagcatgtcatacaaggtacgtacatctgtactactactagagcttttcagctggaaaacatatctataccggcacggtttatacaacctcccatcatatcataacttaacatctccagcgcctgaagcgctccgcatgtcaccgatccctccatcaccatcatcatcatcatcatcagcagcagcagcagcagcagcgacgttacatacataggtacacggctaagggccagccatgtcgactctcacttcatgatcgggggagaggcgtaggggccgttgagccaaccgttggccaccatgcggtaggcggcctcggtcatgtggatgccgtcccagctcacgtacgccgacgggttggagcacacgctccgcgcccgccttgacgcacttcttcctcagggttgaattgtagggcccgtcctccggcgccgcaacacgcctgcaatgccgtgctgaaccgattttccgggntcacgacgaatgcatgcggcttgaannatcgcgtcangatttggctcggg

SEQ ID NO: 28094 - DNA, 966 bp, Triticum aestivum
  Clone ID: PAT_TA_28094
cacgcacgcgcacagccagcgagcgcaccggtgcagcaacgatggcgctggtctcctcctcctccgccgccaccgccgtcgcggcgctccccagtaatgggctgggcggcgcccgagaggcccatctggttccccgggagcacccctcccccgtggctcgacggcagccttcccggagacttcggctttgacccctggggtcttggatccgacccggagagcttgcggtggaacgtgcaggcggagctggtgcactgccggtgggcgatgctgggcgcggcgggcatcttcatcccggagctgctgaccaagatcggcatcctcaacacaccgtcgtggtacaccgccggggagcaggagtacttcaccgacaccaccaccctcttcatcgtggagctcatcctcatcggctgggccgagggccgccgctgggctgacatcatcaagcccggaagcgtcaacactgaccccatcttccccagcaacaagctcaccggcaccgacgtcgggtaccctggtggcctgtggtttgacccactcggctggggctccggctcgccggagaagatcaaggagctgcgcaccaaggagatcaagaacggacgcctcgccatgctcgccgtcatgggcgcctggttccaggccgagtacaccggcactggccccatcgacaacctcttcgcccacctcgccgaccccggccacgccaccatcttccaggccttcacccctaaatgaggtttagcattttgaggagtgctaccgcacatgcattgttaggttgatggccgatatgaaacttcatttttttgtgggggcggactgcggagtagactgtcaatgatgatggaatgttcgtggtgcgatgcatggtgtacttgtactatgttgtaaaccaatgtaaaaatgggatactcgttagataatatgtcctctcttcactgaaaaaaaaaaaaaaaaaaaaaa

SEQ ID NO: 28095 - DNA, 1418 bp, Triticum aestivum
  Clone ID: PAT_TA_28095
ccttcgatcgtccggtctagctgtttctgcttatcgatatctggtttatcgcagcagtttggagctgtcggattcgagtagctagcttagctctacaatcgagcgagaagaaggatcgaggagatgagcggcggcggcggcggaggatcggcggcgacgcaggggcagcaggatctgcagctgccgccggggttcagattccatccgacggacgaggagctggtgatgcactacctgtgccggcggtgcgccggcctgcccatctccgtgcccatcatcgccgaggtcgacctctacaagttcgacccatggcagctcccgagaatggcgctctacggcgagaaggagtggtacttcttctccccgcgcgaccgcaagtacccgaacgggtcgcggccgaaccggtcggccggcacgggctactggaaggccaccggcgccgacaagccggtgggcacgcccaagcccctggccatcaagaaggcgctcgtcttctatgccgggaaggcgcccaagggcgacaagaccaactggatcatgcacgagtaccggctcgccgacgtcgaccgctccgcccgcaagaagaacagcctcaggttggatgactgggtgctgtgccggatctacaacaagaaaggcgcctcggagaggccgagcgccggtgaccggaccgcgagcgcgagccccgggcacgcggtcgtcggatcgccgccggagcagaagccggccctgctgccgccatacgcgccgcagccgttctcggacctggcggcgtactacgaggtgaggccgtcggactcgatgccgcgggcgcacgccgactcgagctgctcggagcacgtgctgacggcgtcgtgcgagcggccggaggtgcagagccagcccaagatctccgagtgggagcgcacgttcgcctccgccaccccgggcgtcaacccggccggctcgatgctcgacccgtcggccgggctccccgccggcgacccgctcctccaggacatcctcatgtactggggcaagccgttctgagaatccagctccgtggctgtacgtgtggtttgggagggaatcgatcggggtgactcgggcgagccgccggaatctatcggcaggagatactcgtagccgttggatggcagatatcaatagggcacaaggagctacggacggcggcgacgagacgcggggccccggtgtgttcgaggagggacgcacagagtactgtactcggtcttggtgaatacggatttgaactaagctgtgtatatgcgattgatttggaaatgggtttttttgtttaaattgcttttttatacctttgtcttgtttgggggatgtgcatggtatcggtaccattggaacgggaatatgtatacttatagttattcttcccgtgcgatcttttttcgcgaatacac

SEQ ID NO: 28096 - DNA, 551 bp, Triticum aestivum
  Clone ID: PAT_TA_28096
gtcattgtatcatctgtcagcggttatgaacttcctctctgtagtgtgatataaactcatagccgaaattttcatcatcatcatcgtgctgtatttacaatcgatcatcgggttgtcacatacgcacaagctgcaacgaacacaacacccctaagatactactactcctaatttgggccccagcagctgaggtacatcaccgtcctcagcccctcctcggccttctccgtcaccgtcggcgcggagaccggaagatgcttggtgccctgcgagacaccaccgcggacgttggccttggcagctcggtggatggacccgagtgcgtagttccagcggcagagcccggcttggtccttgagcgcctccaccgcgcccacgctcatggccaccatccacgaagccttcgccggagcagccatctcttctcctcctccttgtccttgcttggctgctggcaaggatactgaatccttgtgtgtagtgataatggacttgcgaagttgtggtactgaaaaaaggagttgatttcttgaactgtctcactgaagcgg

SEQ ID NO: 28097 - DNA, 1104 bp, Triticum aestivum
  Clone ID: PAT_TA_28097
gaccccgcgtccgtcttcccctatcccaagcaaaccgcgcaccaccatgttcctcacgaggacggagtacgaccgcggcgtgaacaccttctcgccggagggacggctattccaggtcgagtacgccatcgaggccatcaagttgggatctactgcaatcgggttgaagacgaaggatggggttgttcttgctgtggagaaacgtgtgacgtctccattgctggaacctagcagtgttgagaaaattatggaaattgatgagcatgtaggctgtgccatgagtggccttattgctgatgcaagaacattggttgagcatgctcgagtggagacccaagtacttctctttcttgtatactttattcactttgttcattaccttatctgttatctcactgtatgctcataatcagaaccatagattctcatatggggaaccgatgacagttgagtctaccacacaagctatttgcgatctagctcttcgctttggagaaggtgaagaagagtctatgtcacgaccttttggagtttctctccttattgctggtcatgatgaaaatgggccgagcttgtactacactgacccatctggaaccttttggcagtgcaatgccaaggcaatagggtcaggttctgagggtgccgatagttcattgcaggagcagttcaacaaggagctgacccttcaggaggctgaaaccattgctctatctatcctgaaacaggttatggaagaaaaggtgactccaaataatgtcgacatcgccaaggtcgcgccgaactaccacctttacacccctgcagaggtcgaagcagtcatagcacgattgtgaaacgaagatatctttgtcgaatgtcaaccaggattcatatgttccttgtgctgtgtgtctgacatcccgatgccttcaaattagtagaagcacaattgctctatgatatggacactgatgtttgcctcttttcgtttgattatcttgtgttgacaagaaggtgtagaggcctagctgttgttgccctgtcacttgccggcaaggagattgtactacacccttttgtttgatacgaaggatgtgtggcaatagcatgcagtatttcagc

SEQ ID NO: 28098 - DNA, 513 bp, Triticum aestivum
  Clone ID: PAT_TA_28098
caaaatagttacagaagcacatggacagggagggtgatatataaactcatagccgaaattttcatcattatcatcgtgctgtatttacaatcgatcatggcgttgtcacgtaagcacaaactgcaacggacacagcacccctaagctactagtactcctaatttgggccccagcagctgaggtacatcacggtcctcagcccctcctcggccttctccgctcgccgccgctccgccacggccgacgcggaggccagaagctgcttggtgccctgcggagatgccgccgcagacgttggccttggctgcccggtggatggacttgagggcatagttccagcggcagagcccggcttggtgccttgagggcctccacggcgcccacgctcatggccaccatccacgatgccttcgccggagcagccatctctcctcctccttgttcttgcttcgctgctggcgaggatactgaattgtgatccaagtgtatagtagtagtggacttgcgaagttg

SEQ ID NO: 28099 - DNA, 873 bp, Triticum aestivum
  Clone ID: PAT_TA_28099
ctgaacggaccttcgacgcctaatattgatcgtggaatagcactgcataaaatgattagacttatcacaatgggtctaggaggagagggttatcttaactttatgggaaatgagttcgggcatcctgaatggatagactttccaagaggcccacaagtacttccaagtggtaagttcatcccaggaaacaacaacagttacgacaaatgccgtcgaagatttgacctgggtgatgcagaatttcttaggtatcatggtatgcagcagtttgatcaggcaatgcagcatcttgaggaaaaatatggttttatgacatcagaccaccagtacgtatctcggaaacatgaggaagataaggtgatcgtgtttgaaaaaggggacttggtatttgtgttcaacttccactggagtagtagctatttcgactaccgggtcggctgtttaaagcctgggaagtacaaggtggtcttagactcggacgctggactctttggtggatttggtaggatccatcacactgcagagcacttcacttctgactgccaacatgacaacaggccccattcattctcagtgtacactcctagcagaacctgtgttgtctatgctccaatgaactaacagcaaagtgcagcatacgcgtgcgcgctgttgttgctagtagcaagaaaaatcgtatggtcaatacaaccaggtgcaaggtttaataaggatttttgcttcaacgagtcctggatagacaagacaacatgatgttgtgctctgtgctcccaaattcccagggcgttgcgaggaaaacatgctcatctgtgttatcattttatggatcagcgaggaaacctcccccaaatacccatgcctccttaaactttt

SEQ ID NO: 28100 - DNA, 630 bp, Triticum aestivum
  Clone ID: PAT_TA_28100
attcgtttgggtgcgttcctctctttcctcgtcgtctctcgttatctcgccgccgttcgtcgccgccggcgcagactaggagaggcaggcgccatggcgaccgcttcagtatcgttcaagtctcgtgaggaccaccggaagcagctcgagcttgaggaggcgcgtaaggcggggctcgcccctgccgaagtcgacgaggatggaaacgagattaaccctcacatcccgcagtatatgtcctcggccccatggtatctcaacgccgagaagccgagtttgaagcatcagcggaaatggaagtcggatccgaattacacaaaagcgtggtacgataggggtgccaggcttttccaggccaacaaatacagaaaaggcgcttgcgagaactgtggagccatgactcacaataagaaggaatgcatggaccgacctcggaatgttggagctaaatatactaatatgaatatagcaccggatgagaaagttgagtcgtttgagcttgattatgatggcaagcgtgaccgttggaatggttatgacacatcaacctacactcgtgttatccaagattacgaagctagagaagaggccaggaaaaagttcctgaaagaacaacagctcaagaagctc

SEQ ID NO: 28101 - DNA, 820 bp, Triticum aestivum
  Clone ID: PAT_TA_28101
tgtttttactttctttatctgttatcatcaaaaattatgtacctctcctctaatatagaagcatcaatttagtagtttaacattgttttattttgctgcagatttcggtgtggaagaaattcaacctgatcttcctcttcttcctgctccggaagctcatactacccttctactccttcacgctcttctgcatcatcctcccgatgacgatgtttgtgccggaagccgagctcccggactgggtcgtgtgctacatcccagccctcatgtccctgctcaacatcctgccgtccccaaagtcgttccctttcatcatcccatacctgctcttcgagaacaccatgtcggtgaccaagttcaacgccatgatctcgggcctgttccagctgggaagcgcctacgagtgggtggtgaccaagaagtcggggcggtcgtcggagggcgacctcatctccctggcggcggcggcgccgccgcccagggagctggggcaccacccgaagaccgggtcggcgccgagcctggaggcgctgatggtgctcaaggagcagcagccgagcccgaagaaggaagggaagaagcagcagaagaagcacaaccggatatacaagaaggagctggcgctgtcgctgctcctgctcacggccgccgctcgcagcctgctgacgaagcagggtatacacttctacttcctgctgttccagggcatctccttcttgttagtaggccttgacctcataggcgagcaggtcgaatgaaaaaaagaaaatgtaaacatggacacgatagattttaaaagtcagtctcagtggttggcccc

SEQ ID NO: 28102 - DNA, 652 bp, Triticum aestivum
  Clone ID: PAT_TA_28102
cgcgtccggcccgcgtccgcctggcctctcggtatcgcgccgccgttcgtcgtcgcgccgcgtcgcgccggcgagactaggagaggcaggcgccatggcgaccgcttcagtatcgttcaagtctcgtgaggaccaccggaagcagctcgaggcttgaggaggcgcgtaaggcggggctggcccctgccgaagtcgacgaggatggaaacgaaattaaccctcacatcccgcagtatatgtcctcggccccatggtatctcaacgctgagaagccgagtttgaagcatcagcggaaatggaagtcggatccgaattacacaaaagcatggtacgataggggtgccaggcttttccaggccaacaaatacagaaaaggtgcttgcgaaaactgtggagccatgactcacaataagaaggaatgcatggatcgacctcggaatgttggagctaaatatactaatatgaatatagcaccggatgagaaagttgagtcgtttgagcttgattatgatggcaagcgtgaccgttggaatggttatgacacatcaacctacactcgtgttatccaagattatgaagctagagaagaggccaggaaaaagttcctgaaagaacaacagctcaagaagctcgaggagaaggacggcgaaca

SEQ ID NO: 28103 - DNA, 1344 bp, Triticum aestivum
  Clone ID: PAT_TA_28103
gtttgttgaccccggttgtaagcttccagatgggttgggaaacttgataaacttgcaagagcttgattgggttgatgccttgcagttgaagcatgtggaagagctcggcaaactaacaaatctgagaaagctgaggattaaattggacactgatgggatagaaggcaacaaattagaacagtccaaggaaaagctggtgtcctctctctgtaaactggacgaatgcggcctccgttccctgagtattgattattatctgagagaaaaggatggaggagagccgttcctccctgctttgggttgtatccaggaggtttgtgtagatggacaagatatcagccggattagcagatggctcgcgtcacttcccaacctacacatgttgtttttcaacggtccgaagatagagcagcaggatattgagatgattggattgatacccaatctgatcgatttgttgctgcctttacacaaaacagacgacgctgggcggctcatcatcaggcgtgaaggatttcaacagttgcagagtttccgggtatacaatactcgtatgggggttttaatgtttgaaccgggggctatgccgaggctcaaggagcttgaactctataacttcatcgaaaggcccaaatctgctgcggtcgatttcgactttggcatccaacgcctctccagccttgctcgcctcactgtcagcttagcctgctatcgctcgacggcggcagaagtagaggctacggaggatgctttcaagagcatggccgaggcgaaccccaaccgtccaatactggagatgacaagactttatccgcagcatatggtacgagacgagcaaatagatatggcaggctcagctacaacgccggccgtcaagtcctagatgcctaaaccgagatgcgcctttggttatggagcccaagtcacgtactctgattggatgctgcaacaaatgaagctccacatttctattcgggctacctctttgtcgcaaagctggtgtactcttgtgatttgtgttgcgcaactgattcttctgtacatgtctggaagtatcacgaattagtggaatgattaggaataagtaagacaagtatcacgaattcagagtcagatgcaatttttttcttttcttttgggcataagtagcagttgtcatttgagtattttttccattaatattcgtgtattcttagattgagactttgatatgtaacccagatttctgttgttaggaaagacataccgtgtagcttatcagaagaaaagatctggcgtgcatctatattctataacctgtatgcagtaatcagatccacatttgttctaaaaaaaaaaaaaaaa

SEQ ID NO: 28104 - DNA, 817 bp, Triticum aestivum
  Clone ID: PAT_TA_28104
gggtggcttgggggttttttaaaatttttaacactgcattcacccagttattattattagtatcaccatccatatcatttgtattccaaatgaatgattaactgtatgtagcctcattccggcaaaattttgtatgtaaatacataaacagagcctgcaatgcgacccaaaactatatacgggacaggtcgcatgttcattattccttccattccatgtatctataatattatctcagacaaccataacgcctttttccttttctctcctcctcctgttagagcaagcgcacgccgcgacgacccctcccgggaccaggagtgcgttgccccggggccatccatctcgatggagaaacaagagtgctttgcacgccggaacgccgtcagagtacacgcgccgaggcgggggaagagagcctcatcaatggtggtgctgcgagaacggccaccatctcctcttcttcgccgtgtgatgcaacctcggagcgtctgttggcaacaaaaccataggacagagagggtttcagcgattactgttacaaggcagagatcgcggtgtcggtgtggaatgttggttgcatacgtttgcgacggggactggacacgcattgcatgtatgccaatggcaggcaggcatgctactcaccgttctgtggaaatatcgagttgtagtgaacctccgcccaaaagctcaacaacaccactttgttggacttctgaaccttgggttggatctcgatgtagcacgtatccttgaatgaggtcatgacgaaaatcttcactccgtacttgtcagcagcagcctgtaaagtcac

SEQ ID NO: 28105 - DNA, 1091 bp, Triticum aestivum
  Clone ID: PAT_TA_28105
tttttttttttttttttttttaagtcaaatgcaaggttccaactttccaaaccaaggtaaggtacagagacaacagatacactcccagcatgaaccgccctcactttggggcattcatgatgcatcacaacagtatcccccgtctttcggggtttccccgctggcggcgggcatactgcactacaaatacataaatatgaagaacatacacatcaccgagattacggacagacggcaccgacacagacaggctcacatctttagaggcctacttcttccaagcaccaggtcctttctgggggaaatgcaccaccaaccaacagcttgcgctttcatggacgacggacggaacagatcattgtgaaaacatcttccacaacttacagggatgatatttactaaaaagaaccacagagcaaccacaaccatgttccaaagcagatcaggccgcacgaggatcctggagtcacaggcagcacaatcttcagacagccaatgcctggcgctgatcacagagctgagggagatgcaggagagggtggagagccggcggaggtatgacgaatcaggcagggccttcatgctggcaggcctgagctcgcactcatggcagagggccacggcgcgcggcgactcgacggagctcaacacccaaatccacacctaccagacgccgtcgatggtcgacatgctgcaccgctcgcagactctcgtgcccgccgtcgtcgagatgctgaaccgctccccgaccgttgctccttcacgcggctccggccggtcggtgaggtcgacaaaatccttctccgagcggctggcgtgacgctgcttattcatcagaaccaagcttcaagaaataacctgtgaagtggttaggtgatttgagactatccaaattattttttagtttgattattcctacagctattgcttcgatatatttattttaaatactctagtggcctagtgggcatggggttagaaaaattaattgatcttgggacatacaagtacaagtagtttcctgtacatgatcagcgacgctcgaatgggaatgataaatgtcagacctgatagcggtgaaaaaaaaaaaa

SEQ ID NO: 28106 - DNA, 579 bp, Triticum aestivum
  Clone ID: PAT_TA_28106
tgatatacagtgcgtaaattgaggccgaaactttcatcataatcaccgtggtatcttacaacggtggggaaagggcaatcagccaggtctcaggccatggctgcatactttgctccgacgaacacaacacctctagctactatagtactcctagtttgggccccagcagctgaggtacatgaccgtcctcagcccctcctcggccttgtctgctcgccgcctctccgtcactgccgccgcagaggtcggaagctgcttcttgccttgcgagacgccgccgccgccgcggacgttggcctttgccttggctgtccgatggatggacctgagggcatagttccagcggcagagcccggcctggtccttgagcgcctccacggcgcccacgcccatcgccaccatccacgaagccttcgctggaccagccatctcctccccttcttgttcccaagttgctggagagaagatactgaattgtgatctctgtgtctgtagagctactgaacttgcggtagtgaagaaagtgtgctgatgcttgttcgttttttgtggactgcctgaactgatgcctgtttgtgc

SEQ ID NO: 28107 - DNA, 951 bp, Triticum aestivum
  Clone ID: PAT_TA_28107
ttttttttttttttttcaacacaaacctcctttcttgatcaacgaaatggcaaatcttttgccttgtttcaaaaaaaaaaataaaaaattcaacacagcctggccttccaataacctgtctgtaaacatgcctcatttggcaacaaaaaagtggtgatcttcttcgggactgatcttctttgttcacatatctgtgtataaacaaggctcttcaatggacccattttccttgaaattgtcgggcaaacaacccaagtgaagagactaatggtacaaattctattgcatcattggagtttatccttgagcctgctgcctgtcggggaggatctaaatcagtaacctgagccctaacgcgtaccactcgctgtctgaactaaatatttctgctgtgcactcactatttgttttgcttgctaatactatctataaggatcgtgtggccgtgtgtgctacatatgcatatgcggaggtatgatacaatacacttcactgtttattctgctcaagcatggagtcgatgcgtccgtccttgttgtaggcctccacgattttcttggcatacgatggcatatgctgctccgctcttgcccttccccatgcccggttcacatacaggtagttccttatcgtgtggtaatccagagagtagcgaccaaactccaggcccttgggcccaatcagatttagcaggaaggcgatgatgttgcccacaaatatgggagctggattagcagggccttttcccattttcgctgcatcgtcggctttcactgtctccatcacaaatggttgtctagcaccactgctaactgttggcgtgctctccaaaaggccctctatcaggctgagcatctccctccctcgctcgttcctgactgtaatatactgagggtgctgagtcatagaaacgccagaatatttcggtacctgcccgggcggccgctcgaa

SEQ ID NO: 28108 - DNA, 906 bp, Triticum aestivum
  unsure (1)..(906): unsure at all n locations
  Clone ID: PAT_TA_28108
gcaccaaccactgcctcgccaagatagtcgagggtggccgctcgtcggagggcggcaaatcccccatttccctcttctcccgccactccggccgctccacctcctcctcggaagatggcagcgtcaagtccgggggcagcaagaaggcggattcaaagtgcccgaattctggcaacccttttcatgaatgtggagagcattgcaccaccaagatgaaggaactggagaagcagaagaaagccgataagaagtcgccgcgcaagaaaggtgggaaggatggcgccgtggtgcaaaattggaaggtcgatccgaggtgcccaaatgcgggcaacccattccatatatgcgcccagtactgtttcgatcatttgaacgaagcgccatcaacacctacaagcaagccagactcaagaaagggaaaggctgtcatgaaagcagagccaacggaagaaatcaatcctgattgtgtcaatgcatccaatccgtatcataaatgtggagaatattgcaaaagaaatggcaacagatagagacaaggctgtcgagatatcgtctctcgagatgaatagatgatgatggtgcaaaataagtgatgctcgcgacattagccctttttaagttgcagtaagtagtagctgtgccttgtccggctcattttgtagtttggctgcagcggccccgtcttcccggtgcctgcgtgtatatttttctacacccatactatatatatatatatatatattccttcatggtgttcataccaagattaacgaagtttgcaatatgtaggccaagtgtaaggtattgcccgaatactatagtntcatatccttttgtatanattggattaagcagttttgccaaaaggggggcccggtaccaattcncccanagggagtcctatac

SEQ ID NO: 28109 - DNA, 507 bp, Triticum aestivum
  Clone ID: PAT_TA_28109
agccgaaattttcatcatcatcatcgtggtggtatatttacaaccgatcagggagcagccagccaaatctcaggccatggttgcatgcttactaatacttgctgtaacgaacactacacccctgaggcctgagctactggtacttctaatttgggccccagcagctgaggtacatcaccgtcctcagcccctcctcggccttctccgctcgccgcctctccgccacagctgccggaagctgcttcgtgccctgcgagacgccgccgcggacgttggccttggctgcacggtggatggacctgagggcatagttccagcggcagagcccggcctggtccttgagcgcctccaccgcgccgacgctcgtcgcagccatccatgacgccttcgccggaccagccatctctcctcctcctccttgttcttgctgcgctgctggagagtggagactgacttgcgatccttgtgtatgctaaaagaacagagctgattttctgaactatctca

SEQ ID NO: 28110 - DNA, 842 bp, Triticum aestivum
  Clone ID: PAT_TA_28110
catccatccatttgtagctgcaggcagagcagagttgtgcgtgtgggagttgaaggagatcgagatggccacagcatatgctcctccgatggcgagccaggtgatgaagagcggcttggtgtgctccaagccgcggggcatgtccggcgcttcgctcaccaggaggccccgcctcgtcgtcaaggccgtcaagtctgacaagccgacgtaccaggtggtccagcccatcaacggcgacccattcatcggcagcctggagacgcccgtcacctccagccccctcgtcgcctggtacctctccaacctccccgcctaccgcaccgccgtcagcccgctcctccgcggcatcgaggtcggcctcgcccacggctacctcctcgtcggccccttcgcgctcaccggcccgctccgcaacacgccaattcacggccaggcaggcactctcggagccatcggcctcgtctccatccttagcgtctgcctcaccatgtacggtgtcgcgtccttcaacgagggcgcaccgtcaaccgcgccggcactcacgctcacaggccgcaagaaggaggccgacaagctgcagaccgctgaagggtggtcgcagttcaccggaggcttcttcttcggtggtgtctccggtgccacctgggcctacttcctcctctacgtgctcgacctcccatacttcttcaagtagattaattattggcatgcatgtacgatgggtgcagatcatgtgatctcttctcgatggtggttgcttcaaagagtccatgtataaatgaatttacacattcctcacaatctttgcatggatcgatcatactacgatactataacatgcg

SEQ ID NO: 28111 - DNA, 2972 bp, Triticum aestivum
  Clone ID: PAT_TA_28111
cgccagcttccacccccgccgcacacgttgctcccccttctcatcgcttctcaattaatatctccatcactcgggttccgcgctgcatttcggccggcgggttgagtgagatctgggccactgaccgactcactcgctcgctgcgcggggatggcgacgttcgcggtgtccggcgcgaccctcggtgtggcgcggcccgccggcgccggcggcggactgctgccgcgatccggctcggagcggaggggcggggtggacctgccgtcgctgctcctcaggaagaaggactcctctcgcgccgtcctgagccgcgcggcctctccagggaaggtcctggtgcctgacggtgagagcgacgacttggcaagtccggcgcaacctgaagaattacagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccgatacagcgaatacaggagaattcgtgctgctattgaccaacatgaaggtggattggaagcattttctcgtggttatgaaaagcttggatttacccgcagtgctgaaggtatcacttaccgagaatgggctcctggagcgcattctgcagcattagtaggtgacttcaacaattggaatccgaatgcagatactatgaccagagatgattatggtgtttgggagattttcctccctaacaatgctgatggatccccagctattcctcatggctcacgtgtaaagatacggatggatactccatctggtgtgaaggattcaatttctgcttggatcaagttctctgtgcaggctccaggtgaaataccattcaatggcatatattatgatccacctgaagaggagaagtatgtcttccaacatcctcaacctaaacgaccagagtcactgaggatttatgaatcacacattggaatgagcagcccagaaccgaagataaattcatatgctaattttagggatgaggtgctgccaagaattaaaaggcttggatacaatgcagtgcagataatggcaatccaggagcattcatactatgcgagctttgggtaccatgttactaatttttttgcaccaagtagccgttttggaactccagaggacttaaaatccctgatcgatagagcacatgagcttggtttgcttgttcttatggatattgttcatagtcattcatcaaataatacccttgacggcttgaatggtttcgatggcactgatacacattacttccacggtggtccacgtggccatcattggatgtgggattctcgtctattcaactatgggagttgggaagtattgagattcttactgtcaaacgcgagatggtggcttgaagaatataagtttgatggatttcgatttgatggggtgacctccatgatgtatactcaccatggattacaaatgacatttactgggaactatggcgagtattttggatttgctactgatgttgatgcggtagtttacttgatgctggtcaacgatctaattcatggacttcatcctgatgctgtatccattggtgaagatgtcagtggaatgcccacattttgcatccctgttccagatggtggtgttggtttggactatcgcttgcatatggctgtagcagataaatggattgaactcctcaagcaaagtgacgaatcttggaaaatgggtgatattgtgcacaccctaacaaatagaaggtggcttgagaagtgtgtaacttatgcagaaagtcatgatcaagcactagttggtgacaagactattgcattctggttgatggataaggatatgtatgatttcatggctctggataggccttcaactcctcgcattgatcgtggcatagcattacataaaatgatcaggcttgtcaccatgggtttaggtggtgaaggctatcttaacttcatgggaaatgagtttgggcatcctgaatggatagattttccaagaggtccgcaaactcttccaaccggcaaagttctccctggaaataacaatagttatgataaatgccgccgtagatttgatcttggagatgcagattttcttagatatcatggtatgcaagagttcgatcaggcaatgcagcatcttgaggaaaaatatgggtttatgacatctgagcaccagtatgtttcacggaaacatgaggaagataaggtgatcatcttcgaaagaggagatttggtatttgttttcaacttccactggagcaatagcttttttgactaccgtgttgggtgttccaggcctgggaagtacaaggtggccttagactccgacgatgcactctttggtggattcagcaggcttgatcatgatgtcgactacttcacaaccgaacatccgcatgacaacaggccgcgctctttctcggtgtacactccgagcagaactgcggtcgtgtatgcccttacagagtaagaaccagcagctgcttgttacaaggcaaagagagaactccagagagctcgtggatcgtgagcgaagcgacgggcaacggcgcgaggctgctctaagcgccatgactgggaggggatcgtgcctcttccccagatgccaggaggagcagatggataggtagcttgttggtgagcgctcgaaagaaaatggacgggcctgggtgtttgtcgtgctgcactaccctcctcctatcttgcacattcccggttgtttttgtacatataactaataattgcccgtgcgctccacgtgaacatataaatattctaataataggttatcccgtgatttacctgcctaaaaaaaaaaaa

SEQ ID NO: 28112 - DNA, 996 bp, Triticum aestivum
  Clone ID: PAT_TA_28112
aatacgaaggtaaactcttgatgaaaatatgaatgaaattgcatctgatgtcttttgatcacatggcgatcaaattatgcatcacacagtaatatttttacaataatcccgcatcgggagatttgaccccttattacaaaattgacatccagccatccagcgttcactactgctggaaaataacgagcaggtgcatgctccatggcattcacatcgatggatcagtcccacggtatatttgatatgatatatgtaccatgtatgtgtctgtagaagttgagcgatgggtggcgagattaatttacagcgtccatgtgtcgaacttgccggagacgaagtcgtagtggccgccgaccagcttgagggttccgttggccacaccctccttgacgaacgggtaggtgctcagattctggagcgacacgttgacggcctccttttccaggacaccgcactgctcctcaaaaggcatctcggagcactcatccttcaccttcttcctggccgggtacccgatcctgacccagtcctcgacgaagtggaaggtgtcatcggcgccatcctttgaggttgaggagggccttgatcccgccgcagcggctgtggccgatcaccacgatgaactcgaccttgagggcgcagacggcatactcgatggccgacccgacacccagtgtgcttgttctttgcagtagcacgggaccatggcgggcgatgttgcggacggtgaaggcctagcctggctccaggcccaaggtcactgatgggcacacacgcgagtcagcgcacgcggacaccatgtacttgggtgactggtgggccttgaggggctcgaacagattccgctctctggtcgtagacctcggtcttgaacttctcgaagccggtcttgaggcgctcaagcggacggggtccatctcgagaagggacgaagcggaggaagaggaggaggtgtggatgagagagacgaaacttgtggaggggggggaggatgtc

SEQ ID NO: 28113 - DNA, 734 bp, Triticum aestivum
  Clone ID: PAT_TA_28113
atcatctgcacaagctggcggaaaatggagcaggatcaatgctctgcccatcgaacagagcaacaggcaaagcttgcgcccaactcgaaacaacaatcttcccaaagaatttgaaacaaacagatcagtttgaaaggcaattcaaacctttctgaagaaggataatgtgaactcgaagtggggaaaggtttcatcatcatcatcgtgatacgtatttataatcggcagggaattaaccagccaagtcacacggcgtggttgttgctagaagtttctaacagatgctggagctaggagaaaacacctcttggtagctagtagtactaattgggaccccagcagctgaggtacatcacggtcctcagcccctcttcggtcttctctgctcgtcgcttctccgccaccgctgcggaagccggaagctgccttgcgccctgcgagacgccgccacggacgttggccctggccttggcagtccggtggatggaccggagcgcgtagttccagcggcagagcccggcctgatccttgagcgcctccacggcgcccacgctcatcgcaaccatccatgacgccttcgccgcacccgccatgatctctctgcaactctgttcttctcgccgcgttggaggagatgatgccgctcaatggtctgcctgaactctctgatgcttgaagcttgatagcagtggagtgtggattttgtggtggtgaagcaagccctcgtgccgaat

SEQ ID NO: 28114 - DNA, 856 bp, Triticum aestivum
  unsure (1)..(856): unsure at all n locations
  Clone ID: PAT_TA_28114
tggtggcggccgaagggcaggggcagagctattagcaatggaccccctccttatgactggggtgaagaatgggaggaggatggagactattactacaatggtagaggcagagggagaggccggctaagaggaaggggaagagcccgtggctactatggaggtggtcgacgtggtggctatggctatgattacggttatggtggcaggggcggctactatgaagagcagggtggatactttgatggcgaaccagatgagtatcacccccctccaggccgtgggcgtggcaggggaagaagaatggagcagagtgaatactacaatggcgaaccagatgagtatcgccctcctccaggccgtgggcgtggcaggggaagatggatggagcagaatgaatacttcgacgaaccttatgaatacccccctccaggccgtggtcgtggcatgggaagaaggggaggcccatggcgcgcccgaggccgcgggcgtggtccgatgctagattgaactggggcatgcaaaccgcaagccatgaagctagcactgctgcgcttaattacctaataatggtttttgcttacggtgttgctccatgtatggggctctctgacgtgaatctttatggcctctgatgctgtacgacttgccgccgggcaaattttatgtggcttacctgtggtttgtttagctaggccagccagcaaagtacctcaacacctagtagaacgtgtgaaatacctgtatgtttcagcctcccgtgtagttatctcgggttttagctctctgtggatgtgagtgccgagtaggcttgtttgcttcgaagtctgccgtgtctnctttcgcttgttggagctag

SEQ ID NO: 28115 - DNA, 637 bp, Triticum aestivum
  Clone ID: PAT_TA_28115
acttcaccgacaccaccaccctcttcatcgtggagctcatcctcatcggctgggccgagggccgccggtgggcagacatcatcaagcccggctgcstcaacaccgaccccatcttccccaacaacaagctcaccggcaccgacgtcgggtacaaggtggccttggactccgacgatgcactctttggtggattcagcaggcttgatcatgatgtcgactacttcacaaccgaacatccgcatgacaacaggccgcgctctttctcggtgtacactcctagcagaactgcggtcgtgtatgcccttacagagtaagaaccagcagcggcttgttacaaggcaaagagagaactcgagagagctcgtggattgtgagcgaagcgacgggcaacggcgcgaggctgctctaagcgccatgaccgggaggggatcgtgcctcttcccctgatgccaggaggatcagatggataaggtagcttgttggtgagcgctcgaaagaaaatggacgggcctgggtgtttgtcgtgctgcacttaaccctcctcctatcttgcacattcccggttgtttttgtacatataactaataattgcccgtgcgcttcaacatgaacatataaatattctaaaaaaaaaaaa

SEQ ID NO: 28116 - DNA, 1061 bp, Triticum aestivum
  Clone ID: PAT_TA_28116
aggaattcggcacgaggaagaaagtaatggcattgatgcggtcctataacagacaaggagctgcccataggcatggcttacgtacaggatttaaagttggccagtctgtggaaaatggtggggttgttgagtatttctttggtaatgatgggaatgaacctctacactttgataagttcacaagttttttgaaggaattgcatgaagagattattcgtctggaattcagtcattatgatgtcaagtcgacaaacaccatccctgcaaaggattttgcactgtccatggttgcttctgctgacatgaatcacattagcaagctacttgatagagctgatacgttgggcaatgacccttatctcaagaacttgcgcattacctttgaggagttcaaggcatttgctgatttacgtcgaagattggaatcattgacgatggctatatttgcttatggtcaagtaaatgggctgctgacaaagcaggatctgaagcgtgcagctcagcatgtctgtggtgttgaattaaccgacagagtggtcgacatcattttccatgtgtttgacatgaacaatgatgggcacctgagctcagaggagtttctgagagcactacaaagacgagaagccgatattcatcagccagcggcacgaggaggtcccatgggctggctgaaccctaaaaaccgctcttcgcttctgcagatgctgcgctagtagagtttttgattgtcgcaagatcttttcttctttagctttgggttaggtaccatctgaatggtatgtctgcctagtgtaggtcacataagattagttcatccagtcttgttatagtatcctgttctgtcacttgtgctcaggagtgggaggagattttgctgtaaatattatgtaggtatagcggttgatccggttgtaaatagtgtctttgttatagtctctcagtacatggtgatgtgttgtatcagtataggagggtgtaagtttcaaaccttgtccattttcgccgttccatttttattgatttatagatgcatttcataataaaaaaaaaaaaaaaaaaac

SEQ ID NO: 28117 - DNA, 862 bp, Triticum aestivum
  unsure (1)..(862): unsure at all n locations
  Clone ID: PAT_TA_28117
ccccccctttctttaacactgcctccacccagttattattattagtatcaccatccatatcatttgtattccaaatgaatgattaactgtatgcagcctcattccggcaaaattttgtatgtaaatacacaacagagcctgcagtgcgacccaaaactatatacgggacaggtcgcatgttcattattccttccattccaagtatctataatattatctcagacaaccataacgcctttttcttttctctcctcctgtcagagcgagcgcacgccgccgcggcgacccctcccgggacgaccaggagtgcgccccggggccatccatctcggtggagaaacaagagtgctttgcatgccggaacgccgtcagagtacacgcgccgaggcgggggaagagagcctcatcaatggtggtgctgcgagaacggccaccatctcctcttcttcgccgtgtgatgcaacctcggagcgtcgttctgtggaaatatcgagttgtagtgaacctccgcccaaaagctcaacaacaccactttgttggacttctgaaccttgggttggatctcgatgtagcacgtatccttgaatgaggtcatgacgaaaatcttcactccgtacttgtcagcagcagcctgtaaagtcacatggtcaccccattcaccatttcgcgatactttctccagatactcatcatatgccatggggacgtatccatcataggcttcccggttacttttaagctggctaattatctgctccctcacaaactcatggtggtccggagtttggnttttttttttttttttttttttttttttttttttttttttttttttttttttttttttttttttttttttttt

SEQ ID NO: 28118 - DNA, 969 bp, Triticum aestivum
  Clone ID: PAT_TA_28118
cgtccgaaaaaaggaaaccgagcccgcgtcctcaaccctagccgccgcctcctcctcattctcccacctcagtcgcctcccccctccccctcctcccgcatccctcttccatccgtacctgacagcggcgcgcctccacccgcttccgcctcagccccgcacaccgccggccgcagcagtggttcctgatctgagccgtcttcagtgcgtggagcgaaggaggtcggctccctccttctccacggtcgcgcggcgggagaggactcagccccggtgtggttctgctccaagatcagcgacgggggacgctcggccaccgttctcttctccgccgtggctgccgaggctggcaaggaggtgtccggcattctcgagatcgccgcccattctctcgagctcaaaggttaacttcgtgacttacaggcgctgttaaacaacatgaagtggcgaccttctcgctgtgcatgaccgatgggaccactcgtttgtagagctgccgttcagtgcgcgtcgtgcgctcgcgtccgcgtcaccaagtggggcgaactgcgccagttgctggttggctggttccttacgcgcaaggcgattggctggccgtcgtgggtggggattggggcgtcgcatggtctatgctggagttgttcacatataacaagttcactatttgtttcattggtcaattgtataatctgtgggcgtattaagttgaactatgctcctttattggtatttggagacaagatactggcagtttttacgttaccagactgtttattagttatctgtagttttgtaacactctccattgtcttttttttgcggtaaacactctccattgtcattggtagttcagattcttcaggaagaatgggtcttgtatttatattattcaattgtgcaataatcaatagataacaaaagatagatacttaagaagtttaaaaaaaaaaaaaaaaaaaaaaaaaa

SEQ ID NO: 28119 - DNA, 590 bp, Triticum aestivum
  Clone ID: PAT_TA_28119
ttttttttttttttttttgaactcatagccaaaattttcatcatcatcatcatcgtcctggtatctttacaaaccgatcaggggtcaaccagagccaagtctcagcccatggatgcttagtaatactaagttgcttgctgcaacaaacacaacactcctagctactaccactcctaatttagggccccagcagctaaggtacatgacagtcctcagcccctcctccggccttctccgctgggcgcctctcggccacggcggacactgaggcaggcagctgctttgttaccctgcgagacgccgctgcagacgttggccttggctgcacagtggatggacctgagcgtgtagttccagcggcagagcccggcctggtccttttagcgcctccacagtgcccacgctcatcgccaccatccacgacgccttcgccggaccagccatcgtctctcctcctcctccttgttcttgctgcgctgctgaagagtggagactgacttgtgatccttgtgtagtagtgggttttgcgaagttgcggtactgaaagaacagagtagattttcttaaactatctcactgaatcctcgtgc

SEQ ID NO: 28120 - DNA, 1002 bp, Triticum aestivum
  unsure (1)..(1002): unsure at all n locations
  Clone ID: PAT_TA_28120
ctcttgatgaaaatatgaatgaaattgcatctgatgtcttttgatncatggcgatcaaattatgcatcacatagtaatatttgtacaataataccgcatcggaaaatctgaccccttattacaaaattgacatccagccatccagcgttcactactgctggaaaataacgagcaggtgcatgctccatggcattcacatcgatggatcggtcccacgggtatatttgatatgatatatgtacgcatgtatggatctgtaggagatgagcgatgggtggcgagattaatttacagcgcccatgtgtcgaacttgccggagacaaagtcgtagtggccgccgaccagcttgagggttccgttggccacagcctccttgacgaacgggtaggtgctcagattctggagggacacgttgacggcctccttttccaggacaccgcactgctcctcaaaaggcatctcggagcactcatccttcaccttcttcctggccgggtacccgatcctgacccagtcctccacgaagtggaaggtgtcatcggcgccgtccttgaggttgaggagggccttgatcccaccgcagcggctgtgtccgatcaccacgatgaactcgaccttgagggcgcagacggcatactcgatggccgacccgacacctgtgtgcttgttcttgcagtaggatgggaccatggcggcgatgttgcggacggtgaaggcctcgccgggctccaggcccaaggtcactgaggggcacacacgcgagtcggcgcacgcgaacaccatgtacttgggtgactggtgggccttgaggggctcgaacagatccggcttctggtcgtagacctcggtcttgaacttctcgaagccggtcttgaggcgctcaacggcggggtccatctcgagcagggagggtgggggaggaggtgaggaagagagagatggaacttgcttgctggagggtgggggaggatgttgggtgggcttctcccggacccggccggc

SEQ ID NO: 28121 - DNA, 701 bp, Triticum aestivum
  unsure (1)..(701): unsure at all n locations
  Clone ID: PAT_TA_28121
gacaattcttcttcctgtaacacatccatccatttctagctgcaggcagagcagagttgagcgtgtgggagtcgaaggagatcgagatggcaactgcatatgctcctccgatggcgagccaggtgatgaagagcggcttggtgagctccaagccgcgggggctgtccggcgcctcactcaccaggaggccccgcttcgtcgtcaaggccgtcaagtctgacaaggggacgtaccaggtgggtccagcccatcaacggcgacccgttcatcggcagcctgggagacgcccgtcacctccagccccctcgtcgcgtgggtacctctccaacctccccgcgtaccgcaccgccgtcagcccgctcctccgcggcatcgaggtcggcctcgcccacggctatctcctcgtcggccccttcgcgctcaccggcccgctccggcaacacgccaattcacgggcaagcgggaacctcggcgccatcggcctcgtctccatcctcagcgtctgcctcacatgtacggcgtcgcctcctcaacgagggcgcggccctccaacgcgcccgcgctcaagctaacggccgcaagaaggaggcgacaactgcaaatgcggaggtgtccaattnacggaggttctcttcgngttcccggcgcattgggctattctccccnactgtgactccanatctcaatnatatatgttggaa

SEQ ID NO: 28122 - DNA, 534 bp, Triticum aestivum
  Clone ID: PAT_TA_28122
gaatttttcatcatcatcgtcgtggtatattacaatcgcagagcaaccagctgatttccaggccctggttactgcagcaaacacaaactcacacgcctagctagtaatcgcggatactaattggttccccagcagctgaggtacatgacggtcctcagcccctcctcggccttctccgctcgccgcctctcggccaccggccgccgtggatgcaggaagctgcttcgtgcccagcgagacggtgccgcggacgttggccctggccttggctgcccggtggatggacctgagcgcgtagttccagcggcagaggccggcctggtccttgagcgcctccacggcgcccacgctcatcgccaccatccatgacgccttcgccgcacccgccatgatcgacctctctctctgcgttggtgaagatggtactgctgactgatccgtctagaactctgtggtgcctgaagattgatggctagcagggtgtggaccttgtgctatttatgaatgaactgaactgttggatgattgatgctt

SEQ ID NO: 28123 - DNA, 1266 bp, Triticum aestivum
  Clone ID: PAT_TA_28123
ttttttttttttgcaccaaattccactagtgagcaacgataagcaaaatccatgtataaatgttgatgaaaacaggtagcaaaagcgcaattaacagtattcagcatcagtgctcaacgaaaagcaaaccaatctgtaagaccacgggtagcctacaactgatcgtcaatatctaataacagactcaaaactcatccatccatccaacgtgcctcccccaaacaggaggagccaaacattcttccacttcattgctggcgctgtacaggtaatctcatcccacctgggaggagactcgctcagtccgcgccagcgccagcctttgtgaagtctacgtctcccatgccattgtcctcctcctcgctgtcgttgtcgccgtccacctcctcgcctgctagcttcagcttctcaatcgtgtccgcaaacagcttgtcgtctctctcgctcacagctctagcggcttccttcaccaccaatttccccttgtgcttttcaattgcctcggcacaaattttggttgcatttgtcagaactgctatcccctggtctttgtcaagtgtctgtgtggtcagaacataaagcggaggagcaactagcttaatcttcacagggcaatcagcatttccagcagcttcagctttcctcatggcttccttaatgtggagaacaccgtcaaactggaagcatttcatctcaacatcagcacgaatcttgagaggctgtggtgtcattctcctccttatgttcctgaccagtgcatccttaacctcaggggtgacagccggcacaactttagtaacctcctcgcccatcggggccgacgacggtctcctcgtaggtgaggacgtcgagccacggcgtcggggtcggtgacgatgagcttaaaggcctcgaaggcgtggccgtacctgcggtagagcggccagccgatgcgctggtagaggggctcgaggtcgacgccgagggtgtcggcggcgtggcgcatgatggagtggacgagcttggacttgttgtagcggtcctcgcaggtggcggcctcctcctcggagacgcggcgcttggagaggtcgatgtagcccttgtcgcggtcgacgcggagcaccatggagggttcctgccggccgaccttgatgagggaggagatggagcgaatgcggcggcgggagagctcggaaaagaggatcatgccctcgatgttgtggtactcgaggagggctctctctctctctctctctctctctctctctctctctctctctctctctc

SEQ ID NO: 28124 - DNA, 800 bp, Triticum aestivum
  Clone ID: PAT_TA_28124
gaggtgtacggctcctttgaggcgtcttcctccaagaaaaaggctttgtcctccccaggcccaagatgaccaatgctgaccttggtcgcctcatcaactctgatgaggtccagtctgtggtcaagcccatcaacaaggaggtgaagcgcagggaggccaggaagaaccctctcaagaatgctgctgccgtgctcaagctcaacccctacttcgggactgcccgcaggatggcagttcttgctgaggcagcccgtgtcaaggccaggaaggacaagatcaactccaagaggaccaagctcagcgtggaggaggcatctaagatcaaggctgctgggaaggcttggtaccagaccatgatctctgacagcgactacatggagttcgacgtcttctccaagtggctcggcgtcagccagtgatcatctcgttgaattaatacatcttgctgttccgagttataagcaagtatctttccctattacgacaacgcttcttgtcaaaagaactcattggttcaacagctgtacttttgactgaagaagtatttctgccctatatatatattcagcggatggatttattgttgaagcaactgaatgggccgtagactggagaaagttttgcactaaagtggatgcttggaggcaacctgcaaacatttgttttactaagttataatggttcgcattatataatcttaggaaaacaatatacattatatgtttattagagacctgtttctctcctgataatcgttgggaaacagcttcacatgtaatatatcaaaaggattttgtgct

SEQ ID NO: 28125 - DNA, 602 bp, Triticum aestivum
  unsure (1)..(602): unsure at all n locations
  Clone ID: PAT_TA_28125
ccatttctagctgcaggcagagcagagttgagcgtgtgggagtcgaaggagatcgagatggctactgcatatgctcctccgatggcaagccaggtgatgaagagcggcttggtgtgctccaagccgaggggactgtccggcgcttcactcaccaggaggccccgcttcgtcgtcaaggccgtcaagtccgacaaggggacgtaccaggtgggtccagcccatcaacggcgacccattcatccggcagcctgggagacgcccgtcacgtccaaccccctccgtcgcgtgggtacctctccaaccttccccgcgtaccgcaccgccgtcaagcccgctcctcccgtggcatccgaggtcggcctcgcccacggctacctcctcgtcgggcccttcgcgctcaacggtccgctcccgcaacacgccaattcacggcaagcgggaacctccggcgcatcgggctcgtctcatcctcagcgtctgcctcacatgtacggctccctccttcaacgagggcgcgcctcaacgcgccgcctcangctcacgggcgaaaaaggagcgacaactcagacgccgaaggtggtccanttacggaggttctctcg

SEQ ID NO: 28126 - DNA, 1354 bp, Triticum aestivum
  Clone ID: PAT_TA_28126
tttttttttttttttttttttttttttaaaatgttgatgaaaacaggtaccaaaaagcgcaattaacagtattcagcatcagtgctcagagaaaagcaaatcaatctgtaaaactacgggtagcctacaactgatcaatatcagtaacagagtaaaaaaaactcatccatccatccaacgtgcctcctcaaagaggagccaaacattcttccccttcatttcgttgctggcgctgtacaagtgacctcatcccacttgggaggagactcgctcagtccgtgccagcgccagcctttgtgaagtccacgtcccccatgccattgtcctcctcctcgctgtcgtcgtcgccgtcgacctcctcgcctgctagcttcagcttctcaatcgtgtccgcaaacagcttgtcgtctctctcgctcacagctctggctgcttccttcaccaccaatttccccttgtgcttttcaattgcctctgcacaaactttggttgcatttgtcagaactgctatcccctggtctttgtcaagtgtctgtgtggtcagaacataaagcggaggagcaactagcttaatcttcacagggcaatcagcatttccagcagcttcagctttcctcatggcttccttaatgtggagaacaccatcaaactggaagcatttcatctcaacatcagcacgaatcttgagtggctgtggtgtcattctcctccttatgttcttgaccagggcatccttaacctcaggggtgacagccggcacagtgttagtcacctccacaccatcgggaccgacgacggtctcctcgtaggtgaggacgtcgagcacggcgtcggggtcggtgacgatgagcttgaaggcctcgaaggcgtggccgtacctgcggtagaggggccagccgatgcgctggtagaggggctcgaggtcgacgccgagggtgtcggcggcgtggcgcatgatggagtggacgagcttggacttgttgtagcggtcctcgcaggtggcggcctcctcctcggagacgcggcgcttggagaggtcgatgtagcccttgtcgcggtcgacgcggagcaccatggagggctcctggcggccgaccttgatgagggaggagatggagcggatgcggcggcgggagagctcggagaagaggatcatgccctcgatgttgttgtactcgaggagggagacgtaggcgcccatgtcggcgatgtgcttcacctggatcatcaccgccgcgtccacctccgggaaccgcggctcgtacatccggcactcgaggttcggcggctcttcgcgggcggcggcggcggccggaggcggtggggggacggggtggggtggggaggggagcta

SEQ ID NO: 28127 - DNA, 1351 bp, Triticum aestivum
  Clone ID: PAT_TA_28127
ttttttttttttggaaagaaaaacacctgttgataacattttgcatgccaagactaagcatcaaaaacacttgtttaacaacaaaactatatttcactccaaagagagagaaaaaaaaacaggtgcttctcaatcaaagtaaagcccagcactggccgatgaacatctaagatgacactaccagcaaattcaaagagcttttaaataggatgatctaggatcttggctgatgctatacaacgaatctcatccaaatcgactaatgtagattcagtccgcatggacgccagaatttgtgagatcgatatcgcccattcctgtatcttcctcatcttcactgtcatcatcaccagcaacctccgcattttgctcaaccagggtatccaactgggcgttcaatagcttatcttccctctcactcacagctctaggtgcttctttcactaccaactttcccttgtgtttttcaatctctgctgtgcatgctttaactgcatcagtgagaactgagatgccttggtccttgtcgagagtttgtgtagtcagaacataaagtggaggagcaaccagcttaatcttcacaggacaattagtgttcccagcagcttcagctttcctcatggcttgcttaatatggagcaccccatcaaattggaaacatttcatctcgacgtcagcacggatcttgagtggctgcggtgtcatcctcctccgtatattctggaccagggtctccttaatctcaggggtgacagcaggcaccaccttagtcacctcttgtccgtcagggccggtctccctctcctcgtaggtgagcacatcgaggatggcgtcggggtcagcaactatgagcttgaaggcctcgaatgcgtggccgtacttgcggtatagcggccagccgatgcgctggtagatgcgctcgaggtcgatctcgagggtctcggcaacgtggcgcatgatggagtgcacgagcttggacttgttgtacttgtcctcgcaggaccgcgcctcctcctcggagacccggcgcttggagaggtcgatgtatcccttgtcgcggtcgacacggagcacgatggcgggctcctggcggccgaccttgatgagcgaggagatggagcggatgcggcggcgggagagctcggagaagaggatcatgccctccacgttgttgtactcgaggagggagacgtaggcgcccatgtcggcgatgtgcttgacctggatcatcaccgcggcgtccacctccgggaaccgcggctcgtacatccggcactcgaggttcggcatcttctccgtctgccgggtggagggcgtcgccggagttggagggggccgcggcggatctagg

SEQ ID NO: 28128 - DNA, 1055 bp, Triticum aestivum
  Clone ID: PAT_TA_28128
cagcaacaacagccaccatattcgcagcaacaacaaccaccattttcgcagcaacagcaaccaccattttcgcagcaacaacaaccaccattttcgcagcaacaacaacaaccaccatttacacagcaacaacaaccatcgttttcacaacagccaccaatttcacagcagcagcagcagcaacaacaacaacaacaaccatttacacagcaacaacaaccaccattttcacaacagccaccaatttcacagcagcaacaaccaccattttcgcagcaacaacaaccaccattttcacagcaacaacaaataccagttattcatccatctgttttgcagcaagttaaaccaatgcaaggaactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgtcttccccaccccc

SEQ ID NO: 28129 - DNA, 1751 bp, Triticum aestivum
  Clone ID: PAT_TA_28129
gaattcggcacgagccaagatcggcatcctcaacacaccgtcgtggtacaccgccggggagcaggagtacttcaccgacaccaccaccctcttcatcgtggggctcatcctcatcggctgggccgagggccgccggtgggcagacatcatcaagcccggctgcgtcaacaccgaccccggccacgccaccatcttccgggcctttgcccccaagtaaggaacacggtgggagttagcaactaatccgaggagtgtgctaccacggggaagaagatcgctggtggaacttgatttttttctttcctgggaagtagaccgtggatgatggtatgtaattgtggagcaatgcatgcttgttggatgtgtacttgtaccctggtgttgtagccgatgtaaaaaatgaatacccttttgaacattattatgttggcattgtctaaaaaaaaaaaaaaaaaaactcgagactagctcgtgccgaattcggcacgagggatctcatccagtttccctcaacagtgagaacctgcaacttctgagacaaagatattattatgctacgtggaaagctgatggaacacgatacatgatgcttataatgcgggatggctgtttcttaatagaccgaaacttctgctttagaagagttcagatgcgttttcctattaggaatgttaacgatggtttccacaactttacattgatcgatggagaaatggttgtagacgccataccaggtggtggattgaagcggaggtacttagcgtatgatctaatggcaattaatttctcctccaaagtcaagttgcccttttctgacaggtggaagctacttgaggatgaaataattcgtccacgcatctatgagagaaagcagtttgaaactggtctgaaaggcaatccatcatacagatatgacctggaacttttttcggtaaggagaaaggatttttggctgctttccacggtgaagaaattactcaaggagtttattccagcactttcacatgaatctgatgggcttatatttcagggctgggatgatccatacgtgaatcgtacacacgaaggtctgctaaaatggaagtacccagagatgaattcagttgactttttgtttgagactggtagtgaaaaccgccagcttatttttctgtacgagagaggcaaaaagaaacttatggatggtacccgggtggtatttcctgatgatgtagatccatcttcaatatcagggaaaattgttgagtgctcttggaataaacaggaggactgctggttctgcatgcgaatccgagcagataaatcaactcctaatgatatcaatacttacagaaaggtgatgaggagcatcacggataacattactgaagacaagctcctgggcgagatgaatgagatcagtagccttccaatgtacgccgacaggaaggcccatgctgacaggaaggcccatgccgagaagatggctcaccagcacagaaggaggggataaggcgaataatcttggcttctgaactagaatcaacaatgccggctggccactgtagcctgtgtatttagcaataatcaatttttgacttcaattaaacaatagcggtcactacacaagtttttcaatgctttgtcatattggccattgtacatgcatcgttccagagtcctgtatatctcttattgtgtgtcatcaatgcttgatatcattatcatttggtctatacttctgaatgcatggctttattggcccttttttc

SEQ ID NO: 28130 - DNA, 2853 bp, Triticum aestivum
  Clone ID: PAT_TA_28130
gtgagatctgggcgactggctgactcaatcactacgcggggatggcgacgtttcgcggtgtccggcgcgactctcggtgtggcgcgggccggcgtcggagtggcgcgggccggctcggagcggaggggcggggcggacttgccgtcgctgctcctcaggaagaaggactcctctcgcgccgtcctgagccgcgcggcctctccagggaaggtcctggtgcctgacggcgagagcgacgacttggcaagtccggcgcaacctgaagaattacagatacctgaagatatccaggagcaaacggcggaagtgaacatgacaggggggactgcagaaaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccgataccgcgaatacaagagaattcgtgctgctattgaccaacatgaaggtggattggaagcattttctcgtggttatgaaaagcttggatttacccgcagtgctgaaggtatcacttaccgagaatgggctcctggagcgcattctgcagcattagtaggtgacttcaacaattggaatccaaatgcagatgctatgaccagagatgattatggtgtttgggagattttcctccctaacaacgctgatggatcctcagctattcctcatggctcacgtgtaaagatacggatggatactccatccggtgtgaaggattcaatttctgcttggatcaagttctctgtgcaggctccaggtgaaatacctttcaatggcatatattatgatccacctgaagaggagaagtatgtcttccaacatcctcaacctaaacgaccagagtcactaaggatttatgaatcacacattggaatgagcagcccggaaccgaagataaattcatatgctaattttagggatgaggtgttgccaagaattaaaaggcttggatacaatgcagtgcagataatggcaatccaggagcattcatactatgcaagctttgggtaccatgttactaatttttttgcaccaagtagccgttttggaactccagaggacttaaaatccttgatcgatagagcacatgagcttggtttgcttgttcttatggatattgttcatagtcattcgtcaaataatacccttgacggtttgaatggtttcgatggcactgatacacattacttccacggtggtccacgcggccatcattggatgtgggattctcgtctattcaactatgggagttgggaagtattgagattcttactgtcaaacgcgagatggtggcttgaagaatataattttgatggatttcgatttgatggggtgacctccatgatgtatactcaccatggattacaaatgacatttactgggaactatggcgaatattttggatttgctactgatgttgatgcggtagtttacttgatgctggtcaacgatctaattcatggactttatcctgatgctgtatccattggtgaagatgtcagtggaatgcctacattttgcatccctgttccagatggtggtgttggttttgactaccgcctgcatatggctgtagcagataaatggattgaactcctcaagcaaagtgacgaatcttggaaaatgggcgatattgtgcacaccctaacaaataaaaggtggcttgagaagtgtgtaacttatgcagaaagtcatgatcaagcactagttggtgacaagactattgcattctggttgatggataaggatatgtatgatttcatggctctggataggccttcaactcctcgcattgatcgtggcatagcattacataaaatgatcaggcttgtcaccatgggtttaggtggtgaaagctatcttaacttcatgggaaatgagtttgggcatcctgaatggatagattttccaagaggcccacaaactcttccaaccggcaaagttctccctggaaataacaataattatgataaatgccgccgtagatttgatcttggagatgcagaatttcttagatatcgtggtatgcaagagttcgatcaggcaatgcagcatcttgaggaaaaatatgggtttatgacatctgagcaccagtatgtttcacggaaacatgaggaagataaggtgatcatcttcgaaagaggagatttggtatttgttttcaacttccactggagcaatagcttttttgactaccgtgttgggtgttccaagcctgggaagtacaaggtggccttggactccgacgatgcactctttggtggattcagcaggcttgatcatgatgtcgactacttcacaaccgaacatccgcatgacaacaggccgcgctctttctcggtgtacactccgagcagaactgcggtcgtgtatgcccttacagagtaagaaccagcagcggcttgttacaaggcaaagagagaactccagagagctcgtggatcgtgagcgaagcgacgggcaacggcgcgaggctgctccaagcgccatgactgggaggggatcgtgcctcttccccagatgccaggaggagcagatggataggtagcttgttggtgagcgctcgaaagaaaatggacgggcctgggtgtttgttgtgctgcactgaaccctcctcctatcttgcacattcccggttgtttttgtacatataactaataattgcccgtgcgcttcaacatgaacatataaatattctaataggttatcccgtgaaaaaaaaaaaaaaaaaaaaaaaaa

SEQ ID NO: 28131 - DNA, 1296 bp, Triticum aestivum
  Clone ID: PAT_TA_28131
gagggaggacccctcctcactctctccgcaggcagagcggagcagcgagcccgaagcaatggatagataccaaagggtggagaagcctcggaatgagacacccattcgtgagaatgagatcaggatcactgcgctcgggaggatgaggaactatatcggctacgggatgtcgttgcttgaggaaaatgggcatgatgagatcactatcaaagccatgggacgagccataaataagacggtcatggttgctgaattgatcaagagaagggttgctggtctccatcagaatacgtctattgaatctgttggcatcactgacacatgggagcctctggaagaaggccttgtcccgctagagacaactcgtcatgtatcaatgattaccctaacattgtccaaggaaccattggatacgtcatctccagggtaccagccacccataccagctgaagaggtgaaacctgcttttgattatgaacatgaaggatcctttccctctgctcgtgggagaggtcgtggtggacctggtggcggccgaaggggcaggggcagagctattagcaatggaccccctccttatgactggggtgaagaatgggaggaggatggagactattactacaatggtagaggcagagggagaggccggctaagaggaaggggaagagcccgtggctaccacggaggtggtcgacgtggtggctatggctatgattacggttatggtggcaggggtggctactatgaagagcggggtggatactttgatggcgaagcagatgagtatcaaccccctccaggccgtgggcgtggcaggggaagaagaatggagcagagtgagtactacaatggcgaaccagatgagtatcgccctcctccaggccgtgggcgtggcaggggaagatggatggagcagaatgaatacttcgatggagaaccttatgaatacccccctccaggccgtggtcgtggcatgggaagaaggggaggcccatggcgcgcccgaggccgcgggcgtggtccgatgctcgattgaactgggacatgccaagtgcaagccatgaagcttacctgatagtttttgcttacggtgttgctccatgtgttgggctctctgacgtgaatctttatggctttatggcctctgatgctgtacgacttgccgccgggcaaattttgtgtggcttacctgtggtttgtttagctaggccagccagcaaagtacctcgacacctagtagaacgtgtgaaatatgtttcagcctcccgtttagttatctcgggtcttacctctctg

SEQ ID NO: 28132 - DNA, 559 bp, Triticum aestivum
  Clone ID: PAT_TA_28132
tttttttttttttttttggtataaacttgaaattttcatcatcatcctggggacacgtatgtacaaatcagatgcaaccagccagatcccaggccatggttgcttgctgcaacaaacacaccgctagcagctagctagtactactagtttggtccccagcagctgaggtacattaccgtcctcagcccctcctcggccttctccgctcgccgcctctccggcacggccgccgccgaggccggaagctgcttcttgccctgcgagacgccggcgtggatgttggatttggccttggctgcccggtggatggaccgcagagcgtagttccaccggcagagtcccgcctggtccttgagcgcctccaccgcgcccacgctcatggccaccatccaagacgccttcgctgcaccggccatcgcctcttgctggtctggtggaaagtggtcgaactgaggctgatttgtgattgattgcttgtgtgtagtactggactttcagtggtgaaacaactgaactgatggggggatggttcttcctggtgctttgcttgtggagattt

SEQ ID NO: 28133 - DNA, 988 bp, Triticum aestivum
  unsure (1)..(988): unsure at all n locations
  Clone ID: PAT_TA_28133
ttttactagaaaaatagtgagcccattgattagatcgcagaaaatggagacaatgcaggtcacagagtagcacagtacaggtcccagtacgacgagttactacatcaaagttcagacttcagaatcatggtccctctcctcactctctccaacactctcttcttcctcgcagaaacgccggctcaatcattcaatcacaaggcgacacacgacggacgcacacagacaccattgccacacatcgcacacggttttatttggacacagcaacattattcgctaccagcggcagaggactactacgacgacgatggacggacggacgacgactcggggcgggggggcttgtccccggactaatccatggcgatgtgtcgatggcaatgcgaaagctctcctggcatctcatctaccaggggaggatcttccagcgctggttgtcgccctcgcaccacttccagagcacgacctcggtgccgtcgtggacgccgccgtgggccttgtcgccgtggaaggcgtcgaagttgaggtagatgttgttcaccatgcggacgcagcggaagcccttgcccacgtccttgctctccgtccacagcaccgactcgtcctngtacgccgggttgaacggcaccagcttcacggggtgggactggccgatggagtgcttgacggcgaggccggtggccttgttgacgagcgcgaaggccggcatgccctcctcgtccttgacggtggtgctgaagcgcatgtccttgagccagtgctgggtctcgtccttggggttgacgggggcgagcaccacctcgccgtcgcggacggcgaggcagtagtcctccgaggcccggcagtagatcttgaagatctggttggggcccgacgccgccggcgcctggtccttgtggtggtgcccgaacccgaacatcttggcggcgaggagagcgtgtgtatcggactctgtggttggacctcggcctcgaaccgaattcct

SEQ ID NO: 28134 - DNA, 959 bp, Triticum aestivum
  Clone ID: PAT_TA_28134
acatcttcaccaagccattgcctttgccacagtttgagacttgcaggcgcaatcttacccttctagattcattaaaaagtggctaagattgagggagggtgttagactgtatttacatgtgtatattgtaacgttgtataccacctcattatatatatatgtgataggccacccctagagggttgtgccggttccccccaaagcctattgtcttacactgggcatgcgtatttcattgtttttacgtatcacgaaggtcctttattgttacgtaacttgtcattacacacacaagcacaacagctccgttattctgcggggtaggtagcgagagacgcatgcatgttgtctatccgggacggtccacatgacatcgtttcttcagtagatacgtacgtacgcatgtgtggatatctcgatctccccgcgtacgtgcacgagccatgcatggcgcgcgctggctggctggctcagtagtacggctggagcttccagcgctggttgtcgccctcgcaccacttccagagcacgacctcggtgccgtcgcgcacgccgccgtggtccttgtcgccgttgagggcgtcgaagttgaggtagatgttgttcaccatgcgcacgcacctgaacccgttgcccacgtccctgctctccgtccacagcaccgactcgtccaggtagtctgggttgtacggcaccagacgcacagggtgtgactggccgagggagtgcttgatggcctgcccggtcgccttgttcaccagggcgaacgcagggtagccctcctcgtccttgatcttggtgctgtacctcatgtccttcacccaatgctggaactcgtctctggggttggttggcgcgaggcacacggtgccgttcctcacggtcaggctgtagtcctcgccggccgcgcacagaacgcgcacggggactcggacgccagcgcacggtgcaggttgccg

SEQ ID NO: 28135 - DNA, 858 bp, Triticum aestivum
  Clone ID: PAT_TA_28135
aaaagattttgagtactttgcgtctgtgcgaaaaccggatggggaaatgttcatgttgcctgccgacttgatgagagcggtggtccctgttttccctccatcggagtcgaacgtcgtgcgggaagggaggctaaggggggaacccagccccggagagctgcactgcgcgccatccaaattctttgtcctgttcgacacatacaccgatggtctcatctcatttgccgagtacatcttctttgttacattactcagcattcctgagtcaagcttcagtgcggccttcaaaatgttcgacgttgatctcagtggacgtgttttgtttactgaagctgctaaaggtatgttatccccttttgttctctttgattgatttatgcataaacaagatacatttgaataatatatcttgtttgtgctatattgttgtttacctgtgatcattcgcgtgcagttaatttctcttgtccagaaaaaaagacctgctctttatgagcatgttcaatcatctggcttgttagttgatggtaaaacaagggtaatgaacaaattttggcaatcttcttctcggttgttttgttgttcttatctgtcgattctcatcatttccagggagatagacaaagaagagttcaagaaagtaatggcattgatgcggtcctataacagacaaggagctgcccataggcatggcttacgtaccacgccccgccgtcgtacccgatgtggaactccgtcaccacggcgtcctgcaccttcacgcgccccgtccacgagcacacgtcgtacctcggccgtcaagtcctagatgcctaaaccgagatgcgcctttggttatggagcccaagtcacgtacct

SEQ ID NO: 28136 - DNA, 1150 bp, Triticum aestivum
  Clone ID: PAT_TA_28136
gcatatggctgtagcagataaatggatcgaactgctcaagcaaagtgacgaatgtgtggaaaatgggcgatattgtgcacacccttacaaatagaaggtggcttgagaagtgcgtcacttatgcagaaagtcatgatcaagcactagttggtgacaagactattgcattctggttgatggataaggatatgtatgatttcatggctctggatagaccttcaactcctcgcattgatcgtggcatagcattacataaaatgatcaggcttgtcaccatgggtttaggtggcgaaggctatcttaacttcatgggaaatgagtttgggcatcctgaatggatagattttccaagaggtccgcaaactcttccaaccggcaaagttctccctggaaataacaatagttatgataaatgccgccgtagatttgatcttggagatgcagattttcttagatatcgtggtatgcaagagttcgaccaggcaatgcagcatcttgaggaaaatatgggtttatgacatctgagcaccagtatgtttcacggaaacatgaggaagataaggtgatcatcttcgaaagaggagatttggtatctgttttcaacttccactggagcaatagcttttttgactaccgtgttgggtgttccaagcctgggaagtacaaggtggccttagactccgacgatgcactcttgggtggattcagcaggcttgatcatgatgtcgactacttcacaaccgaacatccgcatgacaataggccgcgctctttcttggtgtacactcctagcagaactgcggtcgtgtatgcccttacagagtaagaaccagcagcggcttgttacaaggcaaagagagaactccagggagctcgtggattgtgagcgaagcgacgggcaactgcgtgaggctgctctaagcgccatgactgggaggggatcgtgcctcttcccctgatgccaggaggatcagatggataggtagcttgttggtgagcgctcgaaagaaaatggacgggcctgggtgtttgtcgtgctgcacttaaccctcctcctatgttgcacattcccgggtgtttttgtacatataactaataattgcccgtgcgcttcaacatgaacatataaatattctatataaaaaaaaaa

SEQ ID NO: 28137 - DNA, 1049 bp, Triticum aestivum
  Clone ID: PAT_TA_28137
gttcccgctcgtcgtctccgactcggccgagggcatcgagaagaccgcccaggccatcaaggtcctcaagcagctgggcgcctacgccgacgccgagaaggccaagctgtccgtgggcatccgccccggcaagggtaagatgcgcaaccgcaggtacatcaaccgcaagggccccctcatcgtctacggcaccgagggctccaagatcgtcaaggccttccgcaacctccctggtgtggatgttgccaacgtcgagcgcctcaacttgctcgaccttgcccctggtggccaccttggccggtttgtgatctggaccgagtctgccttcaagaagctggacgaggtgtacggctcctttgaggcgtcttcctccaagaagaagggcttcgttctccccaggcccaagatgaccaatgctgaccttggccgcctcatcaactctgatgaggtccagtctgtggtgaagcccatcaacaaggaggtcaagcgcagggaggccaggaagaaccctctgaagaacgctgctgccgtcctcaagctgaacccctattttggaactgcccgcaggatggcagttcttgctgaggcagcccgtgttaaggccaggaaggagaagatcaactccaagaggaccaagctcagcgcggaggaggcatctaagatcaaggctgctgggaaggcctggtaccagaccatgatctctgacagcgactacactgagttcgacgtcttctccaagtggctcggcgtcagccagtgatcatctagttgtagtagcagtctatcgtcctaccttaagagaccctaaagtatgattttgtgtcatgttatcgtttatctggagtctgagacatcttgctgttttggtagctgtttatcttgtgtgttctatctatggacgcattttgcgagacatgttatattgcatgctttatcgtcgtcgagttcttagttcagattttgagtcgtgtttttcatatatactctattatgaatgcgaaataatttttggcattgtgaagttttgtggttggcatacccgcagtttc

SEQ ID NO: 28138 - DNA, 625 bp, Triticum aestivum
  Clone ID: PAT_TA_28138
aatcccaaagtagtagatttgaaaatatttctattgcacataatatcatgtatcaagcaccaaccaccaaggaactgcttgctattgaaatcatgtatcttgtaccagggaacttttttgtccaccacatgagtttgtcgaaataaatacgacaaaactgtcctcttgctaaggtagttaacaacacaggagtacatggtgaaacgagtgaactcagatgagcttcttcttctggaagaagccttgcaaatgccataactgcagagcggagaccacaacgcacacgcccagagacaagatgctgaaccacgcaaccctagaatttgttttctcactcacttcccgcatctccacttcccttgctttgagatataataagttatgatgaatggattccactgcagcttcaagtttcgcgagctctaattcaacaccctcaattttctccttcttggcaacagagtcccagtcctttgtcgcaatccctatcttccaatcaagattcagagatactcctgatcctttctctgcgctgtctagccagaagcaagcaaggtagtttccagcttctgaagttgtaaatgcaaattggcccactgtggcattttctttctgatgtacagta

SEQ ID NO: 28139 - DNA, 1172 bp, Triticum aestivum
  Clone ID: PAT_TA_28139
gagcagcgagcccgaagccatggatagataccaaagggtggagaagcctcggaatgagacaccgattcgtgagaacgagatcaggatcactgcgctcgggaggatgaggaactatatcggctacgggatgtcgttgcttgaggaaaatgggcatgatgagatcactatcaaagccatgggacgtgccataaataagacggtcatggttgctgaattgatcaagagaagggttgctggtctccatcagaatacgtctattgaatctgttggcatcactgacacatgggagcctctggaagaaggccttgtccccgctagagacaactcgtcatgtatcaatgattaccctaacattgtccaaggaaccattggatacatcatctccagggtaccagccacccataccagctgaagaggtgaaaacctgcttttgattatgaacatgaagaatgggaggaggatggagactattactacaatggtagaggcagagggagaggccggctaagaggaaggggaagagcccgtggctaccacggaggtggtcgacgtggtggctatggctatgattacggttatggtggccggggtggctactatgaagagcggggtggatactttgatggcgaagcagatgagtatcaaccccctccaggccgtgggcgtggcaggggaagaagaatggagcagagtgagtactacaatggcgaaccagatgagtatcgccctcctccaggccgtgggcgtggcaggggaagatggatggagcagaatgaatacttcgacgaaccttatgaataccctcctccaggccgtggtcgtggcatgggaagaaggggagggccatggcgcgcccgaggccgcgggcgtggcccgatgctagattgaactgggacatgccaagtgcagcaaaccatgaagctagcactgctgtgcttaattacctgatggtttttgcttaccctgttgctccatgtggggctctctgacgtgaatctttatgcggtctgatgctgtacgacttgccgccgggcaaattttgtgtggcttacctgtggtttgtttagctaggccagccagcaaagtacctcaacacctagtagaacgtgtgaaatatgtttcggcctcccgtttagttatctcgggttttacctctctgtggatgtgaatgc

SEQ ID NO: 28140 - DNA, 1579 bp, Triticum aestivum
  Clone ID: PAT_TA_28140
ttttttttttgatcctcttgcttccataatatttaataatttattcttatgcaagtcttggtaaatgaataagaatcaggtagcatgtcatacaaggtacgtacatgtgtactactagagcttttcagctggaaaaacatatctataccggcacggtttatacaaactctcaacgaacagactgagcgattttacccatcatcataacttaacatctccagcgcctgaagcgctctgcatatccgtcgatcccctccatcatcatcatcatcagcagcagcagcagcaacgttacgtacatacagggctaaccatctggattttcacttcatgatcgggggagaggcataggggccattcagccagccgttggcgaccatgcggtaggcggcctcggtcatgtggatgccgtcccagctcacgtacgccgacgggttggagcacacgctcgcgcccgcctcgccgcacttcttcttcaggttgaagttgtaggcgcccgaccctccggcgccgcagcatgcctgcactgccgtgctgaaaccgaatttcccggggctgacgacaaactgcattgcagctttgaagtaatcgccgtacatgattttcgtctttgggtacttcttctgaagctggtcaagctgctgcttgagctctctgttgtggtggaaggccaggcggttgtatctccggaggcacccggtgcgcgcgttgtagtccgacttcttgctgctgttgtagagagtcaggtacaatgggaagcacccgatcggaagaattccaggcaccaacaggtctgtcgcgccaagctcgatcaatttctcgacgccgttggcgatggctttggcgaccagcggcacgtaggtcttcacatcggagaaggcgacgccggagaagagaggagcgttgtagtcgttccccccaaactctcccaccacaaacagggacttgctgaagtagtccttgcactctttctccgacttgcaaagcgacggcttcatcttctggagccagccgatctgggtgttgatggagccggtgttccaaatgcgctggtcgatgccatgcgccttaagaaggagtactccagcgccgtggcgccggtgatggcgaagttggcccccttcttgaagcccttgccatgcgcctgggacgctggcggcaggggcagcccgaaatgctcggcgaggaagtcgacgacgacgcggccgttggagcagcggccggtggggcggccgaagaaggtcatgccgtagggcgcgcgcgcggtggtgagggacttggggatgccgtcgacgatgaggttgccggcgtcggagagcgagtccccgaagctgaagacggcctggtacgacttcttggcgtgcctggcgtcggcgccgcccgcgaggcacagcgcggcgacgaggacgagaagcaggccccgatgctccattgctgccgctgctgctctggctgctgtgggtgcgggtgtcggcgggcgacgcgcatgtgctgcgggagagagagagagggatcgacggatatgcagagcgctgaagatatttaagttatgatgagtaaaattgcttagtctgttcgt

SEQ ID NO: 28141 - DNA, 1292 bp, Triticum aestivum
  Clone ID: PAT_TA_28141
gcgcaattgtccttgagcttacgactcggtacacgatgccaaaatcttattatcaccacatgcatcgacatcactaccaaaccagtacttgagagttcagagtacaacaagcagcagcagcaactaataataattagagaaaaatttgtgcaggcatgacacctgccaaacaccatactacagggggcatatcatatcaaccaacggtaataataataaaagagctctatattaacggagtcctctccctcctaatttaccagctcggatcggatctatgcaacaaactgcaacggacggtacggcgattatcaattcgtctccacaagaacagagagttcgccacggcagcaagggccgccgagcgcccggcgatggcgctcacttgacggtgcagatcttgatgacggaggcgacgccgatgcggtgcaggacgacgacggcgtcaccagccttgcagagctgcttcttcacggccgacttgagcgccgcctggaggatctcctccgtcgactccgagtcggtggccttggcggagccctcggcgaggagcgggatcaggcccctgtagatcaggctgtgcctggcggggccctcggagctgacggtccagtcgaacgagtcggtcgtcagcaccgggacgaccaccgacaggatcggcaccctgggccggtacttggccaccagcttcgccgtggtgccgccacgggtcaggacgacgatcagagtggccctggccttgttggcggttcgcacggccgaggacgcgagggactccagcgggctcatcgggaggggcgcggccttgatcatctccttgaagacggcgtcgttgtccagggaagactccgcctccacgcagatgcgcgccatgatcttcacagccacctcagggtatgctccggcagcgctttcaccactgagcatgacgcaatcagttccatcgagcacagcatttgcaacatcagtagcctcagcgcgggttggcctgggggacttgatcatggactcgagcatctgtgtcgctgtgaccacaggcttcccagcaaggttgcacttgtagatcatcattttctgtgcaaggaatatcttctcgactggaatctccattccaagatcacctctagcaaccataaagacatcggtttccctcagaatgtcatcaaagtttacaatgccctcttggttttcaacctttgacattaacttgatgcgctttgcatgctgtccaagaagctgtctgacggtcaccaaatctgatcctttgcggacaaatgacaaagcaatcatgt

SEQ ID NO: 28142 - DNA, 2080 bp, Triticum aestivum
  Clone ID: PAT_TA_28142
gccggccgggtccggaacctccaattcgtttgggtgcgttcctctctttcctcgtcgtctctcgttatctcggcgccgttcgtcgccgccgccgcgtagcgccggcgagactagaagaggcaggcgccatggcgaccgcttcagtatcgttcaagtctcgtgaggaccaccggaagcagctcgagcttgaggaggcgcgtaaggcggggctcgcccctgccgaagtcgacgaggatggaaacgagattaaccctcacatcccgcagtatatgtcctcggccccatggtatctcaacgccgagaagccgagtttgaagcatcagcggaaatggaagtcggatccgaattacacaaaagcgtggtacgataggggtgccaggcttttccaggccaacaaatacagaaaaggcgcttgcgaaaactgtggagccatgactcacaataagaaggcatgcatggatcgacctcggaatgttggagctaaatataccaatatgaatatagcaccagatgagaaagtcgagtcgtttgagcttgattatgatggcaagcgtgaccgttggaatggttatgacacatcaacctacactcgtgttatccaagattatgaagctagagaagaggccaggaaaaagttcctgaaagaacaacagctcaagaagctcgaggagaaggatggtgagcaggatggtgagaatgtgggcagtgaagaggatgaagaagatggcctgaagatagatgaggctaaagttgatgagagcgctcaaatggattttgctaaggtagagaagcgtgtgcgcacaacaggcggtggaagcaccggaactgtgaggaatctgcgtattagagaagacactgcaaagtatcttctgaatcttgatgtgaactctgcatattatgatccaaaaacccgctccatgcgtgaggatcctttgccagatgcagatcccaatgataaattctatgtgggtgataaccaaaatagacttagtggacaagctctggagttcaagcaactcaatgtccatgcatgggaggcttttgacaaggggcaggatttccatatgcaagcagccccatctcaagctgaactactgtacaagagtttcaaaatcaagaaggagaagttgaaatctgaaagcaaggacaaaattatggagaagtatgggaatgctgcatctgacgaaccaatccctcgtgagcttcttcttgggcaaagtgagaaagagattgagtatgaccggactggtcgcataatcaagggacaggatgtagctcttcctaagagcaaatatgaagaggatgtcctaattaataaccacacaacagtgtggggttcatggtggaaagatcatcaatggggctataagtgctgcaagcagactattaaaaatagttactgcacaggccttgctggaattgaggctgctgaagcatcagctgatttgatgagggaaaatatggcccgcaaggaggctgccgaagaggaacctgtacgacaagaagaaaagaaactagccacttggggaacagatattcctcaggatcttgtcctggaccagaagttgctcgaggaatccttaaagaaggaggcaaagaggaagaaggaagagatggacgaaagaaagaggaagtacaatgtgaagtggaacgacgaggtcaccgcggaagacatggaggcctaccgtatgacgagagtccgccacgacgatcctatgaaggattttctcaattaggcgttcatgtcccctggttgcttggcagctgttgtgtaatgcaggtgtaagctggctacgcctgaactcctggtctgcccatcctttgccggattgtcgtgtctgtattctctgcgatctctaggaagacgggatggcatgccagttcgtgagttgctgatgttgtgaagtacagatatgacgcgtgatgtccaaaagcagaatgaagtttgttctcatatgttctttgtaacctcttggtaaccatggcatacgcccacttatatggatatttgtaccgttcatgagtaataagttattgttgctaaaaaaaaaaaaaaaaaaactgagacgtagttctctcc

SEQ ID NO: 28143 - DNA, 1415 bp, Triticum aestivum
  Clone ID: PAT_TA_28143
aaaaaggacgaccctcgcagaggaagaggagcacgcgaaccgaaccgagcctcgcgccatggcgggagtagcgtccctcaacgccgtgtccctgttcgcgccgtgcgccccaggccccgggggcgaccgccgcccgcggccgcctcctcgtcccggcggcccgtcgcttcccgtcgctgcgggccgcgcggcgcgtcgtcgcggcgcgggcggcgcccgtggacgccgacgacgagtgggggaaggagccggcggtgggagggacggcggtggcggaggcgccctcggaggcggccgcggccgcgagcgaggtggcggcgctcaagctgaagctcaaggcggcgctgtacgggacggagcgcggcctgcgcgcctccagcgagacgcgggcggaggtggtcgagctcatcacgcagctcgaggcgcgcaaccccacgccggcgcccaccgaggcgctcaccctcctcaacggcaagtggatcctcgcgtacacatcattttcgcaattgttcccactgttggggtctggaaggctacaagctcttgtcaaggtggacgaaatatcacagactattgattccgagaactttgcggtgcagaactgcatcaagttttcaggacctttggcgtcaacttcagtgtccaccaatgccaaatttgaaattagaagccccaaacgtgtacagatcaaatttgaagaaggcatcatcggcactccacagctgactgattccatcgtactgccagagaagtttgaattctttggacagaacattgacctgagcccgttgagcgggcatatttacttcgatcgagaacgcagcgtcctccgtcgccaagaccatctccggtcagccctccgctgaagattcctttcaggagcgagagcgctgggtcctggctgctcacaacctaccttgatgctgagcttagaatctcaagaggagacggcagcagcatctttgtgctgttcaaggaaggaagctcgctctcaatataggccaagcgtacctattctctgaatagaatttgacatggagaaagggaatccccatagatagttgttgtgcctattttcttatatcctgaattcgtgtgtttatagtttgtccgtgccagtgtgtgggtgtgatgtatatgtagctgaacgaactgccatatgcctttgtaagcctttgggccgtactagtttcggtagactgtggaatacaaagataccctaagttcttgtaaaaatgctaagtatgaaaaatggctgaagctccaaaaaaaaaaaaaaaaaacctcgtgccgaattcggcacgagatgagtggccttattgctgacgccagaacactggttgagcatgctcgtgttgagactcagaatcataggttctcatatggggagccaatgacagtagaatctaccacac

SEQ ID NO: 28144 - DNA, 955 bp, Triticum aestivum
  unsure (1)..(955): unsure at all n locations
  Clone ID: PAT_TA_28144
ttttttttttaaactcttgatgaagaatatgattagaataatgtctgatgtattttgatcatgcgacgatcaaattatgcatcacatagtagtacaataattatgcatcggaaaatactatcgcttattacaaaaattgacaccaagccatcgggcattcactactggaaaataacgaataggtactccatggcattcatatcgatggatcgatatatcttgatatacgtacatatgtatatatatttcgggtttgagcaatgggagggaagattgatttacagctcccatgtgtcaaactttcctgagacgaagtcgtagtggccgccgatcagcttgagggttccgtttgccacaccctccttgacgaacgggtaagtgctgaggttctggagggacacgttgacggcctccttttccaagcacggcacattggtcctcgaaaggcaggtcacaacactcgtccttcaccttcttcttggccgagaacccgatcctgacccagtcctcaacgaagtggaaggagtcgtcttccccatccttgagcgagaggagggccttgataccaccacagcggctatggccaatcaccacgatgaccttaaccttgagggcgcagacggcatattcgatggctgatccaacacccggtgtgcttgttcttgcagtagcatgggaccatggcacccgatgttgcgaacggtgaaggcctcgccaggttccaggcccagggtgactgatgggcacacacgcgagtcggcgcatgcgaacaacatgtacgtgggttcctggttgtccttgaggggctcgaagagatccggcttcttgtcatagacctcggtcttgaacttgtcgaagccggtcctgaggcgctccatctttctatctgcaagggtgcttgaagaggaggacagagacggactttgtggaggatcctcgtgccgaattncctgca

SEQ ID NO: 28145 - DNA, 1185 bp, Triticum aestivum
  Clone ID: PAT_TA_28145
gccggccgggccggggccgccgtctcctctcctctctactagtacttggttcccaagaaaaaccccaccaagcacccaccccgtgtagtagaaatagaatcaagtgcttcgaattccgatccgcatccgccgacgcgatgtttctcacgaggacggagtacgaccgtggggtcaacaccttctccccggaggggcggctgttccaggtcgagtacgccattgaggccatcaagttgggctccactgcaatcggcttgatgactaaggatggtgttgtactggctgttgagaaacgtgtcacctcaccgctgctggaaccaagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagaatctaccacacaagctatctgtgacttggctttgcgctttggtgaaggtgatgaagaatcaatgtcacggccgtttggagtctctctccttattgctggtcatgatgaacatggacccagcttgtattacacagacccatcggggaccttttggcagtgcaaggccaaggccattgggtcgggctctgaaggagctgatagctcattacaagagcagtacaacaaggaactgaccatcgctgaggcagagaccatagccctttctatcctgaagcaggttatggaagaaaaggtgaccccgaacaacgttgacattgcgaaggtctcccctagctaccacctctacaccccttctgaggttgaagcggtcatctcgaggttgtgaaggattgccactttgtgagacagctcttgtattcccatgaaccctaaggcacaatgaactatgaactctgttgtgggtttgggttgtctgcctactgttgaagggatattagtgcctgcttgggcgttgcatctgattctcatctcccagtccagtcatttgtttgtagcactaagacgttgtgtcaccaaaaagaattagtacacataattttcagcatctagcaagtgcgtaggtatcactggctgcatttgtgtgcatttggtttgtaaacatctctactgttaaggggagttggtgtttgtactagaaaaaaaaaaaaaaaaaaactcga

SEQ ID NO: 28146 - DNA, 1619 bp, Triticum aestivum
  unsure (1)..(1619): unsure at all n locations
  Clone ID: PAT_TA_28146
cctcctcccacctagagcagcagcagaagagaaggaaaattcagtagcagtagaactcagagcagcggcagcagaactgcggcgagctgatccagcgagagaactacagcgaggtttgttggatcgccgacccgaccggagatgagcggcggacaggagctgaatctgccgccgggcttccggttccaccccgacggacgaggagctggtgacgcactacctctgccgccgctgcgcccggcgcgcccatcgccgtccccatcatcaccgagatcgacctctacaagttcgacccctggcagctcccaaagatggcgctgtacggcgagaaggagtggtacttcttctccccgcgggaccgcaagtaccccaacgggtccaagcccaacagggccgacgggtcagggtactggaaggcgacgggggccgacaagcccgtgggcacccncaagccgntggccatcaagaaggcgctcgtcttctacgccggcaaggcccccaagggcgagaagaccaactggatcatgcacgagtaccgcctcgccgacgtcgaccgatccgcccgcaagaagaacagcctcaggttggatgactgggtgctgtgccgcatctacaacaagaagggcggcttggagaagccggcgtccgtggaccgcaagccggcggccatgggcggctacgggggtcctcctggggccatggtgagctccccgcaggagcagaagcccgtcatggggatgaacgccaacgcggccggtgggcgtgcagccgttcccggacttcgcggcgtactacgaccggccgtccgactcgatgccgcggctgcacgccgactcgagctgctcggagcaggtgctgtcgccggacttcccggccggggaggtgcagagccagcccaagatcagcgagtgggagcgctcattcgcctccggcggcgaccctgtgaaccccggcggccggctccatgctcgagcccaacggcgggttcgggcgggcgacccgctcctccaggacatcctcatgtacttggggcaagccgttctaagcagcaaacaaaccgatcgatcggtcgaagcgagtacctccatccttggcgtttggggcgatgaaacgggcgagccgccattgttgacctgatgaaggggagataatttaagaagatattagacgggagataagacaaaatcaggtgcttgatgacgacgacgacgaagattggaaggtggcggcgatgataccgtgggtccccgggctctctcaccagcttgacatgaccgacgcccaagatgcttcaaagcgttcgccgcattgcatcatcgggcgggcggttgtgcgctagcatgcatgcatgtgcgtgtatatggatgggtgtacatacatggagatcatgattggttcggtgcaggggttgctgtttcttgattggttagttgtaatattttttttttttgcgggtgagttgtaagggtttattgataagttgataccataccataccagtgctagccgccgtgcgtggtgctggctagctgtagtccgatggtagtagtgtaactgtaagccattcatcaaatgaaactgaatatattatctgccctcaaaaaaanaaaaaaaaaaaa

SEQ ID NO: 28147 - DNA, 950 bp, Triticum aestivum
  unsure (1)..(950): unsure at all n locations
  Clone ID: PAT_TA_28147
ctaggagggggtgtgccgaaccagagttcgtcaggtaaataatagtcttgcaaccttcacatttacgacgaacgaccggttcaggacaagagtggcaaaatacataggagtcatcaaacacagcagtagctctcgcactgcttaccaaccatttacacggatggaaataacacgcgtacaacaacgtgggcacaacaaaatatagagcataagtctctaggagatgtcgcaaatcttaaacggtagagtaacgggtgattttacttgtgggataggaaaaccatgcagtagtacagacggcatgtgcgacctcgtcttcaaaccgtgggcagcgaccgttttagttcttattcttggacttaacccctgcccttgtaactccaagcccaactacatctgaacttttcatgaccctgatcctccggcaagcctcggtgaacatctcccatgggacgtcaccaaccagcatccagtctccatccttgtcttcgtaagtcatcacatattcaccatcctttctgttctcagatgcaccatccttcccggtcctgaagccaatgaacattttccctagcgccacaaccatgtccttatagttcttgtatgtcttgaggtcaaccttcctcaggtaaggcgcaccatccatgctgaccttgacatacagaaactcttgcccctgcttcgtgtcagaatcctccttgctgctcttcagctggttggtggtggttgccatcgtgttcttgcggtagctgcgtcgcccgccctcacgctcaccggccgcaagaaggaggccgacaagctgcagacccgccgaaggctggtcccagttcaccggaggcttcttcttcggcggcgtctccggcgccatctgggcctacttcctcctctacgtgctcgncctcccatacttcttcaagtagattatttattattggcatgcatgtacctgc

SEQ ID NO: 28148 - DNA, 1287 bp, Triticum aestivum
  Clone ID: PAT_TA_28148
cttctgcttgagttgggcttacatttaccaattgcataaaccacgattaaaaaccttgaacaatatataaagtacagtactgcttagaagaatgacaatttgggaacaatagggcaatagaattacacatggctctttagactctggaagaaagggcattatgaggggaactacacaacatggctctttaggctctccaagaaagagcgttatgaggggaaactacacaaaacagaatatgaaaagtgaaagtgacggagcgagtgacagagcaaactgcacatcactcagcggtttcagcagactcaaaaaaaaaaaggaaaaatgtatgaaatgatacaccagtaagaaaacttagcactgatcactagacggcccaaccagtgtagcacgtcgcggtgatgtcgaatgcttcttcttacttcccaggagcaaaaggatcccgccttttgttgaacttgagaggcagcagaccaagaataaccccaatgtggcgatgtcttgttcttaggcagatgccttgtcgaacttgaggggcttcaccacttcccaggtgaagtcggcatcatcgcggccaaagtgaccgtaagcagcggtcttgatgaacctgtttccacctttcttcaagtccaggttgatgctgatcatccctggcctgaagtcaaagttctccttcacgagcttgaggatctcccggtcggggatcttgccggtgccgtaggagtcgacgaacacagacaggggctcaggcacaccaatggcatatgaaatctgcacaatgcagcggcgtgcgagaccgctggcgatgatgctcttggcagcctgcctagcaatgtaggcgccactgcggtccaccttggtcgggtccttgccagagaaggcgccgccaccgtgggctccccagccaccgtaggtgtcgatgatgatcttgcggccggtgagaccggcgtcaccgtgaggtccaccgatgacgaagcggccagacgggttcaggtggaagatggtgttctcatcgaggtacttcccggggatcaccggcttgatgacgtgctccttgaggtccgcggcaatctcatcgttggtgacggtctcatcatgctgggtagagatgaggacggtgtgtacacgaacaggcaccatggcaccaccctcgtttaggtactacaatggtgacctgggtctttccgtcaggcctgagccaggcacaggtgccattcttgcggacctcggtaaggcgagctccaagcttggtggcgagcatgtgggtgaggggcatcagctcaggcc

SEQ ID NO: 28149 - DNA, 1139 bp, Triticum aestivum
  Clone ID: PAT_TA_28149
tttcagccgcggggttgttatttgttatgctatgctccgttagtctcctctgtttttagcaatgctattgtacgatccggtccggtccgtggtactcagagtagttgttgtttggtttcctggcatggttgagtggctcgtcctttctgttgtgagattgcatcatcagttcccaatcaaatttccctggagaaatcaagttacctctggtgattatgaaagttagcatcctctctgcaaataattcttcctttgagaaaccgcaatggagatacgcattgtccttgagcttccgactcgacgatgccaaaatcttattatcaccacatgtatcgacatcactaccaaaccagtacttcagagttcagagtacaacaagcagcagcagcaactaataattagagaaaaatttgcgcaggaatgacacctgccaaacaccatactacaggtaataaaagagctctatataacggagtcctctccctcctaatttaccagcgcggatcggatctatgcaacaaactgcaatactgacggtacggtgagaagaccagagaggaacaagggacccaggtttcgccacggcagcaaggaccagggcggcgctcgggtcaccgtgccgatcacttgacggtgcagatcttgatgacggaggccatgccgatacggtgcaggacgacgacggcgtcgccggccttgcaaagctgcttcttcacggccgacttgagcgcggcctggaggatctcctccgtcgactccgagtcggtggccttggcggagccctcagcgagaagcgggatcaggcctctgtagatcaggctgtgcctggcggggccctcagagctgacggtccagtcgaacgagtcggtcgtcagcacagggacgaccacggacaggatcgggaccctggggcggtacttggcgaccagcttcgccgtggtgccgccacgggtcaggacgacgatcagagtagccctggccttgttggcggtccgcacggcggaggacgcgagggactccagcgggctcatcgggaggggcgcagccttgatcatctccttgaagacggcgtcgttatccagggaagactctgcctcaacgcagatgcgcgccatgatcttcacagccacctccggacg

SEQ ID NO: 28150 - DNA, 863 bp, Triticum aestivum
  Clone ID: PAT_TA_28150
gctgcaaacatccatccatttgtagctgcaggcagagcagagttgtgcgtgtgggagttgaaggagatcgagatggccacagcatatgctcctccgatggcgagccaggtgatgaagagcggcttggtgtgctccaagccgcggggcatgtccggcgcttcgctcaccaggaggccccgcctcgtcgtcaaggccgtcaagtctgacaagccgacgtaccaggtggtccagcccatcaacggcgacccattcatcggcagcctggagacgcccgtcacctccagccccctcgtcgcctggtacctctcaaacctccccgcctaccgcaccgccgtcagcccgctcctccgcggcatcgaggtcggcctcgcccacggctacctcctggtcggccccttcgcgctcaccggcccgctccgcaacacgccaattcacggccaggcaggcactctcggcgccatcggcctcgtctccatccttagcgtctgcctcaccatgtacggtgtcgcgtccttcaacgagggcgcaccgtcaaccgcgcccgcactcacgctcacaggccgcaagaaggaggccgacaagctgcagaccgctgaagggtggtcgcagttcaccggaggcttcttcttcggtggtgtctccggtgccacctgggcctacttcctcctctacgtgctcgacctcccatacttcttcaagtagattaattattggcatgcatgtacgatgggtgcagatcatgtgatctcttcccgatggtggttgcttcaaagagtccatgtataaatgaatttacacattcctcacaatctttgcatggatcgatcatactacgatactataacatgcgaattgctaatttc

SEQ ID NO: 28151 - DNA, 1275 bp, Triticum aestivum
  Clone ID: PAT_TA_28151
ggaggaccgtcgcagaggaagaggagcacgagacccgagccgagcctcgcgccatggcgggagtagcagcgtccctcaacgccgcgtccctgtccgcgccgtcgccccaggccccgggggcgaccgccgcccgcggccgcctcctcgtcccggcggcggcccggcgcttcccgtcgctgcgggccgcgcggcgcgtcgtcgcggcgcgggcggcgcccgtggacgccgacgacgagtgggggaaggagccggcggtgggagggacgtcggtggcggaggcgccctcggaggctgccgcggccgcggtcgaggtggcggcgctcaagcagaagctcaaggcggcgctgtacgggacggagcgcggcctacgcgcgtccagcgagacgcgggcggaggtggtcgagctcatcacgcagctcgaggcgcgcaaccccacgccggcgcccaccgaggcgctcaccctcctcaacggcaagtggatcctcgcgtacacatcattttcgcaattgttcccactgttggggtctggaaggctacaagctcttgtcaaggtggacgaaatatcacagactattgattccgagaactttgcggtgcagaactgcatcaagttttcaggacctttggcgtcaacttcagtgtccaccaatgccaaatttgaaattagaagccccaaacgtgtacagatcaaatttgaagaaggcatcatcggcactccgcagctgaccgattccattgtactgccagagaagtttgaattctttggacagaacattgacctgagcccgttgagcggcatatttacttcgatcgagaacgcggcgtcctccgtcgccaagaccatctccggtcagcccccactgaagatacctttcaggagcgagagcgctgggtcctggctgctcacaacctaccttgatgccgagcttagaatctccagaggagatggcagcagcatctttgtgctgttcaaggaaggaagctcgctgtcgatataggccgagcgtacctattctctgagtagaatttgacatggagaaagggaatccaatagatagtagttgtgcctatgttcttacttcctgaattggtgtgtttatagttcgttcgttgcagtgtgtggctgtgatgtatatgtagctgaactgccatatgccttttttttttcaaaacgaactgccatatgccctcctttgtaagcctgtgcacgtactgtttcaatagactggaatacaaagatacctgaagttcttgtacaaaaaaaaaaaaaaaaag

SEQ ID NO: 28152 - DNA, 1131 bp, Triticum aestivum
  Clone ID: PAT_TA_28152
gcccaagcaaagttcgtcaggtaaataatagtcttgcaaccttcacatttacgacgaacgaccggttcaggacaagagtggcaaaatacataggggtcatcaaacacagcagtagctctcgcactgcataccaaccatttacacggatggaaataacacgcgtacaacaacgtgggcacaacaaaatatagagcataagtctctaggagatatcgcaaatcttaaacagtagagtaacgggtgattttacttgcgggataggaaaaccatgcagtagtacagacgatatgtgcgacctcgtcttcaaaccgtgggcagcgaccgtcttagttcttattcttggacttgacccctgcccttgtaactccaagtccaatcacatctgaacttttcatgaccctgatcctccggcaagactcggtgaacatctcccatgggacgtcaccaaccagcatccagtctccatccttgtcttcgtaagtcatcacatattcaccatccttccctgtcctgaagccaatgaacattttccctagccccacaaccatgcccttgtagttcttgtatgtcttgaggtcaaccttcctcaggtaaggcgcaccatccatgctgaccttgacatacagaaactcttgcccctgcttcgtgtcagaatcctccttgctgctcttcagctggttggtggtggttgccatcgtgctcttgcgatagctgcggactggtggccatcccaccacctgagccttggcagcaggctgcggcggggcggcgaccttcttgtccttctcatccccggacgcgtccttgtctttcccggcggcggaaaccggcgcaggcggcacgacctcgtccgaaaaccctcgcttggcgcccttggcgggcagcaggtcgagtgtggtggtggcggcgaccgggcggcggtccggggactcgcagccgggaagtccgaggcggagctcggtgcctttcaggtcgtcgtccgggcggccgccggcggcggccgagaggcctatgtagtcgagctcgagaggcggcgacatgggaagcagcaggacatgaactggggagtagcaggagggggagggggaggacggaggagaggaggggggagtggagctggtggcctcgtgc

SEQ ID NO: 28153 - DNA, 1362 bp, Triticum aestivum
  Clone ID: PAT_TA_28153
ctgctcggcaacaacttccccgtcttcttcatccgcgacggcatcaagttccccgacgtcatccatgccttcaagcccaacccaaagtcccacgtgcaggagtattggcgcgtcttcgacttcctttcccaccacccggagagcctccacaccttcttcttcctcttcgacgacgtcggcatcccgaccgactaccgccacatggacggcttcggcgtcaacacctacaccttcgtcacccgcgccggcaagtcccactacgtcaagttccactggaggcccacctgcggcgtcagctgcctcatggacgacgaggccacgctcgtcggcggcaagaaccacagccacgccacccaggacctctacgactccatcgacgccggcaacttccccgagtggaagctgttcgtgcaggtcatcgaccccgacgacgaggaccgcttcgacttcgacccgctcgacgacaccaagacatggcccgaggacctcgtccccctccagcccgtcggccgcctcgtgctcgaccgcaacgtcgacaacttcttcaacgagaacgagcagctggccttcggcccggggctcgtcgtgcctgggatctactactccgacgacaagatgctgcagtgcagggtgttcgcctacgccgacacgcagcgctaccgcctcggcccaaactacctgatgctccccgtcaacgcgcccaagtgcggcttcaagaacaaccactacgacggcgccatgaacttcatgcaccgcgacgaggaggtggactactacccgtcccgccacgcgccgctccggcaggcggagccggccagcttccctgtgcccacgcggcccgtcgtcggaagaagggagaagacgaggatcaagaaggagaacgacttcgtgcagcccggggagaggtaccgcagctgggcgcccgaccgccaggacaggttcgtgcgccgcttcgccgacgccctcgcccaccccaaggtcagccacgagctccgcgtcatctggatcgacttcctctccaagtgtgacaagtcgtgcggcatgaaggtggcgaaccgtctcaacgtgaagccaagcatgtgatggatggaccgttctgtgtaaactttgtgctatatcatggaccagcaataagagaccatgccagctataatgtggatcatgtggtcgattacctactgtgctgctactaataagttactatcattttcttttatgtcgcagtaacttacctgtaatccagcaaatgaaattaaagtgggtgctttggagcttatgaatcccaaacgtgtattcgtctttgcctcaagatgatatttgctgttctggatggaacaaaaaaaaaaaaaaaaaaaaaaaaaa

SEQ ID NO: 28154 - DNA, 609 bp, Triticum aestivum
  Clone ID: PAT_TA_28154
tttttttttttttttttttgagagtgatatgaactgaagtaactgaaatttgtcatcatcatcatggtggtttttacaatgggggattccacgggaagccagctagtaccaagtttctgcatcgtggtttcaggccatggttgttgcagcaagcacacacacacacacacacctagctagtactaccaagtaggcagctgctaattgggaccccagcagctgaggtacatcaccgtcctcagcccttcctcggccttctccccttgccgcctctccgccaccgccgcagcagaggccggaagctgcttggcgccctgcgagacgccgccgcagacgttggccctggccttggctgcccgatggatggatttgagggcgtagttccagcggcagaggccgacctggtccttgagcgcctccaccgcgcccacgctcatcgccaccatccaagacgccttagctgcgcccgccatgatctctctctgtgctgctggtctgaaactccgaagtaggtgatgactgaagagtagttgtcgagcgtagagtgcggaatttctggttgtgaatgaactgaaatgaaggctgattgatgcttccggaacggccggc

SEQ ID NO: 28155 - DNA, 1077 bp, Triticum aestivum
  unsure (1)..(1077): unsure at all n locations
  Clone ID: PAT_TA_28155
gaagaaactccgtcccaagaagaaactcgccgccgtctcctctcctctctactagtacgtacttggttcccaagaagaaacaccaccaagcacccaccccgtgtagtagaaatagaaaaagtgcttcgaattccgatccgcatccgccgacacgatgtttctcacgaggacggagtacgaccgtggggtcaacaccttctccccggaggggcggctgttccaggtcgagtacgccattgaggccatcaagttgggctccaccgcaatcggcttgatgactaaggatggtgttgtactggctgttgagaaacgtgtcacctcaccgctgctggaaccaagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagagtctaccacacaagctatctgtgacttggctttgcgctttggtgaaggtgatgaagaatcaatgtcacggccatttggagtctctctccttattgctggtcatgatgaaaatggacccagcttgtactacacagacccgtcggggaccttctgggcagtgcaatgccaaggcaattgggtcgggctctgaaggagctgatagctcattacaagatcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaagcggtcatcgcgaggttgtgaaggattgccactttgtgagacagcctcttgtattcccatgaaccctataaagcacaatgaacgtatgaactctgttgtgggtttgggttgtctgcctactgttgaagggatattagtgcctgcttgggcgttgcatctgattctcatctcccagcccagtcatttgtttgtactccctttgttccgnatttatttgttgttgggggat

SEQ ID NO: 28156 - DNA, 898 bp, Triticum aestivum
  Clone ID: PAT_TA_28156
atttgaaaatatttctattgcacataatatcatgtatcaagcaccaaacaccaaggaactgcttggtattgaaatcatgtatcttgtaccagggaactgttttgtccatcacatgagtttgtcgaaataaatacgacaaaactgtcctcttgctaaggtagttaacagcacaggagtacatggtgaaacgagtgaattcagatgagcttcttcttctggaagaagccttgcaaatgccatagctgcagagcggagaccacaatgcacacgcccagtgacaagatgctgaaccaggcaaccctggaattcgttttctcgctcacttcccgcatctccgcttcccttgctttgagatataataagttatgatgaatggattccactgcagcttcaagtttcgcgagctctaattcaacaccctcaatcttctccttcttggcaacagagtcccagtcctttgtcgcaatccctatcttccaatcaagatttagagatactcctgatcctttctctgcgctgtctagccagaagcaagcaaggtagtttccagcttctgaagttgtaaatgcaaactggcccactgtggcattttctttgtgatgtacagtattgccatatggtgaggtaaccttgacggcgacggtggggtgggcggtggcgtgggcctcgtacatgagcatgtagtccgcgaccaccaccacgttgggctggatctcctcggagacgcacttggtccccgagggcggcaggtcgagccacaccgcctccgagcccagcatcatcagcgccgccacgagcgcccccaccaccagcgccggccgggtcgccgctcccgctgccgccgtcatctgctccgatctgggcgaccctgtctgtccgagtctcctgtggggaaatc

SEQ ID NO: 28157 - DNA, 1439 bp, Triticum aestivum
  Clone ID: PAT_TA_28157
ctcaatgtaagaaagaaccatcatctatggttgccttggtacttaactaaaaaaagaggcaaaatttgctcagctaattgtccaaggtttacccaagcatgtcgttaaggaaagcacaaataagataatcacttgtgtattttttgcctaatagtccctctgtaaagaaatataagagcgtttagatcattagagaatataagaacgtttagatcactactctagtgatctaaacgctcttatatttctttacggagggagtacatcatagataagactacaatggtttttacaaacaggagcacatgtgaaacaggtcacagggaaagagctaaggagttcatccagtgtgtattaagtattaacaaaaagcttgactgcaaaacagttaggcagttcaacctcaatgtaagaaagaaacatcatctatggttgctctggtacttaactaacatgaagaaacatttcatcatcacagagaatatcaaagagttcagcaaggacaggaaaaataaacactaagaaaacagataaataactgagagtaataaaatacaaacctttgacattaacttgatgcgctttgcatgctgtccaagaagctgtctgacggtcaccaaatctgatcctttgcggacaaatgacaaagcaatcatgtcaatgtcattaggcacaccccatcccaaaatgtcctccttatccttctccgtcagggtaggaaggtccacgacaattcctggcagattacaattcttcctctctccaagcattgcagtgttctcacacctacatctgacagttccagctgctgggtcgcaagacagaacagacaaggagatggtaccatcagcacatagtatgacatgcccaggcttcacatcctgaggaagtttcttgtaactcatggagatcgtgttcgtgtcgcccttgatatcatagtcggtggaaacagtgatttcttgaccctttgtcagtttgattggtttaccatccttcaaaaatccagtacgaatctcaggtcccttggtgtcgagcatgacggcgcagaggatgccggtgttgtgcatggcctggcggagggcgtcgagggtctccttgtggtactcgtgggtgccgtgggagaagttgaagcgcgcgacgttcatcccggcgcggagcagcttctcgagcatgggcacggagcgggaggccgggccgagcgtgcacacgagcttggtccgcggggtgcgcgcgtccgccgccgcgtcccgctccatgtccgccagcaccgccgccatgtcgatgttcgccatcgcgccctgccgatccggtcgccggaggtggggtgggaggggttgggttgggggtgcgggggaatgacgatgagatttggatttggtcgcgggcggatggatggatgttttccaggaatggaaggggggatttgggcggacgcgtgg

SEQ ID NO: 28158 - DNA, 962 bp, Triticum aestivum
  Clone ID: PAT_TA_28158
ataaagtttcacaatttatatatgttattatacacaaaggccgaatgatcccagaagtagcagatttgaaaatatttctattgcacataatataatgtaccagggaactgcttgctattgaaatcatggatcttgtaccagggaaccgttttgtccatcacatgagtttgtcgaaataaatacgacaaaactgtcctcttgctaaggtagttaacaacacaggagtacatggtgaaacgagtgaattcagatgagcttcttcttctggaagaatccttgcaaatgccatagctgcagagcggagaccacaacgcacacgcccagtgacaagatgctgaaccaggcaacccttgaatttgttttctcactcacttcccgcatctccgcttcccttgctttgagatataacaagttatgatgaatggattccactgcagcttcaagtttcgcgagctctaattcaacaccctcaattttctccttcttggcaacagagtcccagtcctttgtcgcaatccctatcttccaatcaagatttagagatactcctgatcctttctatgcgctgtctagcccagaagcaagcaaggtagtttccagcttctgaagttgtaaatgcaaattggcccactgtggcattttctttgtgatgtacagtattgccatacggtgaggtaaccttgacggcgacggtggggtgggccggtggcgtgggcctcgtacatgagcatgtagtccgcgaccaccaccacgttgggctggatctcctcggagacgcacttggttcccgtggggggcaggtcgagccacaccgcctccgcgcccagcatcatcagcgccgccacgagcgcccccagcaccagcgccggccgggtcgccgctcccgctgccgccgccatctgctccgatctgcgcgaccctggctgcccgagcggacgcgtgggcggacgcgtgggcggacg

SEQ ID NO: 28159 - DNA, 572 bp, Triticum aestivum
  Clone ID: PAT_TA_28159
ggtccacggaccatttcccaaattttccccactcgcgaaccctaacttcgaccagcctctccctccagatcccctcccctcctctcgccaggagcagaacccacccgctcggaccgcgccgcgtaatcgccatggcgaatgaggaacccgttgatcccaagaagtatcttgaggagcggtgcaagccacagtgtgtaaagccactgtatgagtatgagaaatgtatcaagagagttgaggccgatgatactgggcacaagcactgcactggggcaatattttgactattggtcatgcatcgataaatgtgtagcaccaaagctctttgaaaagctgaaatgatattggggcgctactttcagtgagtcagcctggtcattggccagaaccttgttcaagttgaaatatttgtcgagtctgcaaattgtcccgtgactgtgtttcgatttcatgaacttgtaataagagcaactatcttgacactttttgcaaccattgatttatgtttggctaagcactgatgacaactataacaatttgatgtctgttgattacagttctggtactgatat

SEQ ID NO: 28160 - DNA, 1516 bp, Triticum aestivum
  Clone ID: PAT_TA_28160
tgggattctcgtctattcaactatgggagttgggaagtattgagattcttactgtcaaacgcgagatggtggcttgaaaaatataagtttgatggatttcgatttgatggggtgacctccatgatgtatactcaccatggattacaaatgacatttactgggaactatggcgaatattttggatttgctactgatgttgatgcggtcgtttacttgatgctggtcaacgatctaattcatggactttatcctgatgctgtatccattggtgaagatgtcagtggaatgcctacattttgcatccctgttccagatggtggtgttggttttgactaccgcctgcatatggctgtaccagataaatggattgaactcctcaagcaaagtgacgaatcttggaaaatgggcgatattgcgcacaccctaacaaatagaaggtggcttgagaagtgtgtaacttatgcagaaagtcatgatcaagcactagttggtgacaagactattgcattctggttgatggataaggatatgtatgatttcatggctctggataggccttcaactcctcgcattgatcgtggcatagcattacataaaatgatcaggcttgtcaccatgggtttaggtggtgaaggctatcttaacttcatgggaaatgagtttgggcatcctgaatggatagattttccaagaggtccgcaaactcttccaaccggcaaagttctccctggaaataacaatagttatgataaatgccgccgtagatttgatcttggagatgcagattttcttagatatcatggtatgcaagagttcgatcaggcaatgcagcatcttgaggaaaaatatgggtttatgacatctgagcaccagtatgtttcacggaaacatgaggaagataaggtgatcatcttcgaaagaggagatttggtatttgttttcaacttccactggagcaatagcttttttgactaccgtgttgggtgttccaggcctgggaagtacaaggtggccttagactccgacgatgcactctttggtggattcagcaggcttgatcatgatgtcgactacttcacaaccgaacatccgcatgacaacaggccgcgctctttctcggtgtacactccgagcagaactgcggtcgtgtatgcccttacagagtaagaaccagcagctgcttgttacaaggcaaagagagaactccagagagctcgtggatcgtgagcgaagcgacgggcaacggcgcgaggctgctctaagcgccatgactgggaggggatcgtgcctcttccccagatgccaggaggagcagatggataggtagcttgttggtgagcgctcgaaagaaaatggacgggcctgggtgtttgtcgtgctgcactaccctcctcctatcttgcacatttcccggttgtttttgtacatataactaataattgcccgtgcgctcaacgtgaacatataaatattctaataataggttatcccgtgatttacctgcctaaaaaaaaaa

SEQ ID NO: 28161 - DNA, 1193 bp, Triticum aestivum
  Clone ID: PAT_TA_28161
cccacccccacccacgccctatttagccccatcaccagacttctataatcgcgagcacgctatacacgatacacaaaacagaaaaaagatcaggacgaccccgacgcaccaccacctgctcctcccggcggctgcctgctcgactcgattccccaaccgcagggtcaacgtgggaacctgtcgcgcgatgggcttaggactgagattgcccttctgtctactcctcttgctgctcgtcagcctcggaagcgcacaaggccggagcactgtttttcttgatatccaggaggaggctcgaggccctggtcaaatcatcaacgatcaactaactttgagcaaaattcccgtgcgtgttgagaggggcagcccactatgcccagcttgtgagaagtttacagatgaagctcttagctatcttagtcagaaacaatcacaagataagatgatggaggtccttcatgaagcttgttctcagacattctctttggaaaagaagtgtgttgagtttgtggactcctatgcaactctcttatttgccaagatcgctgagatcaagccagaagagttctgcaaacgaaatggcctctgcagggacaatgctcttctgtctggtgtgagaagtgagagcacatgtgtgttttgccaccacctcatggatgaagttttgtccaaactgaaggatcctgatgctgagtttgagataattcaaattctcctcaaggagtgcaagaagatcgaaggtcatgaacagcaatgcaaacgattggtcctgcaatacatccctctcatcctggtgaacggagagaagttcctcgagaagaacgatatatgtaccatcgtccaagcgtgcgatgctggcaaaaagacgatggtcgggccattctccgaggagggtttgttgcgcgatgcataaaggtagaaaggccacaccaggctgcgtaaacccagacgaacattatgcactagttcttccttgttgtacataggtgtccaaaaattcgtctggcttttgccttgtgctgctgctcctgcattctgtggatgctttgtattataaagggagcggcatgacgagcagtttattatgtcaacttgaagccgtgttgtacttattacttcgtcaatgtttaatttgtaatgacatttgaacaactgtagatactaaatcgagtttcagtctgtctgcaaaaaaa

SEQ ID NO: 28162 - DNA, 1207 bp, Triticum aestivum
  Clone ID: PAT_TA_28162
gcggccgcccgggcaggtaaaaaaatgagaatgagggcattggagaggtttgagggggatcttgacttgcaaggactttaatccccccttattaatccccttcaaacatctccaatcgctgcctaaacggaacaagccataaagcagaacctccccctctcgtagtctcgtctcccacaagccgcaaacccatcttcccctagcccaagcaaaccgcgcgccaccatgttcctcacgaggacggagtacgaccgcggcgtgaacaccttctcgccggagggacggctattccaggtcgagtacgccatcgaggccatcaagttgggatctactgcaatcgggttgaagacgaaggatggggttgttcttgctgtggagaaacgtgtgacgtctccattgctggaacctagcagtgttgagaaaattatggaaattgatgagcatgtaggctgtgccatgagtggccttattgctgatgcaagaacattggttgagcatgctcgagtggagacccaaaaccatagattctcatatggggaaccgatgacagttgagtccaccacacaagctatttgcgatctagctcttcgctttggagaaggtgaagaagagtctatgtcacgaccttttggagtttctctccttattgctggtcatgatgaaaatgggccgagcttgtactacactgacccatctggaaccttttggcagtgcaatgccaaggcaatagggtcaggctctgagggtgccgatagttccttgcaggagcagttcaacaaggagctgacccttcaggaggctgaaaccattgctctatctatcctgaaacaggttatggaagaaaaggtgactccaaataatgtcgacatcgccatggtcgcgccgaactaccacctttacacccctgcagaggtcgaagcagtcatagcacgattgtgaaacgcagaaatctttgtcgaatgtcaaccaggattcatatgttccttgtgctgtgtgtctgacatcccgatgccttcaaattagcagaagcacaattgctctatgatatggacactgatgttttcctcttttcgtttgattatcttgtgttgacaaggtgtagaggcctagctgttgttgccttgtcacttgccggcaaggagattgtactacacccttttgtttgatacgaaggatttgtggcaatagcatgcagtatttcagcaac

SEQ ID NO: 28163 - DNA, 1148 bp, Triticum aestivum
  Clone ID: PAT_TA_28163
acgctatacacgatacgtacacaaaagcagaaaaaagatcaggacgaccccgacgcaccaccacctgctcctcccggcggctgcctgctcgattccccaacagcagggtcaacgacagtacctatcgcgcgatgggtttgggactgagattgccgttcttcctactcctcttgctgctggtcagcctgggagccgcacaaggccggagcacagtttttcttgatatcaaggaggctcgagaccctgatcaaatcttgatggatcagataacttcgagcaaaactcccgttcgtgttgagaggggtagcccactatgcccagcttgcgagaagtttacagatgaagctcttagctatcttagtcagaaacaatcacaagataagatgatggaggtccttcatgaagcttgttctcagacattctcgttggaaaagaagtgtgttgagttggtggactcctatgcaactctcttatttgccaagatcgctgagatcaagccggaagagttctgcaaacgaaatggcctctgcagggacaatgctcttctgtctggtgtgagaagtgagagcacatgtgtgttttgccaccacctcatggatgaagttttgtccaaactgaaagatcccgatgctgagttcgagataattcaaattctcctcaaggagtgcaaaaagatcgaaggtcacgagcagcagtgcaaacgattggtcctgcaatacatccctctcatcctggtcaacggagagaagttcctcgagaagaacgatatatgcaccatcgtccaagcatgtgatgccggcaaaaagacggtggtcgggtcattctccgaggagggtttgctgcgtgatgcatgaaggtagaaaggctacaccaagccgcgtgaacccggagggaacataatgcactagttcttcttgttgtacataggtgtctaaaattcaacttgctgttgccttgtgctgctcctgcattctgtggatgctttgtattataaagggagcggcatgacgaacagtatattatgtcaatttgaagccgtgttgtacttattacttggtcaatgttttaatttgtaatggcatctgaacaactgtagatactaaatcgagtttcagtctgtctactaaatcaatgttttaatcttgtca

SEQ ID NO: 28164 - DNA, 1546 bp, Triticum aestivum
  Clone ID: PAT_TA_28164
cccacctagagcagcacaagagaagaaagaattagcagtagaattcagagcagcagtagcagcgagtgagcgatagaatcacagtgaggctcgttggatcgaggagattcgcgtgaggaggccgattagccgaccgatcgaccggagatgagcggcgggcaggagctgaatctgccgccgggcttccggttccacccgacggacgaggagctggtgacacactacctctgccgccgctgcgccggcgcgcccatcgccgtccccatcatcaccgagatcgacctctacaagttcgacccctggcagctcccgaagatggcgctgtacggcgagaaggagtggtacttcttctccccgcgggaccgcaagtaccccaacgggtccaggcccaaccgggccgccgggtccggctactggaaggccaccggggccgacaagcccgtgggcacccccaagccgctcgccatcaagaaggcgctcgtcttctacgccggcaaggcccccaagggcgagaagaccaactggatcatgcacgagtaccgcctcgccgacgtcgaccgctccgcccgcaagaagaacagcctcaggttggatgattgggtgctgtgccgcatctacaacaagaagggcggcatggagaagccggcggccgtggaccggaagccggcggccatgggcggctacgggggtggccctggggccatggcgagctccccgccggagcagaagcccgtcatggggatgaacgccaacggcggcggcggcggcgcgcagccgttccgggacttcgcggcgtactacgaccggccgtccgactcgatgccgcggctgcacgcggactcgagctgctcggagcaggtgctgtcgccggagttcccggccggggaggtgcagagccagcccaagatcagcgagtgggagcgctcgttcgcgtccggcggcgaccccgtgaacccggcggccggctccatgctcgagcccaacggcggcttcggcggtgacccgctcctccaggacatcctcatgtactggggcaagccgttctaggcagcgaagaaaccgatcggtcggtcgaagcgagtacctcctatccttggcgtttggggcgatgaaacgggcgagccgccattgttgacctgatgaaggggagataatttaagaggatattagacgggagataagacaaaatcaggtgcttgatgacgacgacggcgaagatcggaaggtggcggcgatgataccgtgggtccccggcctctcaccagcgtgacgtgaccgacgacgcccaagatgcttcgaagcgttcgccgcattgcatcatcgggcgggcggtcgtgcgctagcaagcaagcatgtgtgtgtgtgtgtgtacatacatggaaaaaacatgattggttcggtgcggggttgctgtttcttgattggttagttgcaagggtttattgataaattgatatatagtaccataccagtgctagctgtagtccgatggtagtgtaagccattcatcaaatgacaccgaataatatattgttcttcccccccc

SEQ ID NO: 28165 - DNA, 1377 bp, Triticum aestivum
  Clone ID: PAT_TA_28165
ttaatcaagacattactgcaagacctcaaatctttcagtaagtttgtatattgcctttagtcaatttcggttccttcagatatacagtagtacaaactgtttcttgggttgggcaaacagctaagcagtgccagacacaagacggaaaaccacaaggacaaagggtaataaaaggggtaaactgttcatgaaaatattattaaacttatatatgatgtcttttgatcacaggacgatcaaattatgcatcacacgggtagtacaattcctcgtcagaaaatggtaaaagaaaaagggttctattgcttatggcgaattcacatcgggccatcccggcatccagtactggaaaacaacgagtacgcactccatggcattggattcacatcggtcggtcggacgatatcttgatatatgtacgcgtttgcattcgcatgtatatgtaggaagttaaccgctggggaagattcactgctcccatgtctcgaacttgccggagacgaagtcgtagtgaccgccgaccagcttgagggttccgttggacacacccctccttgacgaacgggtaggtcaggaggttctggagggacacgttcactgcctccttgagtgagagcagagccttgattccaccgcagcggctgtggccaatcaccacgatgacctcaaccttgagagcacagacggcgtattcgatggccgatccaacaccagcgtacttgttcttgcagtaggacgggaccatgttggcgatgttgcggatggtgaaggcctcgccgggctccaggcccagggtgaccgaggggcacacacgggagtcggcacacgcgaacaccatgtacttgggcgcctggccggccttgaggggctcgaagaaatcgggcttcttgtcgtagacctcggtcttgaacttctcgaacccggtcttgaggcgctccacggcggcgtccatcttgttggagggtggaggaggtggtggatggtaggtaggcttctggaggagtgacgaggaggaagaatctatcgctgccgccgctgctgctgggttgttctccccaccgggggcggagggcttcttatagcagcaggggaggcacaggcagccgctcatcttcaactatcgcgctcgcgttcgcgactctactcttttgttttttctctcctctcccctgacggattacaatgcgggtgcgacggggcgccggcctggacgggggtgttcctgatgagcttggggcggaaggaggaggagttggagggcgcgggggtgccgaggctggcgacgatggtggaggagcgggcacggggcgcgacggttgcgtagcaccagttagccgcggcggtcgacattgtgcctcgtgccgaattcggcacgag

SEQ ID NO: 28166 - DNA, 1244 bp, Triticum aestivum
  Clone ID: PAT_TA_28166
cgcagtggttttcatgtaaaaaagcttatttctggcatgctgataagctgttgtctcctatactcggcaaatagcgttacggacgcaagtaacactggacacgcatcaacgtgcagcatcacggtataactgccgcttcatggactgtggaaggtgtctacacgagctaaatggcatcagaatcagcccatgtcaaactgaaaaaatactaagaatggtcatgcgacccgttattttggtaagcttccaccgtcgaaacctagaactggaactgcatctccttggtgtagccaaggtcatccaggtttgcagccatggctttgttcatcggaggaggcccgcatctcaatacctgaatgtcggcggcaggcgctgggcagtgagcttggatcatttcctttgacacaaacccaacaccaccatcccagacttcaggtggctgattcaggacatagtagatcttgaagcgatcaggatagtttttagccatattgtccagttcttccagcagaagaatgtcgtcatatgtgacattagcgtagatcaagtgaatttttgtattgtcgtttgggttctcaagaattgcccttgtgacttggaacattggtgtaatgcctgatcctccagctatcattccaaatgctctcacttgcccaggctggtacttgaaacggccctttggccccttcacagacatgtagtcgccaaccttcatctcacgaaaatgatgagacattcttccttggggatacatctttataacaagctcaaagtatccaatatcagaatccagtgtagtaggagtataaggcttgattacttcctcaccagtagcatcctgccctctgcagcttatatgttggccaattggaaggcccaaaactgaagtaggtgtcgggagagcaaatttgaacttggccacattatgactgatctgtctcttctgcacaagtttaaactctttgaagttctcagcatccaagcagcccttgggtttcttgctgcggaggaggaggaatccggcgccggcggccacggcgacgacggcgaccgcgacggccaccgtggtctccgtgctctgcccctgcaggaactccataatcgagcggcgggtcgctccccctcgtggattcgccgcgggtgcggggagattcgcgtggggtccgggatttatgagactggagtgggggagggaggaggagagtggtggtaggtgggggcccacgcgtccgcggacgcgtggg

SEQ ID NO: 28167 - DNA, 1335 bp, Triticum aestivum
  Clone ID: PAT_TA_28167
gatacactaacatcataataggcatgccaagactgggcatcaaaaacacttgtttagaaaacaaaactccaaagagaaaaaaaaaacaggtgctgctcaatcaaagtaaagcccagcactggccgatgaacatccaagatgacactaccagcgaattcaaagagcttttaaataggataatttaggatcttggctgatgctatacaacaaatctcatccaaatcgactaatgtagactcagtccgcatggacgccagaatttgtgaggtcgatatcgcccattcccttatcttcctcatcttcactgtcatcatcaccagcaacctccgcgttttgctcaaccagggtatccaactgggcgttcaatagcttatcttccctctcactcacagctctaggtgcttctttcactaccaactttcccttgtgtttttcaatctccgctgtgcacgctttaactgcatcagtgagaactgagatgccttggtccttgtcgagagtttgtgtagtcagtacataaagaggaggagcaactagcttaatcttcacaggacaattagtgttcccagcagcttcagctttcctcatggcttgcttaatatggagcaccccatcaaattggaaacatttcatctcaacgtcagcacggatcttgagtggctgcggtgtcatcctcctccgtatattctggaccagggtctccttaatctcaggggtgacagcaggcaccaccttagtcacctcttggcagtcagggccagtctccttctcctcgtaggtgagcacatcgaggatggcgtcggggtcggcgactatgagcttgaaggcctcgaatgcgtggccgtacttgcggtagagcggccagccgatgcgctggtagatgggctcgaggtcgatctcgagggtctcggcaacgtggcgcatgatggagtgcacgagcttggacttgttgtacttgtcctcgcaggaccgcgcctcctcctcggagacccggcgcttggagaggtcgatgtatcccttgtcgcggtcgacacggagcacgatggcgggctcctggcggccgaccttgatgagtgaggagatggaacggatgcggcggcgggagagctcggagaagaggatcatgccctcgacgttgttgtactcgaggagggagacgtaggcgcccatgtcggcgatgtgcttgacctggatcatcaccgcggcgtccacctccgggaaccgcggctcgtacatccggcactcgaggttcggcatcctctccgcctaccgggtggggagcttcgccggagttggagggggccgcggcggatctagggtttgcttgggttttgg

SEQ ID NO: 28168 - DNA, 1329 bp, Triticum aestivum
  Clone ID: PAT_TA_28168
ggcaaaatacataggagtcatcaaacacagcagtagctctcgcactgcttaccaaccatttacacggatggaaataacacgcgtacaacaacgtgggcacaacaaaatatagagcataagtctctaggagatgtcgcaaatcttaaacggtagagtaacgggtgattttacttgtgggataggaaaaccatgcagtagtacagacggcatgtgcgactcacacacaacaccatagataaattctatgttggtgataaccaaaatatgacttagtggacaagctcttgagttcaagcaactcaatgtccatgcatgggaggcttttgacaaggggcaggatttccatatgcaagcagctccatctcaagctgaactactgtacaagagtttcaagatcaagaaggagaagttgaaatctgaaagcaaggacaaaattatggagaagtatgggaatgctgcatctgacgaaccaatccctcgtgagcttcttcttgggcaaagtgagaaagagattgagtatgaccggactggtcgcataatcaaaggacaggatgtagctcttcctaagagcaaatatgaagaggatgtcctaattaataaccacacaacagtgtggggttcatggtggaaagatcatcaatggggctataagtgctgcaagcagactattaaaaatagttactgcacaggccttgctggaatcgaggctgctgaagcatcagctgatttgatgagggaaaatatggcccgcaaggaggccgccgaagaggaacctgtacgacaagaagaaaagaaactagccacttggggaacagatattcctcaggatcttgttctggaccagaagttgcttgaggaatccttaaagaaggaggcaaagaggaagaaggaagagatggacgaaagaaagaggaagtacaatgtgaagtggaacgacgaggtcaccgccgaagacatggaggcctaccgtatgacgagagtccgccatgacgatcctatgaaagattttctcaattaggagttcatgtccgctggttgcgtggcagctgttatctaatgcatgtgtaagctggccacgcctgaagtactgctgctgtctgtccattcttcgctggattgttgtgtctgtattctcggccatctctaggaagacgggatgggatggcatgccggttcgtgagttactgatgttgtgaattacagatatgatcgcgtgatgtccaaaagcagaacgaagtttgttctcatatgttctttgtaacatcctggtaaccacggcgtacgcccaattaattgatgagtaataagttcttgttgctaaaaaaaaaa

SEQ ID NO: 28169 - DNA, 845 bp, Triticum aestivum
  Clone ID: PAT_TA_28169
caaaaaaaaaaaaaaaaaacaacagttccatgacccagccaaattttaaagtagattcaaactagaacacacacaacacaccaaggacggacacagagctgacgacatgcagttcattgcacgacaatgaaacatctctagtcacacattcaccacgcacctactaattgaacagcaaatcgacgacacgacacgacaatagctcgttggagcagatgattaactaactagcagctgcaatacgactaggatcaccgagctacaaacttattaaacacacccatcagctggatctaggggttgtagaagacgatcttgatctcgtcgacgccgtggcacttgccgccggggacggagtgctcgaagcagtggccgccgctgttgcagccggcggtggggcagtggtctttcagggggtggccgtggggggtgatggagacacggatgggcatgtgcgactgggcggtgctcacctggtaccacgccccgccgtcgtacccgatgtggaactccgtcaccacggcgtcctgcaccttcacgcgccccgtccacggagcacacgtcgtacgacacgtgggtgccgtggcggagcaggaagccagggctgtagaggagcttgctgttggccagcggctcgataccgaggtagaggtccttgccgcacaggttctgcaccgtcaccttgcggctcggcttgcagttttggggatcctgaccggcggcggacatggcagtcgctgccagcgccacggcgaggaggagagccgccaggggcttggagaacgccattggctgcttggagtgttactcgctggttaggagtgaagaggagtgactgatgccgg

SEQ ID NO: 28170 - DNA, 873 bp, Triticum aestivum
  Clone ID: PAT_TA_28170
ctaaaacatcttgccatcctgacaaatcttcttgctgtaacacatccatccatttgtagctgcaggcagagcagagttgtgcgtgtgggagttgaaggagatcgagatggccacagcatatgctcctccgatggcgagccaggtgatgaagagcggcttggtgtgctccaagccgcggggcatgtccggcgcttcgctcaccaggagggccccgcctcgtcgtcaaggccgtcaagtctgacaagccgacgtaccaggtgggtccaagcccatcaacggcgacccattcatcgggcaagcctgggagacgcccgtcacctccaagccccctcgtcgcctgggtacctctccaacctccccgcctaaccgcaccgccgtcaagcccgctcctccgcggggatcgaaggtcggcctcgcccacggggtacctcctcgtcggggcccttcgcgcctcaacggggccgctcccgcaacacgcccaattcacgggcaagcaagcatctcggcgccatcgggctcgtctccatccttagcgtctgcctcaccatgtacggtgtcgcgtccttcaacgagggcgcaccgtcaaccgcgcccgcactcacgctcacaggccgcaagaaggaggccgacaagctgcagaccgctgaagggtggtcgcagttcaccggaggcttcttcttcggtggtgtctccggtgccacctgggcctacttcctcctctacgtgctcgacctcccatacttcttcaagtagattaattattggcatgcatgtacaaacacatggcaaacttctttcactaagatgttcaaaaaatatagcaaacttgccatggcaacaaaagatgttcaaaaatatggtaacctaagatgt

SEQ ID NO: 28171 - DNA, 1483 bp, Triticum aestivum
  Clone ID: PAT_TA_28171
acttattcttatgcaagtcttggtaaatgaataagaagaatcaggtagcatgtcatacaaggtacatacatctgtactactactagagcttttcagctggaaaacatatctataccggcacggtttatacaacctcccatcatatcataacttaacatctccagcgcctgaagcgctccgcatgtcaccgatccctccatcaccatcatcatcagcagcagcagcgacgttacatacataggtacacggctaagggccagccatgtcgactctcacttcatgatcgggggagaggcgtaggggccgttgagccagccgttggccaccatgcggtaggcggcctcggtcatgtggatgccgtcccagctcacgtacgccgacgggttggagcacacgctcgcgcccgcctcgccgcacttcttcttcaggttgaagttgtaggcgcccgtccctccggcgccgcagcacgcctgcaatgccgtgctgaagccgaattttccggggctcacgacgaactgcattgcggctttgaagtagtcgccgtacatgattttggtcttcgggtacttcttctgaagcgcgtcgagctgctgcttgagctccctgttgtggtggaaggccagacggttgtatctccggaggcaccccgtgcgcgcgttgtagtcggacttcttgctgctgttgtagagagtcaggtacaacgggaagcacccgatcggaagaattccaggcaccagcaggtccgtcgcgccaagctcgatcaatttctcgacgccgttggcgatggccttggcgaccagcggcacgtaggtcttcacctcggagaaggcgacgccggagaagagaggagcgttgtagtcgttccccccgaactctcccaccacgaacagggacttgctgaagtagtccctgcactctttctccgatttgcagagcgacggcttcatcttctggagccagccgatctgggtgttaatggagccggtgttccagatgcgctggtcgatgccgtgggccttgaagaaagagtactccagcgccgtggcgcccgtgatggcgaagttggcccccttcttgaagtccttgccatgcgcctgcgacgccggcggcaggggcagcccgaagtgctcggcgaggaagtcgacgacgacgcggccgttggagcagcggccggtggggcggccgaagaaggtcatgccgtagggcgaccgcgcggtggtgagcgacttggggatgccgtcgacgatgaggttgccggcgtcggagagcgaatccccgaagctgaagacggccccgtacgacttcttggcgtgcctggcgtgggcgccgcccgagaggcacgccgccgcgacgaggacgagaagcaggccccgatgctccattgccgctgccgctgctatgggtgtgggtgtgggcgtcggcgggcgacgcgcatgtgctgcgggagagagagggaaagattttttttttttttttttttttt

SEQ ID NO: 28172 - DNA, 1829 bp, Triticum aestivum
  Clone ID: PAT_TA_28172
ttttgagcttccgactcgacgatgccaaaatcttattatcaccacatgtatcgacatcactaccaaaccagtacttgagagttcagagtacaacaagcagcagcagcaactaataataattagagaaaaatttgtgcaggcatgacacctgccaaacaccatactacaggtaataaaagagctctatataacggagtcctctccctcctaatttaccagctcggatcggatctatgcaacaaactgcaatactgacggtacggcgattaatcagttcgtctccaggagaaagaccagagaggaacaatggagacccgggtctcgccacggcagcaaggaccggggcggcgctcgggtcaccatgcccggcaatggcgatcacttgacggtgcagatcttgatgacggaggccatgccaatacggtgcaggacgacgacggcgtcgccggccttgcagagctgcttcttcacggccgacttgagcgcggcctggaggatctcctccgtcgactccgagtcggtggccttggcggagccctcggcgaggagcgggatcaggcccctgtagatcaggctgtgcctggcagggccctcggagctgacggtccagtcgaacgagtcggttgtcagcactgggacgaccaccgagaggatcgggaccctgggccggtacttggcaaccagcttagctgtggtgccgccacgggtcaggacgacgatcagagtggccctggccttgttggcggtccgcacggcggaagacgcaagggactccagcgggctcatcgggaggggcgcggccttgatcatctccttgaagacggcgtcgttgtccagggaagactctgcctccacgcagatgcgagccatgatcttcacagccacctcagggtatgctccagcagcgctttcaccactgagcatgacacagtcggttccatcaagcaccgcatttgcgacgtcagtagcctcggcacgggttggcctcggggacttgatcattgactcaagcatctgggtcgctgtgacaacaggctcaccagcaaggttgcacttgtagatcatcattttctgtgcaaggaatatcttctcaactgaaatctccattccaaaatcacctctggccatgaagtaattggtttcccacaaagtgtcatcaaagtttacaatgccctcttggtttcaacctagttcagtcgctcgtagctttggagcatgcttaatcagtttgttcctcatgaaccacatatcagcgcacacatacagacacacacgcgatgtgctcagcacctcatgctgctaatcactatgtcgtacctctaagttgcaatggacacacatgtatcattgccactcaatggtttacccttgatggagcggtcttgttcaaaggctaggaaggccttggagaagaccaccttccgggtgagcaacttctgctgggactacacgttggcgcccaagtccctaaggttgccaatgctcctttgggtttgaaaaccttctcttcacagaattatagatcaatttctgaattctggaggactgtacataacgcatacttcattcaatgaatcaaccactttgttcttgcccctggccttatcaaacttatacacaagcaaatcttgcatagttggagaaaatgaatattcaagatcgagaagaacatctagaagctctcgtgcatcaatctcattaagttagttgattggttcccttacaaaaagcaagggaacttgtagttgtactgttgtagcatctccccttcaatcctgaaacttgtaaaacaaagagctgaactattttgccccttgaactattttgcc

SEQ ID NO: 28173 - DNA, 832 bp, Triticum aestivum
  Clone ID: PAT_TA_28173
ccattttaaatcggatttataaactagaaaacacacaacacaccaacgacggatacagagctgacgacatgcagttcattgcacggctatgaaacatctctagccacacattcaccaccgcaactactaattgaacagtaaatcgacacgacacgacacgacaatagctcgttggagcagatgattcactgactagcagctgcaatacgactaagatcaccgagctgcaaacttattaaacacgcccagcagctggatctaggggttgtagaagacgatcttgatctcgtcgacgccgtggcacttgccgccggggacggagtgctcgaagcagtggccaccgctgttgcagccggcggtggggcagtggtctttcagggggtggccgtggggggtgatggagacacggatgggcatgtgggactggtcggtgctcacctggtaccacgccccgccgtcgtacccgatgtgaaactccgtcaccacgggcgtcctgcaccttcacgcgccccgtccacgagcacacgtcgtacgacacgtgggtgccgtggcggagcaggtagccagggctgtagaggagcttgctgttggccagcggctcgatgcccgaggtaaaggtccttgccgcacaggttctgcaccgtcaccttgcggctcggcttgcagttttggggatcctgaccggcggcggacatggcagtcgctgccagcgccacggcgaggaggagagccgccaggggcttggggaacgccattggctgtttggagtgttactcgctggtttggagtgaagaggaggagagagagagagagagagagagagagagagaga

SEQ ID NO: 28174 - DNA, 890 bp, Triticum aestivum
  Clone ID: PAT_TA_28174
ttgagcctttactcttgcctcctgacaatcttcttgctgtaacacatccatccatttgtagctgcaggcagagcagagttgtgcgtgtgggagttgaaggagatcgagatggccacagcatatgctcctccgatggcgagccaggtgatgaagagcggcttggtgtgctccaagccgcggggcatgtccggcgcttcgctcaccaggaggccccgcctcgtcgtcaaggccgtcaagtctgacaagccgacgtaccaggtggtccagcccatcaacggcgacccattcatcggcagcctggagacgcccgtcacctccagccccctcgtcgcctggtacctctccaacctccccgcctaccgcaccgccgtcagcccgctcctccgcggcatcgaagtcggcctcgcccacggctacctcctcgtcggccccttcgcgctcaccggcccgctccgcaacacgccaattcacggccaggcaggcactcccggcgccatcggcctcgtctccatccttagcgtctgcctcaccatgtacggtgtcgcgtccttcaacgagggcgcaccgtcaaccgcgcccgcactcacgctcacaggccgcaagaaggaggccgacaagctgcagaccgctgaagggtggtcgcagttcaccggaggcttcttcttcggtggtgtctccggtgccacctgggcctacttcctcctctacgtgctcgacctcccatacttcttcaagtagattaattatcggcatgcatgtacgatgggtgcagatcatgtgatctcttctcgatggcggttgcttcaaagagtccatgtataaatgaatttacacattcctcacaatctttgcatggatcgatcgaaaaaaaaaaaaaaaaaaggccccta

SEQ ID NO: 28175 - DNA, 681 bp, Triticum aestivum
  Clone ID: PAT_TA_28175
gtcgttcctcccgtggtccacgaaccatttcccaaaatttccccactcgcgaaccctaacttcgaccagcctctcgccccagatcccctccccctactctcaccaggagcagaacccacccgctcggaccgctccgcgtaatcgccatggcggacgaggaacccgttgatcccaagaagtatcttgaggagcggtgcaagccacagtgtgtaaaaccactgtatgagtatgagaaatgtatcaagagagtcgaggccgatgatactgggcacaagcactgcactgggcaatattttgactactggtcatgcatcgataaatgtgtagcaccaaagctctttgaaaagctgaaatgatattggggcgctactttcagtgagtgagcctggtcattggccagaactttgttcaagttgaaatatttgacgagtctgcaaattgtcctgtgactgtgtttcgatttcatgaacttgtaataagagcaactatcttgacactgtttgcaaccattgatttatgtttggctaagcactgatgacaactataacaatttgatgtctgtcgatacagttctggtactgaacatttttctcgtcgagatcatatccaacacaaatagacaagatttcaacaaaaaaaaaaaaaacctcggccgcgaccacgctaatcactagtgaattc

SEQ ID NO: 28176 - DNA, 1463 bp, Triticum aestivum
  Clone ID: PAT_TA_28176
accaaattccacttagtgagcaacgataagcaaaatccatgtataaatgctgatgaaaacaggtagcaaaagcgcaattaacagtattcagaatcagtgctcagcgaaaagcaaatcaatctgtaagactacgggtagcctacaactgatcatcaatatctaataacagagtaaacactcgtccatccatccaacgtgcctcctcaaacaaacaggaggagccaaacattcttccccttcattgctggcgctgtacaagcaatctcatcccacctgggaggagacccgctcagtccgcgccagcgccagcctttgtgaagtctacgtctcccatgccagagtcctcctcctcgctatcgtcgtcgccgtcgacctcctcacctgctagcttgagcttctcaatcgtgtccgcaaacagcttgtcgtctctctcgctcacagctctagctgcttccttcaccaccaatttccccttgtgcttttcaattgcctcggcacaaattttggttgcatttgtcagaactgctatcccctggtctttgtcaagtgtctgtgtggtcagaacataaagcggaggagcaactagcttaatcttcacagggcaatcagcgtttccagcagcttcagctttcctcatggcttccttaatgtggagaacaccgtcaaactggaagcatttcatctcaacatcagcacgaatcttaagaggctgtggtgtcattctcctccttatgttcttgaccagggcatccttaacctcaggggtgaccgccggcacaactttagtcacctcctcgccatcgggtccgacgacggtctcctcgtaggtgaggacgtcgagcaccccgtcggggtcggtgacgatgagcttgaaggcctcaaaggcgtggccgtacctgcggtagagcggccagccgatgcgctggtagaggggctcgaggtcgacgccgagggtgtcggcggcgtggcgcatgatggagtggacgagcttggacttgttgtagcggtcctcgcaggtggcggcctcctcctccgagacccggcgcttggataggtcgatgtagcccttgtcgcggtcgacgcggagcaccatggagggctcctggcggccgaccttgatgagggaggagatggagcggatgcggcggcgggagagctcggagaagaggatcatgccctcgatgttgttgtactcgaggagcgagacgtaggcgcccatgtcggcgatgtgcttcacctggatcatcaccgccgcgtccacctccgggaaccgcggctcgtacatccggcactcgaggttcggcggcatcttcgcgggcggcggcggcggccggaggcggtggggggacggggtggggtggggaggggagctagggttttgggggtgcggcggagacgggcgaggggcagccgggttatggattggttggattggcgagcgagccggacgcgtgggtcgaccc

SEQ ID NO: 28177 - DNA, 1542 bp, Triticum aestivum
  Clone ID: PAT_TA_28177
aaatccaaaaaaaaagcctctccccctccccgtcgccgccgccgccgccgccatggccaccaccgcgcgcccgctcgtctccgtcaaggccctggacggggacatggccaccgacgcggccggcgtcccgatgccgcacgtcatgaaggcgccgatccgccccgacgtcatcaccttcgtccacaggctcgtctcctgcaacagccgccagccctacgccgtctcccgcaaggccggtcaccagacctcggccgagtcatggggcacgggccgcgccgtctcgcgtatcccgcgtgtcggcggcggcggcacccaccgcgccggccagggagccttcggcaacatgtgccgtggcggggcgcatgttcgcgcccacccggatctggcgcaagtggcaccgccgcgtcaacgtccgcctccgccgcgtcgccgtcgcctccgccctcgccgccaccgccgtccccgccatcgtcaccgcccgcggccaccgcatcgagtccgtccccgagttcccgctcgtcgtctccgactcggccgagggcatcgagaagaccgcccaggccatcaaggtcctcaagcagctgggcgcctacgccgacgccgagaaggccaagcagtccgtcggcatccgccccggcaagggtaagatgcgcaaccgcaggtacatcaaccgcaagggccccctcatcgtctacggcaccgagggctccaagatcgtcaaggccttccgcaacctccctggtgtggatgttgccaacgtcgagcgcctcaacctgctcgaccttgcccctggtggccacctcggccggtttgtgatctggaccgagtctgccttcaagaagctggacgaggtgtacggctcctttgaggcgtcttcctcaaagaagaagggcttcgttctccccaggcccaagatgaccaatgctgaccttggccgcctcatcaactctgatgaggtccagtctgtggtgaagcccatcaacaaggaggtcaagcgcagggaggccaggaagaaccctctgaagaatgctgctgccgtgctcaagctcaacccctactttggaactgcccgcatgatggcggttcttgctgaggcagcccgtgtcaaggccaggaaggaaaagatcaactccaagaggaccaagctcagcgcggaggaggcatctaagatcaaggctgcagggaaggcctgggtaccagaccatgatctctgacagcgactacaccgagttcgacgtcttctccaagtggcttggcgtcagccagtgatcgtctagttgaagtagtagcagtctatcgtcctaccttaagagaccctaaagtatgatcttgtgtcatgttatcgtttatccggagtctgagacatcttatgctgttttggcagctgtttatctcgagtgttttatctatggacgcattttgggagacatgttatatggcatgctttatcgtcgtcgagttcttagttcagattttgagtcgtgtttttcatatatactttgttatgaatgcgaaataatttttggcaaaaaaaaaaaaaaa

SEQ ID NO: 28178 - DNA, 1393 bp, Triticum aestivum
  Clone ID: PAT_TA_28178
cccacgcgtccgcgcgagggcaactgggacctgctcggcaacaacttccccgtcttcttcatccgcgacggcatcaagttccccgacgtcatccacgccttcaagcccaaccccaagtcgcatgtgcaggagtactggcgcgtcttcgacttcctctcccaccaccccgagagcctccacaccttcttcttcctcttcgacgacgtcggcatccccaccgactaccgccacatggacggcttcggggtcaacacctacaccttcgtctcccgtgccggcaagtcccactacgtcaagttccactggcgccccacctgcggcgtcagctgcctcatggacgacgaggccacgctcgtcggcggcaagaaccacagccacgccacgcaggacctctacgactccatcgacgccggcaacttccccgagtggaagctgttcgtgcaggtcatcgaccccgacgacgaggaccgcttcgacttcgacccgctcgacgacaccaagacatggcccgaggacctcgtccccctccagcccgtcggccgcctcgtgctcgaccgcaacgtcgacaacttcttcaacgagaacgagcagctggccttcggcccggggctcgtcgtgcccgggatctactactccgacgacaagatgctgcagtgcagggtgttcgcctacgccgacacgcagcgctaccgcctcggcccaaactacctgatgctccccgtcaacgcgcccaagtgcggcttcaagaacaaccactacgacggcgccatgaacttcatgcaccgcgacgaggaggtggactactacccgtcccgccacgcgccgctccggcaggccgagccggccagcttccccgtgccgacgaggcccgtcgtcgggaaaagggagaagacgaggatcaagaaggagaacgacttcgtgcagcccggggagaggtaccgcagctgggcgcccgaccgccaggacaggttcgtgcgccgcttcgccgacgccctcgcccaccccaaggtcagccacgagctccgcgtcatctggatcgacttcctctccaagtgtgacaagtcgtgcggtatgaaggtggccaaccgccttaacgtgaagccaagcatgtgatgatggatggaccgttctaaactttgtgctatacgtacgcatcatggaccagcaataagagaccatgccagctataatgtggatcatgtggtcgattacctactgtgctgctactaataagttactatcattttcttttatgtcgcagtaacttacctgtaatccagcaaatgaaattaaagtgggtgctttggagcgtatgaatccaaacgtgtattcgtctttgcctcggatgatatttgctgttctggatggaacaaaatgactttgttttcggttt

SEQ ID NO: 28179 - DNA, 1137 bp, Triticum aestivum
  Clone ID: PAT_TA_28179
agaacctccccctctcctagtctcgtctcccacaagccgcaaacccatcttcccctagcccaagcaaaccgcacacgccaccatgttcctcacgaggacggagtacgaccgcggcgtgaacaccttttcgccggagggacgcctattccaggtcgagtacgccatcgaggccatcaagttgggatctactgcaatcgggttgaagacgaaggatggggttgttcttgctgtggagaaacgtgtgacgtctccgttgctggaacctagcagtgttgagaaaatcatggaaattgatgagcatgtaggctgtgccatgagtggccttattgctgatgcaagaacattggttgagcatgctcgagtggagacccaaaaccatagattctcatatggggaaccgatgacagttgagtccaccacacaagctatttgcgatctagctcttcgctttggagaaggtgaagaagagtctatgtcacgaccttttggagtttctctccttattgctggtcatgatgaaaatgggccgagcttgtactacactgacccatctggaaccttttggcagtgcaatgccaaggcaatagggtcaggctctgagggtgccgatagttccttgcaggagcagttcaacaaggagctgacccttcaggaggctgaaaccattgctctatctatcctgaaacaggttatggaagaaaaggtgactccaaataatgtcgacatcgccagggtcgcgccgaactaccacctttacacccccgcagaggttgaagcagtcatagcacgattgtgaaacgcagaaatctttgtcgaatgtcaaccaggattcgtatgttccttgtgctgtgtgtctgacatccagatgccttcaaattagcagaagcacaattgctctatgatatggacactgatgtttgcctcttttcatttgattatcttgtgttaacaaggtgtagaggcctagctgttgttgccttgtcacttgccggtaaggagattgtactacacccttttgtttgatatacgaaggatttgtggcaatagcatgcagtatttcagcaacaactgtcgtttgcactgtatgttttggattgttgaacatagcgatttttcttcaaaaaaaaaaaaaaaaaa

SEQ ID NO: 28180 - DNA, 830 bp, Triticum aestivum
  Clone ID: PAT_TA_28180
gagttgttcagacttctatagcaacaattccatcaaccaaaataaacttttatatcagcaacagcaacagaaattctgtcgcaattaatttgggaaggggcacaagaaactgctacaggcaatggacatgaaacccgaaggaggaacagtgtcataatctgcattttatttcatgcattgtgatgctacaaggagcaaaagctgtggcgcatatcaaggaagatgtcttcaaggaagggttctctcatagagaggaagggctcccagtgctttacgctctgctgcctcctttttcaccagagccagcatgtcgctcaaatagcttttgaatggtgtctgtagtgcccggacgtcgtcggggaggtactggtgcttcatggagaggtccatggcgcgcttgagacgctggtggcgggcgtcgaccacctcccggggcagcctgcagagcgcctccttgatgtccagatcgaagtaggggtcatacaggtcgtcgtacctcaggccgtagttcttgaggcggttggagatggtgagcatgtggatgcgggccagcgggttgcggcgcgggttcacgaaccacgacgagaacgcggacagcatcgacgtcatcctgggcgacggcggcggcggcggcggcgatcccctctctcggtctcctctctttctgaagccgccgccgccgaagaggagaggagaggggaaggggaatacaagaaggagctggcgctgtcgctgctcctgctgacggccgccgctcgcagcctgctgacgaagcagggtatacacttctacttcctgctgttgccagggcatctccttcttgttagtag

SEQ ID NO: 28181 - DNA, 1197 bp, Triticum aestivum
  Clone ID: PAT_TA_28181
gaaaaagccactacagtccgtccgtcctccccaagaaaagaaaactccgtccctaccccttatataaaaagaaaagaagaagaagaaaactctatcccaaggagaaactcgccgccgtctcctctcctctctactagtacttggttccgaagaagaaacaccaccaagcacccaccccgtgtagtagaaatagaaacaagtgcttcgaattgcgatccgcatccgccgacacgatgtttctcacgaggacggagtacgaccgtggggtcaacaccttctccccggaggggcggctgttccaggtcgagtacgccattgaggccatcaagttgggctccactgcaatcggcttgatgactaaggatggtgttgtactggctgttgagaaacgtgtcacctcaccgctgctggaaccaagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagagtctaccacacaagctatctgtgacttagctttgcgctttggtgaaggtgatgaagaatcaatgtcacggccgtttggagtctctctccttattgccggtcatgatgaaaatggacccagcatgtactacacagacccgtcggggaccttctggcagtgcaatgccaaggcaattgggtcgggctctgaaggagctgatagctcattacaagagcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaggcggtcatcgcgaggttgtgaaggattgccactttgtgagacagcctcttgtattcccatgaaccctaaagcacaatgaacgtatgaactctgttgtgggtttgggttgtctgcctactgttgaagggatattagtgcctgcttgggcgttgcatctgattctcatctcccagtccagtcatgtctttgtagcactaagacgtgtcaccaaaaagaattactacacatatttttcagcatttccagcaagtgcgtaggtaaaaaaaaaaaa

SEQ ID NO: 28182 - DNA, 1581 bp, Triticum aestivum
  Clone ID: PAT_TA_28182
atcactaatggggaacaaaagctggagctccacccgcggtggcggccgctctagaactagtggatcccccgggctgcaggaattcggcacgaggccgcaccccagcccctaccccgcagccgccgccgccatggccaccaccgcgcgcccgctcgtctccgtcaaggccctggacggggacatggcaaccgacgcggccggcgtcccgatgccgcacgtcatgaaggcgccgatccgccccgacgtcatcaccttcgtccacaggctcgtctcctgcaacagccgccagccctacgccgtctcccgcaaggccggtcaccagacctcggccgagtcctggggcacgggtcgcgccgtctcgcgtatcccgcgtgtcggcggtggcggtacccaccgcgccgggcagggagccttcggcaacatgtgccgtggcggacgcatgttcgcgcccacccggatctggcgcaagtggcaccgtcgcgtcaacgtccgcctccgccgcgtcgccgtcgcctccgccctcgccgccaccgccgtcccggctatcgtcaccgcccgcggccaccgcatcgagtccgtccccgagttcccgctcgtcgtctccgactcggccgagggcatcgagaagacctcccaggccatcaaggtcctcaagcagctgggcgcctacgctgatgccgagaaggccaaggactccgtcggcatccgccccggcaagggtaagatgcgcaaccgcaggtacatcaaccgtaagggccccctcatcgtctacggcaccgagggctccaagatcgtcaaggctttccgcaacctccctggtgtggatgttgccaacgtcgagcgcctcaacctgctcgaccttgcccctggtggccaccttggccggttcgttatctggactgagtctgccttcaagaagctggacgaggtgtacggctcctttgaggcgtcttcctccaagaagaagggcttcgtgctcccaaggcctaagatgaccaatgctgaccttggccgcctcatcaactctgatgaggtccagtccgtggtgaagcccatcaacaaggaggtgaagcgcagggaggccaggaagaaccctctgaagaatgctgctgccgtgcttaagctcaacccctacttcggaactgcccgcaggatggcagttcttgctgaggcagcccgtgtcaaggccaggaaggagaagatcaactccaagaggaccaagctcagtgcggaggaggcatctaagatcaaggctgctgggaaggcctggtaccagacgatgatctctgacagcgactacacggagttcgacgtcttctccaagtggcttggcgtcagccagtgatcatctcgttgtagtagcagtttatcgtccctaaagtatgattttgtcattaccgtgtcatgtaatcgattatcccgagtctgagacatcgaatgctgttttgctagctgtttatctggagtgttttatctgtggacgcattttgcgagacatgttctatggcatgctttaccgtcgagtcgttagttcagattttgagttgcgtttttcatatatatatatactctgtcgtaaaa

SEQ ID NO: 28183 - DNA, 2087 bp, Triticum aestivum
  Clone ID: PAT_TA_28183
ttttgttttttttttttttttttttgatcggaaaagcgcaccatattgctgcaacaacgaccagagtcaccagcaagttaaattgttgtcatagatatcgccagattatgatatatcgaggtctcctttaagtcgaaaatacgacagtacgtactcgataacgcattcaacagctcctaaggctaagttccagctaagtcaaacacaaaacgaaacagtctcgaaacggtcacatgacttcacccttcagacacccatagcatctgcagacaacgattcatcaggacccaccaaagccaaccaaggcctcagttctcctcgtcgtcgtcctcctcagcatcctccccatcagatccctcttcatcctcgtcatctccttcaaactcttcaacctcattgttgaaatatttcaatgggttcggccacaaatcttctttgatgatctctgccacctcatcttgcaccccatcagcaaggctcttgtgctctgtatcagtgaaccaggtgaagaaactttcttcaaccaatgggcgcttgcttcctttcttcttaatggcattcccattaatttccattccctccttccacttaatggaagtggcatttattgtggttgttccatcatcagcaaaggcatatgacttggtaagctttctgtcttcaaagtacggattctcagagaagttaagagtgatggagtagcctgacttgacatctttagaatcatcaacatcaacagattccaagtacttgaacatcttttgatcctcttcagtcaaaagctcactgagaagaggatgacttagaaacgctgtcagccaaaagtctggaattgttttgatgatgtcacacctccgaagatagacaggtctgcgaatctcactgtacttctgctcaacctccaaaaccttatcacttgcttcttcattaaccttctcgagctcgtcctggatctcctggagcctctcgatggagaggacgagggccccgtcgatctgctcgttctcctcgccgacgtcggtatcggtcttggccttcttccccttgtccgccggcgccgtcatagtcgcctgtctctagggttttagcctccgacctgcgccgcgagagcgagagggagtgtgtgcgtttgttaagagtttcaagatcaagaaggagaagttgaaatctgaaagcaaggacaaaattatggagaagtatgggaatgctgcatctgacgaaccaatccctcgtgagcttcttcttgggcaaagtgaaaaagagattgagtatgaccggactggtcgcataatcaaaggacaggatgtagctcttcctaagagcaaatatgaagaggatgtcctaattaataaccacacaacagtgtggggttcatggtggaaagatcatcaatggggctataagtgctgcaagcagactattaaaaatagttattgcacaggccttgctggaatcgaggctgctgaagcatcagctgatttgatgagggaaaatatggcccgcaaggaggctgccgaagaggaacctgtacgacaagaagaaaagaaactagccacttggggaacagatattcctcaggatcttgttctcgaccagaagttgcttgaggaatccttaaagaaggaggcaaagaggaagaaggaagagatggacgaaagaaagagaaagtacaatgtgaagtggaatgacgaggtcactgcggaagacatggaggcctaccgtatggacaagagtccgccacgacgatcctatgaaagattttctcaattaggctttcatgtcccctggttgcgtggcctatgcctgaactccttctgctgcctgtccatcctttgccggattgttgtgtctgtattctctgggtgtctaggaagacgggatgggatggcatgccagctcgtgagttactgatgttgtgaagtacagatatgatcgcttgatgtccaaaggcagaacgaagtttgttctcatatgttctttgtaacctccttcctggtaaccatggcatacgccactcatatggatatttgtaccgttcacgagtaataagtgcttcttgctaaaaaaaaaaaaaaaaaaaaaaaaaa

SEQ ID NO: 28184 - DNA, 797 bp, Triticum aestivum
  Clone ID: PAT_TA_28184
cctccacccgcccactcgctcagagcctcagaccacccgtgtggaccgggcccgtccgcgaatctcagcccttaaatgggcgtttccgcaaaaacgccgtcccccgtaacaaatcgaagagtgggtctctctctcccggcggcgcaggcgtttctctccttctcctccggcggcggcaaggcattttggcatcttgagcccaacagctagcagatggcaggcggcagagttgcacatgcgaccctcaaggggccgagcgtggtgaaggagatcttcattggactcacccttgggctggttgctggtggtatgtggaagatgcatcactggaacgagcagaggaagacccgatccttctatgacatgctcgagaaggggcagatcagcgtcgttgtcgaggagtagttctgaagtgctgaaccagaagttctacatctcgaagtcttttgtcattttggttttgccagtaatttctgaaactctctggagagcatgacagagtgattgctgtggagattgtcatgaaaataagcacaccaccatttgagaacatcgaatcattttgaatttgctttttgtcctatcaaatatgtcttgtctcatatgtgttgcaaacaaattcagggtttggaaggcttccctctgacatgaatatgatttaggtttcactgtcatccttttggaagtgagctcacccttttggcttaatgcaatggtgggatgcctaacaagctactccttgtgtttgatattatcatgaatggaacaagcaccatcattatgacttataactggcg

SEQ ID NO: 28185 - DNA, 1566 bp, Triticum aestivum
  Clone ID: PAT_TA_28185
acacaggcggcacagaaacagcagcatcaagtcaaatgcaaggttccagctttccaaaccaaggtaaggtacaaagacaacaagggtacactcccaacatcacccgccctcactttggggcattcatgatgcatcacaacagtatcccccgtctttcggggtttccccgctgacggcgggcatactgcactacaaatacataaatatgaagaagaacatacacatcaccaagattacggacagacggcaccgacacagacaggctcacatctttagaggcctacttcttccgagtaccaggtcctttctgggggaaatgcaaccaccaaccaacagcttgcgctttcatggacgaaggacggaacagatcattgtgaaaacatcttccacaacttacagggatgatatttactaaaaagaaccacagagcaaccacaaccatgttccgaagccgatcaggcgtcttctgtcttgcacaggtctagcagtgacagtgtctctgctatggagagctccaggcggaatttaggaccatcatagtggtgcagcactggcctgaaagcatcctcttccaaggccttgcaaagccttctaatgcggatcctcaccctgtgctgggaatctggattcacctttgcacttcttatcttcccaagcagtgggatcaatgtttgatcctccaaaactggcagcctcaaacaccccatgtagctgatgggtcgtgtagttgtagaggaaaagaggtagaccaggagtgatggctcggactgaatcacgatatcttgctggcaagccaaaaagctgtctcttgagatcctcctgcatggtatcattgttgcagacaaagatgtatccaccaagaacttcattcctcggtagcatctcgcttgttggcaatgttttgaagcgcttgtcaacagagttgttgttgctgttgcctccattgttgttgttaccaccattgtgtttgccgtttgtttccttcccattctgattattgggatatttgttgaccccaacattcatcttgaacgaattgacattaccgttgtttcccttggggtacatcggattcatgttataggccatgttgcggaaagggtacttcatggcagcctcgttcatcttgagatcattcatcttaagatccaggttcatcaagccaagattgaggtggtccatcttgttgtcttcttggtggtaggatagcttatcccattgcttgacatcagggacggtgttcatccgtgcatactcaaagtcattcatcctctcagcctttgactttgtgatctcagcaagctttgatgtcatgagagaccattggcggtcctccaccacctttgattgcccacggaactcatctccgagatgccacaagttgtccatagctcagttcaagctctctgctcgattcggcgccggattccggcggggagggcgctggatttggggaaactgctgcggggaaggggaagaggaggataggagtcggctcggctggcttggcgttggctcccacttcgctccgcccacacagagtccaccggtcagagagattgagag

SEQ ID NO: 28186 - DNA, 1378 bp, Triticum aestivum
  Clone ID: PAT_TA_28186
cacgcgcgagggcaactgggacctgctcggcaacaacttccccgtcttcttcattcgcgacggcatcaagttccccgacgtcatccacgccttcaagcccaaccccaagtcccacgtgcaggagtactggcgcgtcttcgacttcctctcccaccaccccgagagcctccacaccttcttcttcctcttcgacgacgtcggcatccccaccgactaccgccatatggacggcttcggcgtcaacacctacaccttcgtctcccgcgccggcaaggcccactacgtcaagttccactggcgccccacctgcggcgtcagctgcctcatggacgacgaggccaccctcgtcggcggcaagaaccacagccacgccacccaggacctctacgactccatcgacgccggcaacttccccgagtggaagctcttcgtgcaggtcatcgaccccgacgacgaggaccgcttcgacttcgacccgctcgacgacaccaagacttggcccgaggacctcgtccccctccagcccgtgggacgcctcgtgctcgaccgcaacgtcgacaacttcttcaacgagaacgagcagctcgccttcggccccggcctcgtcgtgcccgggatctactactccgacgacaagatgctgcagtgcagggtgttcgcctacgccgacacgcagcgctaccgcctggggccaaactacctgatgctccccgtcaacgcgcccaagtgcggcttcaagaacaaccactacgacggcgccatgaacttcatgcaccgggacgaggaggtggactactacccgtcccgccacgcgccgctccggcacgccgagccggccagcttccccgtgccgacgcggcccgtcgtcgggaaaagggagaagacgaggatcaagaaggagaacgacttcgtgcagcccggggagaggtaccgcagctgggcgcccgaccggcaggacaggttcgtgcgccgcttcgccgacgcgctcgcccgccccaaggtcagccacgagctccgcgtcatctggatcgacttcctctccaagtgtgacaagtcgtgcggcatgaaggtggccaaccgtctcaacgtgaagccaagcatgtgatgtggatggatgatggatggaccgttctgtgtgtaaactttgtgctatatataggtatcatggaccagcaataagagaccatgccagctataatgtggatcatgtggtcgattacctaccgtgctgctactaataagttactatccttttcttttatgttttttttggggtgatccttttcttttatgttgcagtaacttacttgtaatccagcaaacgaaattaaagtgtgtgctttggagcttgcaaaaaaaaaaaaaaaaaaggccccta

SEQ ID NO: 28187 - DNA, 1520 bp, Triticum aestivum
  Clone ID: PAT_TA_28187
tttttttcacttagcaccatagctctgtagaaatgggaagcgtaaacccagaagcaaacaacaaaacagttgctcaacggaaaagtccccaagagcagagagttgttcagacttctacagcaacaattccgtcaaccaaaataaacttttatatcagcaacagcaacagaaattctgtcgcaattaatttgggaatgggcacgagaaactgctacaggcaatggacatgaaaccggaagtaggaatagtgtcataatctgcattttatttcatgcattatgatgctacgaggagcaaaaactgtggcgcatatcatgaaaagaagtcttcaaggaagggttctctcgtagaggggaagggctcccagtactttacgctctgctgcctcctttttcaccagagccagcatgtcgctcaaatagcttttgaatggtgtctgcagtgcccggacgtcgtcggggaggtactggtgcttcatggagaggtccatggcgcgcttgaggcgctggtggcgggcgtcgaccacctcccggggcagcctgccgagcgcctccttgatgtccagatcgaagtaggggtcgtacagatcgtcgtacctcaggccgaagttcttgaggcggttggagatggtgagcatgtggatgcgggccagcgggttgcggcgcgggttcacgaaccacgacgagaacgcggacagcatcgacgtcatcctgggcggtggcggcggcggcggcggcgatcccctttcgtctcctccctccctcgtctgccgccactccctcccacctcctcctcctatgccctaggagccccgccggcgactgctactcctccaccgcctcgcctcttcctcctcctcgccttcccatcgctcgtcttcaggccgcagcggtggttcccgatctgagccgtcttcaggtgcgtggagcgacggaggtcggctccctcctccacggtcgcgcggcgggagaggagatcagccccggtgctctgcctctccatccgtctccgcaagctatcgtccgatgccgtcattgcccgccatcatcttcatcttgctcgctgcctgcttgctagagagccatggctttcctcgctgtaggttctggcgttctgccatggcttttcttgtcccgtcccactcgcctccccctcctcgtcaccctcctctctctctctctctctttctcgctcactgccaagaagccgccggaggaggaactcgacctggacgaccgccgctggacgaagagccccgaaaaaatcccccaaccacccctgcgccaccgcctcttcaccttcgaccacgggttgcaacgtacggtcagaggaccaagttggagcatactaggtaaatgggccttgccgtgagtcgtggtgcaacagtgacctcgatgggcagggcaatggtcagatacgagtcagcaccaaagatgactgtgagcactcaaaaaagtttaccacgctagagctatgtcaggttgtacgggggcagggaatgaaaatacttgtgacacttt

SEQ ID NO: 28188 - DNA, 1075 bp, Triticum aestivum
  Clone ID: PAT_TA_28188
gccggccgggctgcgaaccacgcacgcgcgcgctcgccttccccactacaggcacagccagcgagcgcactggtggtacaacgatggcgctggtctcctcctcctccgccaccgccgtcgcggcgctccccagcaatgggctggccggcgcccggagctccttccttggcgctgccggcaaggcggcggggtcgcgcgcgtcgttcgccgtgcgcgccgcggcgcccgagaggcccatctggttccccgggagcacccctccgccgtggctcgacggcagccttcccggagacttcggctttgacccctggggtcttggatccgacccggagagcttgcggtggaacgtgcaggcggagctggtgcactgccggtgggcgatgctgggcgcggcgggcatcttcatcccggagctcctgaccaagatcggcatcctcaacacgccgtcgtggtacaccgccggggagcaggagtacttcaccgacaccaccaccctcttcatcgtggagctcatcctcatcggctgggccgagggccgccggtgggcagacatcatcaagcccggctgcgtcaacaccgaccccatcttccccaacaacaagctcaccggcaccgacgtcgggtaccccggtggtctgtggtttgacccgctcggctacggcaccggctcgcccgagaagctcaaggagctccgcaccaaggagatcaagaatggccgcctcgccatgctcgccgtcatgggcgcgtggttccaggccgagtacaccggcaccggccccatcgacaatctcttcgctcacctcgccgaccccggccacgccaccatcttccgggccttcgcccccaagtaaggaacacgttgggagttagcaactaatccgaggagtgtgctaccacggggaagaagatcgctggtggaacttgactttttttttccgtggaagtaaaccggatgatggtatgtaattgtggagcaatgcatgcttgttggatgtgtacttgtaccctggtgttgtaaccgatgtaaagaatgaatacccttttgaacctaaaaaccaaaaaaaaaaaaaaaaaa

SEQ ID NO: 28189 - DNA, 1080 bp, Triticum aestivum
  Clone ID: PAT_TA_28189
gtggtcgcggccgaggtacatatgtttttaccaataataacagtggggtgtgtgcatgatacagaataacatccagtctgtctggtagcaccgatgtaggatacacatatatttagactacaataggcaaggggtggcatttttatatagacattgactgcctgatatgacccatccagaacacacataatctacaataggggcagaacagatgcatatttgcaccaactcagaaagcatggcaataactcaatctctcatcatgccatcgatattgcatgggaggggccccatctcatactgagatgtattccagatcttaagtcgatgttttttttttttttttttttttaagcaacgggaggagattattaggtccatgaggaagcaggcaaatacatataatcgcagaggtattacacataaggtttgtgagaggctaacattcacatcgtcacttgacgagctactgatacaaacattggatggagcacacggcagcttagcctcgttcgcttaagcagcaacctccttgatctcgtccagggcgtagttgttggtcgacacgccggcgtagttcaccttggcgaaacgcaccaccaccgggtaacgggtgttgggatcctgatcaaccgtgacgacggatccggtcccgttgtaccagtaggactccctcctcagaatcttcaccttggtgcccctcttgggtcccctcggcggcggcttggctttggcgggctctttggtggccacggcgccttccggtttctcctccgcggccggtgctggctccgccggcgcggcggcagtcggctcctcctcggcgcgggccacgagcttcaagcccagccggttggaggggacgaagctgacgcggctgctcacgccgccgttggtgccgctggggatgcccgccgccagcatgaatctggaggtggccgacgccatgttggtgcttgccatcgggacggcagcaagtgttgtttgtcggtgctagcttagctccttccttgtggtcgtgtggctccggccagcaaaagtatgtaagtcgacggtgaggtgtaaggcgaaataaggtgc

SEQ ID NO: 28190 - DNA, 1091 bp, Triticum aestivum
  Clone ID: PAT_TA_28190
agaaaggtggaagataggtgagcccattgattagatcaaagaaaaatagacaatgcaggtcacagagtagcacagtacagggcccagtaccaagaaaaacacagacgagttacatcaaagttcagacttcagaatcatggtccccctcctcactctctccaacactctcttcttcctcgcagaaacgccggctcaatcaatcacaaagcgacacacgacgcacgcacacagacaccattgccacacatcgcacacggttttatttggacacagcaacattattcgccaccagcggcagaggactacgacgacgacggacggacggacggacgacgactacgacgactcggcgggcttgtccccggactaatccatggcgatgtgtcgatggcaatgcggcagctctcctggcacctcatctaccaggggaggatcttccagcgctggttgtcgccctcgcaccacttccagagcacgacctcggtgccgtcgtggacgccgccgtgggccttgtcgccgtggaaggcgtcgaagttgaggtagatgttgttcaccatgcgcacgcagcggaagcccttgcccacgtcgcggctctccgtccacagcaccgactcgtcctggtacgccgggttgtacggcaccagcttcacggggtggccctggccggtggagtgcttgatgcattcgccggtgaccttgttcactattgcgaaggcagggtacccttcctcgtccctgatcttgttgctgtgcctcatgtccttgatccagtgctggtagtcgtccctggggttggtgggggcgaggcagacggtgccgttgcgggcggtgaggctgtagtcctcgccggccttgcagaagatgcgcacggcgtgcacggggggcccgccgcccatggcgtgggcgttgttgcccatggtggcgccggactcgacggcggcgtgcgcctcggcccacggccagatcttccagcactggttgtcccccttgcaccactcccagagcacgacggtggtgccgtcgtgcacgccgccgtggtccttgtcgccgttgagggcgtcgaagttgaggcgggtgttgttgaccatgcg

SEQ ID NO: 28191 - DNA, 807 bp, Triticum aestivum
  Clone ID: PAT_TA_28191
gacattcacagcacatgcagatcactgcaccacagctctgtagaaataggcagcgtaaacccggaagcaaacaacaaacagttgctcaacggaaaaggcccaagagcacagacttgttcagacttctatagcaacaattccgtcaaccaaaacaaacttttatatcagcaacagcaacagaaattctgtcgcaattaatttgggaaggggcacgagctacaggccatggacatgaaaccggaaggaggaacagtgtcataatctgcattttatttcatgcattgtgatgctacgaggagcaaaagctgtggcgcatatcaaggaaaaatgtcttcaaggaagggttctctcgtagaggggaagggctcccagtgctttacgctctgctgcctcctttttcaccagagccagcatgtcgctcaaatagcttttgaatggtgtctgcagtgcccggacgtcgtcggggaggtactggtgcttcatggagaggtccatggcgcgcttgaggcgctggtggcgggcgtcgaccacctcccggggcagcctgccgagcgcctccttgatgtccagatcgaagtaggggtcgtacaggtcgtcgtacctcaggccgtagttcttgaggcggttggagatggtgagcatgtggatgcgggccagcgggttgcggcgcgggttcacgaaccacgacgagaacgcggacagcatcgacgtcatcctcggcggcggcggcggcggcgatcccctttcgtctcctctcttcttcggcgtttgtgatttggcgagcggaggaggggaggtggggggggc

SEQ ID NO: 28192 - DNA, 811 bp, Triticum aestivum
  Clone ID: PAT_TA_28192
ctgtgcatgctgtattgctctgtgtagccttccggtaacatgaacaaccgatcttttgtacaaaagtgagcaagaatgcaatcatcttaagcaacaggaggagattattaggtccatgaggaagcaggcaaatacatataatcgcagaggtattacacataaggtttgtgagaggctaacattcacatcgtcacttgacgagctactgatacaaacattggatggagcacacgcggcagcttcgatcgtttaagcagcaacctccttgatctcgtccagggcgtagttgttggtcgacacgccggcgtagttcaccttggcgaaacgcaccaccaccgggtaacgggtgttgggatcctgatcaaccgtgacgacggatccggtcccgttgtaccagtaggactccctcctcagaatcttcaccttggttcccctcttgggtcccctcggcggcggcttggctttggcgggctccttggtggccacggcggcgtccggtttctcctccgcggccggtgctggttccgccggcgcggcggcagtgggctcctcctcggcgcgggccacgagcttcaagcccagtcggttggaggggacgaagctgacgcggctgctcacgccgccgttggtgccgctggggatgcccgccgccagcatgaatctggaggtggccgacgccatgttggtgcttgccatcgggacggcagcaagggctgtttgtcggtgctagcttagctccttccttgtggtcgtgtggctccggccggccagcaaaagtatgtgagtcgatggcgaggtgtaagctcgtgcc

SEQ ID NO: 28193 - DNA, 1008 bp, Triticum aestivum
  Clone ID: PAT_TA_28193
caaactgaatatcgaaaaggttaagactgcaccaagcatcgagaattgggaagaacagggtactaggatcacatatggttttacagatgcagtactaaaaaataactggatagaggaaaccgcacaagtactgcggtttcagtagactcaaaaagcaaaaacaaagcacagaagacatcaaaagacccgactagtattaactcagcacatatttctgtatgccataccaaaataccaatcactagacgccaattcagcgtgtccacggcgatgttgaaaccctgcttccttctaaagagaaggaattcaattatccaagatacaaccaccagcggcagcagcaggaatgatagactccttcatacccacgtctcaagcagaggccttgtcaaacttgaggggcttcacaacctcccaggtgaagtcagcatcctcacggccaaagtggccataagcagccgtcttgatgaatctgttgccacccttcttcaagtcaaggttgatgctgatcatcccaggcctgaagtcaaagttctccttcacaatcttgaggatctccttatcggggatcttgccagtaccataagagtcaacgaagacagataagggctcaggcacaccaatggcgtaggagatctgaacaatgcagcggcgtgcaagaccgctagcaatgatgctcttggcagcctgcctggcaatgtaggcgccactgcggtcaaccttagttgggtccttgccggagaaagcaccacctccgtgtgctccccagccaccataggtgtcgatgatgatcttgcgaccagtaagaccagcatcaccatgagggccaccaatgacaaagcggcctgatggattcaagtggaatatggtcttctcgtccaggtacttctcagggatcaccggcttgatgacatgctccttgaggtccgcagcaatctcatcattggtgacagtctcatcatgctgggtggagatcagaacagtgtgcacacgtacaggaaccatggc

SEQ ID NO: 28194 - DNA, 822 bp, Triticum aestivum
  Clone ID: PAT_TA_28194
gacccagccaaattgtaaatcagatttataaactagaaaacacaacacaccaacgacggatacagagctgacgacatgcagttcattgcacggccatgaaacatctctagccacgcattcaccaccgcaactactaattgaacagcaaatccgacacaacgcgacacgacagtacaatagctccttggagcagatgataactaactagcagctgcagtacgactaagatcaccgagcagcaaacttattaaacacacccagcagctggatctaggggttgtagtagacgatcttgatctcgtcgacgccgtggcacttgccgccggggacggagtgctcgaagcagtggccaccgctgttgcagccggcggtggggcagtggtctttcagggggtggccgtggggggtgatggagacacggatgggcatgtgcgactggtcggtgctcacctggtaccacgccccgccgtcgtacccgatgtggaactccgtcaccacggcgtcctgcaccttcacgcgccccgtccacgagcacacgtcgtacgacacgtgggtgccgtggcggagcaggtggccagggctgtagagcagcttgctgttggccagcggctcgatgccgaggtaaaggtccttgccgcacaggttctgcaccgtaaccttgcggctcggcttgcagttttggggatcctgaccggcggcggacatggcagtcgctgccagcgccacggcgaggaggagagccgccacgggcttggagaacgccattggctgttactcgctggttaggagtgaagaggagtgactcccacgcgtccgcggacg

SEQ ID NO: 28195 - DNA, 1716 bp, Triticum aestivum
  Clone ID: PAT_TA_28195
actatgcattatacagcgctgcaggataaataccacagcattcaagggtacgaaagcatcacaactgcagcttattcgggattcgaaatcaccatcatctttaatccggtgtgtacaaaactgtctcagacaacaagtttagcgagtctacaaggcaaattcttgagttcagccagtagtaacacacctctggttgaaccttcggacactgctgtaggcaatttaacattttattgggaaggggttgcaatgttatcattcacttcagttttgtaactgcagcatgtatggcatctgcaagatggggtacagtcctggagctcaaaccggccatgctgatcctcccatcagatgtcatgtaaatgtgatattcctgcctcatgaaggctacttgctcactgttgagcccagtgaaagtaaacatcccaatctgcttaatgatgtgggaccaatctccaggtgtttctctgattttcagcgcatcaaaaagctgctccctcatgctaattatcctatcagccatggccttcagctccacggtccattcgtcgaacatagcactgtccttaagtatggtagccacaatagaagcaccatgaagaggagggttcgaatacataggcctaattacaagcttaagttgactttcaaccttaacagctatatcagcactcccacaaacgatgcttaaagcaccaacacgctctccatacaatcccatgttcttggcatagctttgagccatgagcaattcaccaccatcagcgacgaacatgcgcactgattgggcatctttgtcaaggcttccgcttgcaaatccttggtaagcactgtcaaagaatggcagcaatgcttttgatctcatcagctgcctgatctgttcccactgttccaaggttgggtcgacaccagtaggattatgggcacatgcatgaagcagtacaattgcgcctgagggagctgaactgaggtcttctaagagtccttggaaatccagtccacgagttgcaggatcatagtaccggtaactcctagcagtcaggccagctaaagtgaagacttttgggtgattcccccaggttggctgggggatgtagatagtgcgttcatggtagtgccttgcaagaaattcacctcccactcgtagggaaccagttcctgataagcactgcactgtagccaccctattttcctgaatagcaggactgtcggcaccgaagataagcttagcactcaacttgttgaaatcggccaatccagtgatcggcaagtactccttaacacgtgactcgttatggatcagcatctgctcggcgcgcttgaccacattcagcacgaggggcttcccttcctcggtccggtaggcgccgacgccgaggttgaccttgacggggctgggatccttgttgtacgcgaccgtcaccccgaggatggggtcctccgggccctgcgcgatcccggcgaagacggagggcgacgccatggtggggaaaggttggagggaggagtcggcggaggtggcggtcgctgctgatgttcgtggggaagaaggcagcaggtggcgcaccagcgtacttaacctgcggtcggcgctaggctgcgccgcgcgcacgttagccgtgggcatcgcggcccggctagggtgcgccggcccgtacgagcgtctcgggcgcgtgccgcgtgctgctgtgggtggaatcgaggggcgcggacgtg

SEQ ID NO: 28196 - DNA, 1154 bp, Triticum aestivum
  Clone ID: PAT_TA_28196
acatacacgatacacaaaaacagaaaaaaggtcaggacgaccccgacgcgccaccacctgctcctcccggcggctgcctgctcgactcgattccccaaccgcagcagggtcaacgacagaacctatcgcgcgatgggcttgggactgagattgccgttcttcctactcctcttgctgctggtcagcctgggagccgcacaaggccggagcacagtttttcttgatatccaggaggaggctcgaggctctggtcaaatcatcaaggatcaactaactttgagcaaaattcccgtgcgtgttgagaggggcagcccactatgcccagcttgtgagaagtttacagaggaagctcttagctatcttagtcagaaacaatcacaagataagatgatggaggtccttcatgaagcttgttctcagacattctcgttggaaaagaagtgtgttgagtttgtggactcctatgcaactctcttatttgccaagatcgctgagatcaagccagaagagttctgcaaacgaaatggcctctgcagggacaatgctcttctgtctggtgtgagaagtgagagcacatgcgtgttttgccaccacctcatggatgaagttttgtccaaactgaaggatcctgatgctgagtttgagataattcaaattctcctcaaggagtgcaagaagatcgaaggtcatgaacagcagtgcaaacgactggtcctgcaatacatccctctcatcctggtgaacggagagaagttcctcgagaagaacgatatatgtaccattgtccaagcgtgcgatgctggcaaaaagacaatggtcgggccattctccgaggagggtttgttgcgtgatgcatgaaggtagaaagaccacaccaggctgcgtaaacccagacgaaacattatgcactagttcttccttgttgtacataggtgtccaaaaattcgtctggcttttgccttgtactgctgctcctgcattctgtggatgctttgtattataaagggagcggcatgacaaacagtttattatgtcaacttgaagccgtgttgtacttattacttcgtcagtgtttaatttgtaatgacatttgaacaactgtagatactaaatcgagtttcagtctgtctgctaataaaaaaaaaaaaaaaaaa

SEQ ID NO: 28197 - DNA, 1026 bp, Triticum aestivum
  Clone ID: PAT_TA_28197
ctttgattcgccaagctcgaaattaaccctcactaaagggaacaaaagctggagctccaccgcggtggcggcccgctctagaactagtggatcccccgggctgcaggaattcggcacgagcggcggcgcaggcgtctctctccttctcctccggcggcggcaaggcattttggcatctgagcccaacagctagcagatggcaggcggcagagttgcacatgcgaccctcaaggggccaagcgtggtgaaggagatcttcattggactcacccttgggctggttgctggtggtatgtggaagatgcatcactggaacgagcagaggaagacccgatccttctacgacatgctcgagaaggggcagatcagcgtcgttgtcgaggagtagttctgaagtgctgaatcagaagttctacatctcgaagtcttttgtcattttggttttgccagtaatttctgaaactctctggagagcatgacagagtgattgctgtggagattgtcatgaaaataagcacaccaccatttgagaacattgaaccattttgaatttgctttctgtcgtatcaaatatgtcttgtctcatatgtgttgcaaacaaattcagggattggaaggcttccctctgacatgaatatgatttagatttcactgtcaaaaaaaaaaaaactcgaaaatcaggtgcttgatgacgacgaagattggaaggtggcggcgatgacaccgtgggtccccgggctctcaccagcatgacatgacgtgcgccaaagatgcttcaaagcgttcgccgcattgcatcatatcgggcgggcggtcgtgcgctagcaagcatgcatgcatgcatgtgtgtgtgtatatggatgggtgtacatacatggagaacatgattggttcggtgcaggggttgctgtttcttgattggttagttgcaagggtttattgataagttgatacctatagtccgatggtagtgtaagcctttcttcaaatgaaactgaataatattttattgttcttgcccccccc

SEQ ID NO: 28198 - DNA, 880 bp, Triticum aestivum
  Clone ID: PAT_TA_28198
tattgccatccggacaaatcttcttcctgtaacacatccatccatttctagctgcaggcagagcagagttgagcgtgtgggagtcgaaggagatcgagatggctactgcatatgctcctccgatggcaagccaggtgatgaagagcggcttggtgtgctccaagccgaggggactgtccggcgcttcactcaccaggaggccccgcttcgtcgtcaaggccgtcaagtccgacaaggggacgtaccaggtggtccagcccatcaacggcgacccattcatcggcagcctggagacgcccgtcacgtccagccccctcgtcgcgtggtacctctccaaccttcccgcgtaccgcaccgccgtcagcccgctcctccgtggcatcgaggtcggcctcgcccacggctacctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgccctcacgctcaccggccgcaagaaggaggccgacaagctgcagaccgccgaaggctggtcccagttcaccggaggcttcttcttcggcggcgtctccggcgccatctgggcctacttcctcctctacgtgctcgacctcccatacttcttcaagtagattatttattattggcatgcatgtacgatgggtgcacaactgcagatgatgtgatcgatctcttcttggtggttggttgaaagagtctatgtataaatgaacttacgtattcctcacaatctttgcatggatcgatgatactacgatactat

SEQ ID NO: 28199 - DNA, 1163 bp, Triticum aestivum
  Clone ID: PAT_TA_28199
gccggccgggcttcccccgtaacaaatcgaagagtgggtctctctctcgcggcggcgcaggcgtctctctccttctcctccggcggcggcaaggcattttggcatctgagcccaacagctagcagatggcaggcggcagagttgcacatgcgaccctcaaggggccgagcgtggtgaaggagatcttcattggactcacccttgggctggttgctggtggtatgtggaagatgcatcactggaacgagcagaggaagacgcgatccttctacgacatgcttgagaaggggcagatcagcgtcgttgtcgaggagtagttctgaagtgctgaaccagaagttctacatctcgaagtcttttgtcattttggttttgccagtaatttctgaaactctctggagagcatgacagagtgattgctgtggagattgtcatgaaaataagcacaccaccgcagagcctctctccctgagctaaataaggctccgcacatcttattattaccactcgtgtaacgccaccataggatccaaggagaagtttgctgcaagtggaacgaacgcccagctccaagctcaagcctctgctacggggagcaggccgagctcctggatgaccccggcgacgccgcggagctgcgcgccggcgctggcgccgcaggcgggcacccggtcgaagagcgaggcggagagctcctcggagacgaagccgacctggaactcgagggtgccctccgcggggtgcgcgacgatgccggagacggagacccagaggaagagcttcttggcctggatgccggcgaggccggtgatccgccccttggagaggcagccgcggagggtcttctcgtagtagacgaggtggtcgccgaagcggacgtagcaggtgcccgcgaggtggatctcgaagtcgcccgtggcctcgtcgaaggtgtaggaggagaccgagtccgggatgaggcccttcgggagtccgtacttgggcaggaggtcgttcgccgcgccgttctccggggccgcggacgcggcggcgacggcgacggcggcggcgaggaggaggaggaggaggaggagggcttggggagtcatggtcgtcgctggggtttgggatggattctctctctgctttgcgcgtggggagtccggtgggggcgccgagttctc

SEQ ID NO: 28200 - DNA, 1528 bp, Triticum aestivum
  Clone ID: PAT_TA_28200
ttttggaagataggtgagcccattgattagatcgcagaaaaacggagacaatgcaggtcacagagtagcacagtacagggcccagtaccaagaaaacacagacgagttacatcaaagttcagacttcggaatcatggtccctctcctcactctctccaacactctcttcttcctcgcagaaacgccggctcaatcattcaatcacaaggcgacacacgcacacagacaccattgccacacatcgcacacggttttatttggacacagcaacattattcgctaccagcggcagaggactacgacgacgacggacggacggacggacggacggcgactaggacgacttggggggcttgtccccggactaatccatggcgatgtgtcgatggcaatgcggcagctcatctaccaggggaggatcttccagcgctggttgtcgccctcgcaccacttccagagcacgatctcggtgccgtcgtggacgccgccgtgggccttgtcgccgtggaaggcgtcgaagttgaggtagatgttgttcaccatgcgcacgcagcggaagcccttgcccacgtctcggctctccgtccacagcaccgactcgtcctggtacgccgggttgtacggcaccagcttcacggggtggccctggccggtggagtgcttgatgcattcgccggtgaccatgttcaccagtgcgaacgcagggtacccttcctcgtccctgatcttgttgctgtgcctcatgtccttgatccagtgctggtagtcgtccctggggttggtgggggcgaggcagacggtgccgttgcgggcggtgaggctgtagtcctccccggccttgcagaagacgcgcacggcgtgcacggggggcccgccgcccatggcgtgggcgttgttgcccatggtggcgccggactcgacggcggcgtgcgcctcggcccagggccagatcttccagcactggttgtcccccttgcaccactcccagagcacgacggtggtgccgtcgtgcacgccgcccgtggtccttgtcgccgttgagggcgtcgaagttgaggcgggtgttgttgaccatgcggatgcagcggaagcccttgcccacgtccttgctctccgtccacagcaccgacgcgtcctcgtacgccgggttgaacggcaccagcttcacggggtgggactggccgatggagtgcttgacggcgaggccggtggccttgttgacgagcgcgaaggccggcatgccctcctcgtccttgacggtggtgctgaagcgcatgtccttgagccagtgctgggtctcgtccttggggttgacgggggcgagcaccacctcgccgtcgcggacggcgaggcagtagtcctccgaggcccggcagtagatcttgaagatctggttggggcccgacgccgccggcgcctggtccttgtggtggtgcccgaacccgaacatcttggcggcgaggagagcgtgtgtgatcggctctgttggttgggacctcggagctgtgcgagtcccagcccggccggc

SEQ ID NO: 28201 - DNA, 1173 bp, Triticum aestivum
  Clone ID: PAT_TA_28201
tttttttttgccaaacctgcactgacagaaacagcactaccttatcgctcaaactgaatattgagaaggttaagactgcaccaagcatcgagaattgggaagaacagggtactaggatcacatatggttttacagatgcagtactaaaaaatagctggacgaccgatagaggaaaccgcacaagtactgcggtttcagtagactcaaaaagcaaaaagaaagcacagaagacatcaaaagacccgactagtattaactcagcacatatttttgtattccataccaaaataccaatcactagatgccaattcagcgtgtccacggcgatgttgaaaccctgcttccttctaaagagaaggaattcaattatccaagatacaaccaccagcggcagcagcaggaatgattagactccttcatacccacctctcaagcagaggccttgtcaaacttgaggggcttcacaacctcccaggtgaagtcagcatcctcacggccaaagtggccataagcggccgtcttgatgaacctgttgccacccttcttcaagtcaaggttgatgctgatcatcccaggcctgaagtcaaagttctccttcacaatcttgaggatctccttatcggggatcttgccagtaccataagagtcaacgaagacagataagggctcaggcacaccaatggcgtaggagatctgaacaatgcagcggcgtgcaagaccgctagcaatgatgctcttggcagcctgcctggcaatgtaggcgccactgcggtcaacccttagttgggtccttgccagagaaagcaccacctccgtgtgctccccagccaccataggtgtcgatgatgatcttgcgaccagtaagaccagcatcaccatgagggccaccaatgacaaagcggcctgatggattcaagtggaatatggtcttctcgtccaggtacttctcagggatcaccggcttgatgacatgctccttgaggtccgcagcaatctcatcattggtgacagtctcatcatgctgggtggagatcagaacagtgtgcacacgtacaaggaaccagtggcacctccctcgttgaggtattcaaccgtgacctgggttttgccatcaggccttagccaggcacaagtgccattcttgcggacttcagtgaggccctcgtgccgaat

SEQ ID NO: 28202 - DNA, 1373 bp, Triticum aestivum
  Clone ID: PAT_TA_28202
gattcggacgaggctcgtgtgcaggggcccgcccaacaagagccagattctctcctctcacttggagccactaaaacatattgccgtccggacaattcttcttcctgtaacacatccatccatttctagctgcaggcagagcagagttgagcgtgtgggagtcgaaggagatcgagatggcaactgcatatgctcctccgatggcgagccaggtgatgaagagcggcttggtgagctccaagccgcgggggctgtccggcgcctcactcaccaggaggccccgcttcgtcgtcaaggccgtcaagtctgacaaggggacgtaccaggtggtccagcccatcaacggcgacccgttcatcggcagcctggagacgcccgtcacctccagccccctcgtcgcgtggtacctctccaacctccccgcgtaccgcaccgccgtcagcccgctcctccgcggcatcgaggtcggcctcgcccacggctatctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgcgctcacgctcaccggccgcaagaaggaggccgacaagctgcagactgcggaaggctggtcgcagttcaccggaggcttcttcttcggcggtgtctcgggcgccatctgggcctacttcctcctctacgtgctcgacctcccatacttcttcaagtagatgattattgtttggcatgtacgatgggtgcagatgatgtgatctcttcttgatggttgcttgaaagagtctatgtataaatgaatttacgtattcctcagaaaaaaaaaaaaaaaaaaaaactcgcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggagg

SEQ ID NO: 28203 - DNA, 1824 bp, Triticum aestivum
  Clone ID: PAT_TA_28203
agctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatccacgccttcaagcccaaccccaagtcgcacgtgcaggagtactggcgcgtcttcgacttcctctcccaccacccggagagcctccacaccttcttcttcctcttcgacgacgtcggcatccccaccgactaccgccacatggacggcttcggcgtcaacacctacaccttcgtctcccgcgccggcaagtcccactacgtcaagttccactggaggcccacctgcggcgtcagctgcctcatggacgacgaggccaccctcgtcggcggcaagaatcacagccacgccacccaggacctctacgactccatcgacgccggcaacttccccgagtggaagctcttcgtgcaggtcatcgaccccgacgacgaggaccgcttcgacttcgacccgctcgacgacaccaagacctggcccgaggacctcgtccccctccagcccgtggggcgcctcgtgctcgaccgcaacgtcgacaacttcttcaacgagaacgagcagctggccttcggcccggggctcgtcgtgcccgggatctactactcggacgacaagatgctgcagtgcagggtgttcgcctacgccgacacgcagcgctaccgcctggggcccaactacctgatgctccccgtcaacgcgcccaagtgcggcttcaagaacaaccactacgacggcgccatgaacttcatgcaccgcgacgaggaggtggactactacccgtcacgccacgcgccgctccggcacgccgagccggccagcttccccgtgcccacgcggcccgtcgtcggaaaaagggagaagacgaggatcaagaaggagaacgacttcgtgcagcccgggggagaggtaccgcagctgggcgcccgaccgccaggacaggttcgtgcgccgcttcgccgacgcgctcgcccaccccaaggtcagccacgagctccgcgtcatctggatcgacttcctctccaagtgtgacaagtcgtgcggcatgaaggtggccaaccgccttaacgtgaagccaagcatgtgatggatggatcgatctgccatggatgatggatggaccgttctgcgtgtaaactttgtgctatacgtacgtatcatggaccagcaataagagaccatgccagctataatgtggatcatgtggtcgattacatactgtgctgctactaataagttactatccttttttttaatccagcaaatgaaattaaagtgggtgctttgtattataaagggagcggcatgacgaacagtatattatgtcaatttgaagccgtgttgtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacgtacctcggccgcgaccacgcta

SEQ ID NO: 28204 - DNA, 1688 bp, Triticum aestivum
  Clone ID: PAT_TA_28204
gcggccgctttttttttttttttttttatttttttttttttaattttttttttttttttttttttttttttttttttttttttttttttagaattacacatggctctttattattctttccgagactcaggaagaaagagcagtatgaggaactacacaacaaagaatatgaaaagtgaaagtgacagagcgactaacagagcaaactgcacatcactcagcagtttcagcgactcaaaatggaaaggataaatatatgaaatgacattaagaaacttagcactgactaccatacaacaagaccagtgtagagcgtcgcttcaatgtctaatgcttcttcccacttcccaggagcaacatgatcccgtcttgacgaacttgagaggcggcagaccaagagaatgccatgctcttaggcagatgccttgtcgaacttgaggggcttcaccacctcccaggtgaagtcggcatcatcacggccaaagtgaccgtaagcagcggtcttgatgaacctgtttccacctttcttcaagtccaggttgatgctgatcatcccgggcctgaagtcaaagttctccttcacgagcttgaggatctccctgtcggggatcttgccggtgccgtaggagtcgacgaacacagacaaaggctcaggcacaccgatggcgtatgagatctgcacaatgcagcggcgtgcgaggccgctggcgatgatgctcttggcggcctgcctggcaatgtaggcgccactgcggtcgaccttggttgggtccttgccagagaaggcaccgccgccgtgggctccccagccaccataggtgtcgatgatgatcttgcggccggtgagaccggcgtcaccatgggggccgccgatgacgaagcggccagacgggttcaggtggaagatggtgttctcatcgaggtactttgcggggatcaccggcttgatgacatgctccttgaggtccgcagcaatctcgtcgttggtgacggtctcgtcgtgctgggtggagatgaggacggtgtgcacacgaacaggtaccatggcaccatcctcgtttaggtactcgactgtgacctgggtctttccgtcaggcctgacccaggcgcaggtgccattcttgcggacctcggtgaggcgagctccgagcttggtggcaagcacgtggctgaggggcatcagctcaggggtctcgtcggtggcatagccgaacatgatgccctggtcaccggcgccaacctcttcaggacgcttggtgaagtgtccgtgaacaccctgggcaatgtcaggggactgctgctcgatgttgacgagcaccttgcaacggtcggcgtcgagaccaacgtcatcagagatgaaaccgatgttgcggcaggtgtcgcgcacgatcttctcatagtcgacggtggccttggtggtgatctcgcccaagaccatgaccatgttggtcttggtgacggtctcgcaggcgaccttgctgtcggcatcctgggccaagcaggcatccaagacggcgtcggagacctggtcacagagcttgtcgggatggccctcgttcacagactcggacgtgaagaggaacgtctcggccgccatttctttagtgctagcgatgcccttgcgctgcttctactgctcgatcgggaggccgatgaaccgagggagggaagaggcggaatgtatgcac

SEQ ID NO: 28205 - DNA, 1660 bp, Triticum aestivum
  Clone ID: PAT_TA_28205
aaaattgcaaggtttcaacttccaacactggcagcagtacagaaacagcagcatcaagtcaaatgcaaggttccaactttccaaaccaaggtaaggtacagagacaacagatacactcccagcatcaaccgccctcactttggggcattcatgatgcatcacaacagtatcccccgtctttcggggtttccccgctggcggcgggcatactgcactacaagtacataaatatgaagaacatacgcatcaccgagattacggacagacggcaccgacacagacaggctcacatctttagaggcctacttcttccaagcaccaggtcctttctgggggaaatgcaccaccaaccaacagcttgcgctttcatggacgacggacggaacagatcattgtgaaaacatcttccacaacttacagggatgatatttactaaaaagaaccacagagcaaccacaaccatgttccaaagcagatcaggcgtcttccgtcttgcacaggtccagcagtgacagtgtctctgctatggagagctcgaggcggaatttaggaccatcatagtggtgcagcactggcctaaaagcatcctcttccaaggccttgcaaagccttctaatgcggatcctcacctgatatgatgatgaatatgtcagatcatgaaaaacaagcctgataataaacatatgtcaaccttggaaattaattacctgtgctgggaatctggattcacctttgcacttcttatcttcccaagcagtgggatcaatgtttgatcctccaaaactggcagcctcaaacaccccatgtagctgatgggtcgtgtagttgtagaggaaaagaggtagaccaggagtgatggctcggactgaatcacgatatcttgctggcaagccaaaaagctgtctcttgagatcctcctgcatggtatcattgttgcagacaaagatgtatccaccaagaacttcattcctcggtagcatctcgcttgttggcaatgttttgaagcgcttgtcaacagagttgttgttgctgttgcctccattgttgttgttaacaccattgtgtttgccgtctgtttccttcccattctgattattgggatatttgttgaccccaacattcatcttgaacgaattgatattaccgttgtttcccttggggtacatcggattcatgttataggccatgttgcggaaagggtacttcatggcagcctcgttcatcttgagatcattcatcttaagatccaggttcatcaggccaagattgaggtggtccatcttgttgtcttcctggtggtaggatagcttatcccattgcttgacatcagggacagtgttcatccgtgcatactcaaagtcattcatcctctcagcctttgactttgtgatctcagcaagctttgatgtcatgagagaccattggcggtcctccaccacctttgattgcccacggaactcatctccgagatgccacaagttgtccatagctcagttcaagctctctgctcgattcggcgccggattccggcggggagggcgctggatttggggaaactgctgcggggaagggggagaggaggataggagtcggctcggctggcctggcgttggctcccacttcgctccgcccacacagagtccaccggtcagagcggacg

SEQ ID NO: 28206 - DNA, 1847 bp, Triticum aestivum
  Clone ID: PAT_TA_28206
ttttttttttttccccaaaactaggcattatagagcgctgcaggataaatacctcagcattcaagggtaagaaagcatcacaactgcagcttattcaggattcgaaatcaccataatctttaatccggtgtgtacaaaactgtctccgacaacaaatttaatgagtctacaaggcaaattcttgagttcagccagtaacacacctctggttgaacccttcggacactgctgtaggcaatttaagattttattgcggaagggggttgcaatgttatcattcacttcagttttgtaactgcagcatgtatggcatctgcaagatggggtacagtcctggagctcaaaccagccatgctgatcctcccatcagatgtcatgtaaatgtgatattcctgcctcataaaggctacttgatcactgttgagcccagtgaaagtaaacatcccaatctgcttaatgatgtgggaccaatctccaggtgtttctctgattttcagcgcattaaaaagctgctccctcatgctaattatcctatcagccatggccttcagctccagagtccattcgtcgaacatcgcactgtccttaagtatggtagccacgatagaagcaccatgaagaggagggttcgaatacataggcctaattacaagcttaagttgactttcaaccttaacagctatatcagcactcccacaaacgatgcttaaagcaccaacacgctctccatacaatcccatgttcttggcatagctttgagccatgagcaattcaccaccatcagcgacgaacatgcgcactgattgggcatctttgtcaaggcttccacttgcaaatccttgataagcactgtcaaagaatggcagcaatgcttttgatctcatcagctgcctgatctgttcccactgttccaaggttgggtcgacaccagtagggttgtgggcacatgcatgaagcagtacaattgcgcctgagggagctgaactgatgtcttctaagagtccttggaaatccagtccacgagttgcaggatcatagtaccggtaactcctagcagtcaggccagctaaagtgaacacttttgggtgattcccccaggttggctgggggatgtagatagtgcgttcatgatagtgccttgcaagaaattcacctcccactcttaaggaaccagttcctgataagcactgcactgtagccaccctattctcctgaatagcaggactgtcagcaccaaagataagcttggcactcaacttgttgaaatcggccaatccagtgatcggcaaatactccttaacacgtgactcgttttggatcagcatctgctcggcgcgcctgaccacattcagcacgaggggcttcccttcctgactcggaccaaaacaccagccatggtcaaatccagctctgatccaacaggtaagcgcagcaattcaatgaaattccccaaaaaaacacctctcacctcggtccggtaggcgccgacgccgaggttcaccttgacggggctgggatccttgttgtacgcgaccgtcaccccgaggatggggtcctccgggccctgcgcgatcccggcgaagacggagggcgacgccatggtggggaaaggttggagggaggagtcggcggaggtggcggtggctgctgatgttcgtggggaagaaggcagcaggtggcgcaccagcgtacttaacctgcggtcggcgccaggctgcgccgcgcgcacgttaaccgtgggcatcacggcccggctagggtgcgccggcccgtacgagcgtctcgggcgcgtgccgcgtgcggcgtgttgggtgcttgctgtggaatcgaggggcgcggacgtgggc

SEQ ID NO: 28207 - DNA, 1787 bp, Triticum aestivum
  Clone ID: PAT_TA_28207
aaccttgaacagtagttaagtacagtactgcttagaagaatgacaatttgggaacaatagggcaatagaattacacatgggtgctttagactctgaaagaaagagcattatgaggggaactacacaacatggctctttagactctggaagaaagagcattatgaggggaaactacacaaaacagagtatgaaaagtgaaagtgacggagtgacagagcaaattgcacatcactcagcagtttcagcacactcaaaaagaaaaggaaaaatatatgaaatgatacaccagtaagaaaacttagcactgatcactagacggcacgaccagtgtagcacgtcgcggtgatgtcgaatgcttcttcttacttcccaggagcaaaaggatcccgcctttgtcgaacttgataggcagcagaccaagaataaccccaatgtgatttcttgttcttaggcagatgccttgtcgaacttgaggggcttcaccacctcccaggtgaagtcggcatcatcgcggccaaagtgaccataagcagcggtcttgatgaacctgtttccacctttcttcaagtccaggttgatgctgatcatcccaggcctgaagtcaaagttctccttcacgagcttgaggatctccctgtcggggatcttgccggtgccgtaggagtcgacgaacacagacaggggctcaggcaccccaatggcgtatgagatctgcacaatgcagccggcgtgcgagaccactggcgatgatgctcttggcagcctgcctggcaatgtaggcaccactgcggtcgaccttggtcgggtccttgccagagaaggcgccgccgccgtgggctccccagccaccgtaggtgtcgatgatgatcttgcggccggtgagaccggcatcaccgtgaggtccgccgatgacgaagcggccagacgggttcaggtggaagatggtgttctcatcgaggtacttcccaggaatcactggcttgatgacgtgctccttgaggtctgcggcaatctcgtcgttggtgacggtctcgtcatgctgtgtggagatgaggacggtgtgcacacgaacaggcaccatggcaccaccctcgtttaggtactcaatggtgacctgggtctttccgtcaggcctgagccaggcgcaggtgccattcttgcggacctcggtaaggcgagctccaagcttggtggcgagcatgtgggtgaggggcatcagctcaggagtctcatcggtggcgtagccgaacatgatgccctggtcaccggcaccgatctcttcagggcgcttggtgaagtgtccgtgaacaccctgggcaatgtcaggggattgctgctcgatgttgacgagcaccttgcaatggtcggcatcaagaccgacgtcgtcagagatgaagccgatattgcggcaggtgtcgcgcacgatcttctcgtagtcgacggtggccttggtggtgatctcgccaaagaccatgaccatgttggtcttggtgcaggtctcgcaggcaaccttgctgtcgggatcctgggccaagcaggcgtccaagacggcgtcggagacctggtcgcacagcttgtcgggatggccctcgttcacggactcggacgtgaagaggaacgtctcggccgccatttcttccgtgctagcgatgctcttgtgcagttgtgctgatgctattcttcaggaggccgaagaaccgaaaggaagaggtcgaatgtatgcacggtgttgtccggagatccaggccgcgcaatttataggagcggaggccccgcaaggtcgtgcc

SEQ ID NO: 28208 - DNA, 1542 bp, Triticum aestivum
  Clone ID: PAT_TA_28208
tcgagcggccgcccgggcaggtcggatgcaataacagttgaagttcctgtcaatgatgtccgtgttggagactcagtattggttcttccaggagaaactatccctgtagatggaaatgtcactggaggatcaagttttgtggatgaatcaatgcttactggagaatccttgccggtagcaaaagaaaaaggatgccctgtattttctggaactgttaattgggatggacctttaaggatcaaagccacaaccactggaccgtcgtcaacaattgctaagataatccgcatggttgaggatgcacaagcacatgaagctcctgtttttttttacttgttcaatcagctcataaaggtcctttattgttacgtaacttgtcattacacatacaagcacaacacagctggctccgttattctgcggcgtaggtagcgagagacgcatgcatgttgtttatccgggacagtccacatcgtttcttcagtagtactagtagatacgtacgtacggcatgggtaggtttgggcatgtcgatctccacgcgtgcgtgcaccgtgcacgagccacgcacgcatgcatggcacggcgcgcgctggctcgctcagtagtacggctggagcttccagcgctggttgtcgccctcgcaccacttccagagcacgacctcggtgccgtcgcgcacgccgccgtggtacttgtcgccgttgagggcgtcgaagttgaggtagatgttgttcaccatgcgcacgcacctgaacccgttgcccacgtccctgctctccgtccacagcaccgactcgtccaggtagtctgggttgtacggcaccagacgcacagggtgggactggccgagggagtgcttgatggcctgcccggtggccttgttcaccatggcgaaggcggggtagccctcctcgtccttgatgctggtgctccacctcatgtccttgatccagtgctggtagtcgtccttggggttggccggcgccagcaccaccttgccgttgcggacggacatggcgtagttggggttggcgcggcagtagatcttcaccgtgggctgcggcggcatcggcctcccgccgtagttgccgtcgatgttcacctgcgacatgccgtacggcaccggcgccgcgtacccgggcgtcgccatcccgtacccgccgtaggtctcgcggtagtagtccatggccggtacctgctcgatctcctaagaaaagaaaaatgcttgtcaaagtgaagacattaactggtaaagaaattgaaatcgatattgaacccagtgacaagatttctcgcataaaagagcgtgttgaagaaaaagaaggcattcctcctcctcaacagagattgatttatagtggaaaacaaatggctgatgaaatgacagcaagtcagtatggcattgaaggtggctcagttcttcacttggtattggcacttcgtggtggtcaataaacaattaacaaaaaaaaaaagctcttttatttgaattcgtcagcaaataaaaaagacgaataaaatttaaaattgatagttttg

SEQ ID NO: 28209 - DNA, 1186 bp, Triticum aestivum
  unsure (1)..(1186): unsure at all n locations
  Clone ID: PAT_TA_28209
ttttttttttttttttttcagcaagttaaattgttgtcatagatatcgccagattatgatatatagaggtctcctttaagtcgaaaatacgacagtacgtactcgataacgcattcaacagctcctaaggctaagttccagctaagtcaaacacaaaacaaaacagtctcgaaagggtcacatgactacacccttcagacacccacagcctctgcagacaacgattcatcaggacccaccaaagccaaccaaggcctcagttctcctcgtcctcatcctcctcagcatcctccccatcagatccctcttcatcctcgtcatctccttcaaactcttcaacctcattgttgaaatatttcaatgggttcggccacaaatcttctttgatgatctctgccacctcatcttgcaccccgtcagcaaggctcttgtgctctgtatcagtgaaccaggtgaagaaactttcttcaaccaatgggcgcttgcttcctttcttcttaatggcattcccattaatttccattccctccttccacttaatggaagtggcatttattgtggttgttccatcatcagcaaaggcatatgacttggtaagctttctgtcttcaaagtacggattctcagagaagttaagagtgatggagtagcctgacttgacatctttagaatcatcaacatcaacagattccaagtacttgaacatcttttgatcctcttcagtcaaaagctcactgagaagaggatgacttagaaacgctgtcagccaaaagtctggaattgttttgatgatgtcacacctccgaagatagacaggtctgcgaatctcactgtacttctgctcaacctccaaaaccttatcacttgcttcttcattaaccttctcgagctcgtcctggatctcctggagcctctcgatggagaggacgagggcaccgtcgatctgctcgttctcctcgccgacgtcggtgtcggtcttggccttcttccccttgtccgccggcgccgtcatagtcgcctgtgtctagggttttagcctccgacctgcgccgcgagagcgagagggagtgtgcgcgcctcgtgccgaattcctgcagcccgggggatccactagttctagagcgngccgccaccgcggggagctccagcttttgttccctttaggagggttaatggagctaacgat

SEQ ID NO: 28210 - DNA, 1818 bp, Triticum aestivum
  unsure (1)..(1818): unsure at all n locations
  Clone ID: PAT_TA_28210
gacggccgtggcggcgtatagactcacttagggattggtaccggcccccttttttttaaacgcactacagtnccaacattacttcccaaaactaggcattatacagcgctgcaggataaatacctcagcattcaagggtaagaaaagcatcacaactgcagcttattcgggattcgaaatcaccataatctttaatccggtgtgtacaaaactgtctcagacaacaagtttaatgagtctacaaggcaaattctcgagttcagccagtaacacacctctggttgaacccctcggaaactgctgtagagaattcaagattttattgtgcgagggggttgcaatgttatcattcacttcagttttgttactgcggcatgtatggcatctgcaagatggggtacagttctggagctcaaaccggccatgctgatcctcccatcagatgtcatgtaaatgtgatattcttgcctcatgaaggctacttgatcactgttgagcccagtgaaagtaaacatcccaatctgcttaatgatgtgggaccaatctccaggtgtttccctgattttcagcgcattaaaaagctgctccctcatgctaattatcctatcagccatggccttcagctccagagtccattcgtcgaacatagcactgtccttaagtatggtagccacgatagaagcaccatgaagaggagggttcgaatacataggcctaattacaagcttaagttgactttcaaccttaacagctatatcagcactcccacaaacgatgcttaaagcaccaacacgctctccatacaatcccatgttcttggcgtagctttgagccatgagcaattcaccaccatcagcgacgaacatgcgcactgattgggcatctttgtcaaggcttccgcttgcaaatccttgataagcactgtcaaagaatggcagcaatgcttttgatctcataagctgcctgatctgttcccactgttccaaggttgggtcgacaccagtagggttgtgggcacatgcatgaagcagtacaattgcgcctgagggagctgaactgaggtcttccaagagtccttggaaatccagtccacaagttgcaggatcatagtaccggtaactcctagcagtcaggccagctaaagtgaagacttttgggtgattcccccaggttggctggggaatgtagattgtgcgttcatgatagtgccttgcaagaaattcacctcccactcgtagggaaccagttcctgataagcactgcacagtagccaccctattctcctgaatagcaggactgtcagcaccgaagataagcttagcactcaacttgttgaaatctgccaatccagtgatcggcaagtactccttaacacgtgactcgttttggatcagcatctgctcggcgcgcctgaccacattcagcaccatgggcttcccttcctcggtccggtaggcgccgacgccgaggttgaccttgacggggctgggatccttgttgtacgcgaccgtcaccccgaggatggggtcctccgggccctgcgcgatcccggcgaagacggagggcgacgccatggtggggaaaggttggagggaggagtcggcggaggtggcggtggctgctgatgttcgtggggaagaaggcagcaggtggcgcaccagcgtacttaacctgcggtcggcgccaggctgcgccgcgcgcacgttagccgtgggcatcgcggcccggctagggtgcgccggcccgtacgagcgtctcgggcgcgtgccgcgtgcggcgtgttgggtgcttgctgtggaatcgaggggcgcggacgtg

SEQ ID NO: 28211 - DNA, 1866 bp, Triticum aestivum
  Clone ID: PAT_TA_28211
ttttaggggcgaaatttggggcccggacgttcgccattgttccccggccccgccaattgggcggccccgcggggaatttggatttagcgtggttcgcggccggaggtttttcagaattacacatcgctctttattatctttccaagactcaggaagaaagagcattatgagggaactacacaacaaagaatatgataagtgaaagtgacagagcgactaacagagcaaactgcacatagctcagcagtttcagcgactcaaaatggaaaggataaatatatgaaatgacaataagaaacttagcactgactaccatacaacaagaccagtgtagagcgtcgcttcaatatctaatgcttcttctcacttcccaggagcaacatgatcccgtcttgacgaacttgagaggcggcagaccaagagaacgccatgctcttaggcagatgccttgtcgaacttgaggggcttcaccacctcccaggtgaagtcggcatcatcgcggccaaagtgaccgtaagcagcggtcttgatgaacctgtttccacctttcttcaagtccaggttgatgctgatcatcccgggcctgaagtcaaagttctccttcacgagcttgaggatctccctgtcggggatcttgccggtgccgtaggagtcgacgaacacagacaaaggctcaggcacaccgatggcgtatgagatctgcacaatgcagcggcgtgcgaggccgctggcgatgatgctcttggcggcctgcctggcaatgtaggcgccactgcggtcgaccttggttgggtccttgccagagaaggcaccgccgccgtgggctccccagccaccataggtgtcgatgatgatctcgcggccggtgagaccggcgtcaccgtgagggccgccgatgacgaagcggccagacgggttcaggtggaagatggtgttctcatcgaggtacttcgcggggatcaccggcttgatgacatgctccttgaggtccgcggcaatctcgtcgttggtgacggtctcgtcgtgctgggtggagatgaggacggtgtgcacacgaacaggtaccatggcaccatcctcgtttaggtactcgacagtgacctgggtctttccgtcaggcctaacccaggcgcaggtgcccattcttgcggacctcggtgaggcgagctccgagcttggtggcaagcacgtggctgaggggcatcagctcaggggtctcgtcggtggcatagccgaacatgatgccctggtcaccggcgccgacctcttcgggacgcttggtgaagtgtccgtgaacaccctgggcaatgtcaggagactgctgctcgatgttgacgagcaccttgcaacggtcggcgtcgagaccaacatcatcagagatgaagccgatgttgcggcaggtgtcgcgcacgatcttctcgtagtcgacggtggccttagtggtgatctcgcccaagaccatgaccatgttggtcttggtgacagtctcgcaggcaaccttgctgtcggcatcctgcgccaagcaggcatccaagacggcgtcggagacctggtcacagagcttgtcgggatggccctcattcacagactcggacgtgaagaggaacgtctcggccgccatttctttagtgctagcggtgcccttgcgctgcttctactgctcgatcgggaggccgaggaaccgaaggagggagggaagaggcggaatgtatgcacggcgttgtaccaagatcccggctgcgccttatatagcggcggaggccggtgcgaggtcgtgcgtgtggctggtgggagcgtcggactgcacaacctgtgctgtggtcgttggtgaagcacttcacctcaccaaccccacccacgcgaccg

SEQ ID NO: 28212 - DNA, 1428 bp, Triticum aestivum
  unsure (1)..(1428): unsure at all n locations
  Clone ID: PAT_TA_28212
cttacctggtaccccacccgggtggaaaatcgatgggcccgcggccgctctanaagtactctcgagttttttttttttttttttaaaagggtaaactgttcatgaaaatattattaaacttatatatgatgtcttttgatcacaggacgatcaaattatgcatcacatggtagtacaattcctcgtcagaaaatggtaaaagaaaaaggttctattgcttatggcgaattcacatcgggccatcccggcatccagtactggaaaataacgagtacgcactccatggcattggattcacatcggtcggtcggacggtcggacgatatcttgatatatgtacgcgtttgtattcgcatgtatatataggagttaaccggtggggaagatttactgctcccatgtctcgaacttgccggagacgaagtcgtagtggccgccaacgagcttgagggttccgttggacacaccctccttgacgaacgggtaggtcaagaggttctggagggacacgttcacggcctccttttcgaggacggtgcactggtcatcgaaaggcattgaggcgcactcagtctgcaccttcttcttggccgggaagccgatcctgacccagtcctcgacgaagtggaaggagtcgtctgcgccatccttgagtgagaggagagccttgattccaccgcagcggctgtggccaatcaccacgatgacctcaaccttgagagcacagacggcgtattcgatggccgatccaacaccagcgtacttgttcttgcagtaggacgggaccatgttggcgatgttgcggatggtgaaggcctcgccgggctccaggcccagggtgaccgaggggcacacacgggagtcggcgcacgcgaacaccatgtacttgggcgcctggccggccttgaggggctcgaagaaatcgggcttcttgtcgtagacctcggtcttgaacttctcgaacccggtcttgaggcgctccacggcggcgtccatcttgttggagggtggaggaggtggtggatggtaggtaggcttctggaggagtgacgaggaggaagaatctatcgctgccgccgctgctgctggggtgttctccccaccgggggcggagggcttcttatagcagcaggggaggcacaggcagccgctcatcttcaactatcgcgctcgcgttcgcgactctactcttttggtttttctctcctctcccccggaccggatggatggatggattacaatgcgggtgcgacgggcgcggcctggacgggggtgttcctgatgagcttggggcggaaggaggaggagttggagggcgcgggggtgccgaggctggcgacgatggtggaggagcgggcacggggcgcgactacggttgcgtagcaccagttagccgcggcggtcgacatttgccccggcccggccggc

SEQ ID NO: 28213 - DNA, 1716 bp, Triticum aestivum
  unsure (1)..(1716): unsure at all n locations
  Clone ID: PAT_TA_28213
agcagcgacgagtaaaattgcaaggatttaacttccaacactggcagcagtacagaaacagcagcatcaagtcaaatgcaaggttccaactttccaaaccaaggtaaggtacagagacaacaagatacactcccaacatcaaccaccctcactttggggcgttcctgatgcatcacaacagtatcccccgtctttcggggtttccccgctggcggcgggcatactgcactacaaatacataaatatgaagaagaacatacacatcaccgagattacggacagacggcaccgacacagacaggctcacatctttagaggcctacttcttccgagtaccaggtcctttctgggggaaatgcaaccaccaaccaacagcttgcgctttcatggacgacggacgggacagatcattgtgaaaacatcttccacaacttacagggatgatatttactaaaaagaaccacagagcaaccacaaacatgttccgaagcagatcaggcgtcttctgtcttgcacaggtctagcagtgacagtgtctctgctatggagagctcgaggcggaatttaggaccatcatagtggtgcagcactggcctgaaagcatcctcttccaaggccttgcaaagccttctaatgcggatcctcacctgtgctgggaatctggattcacctttgcacttcttatcttcccaagcagtgggatcaatgtttgatcctccaaaactagcagcctcaaacaccccatgtagctgatgggtcgtgtagttgtagaggaaaagaggtagaccaggagtgatggctcggactgaatcacgatatcttgctggcaagccaaaaagctgtctcttgagatcctcctgcatggtatcattgttgcagacaaagatgtatccaccaagaacttcattcctcggtagcatctcgcttgttggcaatgttttgaagcgcttgtcaacagagttgttgttgctgttgcctccattgttgttgttaccaccattgtgtttgccgtttgcttccttcccattctgattattcggatatttgttgaccccgacattcatcttgaatgaattgacattaccgttgtttcccttggggtacatggggttcatgttataggccatgttgcggaaagggtacttcatggcagcctcgttcatcttgagatcgttcatcttaagatccaggttcatgaggccaagattgaggtggtccatcttgttgtcttcttggtggtaggattgcttatcccattgcttcacatcagggacggtgttcatccttgcatactcaaagtcattcatcctctcagcctttgactttgtgatctcagccagctttgatgtcatgagagaccattggcggtcctccaccacctttgattgcccacggaactcatctccgagatgccacaagttgtccatagctcagttcaagctctctgcaagattcggcgccggattccggcggggagggcgctggatttgggggcgaatcgggaacgaactgctgcgaggaggagaggagtcggctcggctggcttggcgttggctcccacttcgctccgcccacacggagtccaccggtcagagctggtgccgaattcctgcagcccgggggatccactagttctagagcggccgccaccgcggtggagctccagcttttgttccctttagtagggtttanttngagcttaangaatcaaanttc

SEQ ID NO: 28214 - DNA, 2295 bp, Triticum aestivum
  Clone ID: PAT_TA_28214
gcactgacaaaaaccgcactaccttatcgctcaaactgaatattgaaaaggttaagactgcaccaagcatcgagaattgggaagaacagggtactaggatcacatatggttttacagatgcagtactaaaaaataactggacgaccgatagaggaaaccgcacaagtactgccgtttcagtagactcaaaaagcaaaatcaaagcacagaagacatcaaaagacccgactagtattaactcagcacatatttctgtatgccataccaaaataccaatcactgacgccaattcagcgtgtccacggcgatgttgaaaccctgcttccttctaaagagaaggaattcaattatccaagatacaaccaccagcggcagcagcaggaatgatagactccttcatacccacctctcaagcagaggccttgtcaaacttgaggggcttcacaacctcccaggttgaagtcagcatcctcacggccaaagtggccataagcagccgtcttgatgaacctgttgccacccttcttcaagtcaaggttgatgccgatcatcccaggcctgaagtcaaagttctccttcacaatcttgaggatctccttatcggggatcttgccagtaccataagagtcaacaaagacagataagggctcaggcacaccaatggcgtaggagatctgaacaatgcagcggcgtgcaagaccgctagcaatgatgctcttggcagcctgcctggcaatgtaggcgccactgcggtcaacccttagttgggtccttgccagagaaagcaccacctccgtgtgctccccagccaccataggtgtcgatgatgatcttgcgaccagtaagaccagcatcaccatgagggccaccaatgacaaagcggcctgatggattcaagtggaatatggtcttctcgtccaggtacttctcagggataaccggcttgatgacatgctccttgaggtccgcagcaatctcatcattggtgacagtctcatcatgctgggtggagatcagaacagtgtgcacacgtacaggaaccatggcacctccctcgttgaggtattcaaccgtgacctgggttttgccatcaggccttagccaggcacaagtgccattcttgcggacttcagtgaggcgggcacccagcttggtggcaagcacatggctgaggggcatgagctcaggggtctcatcggtggcatagccaaacatgataccctggtcaccagcaccaatatcctcagggcgcttggtgaaatgtccgtgcacaccctgggcaatgtcaggagactgctgctctatgttgacaagcaccttgcaccggtcagcatcaaggccaacatcatcagagatgaagccaatgttgcggcaggtgtcacgcacaatcttctcatagtcaacagtggccttggtggtgatctcaccaaaaaccatgaccatgttggtcttggtgcatgtctcacaggcaaccttgctgtcagcgtcttgggcgaggcacgcgtcaagcacagcgtcggagacctggtcgcagagcttgtcagggtggccctcgttcacagactcagaggtgaagaggaaagtctcggtcgccatttcttgcgcggtggtggtgatactccaatctacctcttgcgctgccgctgctgccgccgccgccgcgcccacgcgtccgcccacgcgtccgcccacgcgtccgcccacgcgtccgctcagcacaggtgaggatccgcattagaaggctttgcaaggccttggaagaggatgcttttaggccagtgctgcaccactatgatggtcctaaattccgcctcgagctctccatagcagagacactgtcactgctggacctgtgcaagacggaagacgcctgatctgctttggaacatggttgtggttgctctgtggttctttttagtaaatatcatccctgtaagttgtggaagatgttttcacaatgatctgttccgtccgtcgtctatgaaagcgcaagctgttggttggtggtgcatttcccccagaaaggacctggtgcttggaagaagtaggcctctaaagatgtgagcctgtctgtgtcggtgccgtctgtccgtaatctcggtgatgcgtatgttcttcatatttatgtacttgtagtgcagtatgcccgccgccagcggggaaaccccgaaagacgggggatactgttgtgatgcatcatgaatgccccaaagtgagggcggttgatgctgggagtgtatctgttgtctctgtaccttaccttggtttggaaagttggaaccttgcatttgactt

SEQ ID NO: 28215 - DNA, 2245 bp, Triticum aestivum
  Clone ID: PAT_TA_28215
ccattcccgctcccccctctcccccgtccggaatcctccatggcgactcctctgcccactggctcattcgcagcatgtcgcctccaacctaggatccgggtgttgcatgccacgaagccgccggcgcagaatgctggcccggcagcggcagcctgcgctcccgtccggcggggcggtagccaccgtactggcgcgaccaagagcagcctgtccacggtgtgcgagccgctggggcccgaccggcccgtctggttccccggcaccgcccctccgccgtggctcgacggcaagccttccgggaaacttcggatttgatcctctcggattcggatcggagccgggagtccctgcggtggttcgcgcaggcggagctgatgcacggccggtgggcgatgctggcgggcgggccgggatcctggtcccggaggtcctgcacaagtggggcttcatggaggagttctccctggtacacggccggcgagcgcgagtacttcgcggacccgtggacgctcttcgtgacgcagatggcgctcatggggtgggtggagggccggcggtggatggactacctcaacccggggtccgtggacatcgagccgcggttccccaaccgcaagaaccccaccccggacgtggggtacccggggggcctgtggttcgactggggcaactggggccgcggctcgccggagcccgtcatggtgctccgcaccaaggagatcaagaacggccgccttgccatgctcgccttcgtcggcttctggttccaggccgtctacaccggccagggccccctcgacaacctcttctcgcacctcgccgaccccggccactgcaacatctttctcggcgttcacgtcccactgatcgtggcagagtggccaacggtgttgctatggcagaaggtttttgcggtgaacttgagcactaaggctttgagggcgtcatcttgcccgttggaaaatgtgaatattacagtgcaccggaagaggggagtgggccggggaagatgcttaccagtacaattcctcgtcagaaaatggtaaaagaaaaagggttctattgcttatggcgaattcacatcgggccatcccggcatccagtactggaaaacaacgagtacgcactccatggcattggattcacatcggtcggtcggacgatatcttgatatatgtacgcgtttgcattcgcatgtatatataggagttaaccgctggggaagattcactgctcccatgtctcgaacttgccggagacgaagtcgtaatggccgccgaccagcttgagggttccgttggacacaccctccttgacgaacgggtaggtcaggaggttctgcagggacacgttcactgcctccttttcgaggacggtgcactggtcatcgaaaggcatggaggcgcactcagtctgcaccttcttcttggccgggaagccgatcctgacccagtcctcgacgaagtggaaggagtcgtctgcgccatccttgagtgagagcagagccttgattccaccgcagcggctgtggccaatcaccacgatgacctcaaccttgagagcacagacggcgtattcgatggccgatccaacaccggcgtacttgttcttgcagtaggaggggaccatgttggcgatgttgcggatggtgaaggcctcgccgggctccaggcccagggtgaccgatgggcacacacgcgagtcggcgcacgcgaacaccatgtacttgggcgcctggccggccttgaggggctcgaagaaatcgggcttcttgtcgtagacctcggtcttgaacttctcgaacccggtcttgaggcgctccacggcggcgtccatcttgttggagggtggaggaggtggtggatggtaggtaggcttctggaggagtgacgaggaggaagaatctatcgctgccgccgctgctgctgggttgttctccccaccgggggcggagggcttcttatagcagcaggggaggcacaggcagccgctcatcttcaactatcgcgctcgcgttcgcgactctactcttttgttttttctctcctctcccccggaccggatggatggatggattacaatgcgggtgcgacgggcgcggcctggacgggggtgttcctgatgagcttggggcggaaggaggaggagttggagggcgcgggggtgccgaggctggcgacgatggtggaggagcgggcacggggcgcgacggttgcgtagcaccagttagcctcgtgccgaattc

SEQ ID NO: 28216 - DNA, 2087 bp, Triticum aestivum
  Clone ID: PAT_TA_28216
agttttccagtcagagtttaaagacgccatggggggtaatagactcatataggggaattggtacgggccccccttttttttagacaatgccaacataataatgttcaaaagggtattcattttttacatcggctacaacaccagggtacaagtacacatccaacaagcatgcattgctccacaattacataccatcatccacggtctacttcccaggaaagaaaaaaatcaagttccaccagcgatcttcttccccgtggtagcacactcctcggattagttgctaactcccaccgtgttccttacttgggggcaaaggcccggaagatggtggcgtggccggggtcggcgaggtgagcgaagaggttgtcgatggggccggtgccggtgtactcggcctggaaccacgcgcccatgacggcgagcatggcgaggcggccgttcttgatctccttggtgcgcagctccttgagcttctcgggcgagccggtgccgtagccgagcgggtcaaaccacagaccaccggggtacccgacgtcggtgccggtgagcttgttgttggggaagatggggtcggtgttgacgcagccgggcttgatgatgtctgcccaccggcggccctcggcccagccgatgaggatgagctccacgatgaagagggtggtggtgtcggtgaagtactcctgctccccggcggtgtaccacgacggtgtgttgaggatgccgatcttggtcagcagctccgggatgaagatgcccgccgcgcccagcatcgcccaccggcagtgcaccagctccgcctgcacgttccaccgcaagctctccgggtcggatccaagaccccaggggtcaaagccgaagtctccgggaaggctgcatcaagaacaacgagacgtgcacacacactgtcagtgcgaagagtcgatcgcagcatatttcggcatgcatgggcgcaacgtgtccgagtaccaacctgccgtcgagccacggaggaggggtgctcccggggaaccagatgggcctctcgggcgccgcggcgcgcacggcgaaggacgcgcgcgacgccgccgccttgccggcagcgccgaggaaggagctccgggcgccggccagcccattgctggggagcgccgcgacggcggtggcggaggaggaggagaccagcgccatcgttgtgccaccagtgcgctcgctggctgtgcctgtagtggggaaggcgagcgcgcgcgtgcgctcgtgccgaattcggcacgagaaaagatcggttgttcatgttaccggaaggctacacagagcaatacagcatgcacaaccgatcttttgtacaaaagtgagcaagaatacaatcattttaagcaacagaaggagattattaggtccatgaggaagcaggcaaatacatataatcgcagaggtattacacataaggtttgtgagaggctaacattcacatcgtcactcgacgagctactgatacaaacattggatggagcacatggcagctagcctcgttcgcttaagcagcaacctccttgatctcgtccagggcgtagttgttggtcgacacgccggcgtagttcaccttggcgaaacgcaccaccaccgggtaacgggtgttgggatcctgatcaaccgtgacgacggatccggtcccgttgtaccagtaggactccctcctcagaatcttcaccttggttcccctcttgggtccccttggcggcggcttggctttggcgggctctttggtggccacggcggcttccggtttctcctccgcggccggtgctggttccgccggtgcggcggcagtcggctcctcctcggcgcgggccacgagcttccagccgagccggttggacgggacgaagctgacgcggctgcccacgccgccgttggagccgctggggatgcccgccgccagcatgaatctggaggtggccgacgccatgttggtgcttgccatcgggacggcgagctcagaacagcaaggtattgtttgtcggtggtgctagctcgtgtggctccggccaacagaagtatgtaagtcgatgcggacgcgtgggcggacgcgtgggcggacgcgtggg

SEQ ID NO: 28217 - DNA, 926 bp, Triticum aestivum
  Clone ID: PAT_TA_28217
cggacgcgtgggggatatcatgaagaagagggacatgtttgttgcgtttgaaggtgtacttgtgagtgcaagggagcctcgaggatttgggtttgtccagtacttcaatcctggtgatgctgcagatagaatatactacaaggacggacaggttattcatggcaaacaagtagcagttctatttgcataacagaacaaaaagaagcctgccatggggtgtcctgtggcagatgcgcgcccaatgatgttgtggagctatcaactcccacccagatcgccacagagaacagcggagcatcctcccttctcccttctggttgcatctccgcctggtgatctcctccttttgttcagttcatcctctacacaaacccttttggatacatcattagagcttgttatgcagttctctgtttctagaaatttcaatgctaataaactagacactaacctcgaacaatgacttcttgcaggcttgtcttggtgagacaggcatgctgaagcaaagatccttttccttctctgtatccctcaatctttgttttttctcacaatgaagcaccttgcttctccaagacattcaagccatgatggtgtgactacaggtggattacaacatctttacctgataaacatggaatatacaagaggaaggagcaactgcagcaagcagtgatgcttcaggcgctgacgtgaggattactacatttgagagcagaggaagagaagcgtaaaactgtcatgtttgcttccaccattcatgctgagcaggatgcatggtagagaaggatttctttctcgtgaaaatcgggagagaggatattgaagccacctttgccaacatagatgaagatgagaggattggccaactttggactccaacggccactatgatgatgaagacttgaactatggactatgaggcc

SEQ ID NO: 28218 - DNA, 1579 bp, Triticum aestivum
  Clone ID: PAT_TA_28218
cgtagtctctaaaatagttgttgacaccgttaattaaaattgcatcagtatctatcaatgtaaaaaactaaaaaccttagcaaaataaagttatcttgagttacttgtgtatagtatatgcagacgaaatgaaactacctttgtctgatctgtgatggtttcaccgtccatgctttggctgaacagaacacagactgaggacatatttctgtctcttcgccttcttgattacataactgggatactcattcctaataagactagcaagctctatggaatctgctgatttccgaaggcctcttttcagtggcttcgttgatgtatgtgtcttagactggggctttgtgctacttagctttcagtggtactctattcatcaaacaagactcattgtctttctgtttagatgtggattgtttttctgttcggcaccatgtattttttcaagctgattgaaatccaaagtttctttctgaactcctttgacattgttgcgagttgttgtagctgatgctataagattatctaaagaagaacttgtgtgtccttttcatgcttttgatggtattagggttagaaatgcttgttgtttttgttgtgctgcttgggtgcggggtagtctgctacatgtgtcaagaattgggtctacacggttactctcttggctcgctattttgaggcagcaaaatgtctgtctaatttgccttgcattgtccctgcattgctgcttatgttcgtgtttcgtttgcgatgctggtgctctggtggatgtcgggcaggtgtggggcatgtgtggggcttctgatgggggcctgggggccgcgagggtgccgcgtggtcctgggtttgtccagtgctgctgctcaggtgatattgtacatggaagatagtacgatgaccgactggttatgtggtgcacacaaattacagacttatttgcacaaactgcagaaaagaatcctgctctgggccctcccgcgaggattgcgcccttgtggacgacaacaactttacctgataaacatggaatatacaagaggaaggagcaactgccgcaatccgtgatgctgtaggcattgatgtgaggattactgcatttgagagcagaggaagagacctgtaccactgtcgttctcgattacaccattggtgccgtgtggaatgtaaggtagacagtgtttcttttgcgcaaaactaggaagaatggctattgatgctaccattgtcaataatgatgtagatcagaagagacgggaactatggacttcacaagcagcgatgacgattagaactttatctaacaaaatgagactgagtagtagaagatccatgtatgcttctgggcctcgttgacggggattgaaaatgttacagtgatttgtttcaaatataactccatgctaccaaattttaatgtgtatatacatttcattgtagacaacaaacccctgtttttctagaagattaaatttgttgtcatatgtgctttcatgtaactaagcaactaaaccatggattacttttcatcgctaacatggaatcagcaggtctctgcgccatttggtgcaacgggtccact

SEQ ID NO: 28219 - DNA, 2359 bp, Triticum aestivum
  Clone ID: PAT_TA_28219
caagcacctgctgggcgggagtctggctgcggtagggcagtggccgccgcggtcgcgacccgcccggtgcaagccgaacttaatccaggaatgggtgactctttgaacagcaatacatcggaagaaaaaacctcagattgtgcatctcccagccaatctaacaatatggcttctgatgcagagaagaatgaagctgaattacaggctgagacagatgcagcgccaaacagtgtagttgcacctgaggcaggaagttacgatgctgatggccatggcatcacagtgtcggaaatggaaaatgtggtctcatcccacactaacatttctgctgaacaaacacattctgggcaggagtcaaacagtgatagggcagtggcctctgctgagtggaatcgccagaaggaagccgaacttaatcagatgttaatgaaaatgatggaggtcatgcctgggaagtttgcaggcgccaatgtaactgctaccgggctcatttctgcaagtgagaagaaaggtggacttcaaagagagaagcgagacacgaaggttcgaacagagaaaggtgtaaagcgaccagcaaaggagacgagcaccaagctcttgaaggaatccgttgggcagaacagagcagcagttacccccaagactagcatcataacagagaagcgtaattcacctattccacaaagggcaaggagaaattcatcacctccagtcttgccaaaggaagtgatctcaaagacaccagcaaaaaaaaagttcccccaaaccatcacctgcaccagctacccgtagttcatggtcaggatctttgactaaagcaactagtagtactgcacagaaaactaaaaactctcctggagcagtttcaacatcgacaccaactagccggagaaggaccgcgacagcatccttggcacctcagccgatttcaaaggtggaaaaaccccttcaagcagtgaagaacaagaaggaacctgtgactgcgacaaagacagccattaaggggcaggaagataagaagacaaggacagcaacaaagccgagcagagtggctaaaagttcacctgcatcagaagaaaaatcaagtgcaatgacaaagtcaggcatgtataacaaggtcccaaagaaaagcagtgttgtaccagtagaatccaaacccatgaagaaagccactgggattagtcaaagtgttggttctggtgctgttaagagtaaagtgccgcagcttggtgattcttcaaagggcagtggaattgttacccgtgcggaagataaggagcaatctcctgtgacaaccgagccaactaccaaggtaccagaggctgatcttgctcaaccagcacatgatgttgatgaaaatttagaaatttcgatcgataatgacttacatgttgaaaaaacagaaaacccgggctcgagtttaagcgcagccgaaatgggccccagtgaccaggttgagccctctgtcgttgaggtcaaacctcttgacgaggacatggacatctcatcagctgcctgggttgaagtggatcatcaagaagttactgatgtgggtgaaagcgtgacaggcgaggatgtcacctcgccagcaattgaaccgttaccgtcttcaagcccaagaatccgtcattcgttgtcacaaatgttgcaagcagatagcaacgaaccagaaataatagagtggggaaatgctgaaaacccacccgcaatagtttttcataaagattctccaaaaggattcaagagacttcttaaatttgctcggaaaaacaaaggagacaacaacactaatggtttggcaagcccatcggtggtttctgatggagaggatgaacaagaagaatccggtgctggtgacggtgtaaattccagcaggagaacttttgatggttccaagactaatagcgtcttatcagctcaatcaacggccagcagcttcaatgccacaggctcggataggctacgggacaggcctggagctgcaccgtcaactaaagcagcatcaaggtcattcttctccctctcaaacttccggagcagcaaaaccaacgagtcaaagcttcgatagatagcatgcgttgttatacgttagatgtaaaaatggattgaggtgactgattgttgagaacggagccaggttgtttgtgtccggttctgctttcctgctcttcgatattagcttctccttagcggtccgcatatcattactttgctcatgtcttgctgtacatcttttaagtatttttctgagttgttttagatgaccggtatgttatcttgactggtactactatttttcttttttgcgggtgatcttgactgatgactgctgcaaaaaaaaaaaaacagatttaactgc

SEQ ID NO: 28220 - DNA, 1075 bp, Triticum aestivum
  unsure (1)..(1075): unsure at all n locations
  Clone ID: PAT_TA_28220
gaaaaagctttttcgtttgattatacataacaataggaagctacatagcttttttctgtagttagaggactaggtattttatcagcattggcaataacgcaatggtttcgactcaagagccaatttcagcagctggtttgacaggatctgtaaaccaaacgacaatcaacataaacagagagtttcacaccgaggaatcatccacctattggctaccaaaagatgatgacgagcagaagcggctggtagggcaacactttggtctcaaagaattatgtgaaggaaacgtacgcagtaatgttaccaaagcattagattttgaaaagggcatctcgattcttgatgtaggctgtggctcaggtgtgtggattatggatatgatcaatgactatcccaactgtacttatcacggctgtgatattgtgaatgctaccagcaaattcctgaatgccaatcaatttacatttagctatggaaatgtagtgaagggccttccttacgctgacaacacatttgactntgttcacatgagacttttgatacttgctcttcgtaaggaagaatggccaatcgccataaaagaagttatacgtgttgtcaaaccaggaggcatgttgcaattaacagaagcccatctcaaattaccagatgatacctcttgcgcttactataagcttgtgagtgcatttaagactgtagctcattcaaaaggacaagacatggacattgccaaggagttggaagatatgctttcagtcaatagaaatgttagcgtattgcaatcagaatgtcgttggtgtagatcgaattctggcacattagctgcaaagaaacttatttgggacggtatcgagatagcaaagagcaccatgtcttcaataaaaccattgctaggtgtagacagtgaagagagtgctttgaaattcctggatgacctcaactactgtttgacccatacagagtgctactttcgtgccagatctgtcactgcacaaaaattttagtgtgcaaatctgtattctatagtgttagtaaactcatgctatttaaacgaataaaaaatgtgtagaccatg

SEQ ID NO: 28221 - DNA, 136 bp, Triticum aestivum
  Clone ID: PAT_TA_28221
gacataacgtagtaaatgagaaactgggaaagaaacagtttgattgcagcaaagtgtttgaacgttggttaaatggaccacctaatggaaagtgtgaccaataaaataagattatacatattggttttttctagtg

SEQ ID NO: 28222 - DNA, 458 bp, Triticum aestivum
  unsure (1)..(458): unsure at all n locations
  Clone ID: PAT_TA_28222
cccacgcgtccgcccacgcgtccggtagccgcaacatttgcacggaggtctcacggtgcaaattcaaccaactgaatttctggctgcgaactaagggcctcaaatttattttttattgatctccaatcatttgactgggctctttggaggataacatagaaggttttttgtcagatgccggccacaattactgattccttttgctcgatgtacacctgaggttgtaataccaattgtatgctttgtaatgagattatgcaagaggaaatggacgattgagtcgttcctctctttatctgactctggaaaactgcgacttcacaagcaaagtatctggtgaggatcatttgattttttaagacgggcttgaaagaaaggggactggcttacatcattgggtcaacaaaataaagttgtttggttgaatcanaaaaaaaaaaaaaaaaaaaanannnngg

SEQ ID NO: 28223 - DNA, 1816 bp, Triticum aestivum
  Clone ID: PAT_TA_28223
cccacgcgtccgcgaataatttcgtcttatgcattaactggggtgaacacagggttcatacactcatacgatcatatcaggcagaccgatccgagttccaaatacgtaaagcacagtgcatatgtacatagcgaaaacaaagcaccaatctgtgacagaaactaacactacgcataaaaaatataccaatccaactctaatagtacctcccttgcgcagaacaaatttacggtacccagcatactcagtaacccacccggcgcacatgcacacgatattcgttttcaccgtaatcaacctagacacagcacaccgacacctccgtcttattctgaaaaaaacacatttccttcacataggacgcttcatttgcttcatgggaaaatcatgacctcggggtccatgcagcgaggatctcctcggtgagggtgctgtcctccccgatcttgtagctggcgaacacctcgaagttcttcccgaacaggccggccagcttcaggagcgtctccttgtacgcggccttgtccgtccaggtgttgatcgggtcgaggatctcagacggcacgccctcgatggcggtggggatctcgaggccgaagacctcggtcttctggtagttggccgtgaggagctcgccggagtggatggcgtcgatgatcttcctggtgtacggcagcttgatccgcttgccgacgccgtaccttccgccggaccagccggtgttgacgagccacccggtggcgccgtaggtctgcatcttctcggcgagcatggcggcgtacttggtcgggtggagcatgatgaaggccgcgccgaagcaggccgagaaggtggcctgcggctccttgatgccgtcctctgtaccggcaacgagagcagtgtaaccgctgatgaagtggtacatggtctgcgccaggttcagcttgctgacgggcgggagcacgccgaacgcgtcgcacgccaggaggatgacgttcttggggtgcggcccgacgcacggtatcttggcgttggggatgtactcgatcgggtacgcggcacgagtgttctctgtgacagatttgtcggtgtagtccacctcgcgggtgtgctcgtcgaagacgacgttctccagcactgttccgaacttgatggcgttccaaatatcaggctctttctcccgggagaggtctatgcacttggcgtagcagccgccctcgatgttggagacgccattgtcactccagcagtgctcgtcgtcgccgatcaggagcctgttgtggtcagtcgacagcgtcgtctttccagtacctgagagtccaaagaagagggcgacgtcgccgtcgcggcccatgttgcagccggagtggagggagaggatacgcctcttgggcatgaggtagtgcatgacgccgaagaggcccttcttcatctccccggcgtactgcgtgcccaggatgaccatctcccgccgccccaggttgatgtccacgctcgtcgacgacgtcatgtagtgcgtgtagcggttgcaggggaacttgccggcgttgtatatcgtgaagtccggcgtgccgaagctctccagctcctcctccgtcggacggatacacatgttgtgcatgaagagcgagtggtaggccctggcggagatgatgcggactttgatgcggttctcggggtcccagttgaggaactggtcgttgacgtacaccttgtccagggagttgaggtagtccacggccctctccctgttggtcaggaacgtgtgctcgtccatctcgatgttcggcgagcccttgccccaccacagctcctgcgccgccgcctcgtccttgac

SEQ ID NO: 28224 - DNA, 728 bp, Triticum aestivum
  Clone ID: PAT_TA_28224
agaatcacctattatgacttagaacttgaagatcttggtaaggtatattggtctcctaatacttgcaaaacaagattcgcattaaatttaaagaatattccttatgatactgagtggctcacttttaatgaagttgcaaaggtcataccatccaagactaagacaggcgctagacccacagttcctatcattgaagataaagaaacccaaaaggttatccaagattcttgggaaattgttaattatctcgaagaagcttttcctgatagtccaagcgcatttcacggtaaccaaggtattcacaaatttttccagagccaatgtgaaaaaaatatcgtgtttcctatctttaaaatggttgttttgactattggcaatgcatgtggtcctttcaagcagtcattccgtgaaactagagaaggctactttaatatgtccttagaaaagcttgctggtcaacccgaggatcacgcacctgatttgaagaaaggcttggagcccattcatgaggtactcaagagctatccttttgtaaccggaaatcaagctggctgggctgatgttgtacttgcagcccatctgaatttcttggaaaaacttaaacctgaatcatttcaagcctatgtgttggatgtatttgatgatgatattttattaaattggtggaaacgcgttgaatatattcgtaaataaatatgcttcaccctttttcgtttttagcacatcgt

SEQ ID NO: 28225 - DNA, 777 bp, Triticum aestivum
  Clone ID: PAT_TA_28225
ggatccattgtgtcgttggcgagtgttgccagtgtcatggagggatggcctcacgcatacaccgcgtcgaagcagcggtggtgggtctcaccaagagtgtggcattggagctggggaggcatggcatacgggtgaactgcgtgtccccctacgccgtgccagcgctctccatgccgcatttaccccaaggagagcagaagggtgatgcagtgagggacttcctggcctttgttggcagtgaggcaaacctgaaaggtgttgatctgctgccgaaggatgtcgccgaggcggtgctctacctggcgagcgacgaggcgaggtacatcagcgcgctcaacctcgtggtcgacggcggattcacctccgtgaatggcaacctgaaggcgtttgaggactagttgaagtctttagctgcatttgttacttggtatctgaaagcatttgagtaccattttctgatttgcctgtgttagcatgtcaataaggtgggtgatcatgtgtaaaatttgataattattctatattagtgcttaaggacagtgttgattattattgatattactctgttgaacctgtgagatgtgacaggagcttgtatagcgttcagttagagtttcataaagacttctgtgccagtatatctgcgggatagaaaccattgagcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgggc

SEQ ID NO: 28226 - DNA, 648 bp, Triticum aestivum
  Clone ID: PAT_TA_28226
caaataagcatgctttagaattagaacagatggtagctcgctttgttggaaaagaggatgcaatgtgtgtcagtatgggtttcgctaccaattcgactacaattcctgcccttgtcggtaaaggatgtcttgttatctctgacgaattaaatcattcctctatcgttttcggtgtccgtctttcgggtgcctcagttcgtgtgtttaaacataataacatggatgatttacgtgaattgcttcgtgaggttatttctcaaggtcaacctcgtactcatcgtccttggagaaaaattttagttatcgttgaaggtctttattctatggaaggtacaattgtaaaccttcctgaacttgttgagttgaaaaaagaattcaagttttatttatatgttgacgaagcccactcaattggtgcgcttggtgaaaatggtggaggtgtttgtgatttctatggtatcgatccagcagaggttgatattttaatgggaacttttactaaatcttttggtgctgctggtggttatattgctggtgataaaactattattgaccatttgcgcttgcgtaaccatgcttacaattacgctgagcctgtttctgttgctgtcacccaacaagtcattacttccatgaagattatttggt

SEQ ID NO: 28227 - DNA, 1487 bp, Triticum aestivum
  Clone ID: PAT_TA_28227
cattgcaaaaacggaacgaggtcagcttcaaagcttaaacgttgaacaagttagctgtaaaactcctttgaaatctcatggcgatcctcatgtcatgcgttacttccaaaacgttggcgccatgcactccggaggtttctcggcaacaacggcacacatgtatttctgtatcagctcaccgccggcaaatccgaatcggcttaaccatgaagtcttggggcaccagctgtaccgttccaccgatgtggataagaggagcaacacgaattactgcagttggttccggtcctggagaactgccagaagaaaaatcaccaatacccaacaaagaggctgcaattagttcggaccctggggaattaccaggaaaatccccgctgcccaacaaatcttcattggtaacggtggtcgttggtggcgtctttggagcagtatccttttacggacagatgagagcaatggaagagaaggtggagaagacagcagaggtagcaatcgagactatcgagaaagcggcggatgtggttgacaaacttgcggacgaagtcatagcatttcctggtaatgaaaaccttaagaaggcagccttcaggatcaaagccatcgcggaagagatagagaaggatgcagaggaagccgaggccctaatccacaaggttgaagagatagaaaaggaggtggatgctgcagtggatactttcatggggaagggcatgaagaagggatcgagatgaatgggataagaaataaaagtaacagttactaatagtagaagttaacaaataaatataggatcatcttctcattggatggtaagccatatcgatgcatgcaggcttgcacaccccgattttgagtccattctttacctatgtccacgttctatgttagaaaatacaggggacacaagcatagtgtttctaccgtggctataccgaaacaatacaatgaaaagtagtcatatatgtacgaatatagctttcctccttgttgttcaaatcctcaacaatgagactgggtgtgtacaatctaccacgcgtataaaagtagaagtccacaagcccctctttcagagtgggaagccttttaggcggagatctgaaatcctagcactcttttttggtctaaatcccaacactttttttcgtcccctgaattatgcacttctctaagccttgttgttacaattctttcaacaagtttttcgggtgtggatgcttgcaacagcgagtggcttagtatgttgtacctttacctcattcatctattgcagttcatgagcaaaagaacttgtagttgacatgcctcatgagtatagtactcacatagccggtttgaaattgtacaacacaagttgcattatcttcatagatagtggccactgctttcaaaacaacaagtccatatgatgtctctatgaggagtgttattctccaaacccatatacactcttgtgatgattgatataatgcaatttgttttgaagt

SEQ ID NO: 28228 - DNA, 670 bp, Triticum aestivum
  unsure (1)..(670): unsure at all n locations
  Clone ID: PAT_TA_28228
ngatgcattagttaattcatccccaagttttatcctgtgagataatcagaacaggcgatttaacccacaacccatgtccctttctaattctaagtcattgccaaagcataaaataaccctcaagccaggctgtactcagaatcaaacaaaataatcaagaaacaaacccacgcaccagcactatccctcctcaagatgtcatatcgatctgcttctgcagataacgcgataacttcttgggctgtcgtggtggatgcgtgtagccaatggcgagaaactcctcaacggtgggacgaagaagtccctcttcccccaacggcagtgcaggcaagcgtttgcccaacgccatctgatctcaatgcgggaggagccacaatggcggtgtggcggtgtggtcctctagggccgccgtagccgtgcaagtttgtgggcttctccttcttcgacgacggggaggaggcttccactaaggcggggatgcggcggtcagaggcggcgcccatgagggccatgtaggaggttcaagaggataagagaagggaatggggaagagatggacgagggacggggcggatgggacaggggcaggacttccctgcgtgaccggatggggagatcgtgggtgtgtgctaggggatcgaggcggttgggcgaagacatggcgtgggac

SEQ ID NO: 28229 - DNA, 608 bp, Triticum aestivum
  Clone ID: PAT_TA_28229
ggccaagggctggcgttcctgcatgaggcggacacccccgtcatctaccgcgacttcaaggcctccaacatcctgctcgactcggattacgcagcgaagctgtcggacttcgggctggccatggaggggccgaagggggacgacacgcacgtgacgacgcgggtgatgggcacgcacggctacgcggcgccggagtacatcctcacgggccacctcacggccaagagcgacgtgtacagcttcggggtggtgctcctggagctgctcacgggccggcgctccgtcgacaagcggcggcgcgggcgggagcagaacctcgtcgactgggcgcgcccctacctgcgccgcgccgacgaccggctgcaccgcgtcatggaccccggcatggagtcgcagtactccacgcgggcggcgcgcggcgccgcggccgtggcgcactcctgcctgcagagcgtgcccaaggcgcggccccggatgcgcgacgtcgtggacgccctcgagccgctgctcgcgctcgacgacgacgtgcccatggggcccttcgtgttcacggtctgcgagccggaggcggcggcgggcaagggggacggcgccggggacgacgagcc

SEQ ID NO: 28230 - DNA, 965 bp, Triticum aestivum
  Clone ID: PAT_TA_28230
gtctgccacttcatcggggagggcgggttcgggccggtctacaagggcttcctcgacgacaaggtggtgccggggatgcagccgcagcacgtggccgtcaagtacctggacgccgagggcccccagggccaccgcgagtggctcgccgaggtcgtctacctcggcatgcagctcagccacccgcacctggtgaagctcgtcggctactgctaccaggagcaccaccgcatgctggtgtacgagtacatggcccgcggcagcctcgagcaccacctcttcaagaatctgctggcgagcttgccgtgggcgacgaggctgaagatcgcggtgggggcggccaaggggctggcgttcctgcacgaggcggagacgccggtcatctaccgggacttcaaggcctccaacatcctgctcgaatcggactacacggcgaagctgtcggacttcgggctggccaaggagggcccgtcgggggacgacacgcacgtgtccacccgggtgatgggcacgcacggctacgcggcgccggagtacatcctcacgggccacctcacggcgaggagcgacgtgtacagcttcggcgtggtgctgctggagctgctcacgggccgccggagcgtcgacaagcgccgccgcggccgcgagcagaacctcgtcgactgggcccggccctacctgcgccgccccgaccggctgcaccgcgtcatggacccgagcctcgagggcagctactccgccgaggccgccgccaaggccgccacggtggcgtacaactgcctgcacagcgtgcccaagaaccgccccaccatgcgcgaggtcgtcgactcgctcgagccgctcatgcgcatgtcccgcgacgtgcccgccgggctgttcgtctacaccgcgccgtcagagccgtcgccggtggccaaggccgtcgcggacaaggccgatgtggctgcggaggccgtcgaggaaaccaa

SEQ ID NO: 28231 - DNA, 268 bp, Triticum aestivum
  Clone ID: PAT_TA_28231
actgaaaatgcggttgtttccactgactttgtaggtgaagaacacagtagtgtatttgatgctaaggctggtattcaattaagtcctacctttgtcaaattggttgcttggtatgataatgaaaagggctacagttgcagagtagttgaccttgttgaacatgtttctaaatccttgtaaaaaaaaaaaaaaaataatgtataattctgtgtaaaatctttttttcaaataaaaaaaaaaagaaatcgccgtttcttttttgttgact

SEQ ID NO: 28232 - DNA, 701 bp, Triticum aestivum
  Clone ID: PAT_TA_28232
gcgcaagcaagcagcatcgatcccaagaaaaagcctcttgcttgcactatcaaatatcaatccaaggggaagagaaatccatcaattgcggcgagagccatgtccggcagcagcatcctcctggccgcggcggtggcagcggccctgctggtggcgtcggcgtcggcgcagtccgggtgcacggcggtgctcgtcgggctgtacccgtgcatgaactacatcggcggcaacgacatggcgccgactaagtcctgctgctcgcagcttggctccgtggtgcagtcccagccgcagtgcctctgcagcgcgctcggcggcgactcgtcatcgctgggccgccacgccgaccacgcccgaggtgcagacaccggcagggtctggatccaagacgaccccgtcggcgtacctgcaggagaacggcggctcgtcactccatggcccggctgggctggtgctcgccctcgcggctgctgcggtctacgccgtgtggtgagcgagcatctcggccgctggactgaagcggcagctggctggcgactcggaaattcgtttcctgtcagtgtgacacgattagattttcatattggtttagcgttgagcattggcgaggaggactggtcagtgttgtgttccacatctgtactatagcattatttggtttcttgctgcagtcgaaataaagaggtactggttgtttttgt

SEQ ID NO: 28233 - DNA, 880 bp, Triticum aestivum
  Clone ID: PAT_TA_28233
tgggcaggaagccgcatcctcccccaaagcaacaaaaactctcttccactcactatcaaacaataggattcatagaagaacaacaagggccaagtcaaccagcaagggtgtcctgagggccacaggtggcgcgcatctgccggtgccgtggggtccgccggggcccgggggtggcgcaggcgtcgtcggtctccgcgggtgcgtcgccgaccggcggcgcgtcgccgctgatcgcccaaaatcctgctgcgcgcaaccgagcgcgggagtgcagtccccgccgccgtgcccctgcagcgcgctcggcggctcctcgtcgtcgcccggcggcatgaccctcgagcagacgcgcgcgcgcgagcttcccatcgcgtgcaacgtgcacacccaaccggccacccgctccaacggcggcgaccgccctccaggcgccgaccccccgcccacgccagtggagcagacaggggcaggggctggatcccaggcgacacggccagcgcgcctgcaggcgcgcggcggctcgtcccgccagggtccggctgggcggcgactccgccgcgcggccgctgcggtctaggcagcgtcgtctcgtcgagcgtctggggcgctgggcggttggtcttgcttgcagcatgtacttctttcccggtattattttttggtttagcatagggcattggtggttggtgtggaccgagaggattatattgtagggtgttctgttccacatatgtattattattattggttttcttcttggagtctccgtataagttcaacaacgataatcatcgatttttttcaagctatttattcctcgcgttgctgcaggctcaacatcaaggagtcaatttcaaaaaaaaaaaaaaaaaaaaaaaaa

SEQ ID NO: 28234 - DNA, 830 bp, Triticum aestivum
  Clone ID: PAT_TA_28234
cgcgccacgacacagttgcatacacacagagagcgaaacttccattgttttgatacttcgtagatagtatactgcctagctagacataccacatatagagtatgggttcttggaagcgcaccatcacgacgccgttcaggaaggcgtgcaccatcctcagcccgcagcacggcagcgggaggagcgacgatcagcacggcggcagcggccacgacggcaagaagagcgccgcgcacgccgcaccatctgaagcggtccggagcggcggcggcggcggcggcggcgatggcgcagggcgaggtggtggagagcccgtcgacgacagcgcagctctacggcgacgtgatggcgtgcgcctacgaggacgtgcaggtcatgtggtccatgctggacaacaaagccaaggtcctcgacagcgccgcctcgtgaccacgcgctccgtcatcaccaccgatcgatcgatgggtcgaggagtttcatcatcgattcaatacatactactggcacatcgtccactgcacccagatttcagaccctttggcgctcaatctgcagaccgtccacgacgagtcctgaaactcttccgcgttctcctttttgttgagcctgatgaatccccccggctggcatggtacctgaataattatactaaagtgctagctagcttggagtgattggattgattgattccacagacagagtatggatctatgtttgatattgggggcatgttttccttttcccttcctttttgggtgtcacagatggatatggatgtattcggtcgtgcatcatccgattcgccaatcaatgacaagagtttttaaaca

SEQ ID NO: 28235 - DNA, 560 bp, Triticum aestivum
  Clone ID: PAT_TA_28235
tggaccggctggccgccttctccaagggcctcgccacatgggcaaggtgggtcgacgacaacgtcgacgcgtcgctcaccagggtcatctaccaaggcgtctccccaagccactacacgtccaaggagcaggagagcgacggggcggcgccggcgtcggggggctgtttccagcagacacggccgcggcaggtggccacggacggggacgagagggtgtccccggagcaggtggtcgtgcggggcctgatcgcgtccatgtcgacgccggtgtccctgctggacatcacctcgctctcgcagctcaggatcgacgcgcacccgtcggtttacggcgggcctggccgggacggcatggactgcacgcactggtgcatcgccgggctgccggacgcgtggaaccacatcctcaacgcgatgctgctgcagcacgcatgaagcagtcgcgtctggcgtgtgcgatacctccctagatcgtcgattgacagaggggcagtgtgtaaggctaattaaggcctccaaatattgtgcgcaaactgtcattgatttttagtattcatc

SEQ ID NO: 28236 - DNA, 509 bp, Triticum aestivum
  Clone ID: PAT_TA_28236
cctgctacacaagctgaatgtacttttgaacaagccatgattgagactgaaaacagagtcatctttgcttctggtactgcttttccagcctatacgattccttccacgaatcaagtgaaatatcctggccaaggaaataacatgtacatctttcccggattaggtttaggtgctatcctatcacgtcccaatcatatcacagatcgtatgatttacgctacagcaaaagcattagcagattcattaacaacagaagaaatcaatcaaggttggctttatccttctttaaaacgtattcgagaggtctcagccacgattgctgttgcagtttataaagaagcagtggatgctcatttggctagtttacctaaagttgataacattcaggattacgttatatccaatatgtggtcacctatcgatgatcattacggctcattggataccaaatcaaatattcatgcaaatctgtaaacaaaaataaaccctttttttttatatattaaaaa

SEQ ID NO: 28237 - DNA, 361 bp, Triticum aestivum
  Clone ID: PAT_TA_28237
cggacgcgtggggcacggcgttgaccgatctggcggctggtgcgcggcttgttccggtcccaacgacatcctgctcatccatagaaggagagagaagggcccgagggagagaggaaacagatgaagaaaggagaaggggcatacgcagggtgagggaggaagtcgccggcggtggcggctccggtgactggccgacgggcttgctaggcaaggctaaggagtacgctagcctgagattcgatagaggtgtgtttgatttttagatttgggctgaacaaccaattcttgggtagatttattcgatgtactgatggatcatcctctggagtgcatgaattgaatgaatttctgaattctgagc

SEQ ID NO: 28238 - DNA, 467 bp, Triticum aestivum
  Clone ID: PAT_TA_28238
acgggggaaacctgccgccggcaactcatattctcggtccgccgccggcttcccatctgctcccccgcgcagctcgcgggcaaggagggggttcgatccaatctttctttccacttcctcctgagtcctgaactaccaacgcggctgtaaatctctgccatcgccgtccgcgttcttcctcatcgcaacatcgtgcccctccgcaatatttgcccagtgggttctaaggtcaaagaccagagtataaaataaaggtgggttactgttaatatttcatacaatggagtccttgtggaagctgtcctatttgcttgagccggcgtcacttgccctcatcgtgacggctgtttcagttgcctatgcatcagcgtctcgtgctctggaccatggcaaggagatggagaggaacttggacttctcggaggccttcatcacacttgatcggtcgcaggcttttatgatccccc

SEQ ID NO: 28239 - DNA, 829 bp, Triticum aestivum
  Clone ID: PAT_TA_28239
ctcgggcccactgccgccggcggctcatattttctggtctctgtcggccctccgacggcttccccccccgggcccccaggaaggaagggggttagcctgcctgtctttccgctgcttccgaagaagttagagcttccggcggagcttgacttccctaggaacttgttgggcgggattgttccaggaagcactcctcgtgactacatgatgctcggccttggagacatggccatcccagggatgcttctagctcttgtactctctttcgatcatcgcaagagcaaagatgtggctgttccatcagacttgtctccctcctcaaagcggcgaaaatatgtatggtttgcgctaacaggttatggtgttggcttggtaactgcattggcagctgggatcttgtctcagtctccccagcctgctctactctacctggtgccctcgacactcgggcccattgtgtacctgtcatggttgaggaatgatctgtgggagctgtgggaaggatctggcacaattgtgaacgagaaagctcatttgctggaagtctgagatgatccaacatggccataaaaatcacaacctcttgtgatgtaatctagctaaaaaaaatctgctccaagcttctcattctacaggagaatatttataagatagtttggccttagtaatctaagccttttaccatgttctcacaagaggaaacaatatgtaatttatctgtaatggaaattgttactccgtattatatttggtgaaattttctattctctcttgcttgaacgaaaaaaaaaatatcatgttccgtgataaaaaaaaaaaaaaaaaaaaa

SEQ ID NO: 28240 - DNA, 598 bp, Triticum aestivum
  Clone ID: PAT_TA_28240
cccacgcgtccggcaaggttgacccggacgtgtgggagttcgcgcacgagtcgttcctgcgcggccaggcgaagctgctgccgctgatcgtgcgcaagaagaagagagccggcgccggcgcggcggggagggagctgtgcgaggaggaagaggaggtgcggggaacgatccaggcggtgcagaggctgcgggacgagcggaggggcatggaggaggagctgcaggccatggaccgcaggctccgcgcggcggagaaccggccgggccagatgatggccttcctcggcaagctcgcggacgacccgggcgtggtgctacgcgccatggtcgccaagaaggaggagctggctgcggccggcgccggtggcaagtattcaagcccggataagaggaggcggatcggggccgacgccggacgcggagctgacgctgcggatcaggcggcccagagcagggccgtgccgttccccttatctaatctgggacaggtgttctactgatagaccttgggagccgagagttgatagataggtgtacacgtgtgatgttttggtgtttatgtatgtttatatgtatgtacagtgtacttcccctcggc

SEQ ID NO: 28241 - DNA, 945 bp, Triticum aestivum
  Clone ID: PAT_TA_28241
tgccgcgccccaaggagcacaacaaccccacgccgagccccgcacggaccgcagccggcgcacctagcgggttgtagactcttcgtccatgggaagcgagtgcaagggccaccagccgcaggacgacggcggcgtggcgccgttcgtggcgaagacgtttcacatggtcagcgacccggccacggacgccgtggtgtgctggggcggcgccagcaacacgttcctcgtcctcgaccccgccgccttctccgacttcctcctcccctcctacttccaccaccgcaccttccccagcttcgtccggcagctcaacacctacggtttccgcaaggttgtcccggacgtgcgggagttcgcgcgggtgtcgttccagggcggccccgggcggctgcggccgctgctcgcgcgcaagaagacctgacccggcgccggcccggcccggacggccccgggcgtgggggcagaggaggtgcggggaacgatccaggcggtgcagaggctgcgggacgagcggaggggcatggaggaggagctgcaggccatggaccgcaggctctgtgcggcggagaaccggccgggccagatgatggccttcctcggcaaagctcgcggacgacccgggcgtggtgcttcccgccatggtcgccaagaaggaggagctggcttgcggccggtgccggtggcaaggattcaagcccagataagaggcggcggatcggggccgacgccggatcaggcggcccagagcagggccgtgccgttccccttctgtaatctgggacaggtgttctactgatagaccttgggagtcgagagttgatagataggtgtacacgtgtgatgttttggtgtttatgtatgtacagtgtacttcccctcggcatagttgctaatatgaccgtctgattggcgccatagtagtcaaaaaaaaaaaaaaaaaaaaaa

SEQ ID NO: 28242 - DNA, 1188 bp, Triticum aestivum
  Clone ID: PAT_TA_28242
gcccgccgctcactctcagtatggcacaagttgagcctgagaccaaagggagctccatcaatgggcccgagggcaccgctgaagctctcgtagctacacttcccacaagggaaggatggtcgacgcccctcaccctctaccccttcggccccctgtgggcgcacatgctcagaaagttcatggtcgtgttggccaacccgcagccccggcgcgacgacatcatcctcgccacccaccccaagagcggcaccacctggctcaaggccctcgccttcaccatctccacccgctcccgctgcgacttcaccgacagccctctgctcacaatcaacccacagcgggtcgtgcccttcataggagccgtgggcggagaccttcgacatcctcgagacgctcccttgcgccgagggtgactcgctactccacctgcctccatcgttgctgccggcggaccgtctgcaccgtgggctgcagggtcgtgtagaaatgggaggatcccaaaatcgccttcgtgtcaaggtggtacttcaggaacaagatgggaaaaggcgggactcctatcacccttgacgatgccttcagcatgttttgcgaataagtctccccattcgggcccttctgggaccattatctccagtactggaaagaaagcttggcgaggccacacgaggtaatgtttctcaagtatgaagagattgtgtcggatccgctcacggtcgttagaaagctcgcaagcttcctcgatgtgcccttcacagaagaggaggagaagagtgggatcgtcgatcaggttgtgagcttctgcagcttcgaatcacttcgcaacctagacgttaacaaaacaggcggcgcggagcgtgcaggaggtaagattttcatccagcattcctcactgtttaggaaagggaaggttggggactgggtgaaccatatgagcaaagaaatgggagaaaaaatggatcgccttgtggaggaaaagttcagaggatctggtctagagttctgagatgcattcttgtcttgcctgcatctggtgggagagagtgcctataatgttgatgtattatgaagtctatgtgcactgtaataaaattaaataaccatgtgtatggtgacatggccattgtgaaaagttagttgcggtaatgatccgtttgctgtttttttataaagcccaaaaaaaaaaaa

SEQ ID NO: 28243 - DNA, 650 bp, Triticum aestivum
  Clone ID: PAT_TA_28243
cgagagctagctagaagcctagaacaaccataagcatagaggtcaatgacaatggcttagaccatcaccgtcgtcttcctcctcggactctccttcgcgtccgtgagcatgagcagcacgatgagaaagctagaggaggagatggctacgtccaagggggacgagcaccagcccccgatgctgaccctgcccaaggtccagctgtccccattcccgcacggtccacctgccccctagcggctcagcggcccaaggctgaagtctgccgaacgttcccggcaggccgcacctgccaccccaagccccgcagctcccaacgttcccggcaggcgcacgttccacgccaaggacctacagctagcccaaggtggacctaccaccaaaggccccgaagatgcctaccatccccgagttccacttcactgtagccagtagtctaagccatgcaagactgtcttcacttgtcttctttgtgttcgcgctcttatttgtatctgttgttcgtgttgtgtctttgggtgattcctggcttgtctttgtgtgatgtgaagtgcttatctatggcatctattagtggatgggatgtacatgtacaaatgtatgtttatgaaaaatggaaatgttgatctcacgaattttccttttctctt

SEQ ID NO: 28244 - DNA, 1052 bp, Triticum aestivum
  Clone ID: PAT_TA_28244
tgcgtcgcccggcctcgcctgccctccccggcgctcggggccgccgtctgcgccgccgccgtgccggccgtgcgccgctgccccccggcttcggcccggccgtgtccgccggcgccggcgccggtgtccgtgtcaattccgccgtccctcgcgccggcgccggccccggccccgcgctacgtggacctggcggcgctcctcgacgtggccggcccgttccacaccttcctcgcctacctgcagaagacgaacgtgatccagaccttccaggcccaggccaacaagaccgacgagggccatcaccatcttcgtccccaaggactcggcgttcgccgcgctcaagaagtccaccttctccaaccctcacctcgccgaccagctcaacgacgctagctcctctaccaacgcccttccccaagtactacccgctggcgcaggttcaggaatctcaggctcgctcaatcccggtgaacagccttcgccggctcgccctacacgctcaacctcaccgacgacatgggcagcatcagcgtcgagtccatgtggtccaagcccaagatctccagcagcgtctacgccaccaagcccatcgccgtctactccatcaacaaggtgctcctgcccatgcagctcttcagcaaggacccgccgctggcgccggcgccggcgcccgcgccggagtcaggggcgtcggacatcgcccccagcccggacggcggcaaagtgggcgcccggaacggcaaggcggactcgacgagcgccgggcatgtcggtgccgcgaattgcttcgggctgctggctgccgcggcaggtggcctgatgctcctgtggtgagagaggacacatggatggatggttcctgtcatttgtaagcacttgaatttgattttgagctggttgatggaggcattcttttggacatagtaggcatgatgttaggattgagtcggggtattttacatcgtattgctctcatgcataatcatgatcattactcataaattgacggacggatgaatatcgaaagaggtttcgtcacctttattatgatg

SEQ ID NO: 28245 - DNA, 634 bp, Triticum aestivum
  Clone ID: PAT_TA_28245
aggaattcggcacgagggtactccctagcgggcctcgtctgcctccttcagagcagccgccccaccatctcccgtgtcgaggccatgtggtgcctcctcgccaacgacctccgcctcgagcaggccatcaacatgggagcctccttcaccgataagtcgccccactctggcttctccaccgccgagagtgatgcgccttccccggccgcccccgccccagggcagcgtggctactgccacttccatgcgaccacggccacagagaaccacatgtttgaccctgaaacattcatgcgtcttgcgatgcgcgcccacactgacagcacgcgcccgcacaccgagagcactgctggcgtggtctcctgcgtcaagaacacatggtcacggtccggcggcagcgctgccccggcccctgctgccccagatgggcaggggcagcccaagcagtcatttgctatgaaggtgtccaccgatgatctcatcgagtctgtggtgatggagcttgagtcgctggacattgacaagaaggaccctcctgcggagaagcctgatcccaagaatgagatggtgcgtgacctcattaaacagacgcgggagatggaggagcagctcaaggagcgcaaggagtgggccc

SEQ ID NO: 28246 - DNA, 926 bp, Triticum aestivum
  unsure (1)..(926): unsure at all n locations
  Clone ID: PAT_TA_28246
gttttgaataagagagccttttcttcttgttcttacttgcntgaaagacattaaaaatgttactattatcggtgctggtttaatgggatctggtatcgttcaagtggccgcccaaggcaaatataacgtaaccatggtggatacttctgatgccgctttagaaaatggcaaaaaaattatttccagttcattaaagcgcgttgctcgcaaaaagtttgctgatgatgagaccaaacaaaaggatttcatcaaccaaacattgggttatatcaagacatcaaaagatgccaatgaagcatctgcatcctctgaccttatagtagaagctatcgttgaaaatattgatatcaagcaaaaactcttcaaaggacttgatcaggcagctcctgctgacgccatcttttgctccaacacttcatcattgcctgttactttaattgccaaagctacttcagaggaaagacagaagcgctttgcaggtctccatttctttaaccctgtacctgctatgaagctagtggaaattgttcgtacggagaacgttacggatgaagtgattaattctttgaatcaattctcaaagaatgttggaaaagtacctgtgagttgtaaagacacaccaggtttcatcgtcaatcgcctgcttgttccttatcttatggaatcttatcgtatcttggatcgtgaggaagcctcaattgaagacgttgatgctgctatgaaattgggtgctggtatgcctatgggtccttttgaactctctgattttattggtttagatacgatgaaatttattgttgatggctggcataaggaaggcaaaatcgatcctgcctttacccagccttcaaagacattggataaacttatcagtgaaggaagtttaggacgtaaaactggaaagggattttacgattattccaagt

SEQ ID NO: 28247 - DNA, 697 bp, Triticum aestivum
  unsure (1)..(697): unsure at all n locations
  Clone ID: PAT_TA_28247
anaaaagtgagacaaaacctttatttctcaagtggtttaaagggtgctgttattggtcttggtttaggtgtagctgctactgcttttactttacgtagatcccctgaattcagggcattaagtcgacctatccaatccatcatggcagcttccactacaacggcaggtttcttgtttgcttctgattctgctgttactgaatatgaaaacagagaaatgggctatacagatgaagacatgattcattcattattaaattcaaagcatacggatgacaccaacttgtctactgttgatcgatcattacaatacttaaacaagaaccgttggtcatttattggtttgtcttgggcagcatccatggctggtgccttgggatatagtttttcaaacagataccttaccacacagcagaagattgttcaggctcgtatgtatgctcaagcagtaaccattgctgtcttgatggcctctgctggtatctcaatttatgtaggtgatgatgaaaaaacgagaaaggaattacccgatcctcagttaagagctgttcttgaacttcctcattctaattcgccaaagccagacttgatgaagtctacctctgcttaaactcataaatgcatatattctctttcatccccttgttttattttttttttttgtttttttagacaataaaaacatgatgtagatattt

SEQ ID NO: 28248 - DNA, 1168 bp, Triticum aestivum
  Clone ID: PAT_TA_28248
gaattcggcacgaggctacagctgccgaccgcgtgtggcgccgctgcggcgtcgtcggcgccgggccccttctcgctctcgcggccgccgccctcgcggctgcgcgcgtcgcacgtcctcttcgccttccctcgcctgaggaaatacggccgccggaaccgcgagccggtacccaccaccctcgacgacgacgaggacgaggccgatgaggacgacgacgacgacgtggaggaggcggttgacgaggacatctttctcaagaaccggcccaagccggccgggttcggcgtggggaagacctacaccaccgacgtcgaagagcagcttctccggggggtgggcatcggcggcgccgggcgcaagagcaaatcggctgcgcccaagaacctcaaagccaacggctcggacacagaaaccggcgcagatcgcagtaatgatggcgttcatgttcgtatttggaacctcccgaaaaagaagaacatacataaggacctgaacctagctttcaaagggtttcctggcctggtaactataaatccagcaaactctggaactaagaagacccgtgatcctatttgtaagggctttgcatttgtcaaactggagtcagtggatgctgcaacgaggttcgttgaactgtactctcgtaaagctgtgtcgttcggtaaggttgaaaagccaatcaagtgctgtattgttgaagggcacgtctcgacggatccttcaggtccagcatccagtagtcagccaccagggtcgaacccacaacggttggtagccgtaagatgagtggcacagttgatctgtcgtcgatccagttgccactcggtacttcgactgaaggagaattccgggaagaaggttcgctacacagatatcggcatgcttcgctcaagattgcgaagatacagaccgtctggtcggaattcccggttttatagatgatatcaagcattgacattggtaggaaaccctttctccaatgggtttatttagaagatgggcagggatattagactcggttccttaaggtatgcagtggtttttttagttaaatttacgtgaagggattgtgtctaaattaggcccactgtttcggagaaggatttgaatctgaatccgcagcgtcgttataaatccccagattaaagttgcttcaaaaaaaaaa

SEQ ID NO: 28249 - DNA, 612 bp, Triticum aestivum
  Clone ID: PAT_TA_28249
ccgctcaggcggcgggcgggatttctatcccaatagcagaaaccatggccggcgaaggggatctgaagctgctggggctgctggtgagcccgttcgtgacccgcgtccgcctggcgctgcacatcaagggcctgagctacgagtacatcgagacggacgtgctggacaagggcgagctcctcctccgctacaacccggtccacaagaaggtgcccgtgctcatccacaacggcgtgccgctctgcgagtcgcagatcatcgtgcagtacgtcgacgaggtctgggccgccgccggcgcgcccatcctccccgccgacgcctaccagcgcgccaccgcccgcttctgggccgcctacgtcgacgacaagctgttcccggcctggctgggcatcctcctggccccgaccgaggcggcgagggcggagaaggtgggcgagacgctcgcggcgctcgcgcagctggaggtggccgcggcggagtgcctggacggcggcaagaggcccttcttcgccggcgactccatcgggttcctcgacctcgccgtcgggtgcaacatgttctggatggaggcgctgcgcaggatgttcggcgtgacgttcctcgacgcgggga

SEQ ID NO: 28250 - DNA, 828 bp, Triticum aestivum
  unsure (1)..(828): unsure at all n locations
  Clone ID: PAT_TA_28250
nnnnnnnnnnnnnnnnnnnnnnnnnnnnnnnnnnnnnnnnnnnnnnnnnnnnnnnnnnnnnnnnnnnnnnnnnnnnnnnnnnnnagaagggagaggcagttgtggttgtagcagcgcgatgcccaaggaagggggcggagatcatgagaaacggggtacgcttgtgcgagtcgcagatcatgggccagtacgtggacgaggtaggggggggggngggggngaccatcctccccccgcgacgcctaccagcgcgccaccgcccgcttctgggccgcctacgtcgacgacaagctgttcccggcctggctgggcatcctcctggccccgaccgaggcggcgagggcggagaaggtgggcgagacgctcgcggcgctcgcgcagctggaggtggccgcggcggagtgcctggacggcggcaagaggcccttcttcgccggcgactccatcgggttcctcgacctcgccgtcgggtgcaacatgttctggatggaggcgctgcgcaggatgttcggcgtgacgttcctcgacgcggggaagaccccgctgctggtggcgtgggcggagcggttcgcgggcaccgaggcggcgacggcggtggtgccggacccggacgccgcggtggcgttcgccaggaagcttcaggccaaatatggttccgcgccgcctgccaactagactggcttcagttcagttcagttcagttcactccaagtagtagcagtgctcatcgtggaactgtgtcgcgaatcgggtgtgtactttggaacatgtagcacttggctactcgtgtaataaagccatggagagaaatcatggattatctttttt

SEQ ID NO: 28251 - DNA, 968 bp, Triticum aestivum
  Clone ID: PAT_TA_28251
cggcagagcagcagaacagacagagctatcccgatagcagaaaccatggcgggagaaggagatctgaagctgctgggcctgctggtgagcccgttcgtgacccgcgtccggctggcgctgcacatcaagggcctgagctacgagtacatcgagacggacgtgctggacaagggcgagctcctcctccgctacaaccccgtccacaagaaggtgcccgtgctcatccacaacggcctgccgctctgttagtcgcacatcatcgtccagtacgtggacgacgtctgggcccccgcccgcacccccatcctccccgccgacccctaagcccgcgccactggccgcttctgggccagcctacgtcgaccaccaaggctgttccccgccatggtttggggcctcctcttggacggcacagagggggcggaggacgggaggcggtcggcgacgccggcgctcgcgcctctgcgcagctggaggtggccgcggccgagtgcctggacggccggcaacaaccccttcttcgccggcgactccatcgggttcctcggacctcgccggtcgggtagcaacatgttgcggatggagttccgggtgaggttcttcgaccgcgggtacctcgacgctggtagtagcgtgggccgggcggcgtgggcggggcggttcccgggcaccggggcggcgacggcggtggtgcccgacccggacgacgcggtggcgttcgccaggaagcttcaggccaaatatggttccgctccacctgccaactagactggcttcttcttcatggagacatgacttgtccgtgatgtaataaagccgtgaaggagacatgatttgtcgaccttcatggacatggcttacggttgccccggactggctgaacttgtgagctgttcttcatggagacgtggctgtatcgcgcccggctccattgatgccaaaaaaaaaaaaaaaaaaaaaaaaaaaaa

SEQ ID NO: 28252 - DNA, 881 bp, Triticum aestivum
  Clone ID: PAT_TA_28252
gaaataaaagaacattgactcccttcacgccaaatttgaagcccttgagaagaaggtggaagaaggtttacccaagaagcagcttcgtatgatcatcatgggtcctcctggtgccggtaagggaacgcaagcacctgctatcaaggacaagttctgtgcctgtcatttggctacgggtgatatgcttagagctgctgtgaatgccaagacccctcttggtttggctgccaagaagatcatggatgaaggtggacttgtatccgatgaaattgtggtgggtatgattgaggaaaacttggataagaatcctgaatgtaagaatggtttcatcctggatggtttccctcgtactgtcgttcaagctgaaaagttggatgagatgcttgacgctagaaagaagcccttgaactctgttgttgaattggtgattgatgataaccttcttgtttctcgtatcaccggtcgtttgattcacccttcatctggtagaacctatcacagagagttcaaccctcccaaggttcccatgaaggatgatgttactggtgaacccctcattcaacgttctgatgacaatgtcgaatcattaaagaagcgtttggatgctttccacaagcaaactgttcctgttgtcgaatattacaagaagaagggtatttggtacggtgttgacgcttctcaatctcccaaatctgtctgggcttctcttggtgctatctttgacaagactctttagattatttttctgtattttgtaattatcttttgcttttttcccttttacaaaaaaaaaaaagaaataattcttttttggtcaaaatatacaacatttaaattgtttacaatgaaaaactacctcaagaattctatgcttgcccttg

SEQ ID NO: 28253 - DNA, 587 bp, Triticum aestivum
  Clone ID: PAT_TA_28253
gaagttattctgggtgggtaaagataagactaacatgtcgtcgttattgatcggttcgattccggtaaatctaccaccactgactggttgatctacaagtgtggtggtattgacaagcgtaccatcgaaaagtttgaaaaggaagccgctgaactcggtaagggttccttcaagtacgcttgggttcttgacaagctcaaggctgaacgtgaacgtggtatcaccattgatatcgctctctggaagttcgaaacccccaagtaccaaattaccgttattgatgctcccggtcaccgtgatttcatcaagaacatgattaccggtacttctcaagccgattgtgctattcttatcattgctggtggtactggtgaattcgaagctggtatctccaaggatggtcaaactcgtgaacacgcccttttggctttcactcttggtgtccgtcaattgattgttgctgtcaacaagatggataccaccaagtggtccgaagctcgtttcaacgaaatcgtcaaggaagtttcttccttcatcaagaagattggttacaaccccaagtctgttcccttcgtccccatctctgg

SEQ ID NO: 28254 - DNA, 759 bp, Triticum aestivum
  Clone ID: PAT_TA_28254
gcgacacgtgggcgccgtggacgcggcgcggctctactgccggtccgacggcgcctacctctgcgccgggtgcgacgcgcgcgcgcacggggccggctcccgccacgcgcgcgtctggctctgcgaggtctgcgagcacgcgcccgccgccgtcacctgccgcgccgacgccgccgcgctctgcgcaacgtgcgacgccgacatccactccgccaacccgctcgccagccggcacgagcggctcccggtcacgcctttcttcggcgcgctcgccgatccgccccagcccaacccctccccgtcctccgccgccgcgatgcaggaggacgcagacgacgacgggagcaacgaggccgaggcggcctcgtggcttcttcccgagcctggcgacagccccgaggacagcgccgccacgttcttcgccgattcggacgcgtacctcgatctggacttcgtccggtccatggacgggatcaaggccatcggggtgcccgtcgccccttccgagctcgacctcgccggcggcgctctcttctaccccgaacactccatgaaccagagcatgtcaatgtcagaggtcgcagtggtgccggacgcgctgtcagtcggcggggccctggcgccggcgccgtcggtggcggtggtggcgagcaaggggaaggagcggcaggcccggctgatgcggtaccgggagaagcgcaagaaccggcggtttcagaagaccatccgctacgcgtcccgcaaggcgtacgccgagac

SEQ ID NO: 28255 - DNA, 1008 bp, Triticum aestivum
  unsure (1)..(1008): unsure at all n locations
  Clone ID: PAT_TA_28255
gaggaattcggncgaggcggtgaccccacgcgtccgcggacgcgtggtctcttatggcaactgcaggtcttgacaagaagattaagatttgggatctcaggaagtatgaggttgtgcatacacacgctgcacgagctgagtccttggatttcagccagaaggggttgttggccgccagtgatggatctctagtagagatatacagggatgctgggggccatgattataaagtttatttgaagcataggatggtaaagggatatcaggtcggtaaggttttgttccgcccttacgaggatatctgttcgattgggcactccacggggttttcttccattctcgttcctggatcaggcgaggccaactttgatacctttgttgagaaccctgtggagactgccaagcaaaggagggagagggaggtgcatgctctcctcaacaagcttcagccggagaccgtgatgcttaacccaaatatgatcggtaacgtgagacagccaaagaagaaagagaagaagaccaaaaaagaagtcgaggaggagattgaagatgcggtggaggccgccaagagcacgaaggtgaagaataagaccaagggcaggagcaaacccagcaagcgggccaagaagaaggaagaagaggtcctcagagccaagaggcctctactggaccagtacaaggaaatcggcgggcatcccgacaagaagcagcgggtcggcgacaaggccgagctgccaaaggccctgcagcggtttgccaagaacaagcaatcatgatcttgtttatctaccagcttgtgttgtgtagtctatcatgtagctggcaagtagtatttgagtccatgtggacatgccacatgagacaacgatgggaaaggacgcagcaaatttttgtcccgaaataacttatgttctagttgaaatttagctcacttcttgagttggacatcctatatcttgtatgaatgggctaggctggggcttgagaggtttatttgatgattggtgg

SEQ ID NO: 28256 - DNA, 1103 bp, Triticum aestivum
  Clone ID: PAT_TA_28256
ccgcgcggcgcgcccccagctccgccaacttcttccaggccagccagctcagctctcccacacacactcgctgtcagatcccgagaatggcggtcgccgctcagccgctgctggcctccgcgctcctcgcgctcctcctcgccgccgtctccgctgccgatactaagaataaccctgccgatgagcttgtgagcttgatcaactccaaccgtaccgccagcaaggcatcaaatcttgctgacaatcaaggctcttggatgcattgctctgcagtacataaaagcatataagggtcagtgcgaccaggtgggtggaaacaagaagcctgtggattccagtttcattgacacatttgccccaaattgtggtgtccaagctgcaagccttgccaagatcactgggaggctcctggcgtgccagccaagctacccgcctccagcgcaggccttcgacatgctcattgctgatgagaggagcctccaggtactgcatagcaagaaccacacagaggtgggggcggctgtcaccggcacttctggcggcggcccgtatttctggtgtgtcttgttcagcaatgggaaggccaactcgagcttcacggtagaagggggagttcccaagactgcacatcctggatgcttcagcggcaacaatgacgagtgcagtggtgccatttcgaccggtgtgggtgcatggacactggtgtcggccactctttttgctctggctggcgcctttactttgtgagcttgtgcagagatgcatcggcgcaccgttcttttgccaattttcagatctggtagagcacactagttgcagtgtctctactttaccacaattcttttgctcctttttagcaggtgatttctgtaaggactaaaaggattatggttttcaacatttgtgacgagtttacctgtgcaggttgttaatgccagagctggtagagcacactagttgcagtgtctctacttcaccgcaattcgtttgctccttttagcaggtgatttctgtaaggactaaaaggatcatggttttcaacatttgtgacaacgaggttacctgtgcaggttgtaaaaaaaaaaaaaaaaaaaaaaaaaaaa

SEQ ID NO: 28257 - DNA, 822 bp, Triticum aestivum
  Clone ID: PAT_TA_28257
gttaattatgtttttaacacgttctgaatatgaccgtggtgtaaataccttctctcctgaaggacgtttgtttcaagtagaatatgctattgaagctatcaaactcggcacaactgctattggtgttcaaacgtcggaaggtgttgttttagctgttgaaaagcgtgtttcttctacattattggaacctagttcgattgaaaagattatggaaattgacgaacatttaggttgtgctgttagtggaatgacagctgatgctagaacaatgattgaacatgctcgagtagctgctcagaaccatcgattcacatatgaagaaaagttaaaggttgaaagtgtaactcaaagtgtttgtgatttagcattgcgatttggtgaaggtgctgaaggtgaagaatcaattatgagtcgtccttttggtgttgcattgcttattgctggtgttgatgaaaatggaccacaacttttccatgctgatccttcaggcacatttatgaagtatcaagcaaaggctattggatctggatctgaaggtgcccaaacagagcttcaaaaagaatatcacaaatcaatgacattgaaggaagcagagacacttgcattgagtgtattgaagtcagtgatggaggaaaagttaaacaaaaccaatgttcaaattgcagccattacaccagaaagcaactttaaaatttattcagaagaagaattgcaaactgtgattgaaagattgtaatcgtattatctctattattcatctccctgttaccattttccctttttttctttgcagaataaaaaagcacaaacacatactcgcac

SEQ ID NO: 28258 - DNA, 567 bp, Triticum aestivum
  unsure (1)..(567): unsure at all n locations
  Clone ID: PAT_TA_28258
ataatcatcaacatcataagngaaacaaacattaatcttcgtgctgccgcattgcatgtcattggtgatttattagcttcaattggagttttaatttcttctattattctgatctttagacctgatcttactattgttgacccattatgtacattcttcttttctattcttgtattatacacaacctatcacctcgtcaaggactcacttgctgtgcttatggagggcgtacctggaaatattcatccagacttgatagagaagtcgcttatggcagtacctggcgtaattgccgttcatgatttgcatgtctggaccttgtctcctggaaagtattcccttacagctcatattaaaatagaccatgcagcagaaattagctatgatgaagtgttatcaaagggacaacatattgtctgtgatgtttatggtgttcatcattccacacttcaaatagagtcagataaaacagcattcacaagccactgtaaccctgaattgtgtgctcctagaaaccaataatcccaattttttaaaataaatacaattacattattattttattat

SEQ ID NO: 28259 - DNA, 435 bp, Triticum aestivum
  Clone ID: PAT_TA_28259
cggacgcgtgggtggtgctggttacgctcctgttttggattgtcacactgctcacattgcctgtaagttcgctgaattgatcgaaaagattgacagacgttccggtaagtccttggaagctactcccaagttcgtcaagtctggtgactctgccatcgtcaagatgatcccctccaagcccatgtgtgttgaagcttacactgactaccctcctcttggtcgtttcgctgttcgtgacatgcgtcaaaccgttgctgttggtgtcatcaagtctgttgaaaaggttgacaaggctggtaaggtcaccaaggccgctgccaaggccggtaagaaataaatttcttaacccggtatttctctgactgaaaagtaataattacttttgtaaaataaatataatacaaatatacatattaaatgtatgcttataatttt

SEQ ID NO: 28260 - DNA, 907 bp, Triticum aestivum
  Clone ID: PAT_TA_28260
gaagaggcagtcgcacgggttatcaagaactcaatcaacgggcatctatcaaatggagcatcggcgttgatgagacatggcatgagtgatgagctatgctgggcatgtcagactgacgatgaatttactctcactcacagcatattggtatggcatgtcgcgactggctactgcgagatcgaaacaatcgcaggccccaatgaaaatgatatgcatccaaaccgaggtgtcgccactagcttgtccaagtatgtcgcatacttggtagcttgtgctccgacgttgctaccaggccgtctgatagtttcagagtgtacgcttgacgagctggaggcacaagcaaagaaaactcttcaaggactcgtatcaccaagggagaggtatgaaaagcttagagaactgtacaatgtcgttgatgaagttccgtcaagcgtagcggatgcaactgctgcaacagaggcaacgtccgcgcatctgttgagcaagggtgtcaggctagggaagttgttggagagcatggagaatcacatgatccgttgggaactattggccgatttctgggcagagatgctggtgtatatcgccccgtctgataatgtggctggtcacattgaacttcttgctgaaggtggcgagtttgtgacccacatctgggtgctgcttatgcatgctggcatcctggagcggcctgctactgcaataccctagatgaaggagagcaagatggtctaaaggtgatgaaggagctacccttggtcgtcgtatgtcctttatgatttatgtaatcaagacgttgtgtttgtgacgactctgcgcttgttgatctagtgtaagactatgattgtgtgttgtacttgctttctgaaactctaatatctcttgtatgcttgtactagtacattctcat

SEQ ID NO: 28261 - DNA, 1699 bp, Triticum aestivum
  Clone ID: PAT_TA_28261
gagcgttctatctcgggctagtccctcgtgcctctctcgccgtacgctcctgcgccggcggcgactgctcttctcggcgggcgcccatggcgacgatgtcccgcgcgctcggctcggcgttcgtggggttcacgcggacgcccgccgtgccggcgacgacgcccttgccgttgccctcctctcgcgcctcctcggcgctcctcctgcgctggcagcggagccggggcgtcgtcggcggcggcgggggcgcgcggcggtactcctcgggccgcaacgcgaagattagcatgagcctccgcgccggcatcggccggcctgcccaacgtcggcaagtccaccctcttcaacgccattgttgaaaatgggaaggcccaagctgcaaactttcccttctgcaccataaacccaaacaccggcgtcgtggctattcccgatcctcgattggatgtgctctcgaagttaagccagtccaagcagacggtaccgacatcgattcatcttgtcaacattacaggcctcgtcaaaggagcgagcaaaggggagagactgggtaatcaatttctttcaaacatacgtgaagtggattctatacttcaggttgtgcgatgttgtgaagatgatgatattgttcacgtgaatggaaaagttgatcccaagtcagatattgatgtgattaacttagaactcatattttgtgatcttgaacagatagagaagagattggattagcttaaaaagagcaaaactaaggatccacaagtcaaagttaaggaaggagcggaaaggtcaggattagaaaaaattctggatgcacttatggatggaaagcctgcaagatctgttgatttgcctgaccatgagaaagaagctatacaacatctttatctgctcactatgaagccagtcatttatgttgctaatgtaacagagtctgatcttgccgaccctgataaaaatccccatgtccaggaggtggccaaactagcatcagagctgaaatctggcatggttacaatatcagctcaggttgaggctgaactgtctgaactaccactggaagagagagttgaatacctaaattctcttgatgttgccgaaagtgggctaggcaacttggtaaaagcaacatataaccttttgggactaagaacttatttcactaccggagagcaggaaacaaaagcttggaccattattgcaggcatgactgcacctcaagcagccggagttattcatagcgacttccagaaaggcttcattagagctgaaactgtatcttacgatgattttgttgcggcgggtactcttggagcagcaagggagaagggagtgatgaggttggaagggaaggagtatattgtgcaggaaggagatgtcatgctcttccgattcaatgtgtgacaacaataccatgcaagaaattccaggctttattcagctcgaatttcatacggacttacaaggcaagacaaaatttggatagaccatcagattttgtctttgaggcaacaattgttcatttactcggcatcgttgcattttcggaggaaaatgcaatcatttttatttcatgtaacatatgcagatacttaatggctctgcatcataacttgggatccttagtgagttttgtaaatcacttcaataaactctgctgttatattatgagcaataatatgtaatccttttttgaagtaac

SEQ ID NO: 28262 - DNA, 556 bp, Triticum aestivum
  Clone ID: PAT_TA_28262
gctcatctcatctcatctgaagaaagacttcatcgattagcaatgggcaagtcgggttctccttcccttgtgttgctgctggttgctgccatggcgggggcgacggtgttcgtcgcgtcgtcgccggtggccggattgccggaggcggagcccccgttcccgaacccgtggctttccctccagaacctctccggctgccacatgggcgacgagcgggacgggctggcgaggctaaaggacgacctgagccacttcgggtacctcccaggcgggccgtcgtcgtcgcccttcagcgacgcgttttccacaaactctccggcggccacagccacgtaccagcgcaaacggggctcgcaaggctcaaggtctatcctggagccacttgtggtaccctccctgggcccgcgccccggcctggccgacgtcgtccacggcacgcccaccttggggcggccgaacccgtggacgaagcacaacttcggcctcaacgcgtcggggttcctggacccgtccaccgtgtcccaaatggtcgccccgcgctgcggcgtggcggacg

SEQ ID NO: 28263 - DNA, 1417 bp, Triticum aestivum
  Clone ID: PAT_TA_28263
gaattcactactcctacgaggtttgtgataggcacgagatggcccgtgtagcggagcaaaaactccagcctagttgcctcggtgacgcgctgacggcgaggaacgatgccgacaacctcaccgagctcatcccgtcgctgcccgtcgagaagcggctagtgccgccgcccgccgacatgcagaggcgacagtaccgtgggtactggttccccgagtggcacctgtcggccctggcggcagtccgcgatcacttcgagcccaagccaacggacatcttcctcgtgagctgccccaagtctggcaccacatggcttaaatctctagccttcgccactgtgcaccggcacgtccacccgccatccagccaggagcaccctctgctccaccaaaacccgcatggctgcgtcaaattcatccacgcaatctatcggcaaccggtcgatgttgtgcaaggcatcatcgaggcgtacccttccccgcgtatcttcggctcccacttcccattgtccttgttgccggagcgcatcaatgatgatgattgcgggtgccggatcgtatacatctgtcgggatcccaaggacgtggtcgtctcgtggtggtggttcatgcgcacctacctcccaaaccccgagcaggtccagttcgaggaggtcttcgatttgttttgcgagggccgcacaggtgcgggcccttattggcgccacgccctcgagcattgggaggagagccggagaaggccccacaaggtgttgttcctcaggtacgaggagatgctacgagacccgcaatgcaatcttaggaggctggcggagtttttggggtgcgcattctccgaggcggaggagaaggccggcgtcctagaggccatcttggagttgtgcagccttggcaagctaaagaagctggaggtgaaccagagcggcaaccggattaatgacgaacccatgatgaacgattccttcttcaggaagggggtggccggtgactggatcaaccacatgacgccagagatggcggcaaggctcgatgcaatcgtcgaacaggcgctgcaaggcaccggatttgacttcggcatctccatgccacagtaatcaatcgtgtattcctacacatatctcctggtagccccgagggaactgtgaaggcattctataccgtcacgaggcatatccaatgtgcatcatcttggggtttttattttcctttttgtaagccaattcatcggcatcaatgtttggcttgcttggcattgtcattcaataatcaataatgtatgagtgtgtgcatgctgttggtgtcctctttctcaatgaaaaagtaaaacatctgtggtttgtcgtggaaaaaaaaaaaaaaaaaaaaactcgagactagttctctcacctcggccgcgaccacgctaatcactagtgaattc

SEQ ID NO: 28264 - DNA, 569 bp, Triticum aestivum
  Clone ID: PAT_TA_28264
cccacgcgtccgattaataaagatgggtttgaattggtcacaaattaatgataatacatatgaaacagaatttccaaatgaatatcaagaaagacaaaaactatttaatttttggaaaaataataaacaggaattaaaaaatgatgggtttcttattaaaaaagacgatgaagataaatggaaaattatttataataataataatgatttaaatatagaagatatatgttccaaatggaaagaatcatttgatggctttaatgaagataatattgagattaaaactagatattttcaaaatcaagaaaatcaagaaaaattagaaattatgataaaaaaaataatacaggatgaaatttcagatttaaaaagttcaatacttaatgaattaaatgaaattaaagaattattaaaacaaaaaaaagaaaagacaatagtttttatattaattttaatattaattgttatgtaattttgttttattttctatatttttcgattatcaggtttaaagtaattttctaaatgttaaaaaaaatataacaagaattatataacttctataattg

SEQ ID NO: 28265 - DNA, 1601 bp, Triticum aestivum
  Clone ID: PAT_TA_28265
cctctcccccccccgcatccacccgacctccaccgccccgtaccaccagcctccgcatccccctccgtcccgccctggcccctgcacccgcaaattctgacccagtcccggacttagccatacggcgcgctggacctcgcgcccaccgctacccccccgcccgccgtcaggggcgagaccagaccgctgctcccccggagggtctggcgcccacctcttcttcatctcccgccactatccgcagcaccgcggtgtggtgtgcacggcagagcaacggcagcggcaagaagcagccgctggacgccatgggcgccttcttctcggcgcaggtgaaccgccgcaagctggtcaccacgcagaagctggccatgtccgagcgctgcacctcctgcggcgacgagttcccgggctgcgcccaccgccccgccgaccgccagccgtggatggcggagctggggcccgaccgcctgcgcgtgcaccaggtggtgtggccgggcacccacgactcggccaccaacaagatcggcatccccttcatcacccgccccttcgcgcagtgccagtcgctctccgtctaccaccagctcgccctcggctgccgcctcctcgacgtccgcgtgcaggaggagcgccgcgtctgccacggcgtgctcgccacctactccgtcgacgtcgtgctcgacgacgtgctgcggttcctggccgagacggagtcggaggtcctggtgctggagatccgcaccgagttcgggcgcgaggacccgccggacttcgccaagtacctggtggagcggctcggggagcacctgatcccgcaggacgaggcggtgtttcacaagaccgtggcggagctgctcccgaggcgggtgatctgcgtgtggaagccgcgcaagtcgccggcgcccgggcgcggcgagccgctgtggagctccggctacctgcgggacaactggatcgacacggacctgccggagaccaagtacgagagcaacctcaagttcctgggccagcagccgccggcgagggaccggcggtacctgtaccgggtggagaacacggtgacgccgcaggccgacaacccggtggtgtgcgtgcggcccgtcacgaaccgcatccgcggctacgcgcgcagcttcatcgccgaggccttcgccaagggcctcggcgaccggctccaggtcttctccaccgacttcatcgacggcgacttcgtcgacgcctgcgccggcgtcaccaaggcccgcgtcgacggcaccgcgtgagatcaacggcgtgcatggccttgtgtagtaattagaggtgtggccgcgcgcgattagaggggttcgtttgttggtccttcgggttgtctttccttcttttcgtggtttgtgcagaggagagcagagcaggggagcagaagcagagtgtctgagtgtgggtccgggtggggattatttacttacaggtaaatttgggacaccgtggattaatggtgttgatgttcgtgcgtgatgttttgtactgtactagtggattgggggtctgtaaatacagtggcgaattgcatgtgcaagggaataagcaaaactgtttgatgtgaattgttcgttcatctcagc

SEQ ID NO: 28266 - DNA, 570 bp, Triticum aestivum
  Clone ID: PAT_TA_28266
cggacgcgtgggcggacgcgtgggcggacgcgtgggcggacgcgtgggatagcaggtgggcggcggcgctgggccctgcggtggatgcactggtcacctcggtgcacggcggtggagcaacggcggccgggggtcttgcccaactcctgcagcagagtggctggccttggcgagccggggttgcggccggggatgcgagaaggacaacgagtagagccgactgtgagccgtggaatcgccgcctgtcgaggtgtcgctgcggaggagcagctgggcggcggcgaagctcgcctccgcagcgcagctaagcaggggcggcgcaagatggcagctgcgggacaggtgggcggcggcgcaagtgggacttcgtcctggctgatcctacggcggctggggcacgcggtgcccgtgggcaacaaggggaggcggaggctgggaaggaccgattagcacgagatttaaaataaaaaaggatttttctgcaaaattacaattgaactatgctggtgacaactttttccggacggagggagtaattcagaagaataggtgagtactctgtttcccccc

SEQ ID NO: 28267 - DNA, 666 bp, Triticum aestivum
  Clone ID: PAT_TA_28267
cccccgggctgcggcactgcgggagcgcgaaagcacacgcagtcgctaacacttgctccattaatatcgatcgatggccatggtagcgagagccgcgctgctcctggccatggtggtcgtggcaagcgccacctactgccccccgccgccggcgccggtgcccgccccgctacgggtcgtgcccccagaacgcgctcaagctgcacgtgtgtgccaacgtgctgaacctggtgaaggccaagatcggcgtgccgccaacggagccctgctgctcgctcctcgacgggctcgtcaacctggacgccgccgtctgcctttgcaccgccatcaaggccaacgtgctcgggatccacctcaacgtccccatcgaccttagcctcatcctgaacaactgcggcaagatctgccccgccgacttccagtgcatccactaggaatgctagaagtgcatgcacagtactatcgatcgagtggggtgttgtttgctttcgtttcaagcctttgctttatttatttcttaattctatgctggcaatctggcctagcatgtacgttctcgctttcactcgagaggtaggattatgatcctttggagtttaattgaagtggtgatttcatgaaaaaaaaaagcaaaaaaaaaaaaaaaaagggcggtctagatcgcga

SEQ ID NO: 28268 - DNA, 625 bp, Triticum aestivum
  unsure (1)..(625): unsure at all n locations
  Clone ID: PAT_TA_28268
gggtcgcccagctcctgggctccaccgccgcctgcttcctcctccgcttctccaccggcgggctccccaccggcaccttcgggctgaccggcatcggcgcgtgggaggcggtggtgctggagatcgtgatgaccttcgggctggtgtacacggtgtacgccacggccgtggaccccaagaagggcagcctgggcaccatcgcgcccatcgccatcggcttcatccgtgggcgccaacatcctgggtccggcggcgccttctccgggcgcgtccatgaaccccgccgtctccttcggccccgccctccgtcagctgggagttgggggtacaagtgggtgtactgggtccggcccctcatcgggcggcggctcgccggcgtcatctacgagtgtcttcatctcccgcaccaacgacagtccccacaccgactactaacaacaacttgcatgcgactcgcgtcaaccgtgtgatgatnntngcgtccgtctctctcctcctgcangcatgatcgtttagttgcttgaatgaacatcaatcctgggtcatgtcggcantatcatantntggcgtctcgtgagcttaaactgatatccattgganacgncctgtaattntcgaatggatt

SEQ ID NO: 28269 - DNA, 739 bp, Triticum aestivum
  unsure (1)..(739): unsure at all n locations
  Clone ID: PAT_TA_28269
ttttttttttttttttttttgagtacattggaagttacattgagttcgtcataagctagatcacaatatcctccatcgcttccaaactacggccacggtctcaatgcatcatttgaaccatgcaaatcaaaagtcggttgaaaaccattgtctggcaccaccaccagtaagctggcggtaaggtaaggtttaactcgaaaaggtacagtacttgcttggctgcgaagtgacccatcacttgcatgccttcgtctctttagccgaagcatggtaattaatttacatctgtgtacatcctaagcaaaacctaaagaaacaactttggcttctcccaggagcatgaccatgggctcatggccacactcgatcgcatcggccaaggaatatggggcttctggtcctcacgagacaacgtgtgacccattcttctttgttctcaggaaactaaccaatgtgatcatgggggcaacacccgtccccgaacgcttcttgattgttgttgtcttccatggctttccatcttgcacagtacctgtggtcgtagacgttacattgtaaaactcgcaaacaccatgtaatagcaacctctgaaatgggtcctggacattcaacacaagcacatctttatcagtagtgtcttcaatgaaggccctgatccgttcctgcaaaagtgaagcacggtttttgctaacttaaacaacagcaaaataatacagatatagacaagtntatactttct

SEQ ID NO: 28270 - DNA, 845 bp, Triticum aestivum
  unsure (1)..(845): unsure at all n locations
  Clone ID: PAT_TA_28270
ggagtacattggaagttacattgagttcgtcataagctagatcacaatatcctccatcgcttccaaactacggccacggnctcaatgcatcatttgaaccatgcaaatcaaaagtcggttgaaaaccattgtctggcaccaccaccagtaagctggcggtaaggtaaggtttaactcgaaaaggtacagtacttgcttggctgcgaagtgacccatcacttgcatgccttcgtctctttagccgaagcatggtaattaatttacatctgtgtacatcctaagcaaaacctaaagaaacaactttggcttctcccaggagcatgaccatgggctcatggccacactcgatcgcatcggccaaggaatatggggcttctggtcctcacgagacaacgtgtgacccattcttctttgttctcaggaaactaaccaatgtgatcatgggggcaacacccgtccccgaacgcttcttgattgttgttgtcttccatggctttccatcttgcacagtacctcgcaaacaccatgtaatagcaacctctgaaatgggtcctggacattcaacacaagcacatctttatcagtagtgtcttcaatgaaggccctgatccgttcaagcagtgagtaggactccatatggaagatccataacacagtcaacacttgcaaatattttcctactcaatccgaagtagaaccaaattgatcaaaacagcatgttctttgttttatcagaataatggtgctaaactgctaactcatacataagcccatcagcagtacataatttgaacttactaatataagcagtgcatgaattgttggttttaacaactgaactcagt

SEQ ID NO: 28271 - DNA, 589 bp, Triticum aestivum
  Clone ID: PAT_TA_28271
cacaagctaatcaactacctttctaaaactctcggctccttcctagctccaaagttgctagcaagcaagccggagcactagatcctcgatggctcgcatggcactgctagccgtgttcgccgtgctcgcggcactggcggtggcggagatggcgtccggggcggtgacctgcggcgacgtgacgtccgccatcgcgccgtgcatgtcctacgcgacggggcaagcgtcgtcaccctcggtggggtgctgcagcggggtgaggaccctgaatggcaaggcgtccacctcggccgaccggcaggcggcgtgccgctgcctcaagaacctggcggggtcgttcaagggcatcagcatgggcaacgccgccaacatccccggcgagtgcggcgtctccgtctctttccccatcaacaacaacgtcaactgcgacacgtacgtacatcctccactcctaacttgaaagattatattctaagtactcattggccatttaatcttaattagtaagtataaacagtaagactaatcgttgagttttgtgtctgtgcgtttgcagccttcactaagttatctaccagcatcatcatac

SEQ ID NO: 28272 - DNA, 831 bp, Triticum aestivum
  Clone ID: PAT_TA_28272
tcgaggggccggccgggcccgggatctccaccaccacacaagctaatcaaactacctttctaaactctcggctccttcctagctccaaagttgctagcaagcaagccggagcactagatcctcgatggctcgcatggcactgctagccgtgttcgccgtgctcgcggcactggcggtggcggagatggcgtccggggcggtgacctgcggcgacgtgacgtccgccatcgcgccgtgcatgtcctacgcgacggggcaagcgtcgtcaccctcggtggggtgctgcagcggggtgaggaccctgaatggcaaggcgtccacctcggccgaccggcaggcggcgtgccgctgcctcaagaacctggcggggtcgttcaagggcatcagcatgggcaacgccgccaacatccccggcgagtgcggcgtctccgtctctttccccatcaacaacaacgtcaactgcgacacccttcactaagttatctaccagcatcatcatacagcaggctggctggccgactcggtgtctacggttgctgctctctgcgtgtgttcgttgttgttttctgcatgtgttcgacctccatttgttgcccctgccgggcgtcacacaaaaaggtcagcggcgtgaaatagtttcacgggcggttcattctgtgatttgatttcgtccataggtcaaatttatcaattttgcccccctgttacagatcgagcaagtgaaataaaataatgtgttgagcttaatcttgtactcctatgacattggctgttatcaataatgattataaagtagtttcatgcccgcatattgctgctggaacttttagc

SEQ ID NO: 28273 - DNA, 549 bp, Triticum aestivum
  unsure (1)..(549): unsure at all n locations
  Clone ID: PAT_TA_28273
cgacggcgcggcgacccccgccggcctcatctcggcggcgatagcccacgccttcgcgctgttcgtggcggtgtccgtgggcgccaacatctccggcgggcacgtgaacccggccgtgaccttcggcgccttcgtgggcggcaacatcaccctcttccgcggcctgctctactggatcgcgcagctgctgggctccaccgccgcctgcttcctcctccgcttctccaccggcgggctccccaccggcaccttcgggctgagtggcatcggcgcgtgggaggcggtggtgctggagatcgtgatgaccttcgggctggtgtacacggtgtacgccacggccgtggaccccaagaagggcagcctgggcaccatcgcgcccatcgncatcggcttcatcgtgggcgccaacatcctggtgggcgcgcctctcngcgcgtcatgaccccgcgtctctcgcccgcctcgtagctgagtggggacagggggactggtggccctatcgcgcggctcgcgcgtattacagctgttcattccgaccacacagtccac

SEQ ID NO: 28274 - DNA, 524 bp, Triticum aestivum
  Clone ID: PAT_TA_28274
atagtggccgccggcggtcgccacctcgctcactgccctcgatcgaattgaacccccactctgcgactgcccgatggaatcaacagcgagactgagacggggaagaagaaattgggtgtgggagaaatgttgttgccggtgtcggatttgggggaggagacgaaaaggaagtgtaaagcagcatctcctgtgggagctcctatttgacgcattttacgtcaaattctggatctgctgcttgacaatgagagcggctaaccagtcgacctgacaagtgttgctgactatagaggagcacatatgtctaaggctggtcacaatgggcaggaacgtaagctagtaacctacacagtttcctagactatgttactacctccatagtgggaaggaacatgtatgtagtgtcatgcagcgatgtatttattaggatatagactcattgtttcttgaagtgtgtaatgttccggtaacttagctagttaccacaagtacctctctcttcattaaatatgtgccacataagc

SEQ ID NO: 28275 - DNA, 648 bp, Triticum aestivum
  unsure (1)..(648): unsure at all n locations
  Clone ID: PAT_TA_28275
gactccggccagtcagtctcttcttcttctctagcgagcgagcaagctaggcttggaggtgaccgaaaatgccggtcaacaagatcgccgtggggagccaccgtgaggtgtacgaggtgggcgccctcaaggcggcgctcgccgagttcatctccacgctcatcttcgtcttcgccggccagggctccggcatggccttcagtgatttcttcctctttcttctcagcgattaatctttacatcaccacccgctccgctcgcatgttgggtacttaatttaggagaaattaactattaattaacaatttgcatcatcataatgggtaactaactaatgagcgttacgacaagacanggaaaaaaccctgcttttgggttttgggacacaatttaaatgaaagaacacttttangaggcttaccattacccaaaaaaatttcccaaaaagattaggtttgattggngcagttttaagttnaagatgggccaaaagacatttccccggatactggaaaccaagtgggancacatactcgtccgtnnaccgcacagtcaacnactcgccaaanacaaatnantctcaattccaaatacacanttcaaaatcgnnatncgacgattttctttnttctagantacccnngcgcc

SEQ ID NO: 28276 - DNA, 734 bp, Triticum aestivum
  unsure (1)..(734): unsure at all n locations
  Clone ID: PAT_TA_28276
aggaattcggacgaggtcccctctgctctgctcagctctactgcttcccctccatccaccgatcgagtgaaaagctctccgtccgccggaacatcgacgaccatggcgggcacggccaactgcatcgacatcatcctcgccatcatcctcccgcccctcggcgtcttcctcaagttcggctgcggggtaagcatcggcaccagattctttcctctttctctcttctttcgtcttcccttttctggctcgctccacaggttgatagatgcgtagatagatagatagatagtgacatatatggatggaattctgattactgataattgtttcttggtttctctcttgcagcacgagttctggatctgcctcctgctcaccttcctcgggtacatcccggggatcatctacgccatctacgccatcaccaagtaaatcaaggcagccgccccgagtgttccggcggaatagtagtatatttccatgatgatctcgcctgtctattcctagcgtgctcgggttattgcttgtgtgggttctttgaattcttttccgtgtacgttgacgatgcgaatttctctgtggtttccatggaccgtgtgaagagatttcagcttctttatatgtactatgtatatgcactagtatcatgtatgggagtttatgcatacagtacttattgttgaagttagattaccgcctnccctgttcaagtcggaatcggcagtnatgtgtat

SEQ ID NO: 28277 - DNA, 990 bp, Triticum aestivum
  Clone ID: PAT_TA_28277
aggcaaaagttgagctgaactgattgcacaagcaaaaactggactaattatgtagcacagcactcagattctctagtacttaacattgaaaaacttcactgattacacaaagagaaaaaccgaactgattgcacagggcaaaaacttaacaccgaaattccatagcactcatcattcaagttctgtagcaacaggtggtcagcggaagtccggctggcctgtggacgtgaggcaacggtgccacatcctgcccttatggtttacacgcttcggtgccgtgatgacttgcgtgaccggaaggtacacatagtgagtgttgcagatgcaggaagtgatgccactgaacccggcaaacgctccatggacggcattttgcccaagcacggtgcacagaatcgcatcggacgcattggcacgacaagcccggaccatgtacgtcgggtcgatgtattttatatcagcatggacaccgatgcccttgaaatgcgtcttgatcttttgttgcatgtgaacaccaatgtcgctaagtattgtatttcctgatgcatcagttgcgcctgagttttgcagtaactcttgtcctgcagcttcagcaacgcaaaccacacagaatcccttgttctttattaactgctcgaggtgctgtaaaacaccatattctccatcgagcgcgaatgagacctctggtattaagcagacatcaacctgcccactcgaaagagaagcatgcattgcaatgaaaccactgcttcttcccattaatttgaccaagccgataccatgatacgcactacgtgcctctatataggcagaattaatggcccgttgagcttcttccacagcggtatcaaaaccaaatgttttgtccattaaaggtatatcattgtcaatggtctttggaactgctacaacagaaaccttgagctttcttttacggcactcatcatggatagcatttgctcctgcatgggtacctgcccgggcggccgc

SEQ ID NO: 28278 - DNA, 799 bp, Triticum aestivum
  Clone ID: PAT_TA_28278
tcggcacgaggcacaagctaatcaagctctcaactccatcccagctccacggtttccagcaagcaagccgaagcactagatcctcgatcgatggctcgcgtggcactgctcgccgtgttcgccgtgctcgccgcactggcggtggcggagatggcgtccggggcggtgacctgcggcgacgtgacgtccgccgtcgcgccgtgcatgtcctacgcgacggggcaagcgtcggcgccctcggcggggtgctgcagcggggtgaggaccctgagacgccaaggcgtccacctcggccgaccggcaggcggcgtgccgctgcctcaagaagctggccgggtcgggcatcagcatgggtaacgccgccaacatccccggcaagtgcggtgtctccgtctctttccccatcaacaccaaagtcgactgcaacacgtacatcctccacccctaacttgaaagattatattatataattctaagtactcattggctattaaaccttaattcgtaagtataaacagtaagattaatcgttgagcttttgtgtctgtgcgtttccagccttcactaagttatctgccagcatcatcatcacaccaggctagctagccgactcggtgtctactgttgctgctccttgcatgtgttcgctgttgttttctgcatgtgttcgacctccatctgttgcccctgttacagatcgagcaagtgaaataaaataatgtgttgagcttaatcttgtactcctatgacattggctgttatcaataatgattttaaggtaaaaaaaaaaaaaaaaaaa

SEQ ID NO: 28279 - DNA, 668 bp, Triticum aestivum
  Clone ID: PAT_TA_28279
gacacagctaatcaagctatctgctccttcccagctccacttccagcaagcaagccgaagcactagatcctcgatggctcgcgtggcactgctcgccgtgttcaccgtgctcgccgcactggcggtggcggagatggcgtctggggcggtgacctgcagcgacgtgacgtctgccatcgcgccgtgcatgtcctacgcgacggggcaagcgtcgtcaccctcggcggggtgctgcagcggggtgaggaccctgaacggcaaggcgtccacctcggccgaccggcaggcggcgtgccgctgcctcaagaacctggcggggtcgttcagtggcatcagcatgggtaacgccgccaacatccccggcaagtgcggcgtctccgtctctttccccatcaacaacaacgtcaactgcaacaaccttcattaagttatctacgaacatcatcatcacagatcacaccaggctagctagctagccgactcggtgtctactgttgctgctctctgcgtgtgttcgttgttgttttctgcatgtgttccacctccatctgttgcccttgttacagatcgagcagattactgatcgaatcatcaataaaataatgtgttgagcttaaaaaaaaaaaaaaaaaaaaaaaaaaaaaattaaaaaaaaacaacccccccgc

SEQ ID NO: 28280 - DNA, 729 bp, Triticum aestivum
  unsure (1)..(729): unsure at all n locations
  Clone ID: PAT_TA_28280
atcaagctctcagctccttcccagctccacggtttccagcaagcaagccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgacggggaaggcgtccggcaccctccgggtgcgtgctgcagcggggtgaggaccctggaacgccaaggcgtccacccccggccgaccggaaggcggcgtgcaactgcctcaaagaacctggcggggtccgggatcaacatgggtaacgccgccaacatccccggcaagtgcggngtctccgtctctttccccatcagcaccaaaaccaactgcaataagtacatcctcaaatcctaacttgaaatattatattttaagtactcgttagccatttaatcttagttcgtaagtactataaatagtaagactaatcgttgagcttttgtgtctgtttgtttgcagccttcactaagttatgtgccagcatcatcatcacaccaggctacctagcccacctcggtgtctactgttgctgcccgctctctgcatgtgttcgttgttgtttttctgcatgtgttcaacctccatctgttgcccttgttacagatcgagcagattactgatcgaatcatcaataaaataatgtgttgagcttaaa

SEQ ID NO: 28281 - DNA, 672 bp, Triticum aestivum
  Clone ID: PAT_TA_28281
gccggccgggttccgggatcaccaccaccacacaagctaatcaagctctctgctccttcccggctccacttccagcaagcaagccgaaacactaaatcctcgatggctcgcgtggcactgctcgccgtgttcaccgtgctcgccgcactggcggtagcggagatggcatctggggcggtgacttgcagcgacgtgacgtccgccatcgcgccgtgcatgtcctacgcgacggggcaagcgtcttcaccctcggcggggtgctgcagcggggtgaggaccctgaacggcaaggcgtccacctcggccgaccggcaggcggcgtgccgctgcctcaagaacctggcggggtcgttcaatggcatcagcatgggtaacgccgccaacatccccggcaagtgcggcgtttccgtctctttccccatcaacaacaacgtcaactgcgacaaccttcattaagttatctacgagcatcatcatcacaccaggcttagctagccgactcggtgtctactgttgctgctctctgcgtctgttcattgttgttttctgcatgtgttccacctccatctgttgtccttgttacagatcgagcagattactgatcgaatcatcaataaaataatgtgatgagcttaagtttttatgtaaaaaaaaaaaaaaaaaaggccccta

SEQ ID NO: 28282 - DNA, 673 bp, Triticum aestivum
  Clone ID: PAT_TA_28282
gcgataagtagatcgcaaattcttatttattatgtaaaaccagtatgcgcacatagtaagctgggtcgaaaccggtacatgctagtatggcagattatttagggtaggtgacgtaggtgcgctgatgcacctcgaagattgtgagcctgcctgtagccagcactcattgagctcaccagcgagaccgaggccaatcagactgttacggaggccatctggcaaaccaggttgcggatgcgggccatgccacagacgccgagcacggaattgacgccattggcaacatcggcgccgagaaggccaccagccagcatgaaggtcatgcacagacagtcggcggccctctgcatccccatcccctgaatccgatggcagcaacggttcttgtcagacgggcttgtcctgcccggttgaaggttaagacacactccaagcgagactgcgccattcagattgcacttgccaccgccagcggatggtgccggtgccattgccggtgaaggcggcatgctctggccatgcgcctggacagaagccagggccaggaggatcgcggctaggaggaggatgcgagaggacgccatggttttggtgttggtggtggctaactggctatcgttgctgatgtttggttgctgcggtgcggttgcgcagacaagcagttcgatggagt

SEQ ID NO: 28283 - DNA, 1095 bp, Triticum aestivum
  Clone ID: PAT_TA_28283
ccgactgaactggtgacacaaaaataaaaggtggacaggttaaatgggaaaaactgaaccggctgagcaagggaaaaataaaaggggttacaaagttgaactgaactgattgcacaagccaaaaactggactaattatgtagcacagcactcagattctctagtactttaacattgaacaacttaactgattacacaaagagaaaaaccgaactgattgcatggggcaaaaacttgacaccgaaattccgtagcacttatcattcaagttctgtagcgagaggtggtcagcggaagtccggctggcctgtggacgtgaggcaacggtgccacatcctgcctttgtggttcacacgcttcggtgctgtgatgacttgcgtgaccgggaggtacacgtagtgagtgttgcagatgcaggaggtgatgccactgaacccggcaaacgctccatggacggcattttgtccaagcacggtgcacagaatcgcatcggatgcattggcacgacaagcccggaccatgtacgtcgggtcgatgtattttatatcagcatggacaccgatgcccttgaaatgcgtcttgatcttttgttgcatgtgaacaccaatgtcgctaagtattgcatttcctgatgcatcagttgcacctgagttttgcagtaactcttgtcctgcagcttcagcaacacaaaccacacagaatcccttgttctttattaactgctcgaggtgctgtaaaacaccatattctccatcgagcgcaaatgagacctctggtattaagcagacatcaacctgcccacttgaaagagaagcatgcattgcaatgaaaccactgcttcttcccattaatttgaccaagccgataccatggtacgcacttcgtgcctctatataggcagagttaatggcccgttgagcttcttccacagcagtatcaaaaccaaatgttttgtccattaaaggtatgtcattgtcaatggtctttggaactgctacaacggaaaccttgagctttcttttacggcactcatcatggatagcatttgctcctgcatgggtaccatttccaccaagtacaaaaagcatatcaattc

SEQ ID NO: 28284 - DNA, 579 bp, Triticum aestivum
  Clone ID: PAT_TA_28284
gcggctcggcggcggagaaacctcggcgacccgacgacggcgcaggctgactccggttcggcgtggtaaatctgcagcgacagtcagatcaaggcaaggatgggtcggaaagctgggttgtacataaactcaaagaagtttggcggcgtcgttaagccgtgcatgctggagatgacggccttcctcaactgcctcgccttgaacaagcagatcgatgagaagtgcacgaggcagaaggagctcttgatcacctgtacccaggctcagaagggcaggccaaagaacgctgccaagaccatcaattaccatcttcagaggcttgggcgagacaagttccactagttggagtgaaaactctttccctattttcattgccctgatgtctgggtagcaataatttcttccaagtagcttttgctaaacgagcagtgatctttagacattggtgaagtttgaatcgattttggatgtgagacttgtaaggcatcagcacaatatcagtatggtttacttctcatgatataatatgcactgcactactacttttcttgtttttacctgcccgggcggccgctcgaa

SEQ ID NO: 28285 - DNA, 644 bp, Triticum aestivum
  Clone ID: PAT_TA_28285
ctcccactccacggtttccagcaagcaagccgaagcactagatcctcgatcgatggctcgcgtggcactgctcgccgtgttcgccgtgctcgccgcactggcggtggcggagatggcgtccggggcggtgacctgcggcgacgtgacgtccgccgtcgcgccgtgcatgtcctacgcgacggggcaaacgtcggcgccctcggcggggtgctgcagcggggtgaggaccctgaacgccaaggcgtccacctcggccgaccggcaggcggcgtgccgctgcctcaagaagctggccgggtcgggcatcagcatgggtaacgccgccaacatccccggcaagtgcggtgtctccgtctctttccccatcaacaccaaagtcgactgcaacacccttcactaagttatctgccagcatcatcatcacaccaggctagctagccgactcggtgtctactgttgctgctccctgcatgtgttcgctgttgttttctgcatgtgttcgacctccatctgttgcccctgttacagatcgagcaagtgaaataaaataatgtgttgagcttaatcttgtactcctatgacattggctgttatcaataatgattataaagtagtttcatgcccgcatattgctgctggaaaaa

SEQ ID NO: 28286 - DNA, 535 bp, Triticum aestivum
  unsure (1)..(535): unsure at all n locations
  Clone ID: PAT_TA_28286
gcggatacgtgtttcaccgccccttccttcccatcctgctctgctcagcgcctctactgcttcccctccgtccaccgatcgagtgaaaaagctctccgttcgccggaagatccacgaccatggcgggcacggccaactgcatcgacatcatcctcgccatcatcctcccgcccctcggcgtcttcctcaagttcggatgcgggcacgagttctggatctgcctcttgctgaccttcctcgggtacatcccgggtatcatctacgccatctacgccatcaccaagtaaactagcaagccgtcccgagtgttccgcgacacaatattttcaaggatgatttgatctgtctaatccctccttgcctgtgtgggtcctttaattcctttccgtgtgcgttgatgatgcgaatcctccgtgggttccaatggacaatgttaagaacaacaacttctggaaggaaaatgtccnataagaaaaaatggaatttaaaanagcttcccganngggaaaatcctggtnaaattaattatgccccc

SEQ ID NO: 28287 - DNA, 1479 bp, Triticum aestivum
  Clone ID: PAT_TA_28287
ttttattaaggaacggagggagtataaatgactgaacgggttatacaaggcaaaaactacattggatacacaaacggaaaaattgaacatctaaataccgactgaactggtcacacaaaaatcaaaaggtggacaggttaaaggggggaaactgaactggctgagcaaggaaaaaatatatggggttacacaacgcaaaagttgaactgaactgattgcacaagcaaaaactgcacagcactcagattctctagtacttaacagtgaacaacttaactgaatacacaaagagtgcagggggcaaaaacttgacaccgaaattccgcagcacttatcattcaagttctgtagcagcaggtggtcagcggaagtccggctggcctgtggacgtgaggcaacggtgccacatcctgcctttgttgttcacacgcttcggtgctgtgatgacttgcgtgaccggaaggtacacatagtgagtgttgcagatgcaggaagtgatgccactgaacccagcaaatgctccatggacggcattttgtccaagcacggtgcacagaatcgcatcggatgcattggcacgacaagcccggaccatgtacgtcgggtcaatgtattttatatcagcatggacaccgatgcccttgaaatgcgtcttgatcttttgttgcatgtgaacaccaatgtcgctaagtattgcatttcctgatgcatcagttgcgcctgagttttgcagtaactcttgtcctgcagcttcagcaacacaaaccacacagaatcccttgttcttaattaactgctcgaggtgctgtaaaacaccatattctccatcgagcgcgaatgagacctctggtattaagcagacatcaacctgcccacttgaaagagaagcatgcattgcaatgaaaccactgcttcttcccattaattttaccaagccgataccatggtacgcacttcgtgcctctatataggcagagttaatggcccgttgagcttcttccacagcggtatcaaaaccaaatgttttgtccattaaaggtatatcattgtcaatggtctttggaactgctacaacggaaaccttgagctttcttttacggcactcatcatggatagcatttgctcctgcatgggtaccatttccaccaagtacaaaaagcatatcaattcttctggcctgtatactatctacaatttcactagttttaggtcctccacgggaaactcctagaaaacttccaccagcaagattaatattctccactagattacgtgaaagtggcatttcttttagacctttttcaaaaaatccacgaaagccaaatggaattccaacaatattcttaaccccatatgtctctagggtgaatactacctgtctgatgacatcattcaaaccagggcagagacctccacaagtaactatagcagcttttacttcatttggctcatagtatatatccttaccccacgcgtccg

SEQ ID NO: 28288 - DNA, 646 bp, Triticum aestivum
  Clone ID: PAT_TA_28288
accaccaccacacaagctaatcaagctctcagctccttcccagctccacggtttccagcaagcaaaccgaagcactagatcctcgatggttcgcgtggcactggtcgccgtgttcgccgtgctcgcggcactggcggtggcggagatggcgtccggggcggtgacctgcggcgacgtgacgtccgccgtcgcgccgtgcatgtcctacgcgagggggcaagcgtcggcaccctcgggggcgtgctgcagcggggtgaggaccctgaacgccaaggcgtccaccccggccgaccggaaggcggcgtgcaactgcctcaagaacctggcggggtcgggcatcagcatgggtaacgccgccaacatccccggcaaatgcggcgtctccgtctctttccccatcaacaccaaaaccaactgtaacaaccttcactaagttatctaccagcatcatcatcacaccaggctagctagcccactcggtgtctactgttgctgctctctgggtgtgttcgttgttgttttctccatgtgttcgacctccatctgttgccgttaatacagatcgagcagattactgatcgaatcatcaataaaataatgtgttgagcttaagttttatgaaaaaaaaaaaaaaaaaaggccccta

SEQ ID NO: 28289 - DNA, 959 bp, Triticum aestivum
  unsure (1)..(959): unsure at all n locations
  Clone ID: PAT_TA_28289
ttttttttttttggacaacatggttttattaacttggacataaatccaccgtaaaggagcaacagtaataactttccgcgacattggaaattttggcagaaggagcggtcgacgcgcagtcgagcatttccgtctcaaagaatagtggtacaaacgaagatcgacccaactgcactgcaggggccgatcttcttctggtcttgctttccagataagcaaagtttgaatagtaatcatcatcaacaccgtctctcctaactacccctagcaatcacccgcttattcggcccaccgacaggtggggccgcacgggaatcagcatctccgccagcgggctccccaccggcaccttcgggctgacgggcgtgtcggtgtgggaggcgctggtgctggagatcgtgatgaccttcgggctggtgtacacggtgtacgcgacggcggtggacccgaagaagggcagcctgggcaccatcgcccccattgccatcggcttcatcgtgggggccaacatcctggtgggccgggcgccttccgacggcgcgtccatgaaccccgccgtgtccttcggccccgccctcgtcagctgggagtggggctaccagtgggtgtactgggtcggccccctcatccggcggcggcctcgcccggcgtcatctacgagctgctcttcatctcccacacccacgaagcagctcccctccaccgactactaaaagccgaagccgaccgacccaggggtgcgcagcgcaacgcaactagcatcaacgctctctccccgctcgccgccgtttatttctctccgtgcacgtgcatgcatcgtagactgtctcaagccgccgctgcgccggcgccgctccgcacctttgctccttggacaacatcgtccccgtcagntgaatctgtacgtgattccggccgttgtcgtagttggtgattgctganacaataaaaaaaaaaaa

SEQ ID NO: 28290 - DNA, 517 bp, Triticum aestivum
  Clone ID: PAT_TA_28290
catccagctctgctcagttcctctctactgcttcccctccatccaccgagtgaaaaagctctccatccgacgaaagatcgaccatggcgggcacggccaactgcatcgacatcatcctcgccatcatcctcccgcccctcggcgtcttcctcaagttcggctgcgggcatgagttctggatctgcctcctgctcaccttcctcgggtacatccctggtatcatctacgccatctacgccatcaccaagtaaaatcgagccgtcccaaagcgttccgcgatgtaatattttcaggatcatctcgtctgtctagcccctccctgcctttgtgggttcttttgattcttttccgtgtgcgttgctgatgcgaatttctctgtggtttccatggaccgtgtgaagagcagtggcttctctatgtatgtatatgtatatgtactattagtatatcatgtatgggagtttatatatgctcccctattgggagtaaaaaaaaaaaaaaaaaaaacacacaaacc

SEQ ID NO: 28291 - DNA, 1040 bp, Triticum aestivum
  unsure (1)..(1040): unsure at all n locations
  Clone ID: PAT_TA_28291
gcggccgcccgggcaggttgcgaattcctctgtggtttccatggaccatgtgaagagcatcagcttctgtatgtatatgtacatgccacaccagttaagaaataactaaaaagtgcagctgaggatacgagtcttatctcttgataagtagagccattacgcatttaacctagatgaggctacccaggatgttctccactgctccctccaacaaatgtctctgaagtttttggcagattgtctacactggcaaaaagctcgtccgccgcagaagcatacaagcttgaaggctctggcagatcaaccacgtcagcgaaaggctcgttcactgaaggagtatatgtctctgaagggtttgtcagatcaaccacatcaagcaagggtttgttggaggcacaagcatcgacctctgacgataccggcgcatcaaccacgtcaaataaaggcccatccatggcaaaggcatcatcatctgaagatgggaatgtagtgaacaaatgatccgaaccaaggcccagcagcatcactgtcagactcctccacagcagaaatttgtgattcagaatcagatgattcagcaagcaagacttcgagagaagggctgcttgtactcgttctcttcggtacgaaagccatgcccaatatgtcgttctcctgtgagcccacagttgggcttacatcaggaccagctccattacccgcaaaaagatcttccacatgatttccagtcgcggcattccctgaactggtggcttctctggaagaatctccatcagatggttccgtactactcaaatctgacaaggagtgttctacctctggttttctgaagccttctgctggggcctgagtgcaaggtgccacaggaatacagagtccatcccaccagaaagcctagtgttgtcctttgtattctccagaactccatcctcatctgacagggtttccatttcattggtactgtgcccaccagaaagcataatgntgccctttgtattctccagaacnccatcctcatctgacagggtttccattgcatc

SEQ ID NO: 28292 - DNA, 571 bp, Triticum aestivum
  unsure (1)..(571): unsure at all n locations
  Clone ID: PAT_TA_28292
ccacacaagctaatcaaggtctcagctccttccgagctccacgatttccagcaagcaagccgaagcactagatcctcgatggctcgcatggcactgctcgccgtgttcgccgtgctcgcggcactggctgtggcggagatggcgtctggggcggtgacctgcggcgacgtgacgtccgccatcgcgccgtgcatgtcctacgcgacggggaaggcgtcggcaccgttcggcggggttgctgcagcggggttgaggaccctgaacggcaaggcgtccaactcgggcgaccgggcaagcggcgttgccgctgcctcaagaacctggcgggtcccttcaaagggcatcaacatgggcaacgccgccaacatccccggcaagtgcggggtctccgtttcttcccgatnaacaacaacgtcaactgnaacaacaatcactaagttatcggtcaagaacaacaaaacaagctcttnatggttacttacccacccngggngtccaaagggtgncanctttgnaaaagttcctggcggctttcccaaggggtccanccccaaccttttgcctttttaaa

SEQ ID NO: 28293 - DNA, 1042 bp, Triticum aestivum
  Clone ID: PAT_TA_28293
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcacgagttctggatctgcctcctgctcaccttcctcgggtacatcccggggatcatctacgccatctacgccatcaccaagtaaatcaaggcagccgccccgagtgttccggcggaatagtagtatatttccatgatgatctcgcctgtctattcctagcgtgctcgggttattgcttgtgtgggttctttgaattcttttccgtgtacgttgacgatgcgaatttctctgtggtttccatggaccgtgtgaagagatttcagcttctttatatgtactatgtatatgcactagtatcatgtatgggagtttatgcatacagtacttattgttgaagttagattaccgcctccctgttcaagtctggaatcggcagtgatgtgtatgtagtcgggtttctcatttgatttttcagtttttcttcagtaataataatataaataaagaagcatcaggttcaaaaaaaaaaaaaaaaaaaaactcgagactagttctctcacctgcccgggcgg

SEQ ID NO: 28294 - DNA, 1039 bp, Triticum aestivum
  Clone ID: PAT_TA_28294
ggatcgcaaattcttatttattggaaaaccagtatgcgcatagtaagctgggtcgaaaccagtacatgctagtaggcagattatttaggcaacacttatatttcataggtgacgtaggttcgctgatgcacctctcagagtgtgagtctgcctgcagccaacactcattgagctcaccagcgagtccgaggccaattagaccgttccagaggccaccaggcaaaccaggttggggatgcgggccatgccgcacacgccgaacacggaattgacgccatcggcggcattgctggcgacaaggccaccagccagcatgaaggcaaagcagagacagtcggcggcactctgcatcccctggattcgagggcagcaacggttcttgtcggacgggcttgtccttcccggttgaagtttaagacacactccaagcgtgactgcgccattcaacgtgcaattgccactgcgagcggctgttgccgatgccattgccggtgaaggcggcatgctctggccatgcgcctggacagaagccagggccaggaggatcgcggctaggaggaggatgcgagaggacgccatggatttggtgttggtggtggctaactggctatcgttgctgatgtttggttgctgcggctgcgcaaacatgcacctcgtgccgaattcggcacgaggggcatcagcatgggcaacgccgccaccatccccggcaagtgcggggtctccgtttctttcccgatcaacaccaacgtcaactgcaacaacattcactaagttatcggtcagcatcatcacaccaggctctacatggatagctagccgacgcggtgtgtctactgttgctacttctgcatatgttcgttgctgctttccgcatgtgttcgacctccatcttttgcccttgttacagatcgagcagattactgatcgaatcatcaataaaataatgtgttgagcttaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28295 - DNA, 623 bp, Triticum aestivum
  Clone ID: PAT_TA_28295
gctcgctagtagtacatctttttctccaagtcaggaggaggtccgtgtggtgcgggagagcggcacggcggcggagaaacctcggcgaccagacgacggagcaggttggctccgattcggcgtggtgaatctgcagcggcggcagtcagatcaaggaaaggatgggtcggaaagctgggctgtacataaactcaaagaagtttggcggcgtcgttaagccgtgcatgctggagatgacggccttcctcaactgcctcgccttgaacaagcagatcgatgaaaagtgcacgaggcagaaggagctcttgatcacctgtacccaggctcagaagggcaggccgaagaacgcggccaagaccatcaattaccatcttcagaggcttgggcgggacaagttccactagttggagtgaaaactctttccccatttttattgccctgatgtctgggtagcaataatttcttccaagtagcttttgctaaacgagcagtaatctttagacaatggtcaggtttgaatcaattttggatgtcagacttgtaaggcatcagcacaatatcagtttggttttcttctcatgatataatacgcactgcactacttacttttgttttaaaaaaaa

SEQ ID NO: 28296 - DNA, 690 bp, Triticum aestivum
  Clone ID: PAT_TA_28296
tctccaagtcaggaggaggtccgtgcggtgcgggagagcggcacggcggcggagaaacctcggcgacccgacgacggcgcaggttggctccagttcggcgtggtgaatctgcagcggcggtcagatcaaggaaaggatgggtcggaaagctgggttgtacataaacccaaagaagtttggcggcatcgttaagccttgcatgatggagatgacggccttcctcaactgcctcgccttgaacaagcagatcgatgaaaagtgcacgaggcagaaggagctcttgatcacctgtacccaggctcagaaggggaggccgaagaacgcggccaagaccatcaattaccatcttcagaggctcgggcgcgacaagttccactagtttcggtggaaccgagaccatcgttatcctttctatctcttatgtccggacagcaataatcttccaagtagctttgctgaatgagcagtagactttagacaatggtttagtttgaatcaattttggatgtcagacttgtaaggcatcagcataatatcgataccgatttctcctcctgattgctgctgcttcctttattgttttgtttttgagacaagagtgtgcacgaaacggattgattgattacataacttggctggagtatcaggatctctactagcaaggtactattgattcgcccaaaaaaaaaa

SEQ ID NO: 28297 - DNA, 609 bp, Triticum aestivum
  Clone ID: PAT_TA_28297
ggagtaagaagattaagttccacacttcccacttaaaacatataacagagaccacactgctacacagcagcaacagatgttcgcacacaaaatacgggactaagacactgacaacagtaacacacgatgacgactcacacataaccatagagacgactaccaggacccgtgaaacgattttccaaagaaatcactggccaccacggaggcggagcaccaggtgcagggtggactccttctgaatgttgtaaacagcaagagtacggccgtcctcgagctgcttgcaagagacgactaccaggacccgtgaaacgattttccaaagaaatcactggccaccacggaggcggagcaccaggtgcagggtggactccttctgaatgttgtaatcagcaagagtacggccgtcctcgagctgcttgcctgcgaagatcagacgctgctggtccggcgggatgccctccttgtcttgaatcttcgccttaacattgtcgatggtgtcggaggactccacctcgagagtgatagtcttgccggtgagggtcttcacgaagatctgcatcttgacggaggattgcggcgatgttttcgatcggaacctcgtgccga

SEQ ID NO: 28298 - DNA, 648 bp, Triticum aestivum
  Clone ID: PAT_TA_28298
gcacgaggaccacacaagccaatcaagctctctgctccttcccagctccatttccagcaaggaagctgaagcactagatcctcgatggctcgcgtggcactgctcgccgtgttcagcgtgctcgccgcactggcggtggcggaaatggcgtctggggcggtgacctgcagcgacgtgacgtccgccatcgcgccgtgcatgtcctacgcgacggggcaagcatcgtcaccctcggcggggtgctgcagcggggtgaggaccctgaacggtaaggcgtccacctcggcagaccggcaggcggcgtgccgctgcctcaagaacctggcggggtcgttcaatgggcatcagcatgggtaacgccgccaacatccccggcaagtgcggcgtctccgtctctttccccatcaacaacaacgtcaactgcaacaaccttcattaagttatctacgagcatcatcatcacaccaggcttagctagccgactcggtgtctactgttgctgctctctgcgtctgttcattgttgttttctgcatgtgttccacctccatctgttgtccttgtttcagatcgagcagattactgatcgaatcatcaataaaataatgtgatgagcttaagtttttatgacattcgctgttataaaaaa

SEQ ID NO: 28299 - DNA, 645 bp, Triticum aestivum
  Clone ID: PAT_TA_28299
gccgcgtcgagccggccgggccggcaatctccaccaccaccacacaagccaatcaagctctctgctccttcccagctacatttccagcaagcaagccgaagcactagatcctcgatggctcgcgtggcactgctcgccgtgttcaccgtgctcgccgcactggcagtggcggagatggcgtctggggcggtgacctgcagcgacgtgacgtccgccatcgcgccgtgcatgtcctacgcaacggggcaagcgtcgtcaccctcggcggggtgctgcagcggggtgaggaccctgaacggcaaggcgtccacctcggccgaccggcaggcggcgtgccgctgcctcaagaacctggcggggtcgttcaatggcatcagcatgggtaacgccgccaacatccccggcaagtgcggcgtctccgtctctttccccatcaacaacagcgtcaactgcaacaaccttcattaagttatctacgagcatcatcatcacaccaggctagctagcccactcggtgtctactgttgctgctctctgcgtgtgttcgttgttgttttctgcatgtgttccacctccatctgttgtccttgttacagatcgagcagattactgatcgaatcatcaataaaataatgtgttgagcgg

SEQ ID NO: 28300 - DNA, 1578 bp, Triticum aestivum
  Clone ID: PAT_TA_28300
gaattcactagtgattagcgtggtcgcggccgaggtcaagtatatactttcttttcaagaataacatagtcaagtatatgctttctgcagagcatctaagctggctgtactattgaatctaacaagtattaaacagatacagatagaacttacaagcagtgagtaggactccatatggaagatccataacacagtcaacacttgcaaatattttcctactcaatccgaagtagaaccaaattgatcaaaacagcatgttctttgttttatcaagaataatggtgctaaactgctaactcatacataagcccatcagcagtacataatttgaacttactaatataagcagtgccatgaattgttggttttaacaactgaactcagttcaacaaacatttatcagattccatttctttccatttgcatgattcatttaatctatatgtgctcagtgttccgaaactacaaaccaaacagatgagagtagatgaattatcttcatgtgccattttatttttacacaaccaaaatattactagtaccattttatttttactcccaagtcttgacaccacacatgttctaagcattataacaacaaccaaaaatataacattcagcacaattgactcatcttcattcacaagattcttctgctttgatgattgtttcattcgttgcataaatcttgcctcaacgtccatgtcaatgctcctgaatgcatcccactcaccaacacttgtcctgcaaaatgctgacagtggtgcttcctcaccaaatggcggaggggcaaagaggcctttgatttcttcaacatgaagacgagggacgagctcaatcagcaagcgatcattcaaccatctgcgctatgtttttaaggcgacgccttaccgccttagggagggggggcgctttggcgcctaggcgacgctttaaaaacataggtgctatctagactgggactggggctctcaatcaagccatgcatttgcagactactggacccgaatatggtgacaaaatcataattactgcttattcacacttggtgggtgacaaccccggggtagagatgtgcggttcaccgatataaagatatttcatagggtacatggttgctcgctgtctcctgatgtgaagggattacaagcctttgcaatgtcttcaggtagctagttaattggatgaaagaaggacgcaagtttggatccttctgcccagcaatcacgtataattgatgcaactataggatctacttcttttggaatgtcaagccgtcggtcctggaagccaactgcgcccacaacttgcattttggttcatcccatgccatggctttcttagtgttgctagctcccacaggataacaccaaagctgtaaatatcacacttctcattggattgctcattccgcaaaacctctggtgccatccactcaggagtcccggcagtggattttgatgacaaaaatgtactgtgcttcagacgtgaaagtccgaaatcacagaccttcacagtccaattatcgtcaaccagcaagtttggtgattttagatcccggtgaacaattgttggcac

SEQ ID NO: 28301 - DNA, 955 bp, Triticum aestivum
  Clone ID: PAT_TA_28301
cccacgcgtccgcggacgcgtgggctgcaggcaagctgagccccgacggcgcggcgacccccgccggcctcatctcggcggcgatagcccacgccttcgcgctgttcgtggcggtgtccgtgggcgccaacatctccggcgggcacgtgaacccggccgtgaccttcggcgccttcgtgggcggcaacatcaccctcttccgcggcctgctctactggatcgcgcagctgctgggctccaccgccgcctgcttcctcctccgcttctccaccggcgggctccccaccggcaccttcgggctgagtggcatcggcgcgtgggaggcggtggtgctggagatcgtgatgaccttcgggctggtgtacacggtgtacgccacggccgtggaccccaagaagggcagcctgggcaccatcgcgcccatcgccatcggcttcatcgtgggcgccaacatcctggtcggcggcgccttctccggcgcgtccatgaaccccgccgtctccttcggccccgccctcgtcagctgggagtgggggtaccacgtgggtgtactgggtcggccccctcatcggcggcggcctcgccgggcgtcatctacgagctgctcttcatctcccgcacccacgagcagctccccaccaccgactactaagcaaccaagcttgcatgcgagctcgccgtccatccgtgtgatgatcgatcgcgtctccgtcatcgtctccttccttggccatccgccatgagtccttttaatttgctttgaaatgaatccatcccatccctggggtcgattcggtcggccagtatcgatcatttgtggtgcgttcgtgcgtggagctgttaaagcgtggatgatctcgatctgggacgaccgacctgtcaattgcttccggtaaaacgggaattcgcccgccccgcccgagtaattcaattcattgatttgaaaaaaaaaaaa

SEQ ID NO: 28302 - DNA, 1179 bp, Triticum aestivum
  unsure (1)..(1179): unsure at all n locations
  Clone ID: PAT_TA_28302
aaatcaaaagtcagttgaaaaccattgtttgccaccaccaccagtaatctggcggtaaggtaaggtttaacgcgaaacaggtacagtacttgcttggctgcgaagtgactcatcacttgcatgccttgtcatctctttagacgaagcatggtaaattggtaattaatttacatctgtgtacatcctaagcaaaacctaaagaaacaactttggcttctcccaggagcatgatcatggcctcatggccaacactcctttgtattggccgaggaatatggggcttccagtcctcacgaggcaacgtgaggcccattcttctttgttctcaggaaactaaccaatgtgatcatgggggcaacacccgtccctgaacgcttcttgattgttgttgtcttccacggctttccatcttgcaaagtacccgtggttgtagacgttacgttgtagaactcgcacacaccatgtaatagcaacctctgaaatgggtcctggacattcaacacaagcacatctttatcagtggtgtcttcaatgaaggccctgatccgttcctcatatatttcaagcagttcaggtaggaagtttctcttcatagcttctcttgtttggcaatctatacgacgccaagcattcagcacaattgactcatcttcattcacaagattcttctgcttagttgatgattgtttcatccgttgcataaatctttcctcaacgtccatgtcaatgctcctgaaggcatcccactcaccaacacttgtcctgcaaaatgctgacagtggtgcttcctcaccaaatggcggaggggcaaagaggcctttgatttcttcaacatgaagacgagggacgagctcaatcagcaagcgatcattcaaccatctgcgagacctccggttactaaccttggttgccatgtcctccagggcttcaatcttcctctcgatcatctgcccacgcgtcttggcggcagcggcatcgcctttggcggaatcgaacagggactcgtagaactcctcctccctccgcagcagatccgcgctcgccatggttgagtccttcacgcgagcttctcgcgctcccttctggacctcgagcttctgccgcggcgatggaggaggaatcgaggcttgggttgggtggtttccgcttttgtcccggttgcggctggccctncctgcg

SEQ ID NO: 28303 - DNA, 617 bp, Triticum aestivum
  Clone ID: PAT_TA_28303
ctcgggggcgtgctgcagcggggtaaggaccctgaacgccaaggcgtccaccccggccgaccggaaggcggcgtgcaactgcctcaagaacctggcggggtcgggcatcagcatgggtaacgccgccaacatccccggcaaatgcggcgtctccgtctctttccccatcaacaccaaaaccaactgcaacaaccttcactaagttatctaccagcatcatcatcacaccaggctagctagcccactcggtgtctactgttgctgctctctgcgtgtgttcgttgttgttttctccatgtgttcgacctccatctgttgccgttaatacagatcgagcagattactgatcgaatcatcaataaaataatgtgttgagcttaagttttatgacattcgctgttatctataatgattataaactactccatctgtaaagaaatatgagagtgtttagatcactatttgcttttatatttccttgcggagggagtagtttcttgcccgcatgttgctgctggaaattagcaagttttattaatgtctttgataccaacatggcacatttgtaaatttttcctaaatgcaagggaaaaaaacttgacgatgtcaatttgccg

SEQ ID NO: 28304 - DNA, 667 bp, Triticum aestivum
  Clone ID: PAT_TA_28304
tctccaagtcaagtcaggaggaggtccgtgcggtgcgggagagcggcacggcggcggagaaacctcggcgaccagacgacggcgcaggttggctccagttcggcgtggtgaatctgcagcggcagtcagatcaaggcaaggatgggtcggaaagctgggctgtacataaacccaaagaagtttgggcggcgtccgttaagccttgcatgctggagatgacggccttcctcaactgccttgcccttgaacaagcagatcgatgaaaagtgcacgaggcagaaggagctcttgatcacctgtacccaggctcaagaaggggcaggcccaaagaacgctgccaagaccatcaattaccatcttcagaggcttgggcgaagacaagtttccacttagttggagtgaaaactctttccccattttcaattgcccctgatgtctgggtagcaataatttcttccaagtagcttttgctaaacgagcagtgatctttagacattggtgaagtttgaatcgattttggatgtgagacttgtaaggcatcagcacaatatcagtatggtttacttctcatgatataatatgcactgcactactaaaaaaaaaaaaaactcgagacttagtctctctcacctgcccgggcggccgctcgaaatcacttagtgaattc

SEQ ID NO: 28305 - DNA, 712 bp, Triticum aestivum
  Clone ID: PAT_TA_28305
cggacgcgtgggagctaatcaagctctcagctccttccgagctccacggtttccagcaagcaagccgaagcactagatcctcgatggctcgcgtggcactggtcgccgtgttcgccgtgctcgcggcactggcggtggcggacatggcgtccggggcggtgacctgcggcgacgtgacgtccgccgtcgcgccgtgcatgtcctacgcgtcggggaaggcgtcggcaccctcgggtgcgtgctgcagcggggtgaggaccctgaacgccaaggcgtccaccccggccgaccggaaggcggcgtgcaactgcctcaagaacctggcggggtcgggcatcagcatgggtaacgccgccagcatccccggcaagtgtggcgtctccgtctctatccccatcagcaccaaaaccaactgcaacaaccttcactaagttatctgccagcatcatcatcacaccaggctagctagccgactcggtgtctacggttgctgctctctgcgtgtgttcgtgttttctgcatgtgttcgacctccatctgtttcccttattacagatcgagcagattactgctcgaatcatcaataaaataatgtgtcgagcttaagttttatgacattcactgttatcaataatgattataaagtagtttcatgcccgcatgttgatgctggaaattttagcaagtgttattcacgtgtttgatgcaaggg

SEQ ID NO: 28306 - DNA, 1168 bp, Triticum aestivum
  Clone ID: PAT_TA_28306
ttttgaaccatgtaaatcagaagtcagttgaaaaccattgtttggcaccaccaccagtaagctggcagtaaggtgaggtttaacgcgaaacaggtacagtacttgcttggctgcgaagtgactcatcacttgcatgccttgtcacctctttagacgaagcatagtaaattggtaattaatttacatctgtgtacatcctaagcaaaacctaaagaaacaacttttgcttctcccaggagcatgatcatgggctcatggccagaatatggggcttccagtcctcacgaggcaacgtgtgacccattcttctttgttctcaggaaactaaccaatgtgatcatgggggcaacacccgtccccgaacgcttcttgattgttgtcgtcttccacggctttccatcttgcacagtacccgttgtcgtagacgttacgttgtagaactcgcacacaccatgtaatagcaacctctgaaatgggtcctggacattcaacacaagcacatctttatcggtagtgtcttcaatgaaggccctgatccgttcctcatatatttcaagcagttcaggtaggaagtttctcttcatagcttctcttgtttggcaatctatacggcgccaagcattcagcacaattgactcatcttcattcacaagattcttctgcttagctgaggattgtttcatccgttgcataaatcttgcctcaacgtccatgtcaatgctcctgaaggcatcccactcaccaacacttgtcctgcaaaatgctgacagtggtgcttcctcaccaaatggcggaggggcaaagaggcctttgatttcttcaacatgaagacgagggacgagctcaatcagcaagcgatcattcaaccatctgcgagacctccggttactaaccttggttgccatgtcctccaaggcttcaatcttcctctcaatcatctgcccacgcgtcttggcggcagcggcatcgcctttggcggaatcgaacagggactcgtagaactcctcctccctccgcagcagatccgcgctcgccatggctgagtccttcacgcaagcttctcgcgctcccttctggacctcgagcttctgccgcggcgatggaggaggaatcgaggcttgggttggcttgtttccgcttttgtcccggttgcggctggccctcctgc

SEQ ID NO: 28307 - DNA, 780 bp, Triticum aestivum
  Clone ID: PAT_TA_28307
gcgccaccaccacacaagccaatcaagctctcaactccttccgagctccgcggtttccagcaagcaagccgaagcactagatcctcgatggctcgcgtggcactgctcgccgtgttcgccgtgctcgcggcactggctgtggcggagatggcgtccggggcggtgacctgcggcgacgtgacgtccgccatcgcgccgtgcatgtcatacgcgacggggaaggcctcggcgccgtccgcggggtgctgcagcggcgtgaggaccctgaacggcaaggcgtccacctcggccgaccggcaggcggcgtgccgctgcctcaagaacctggcggggtcgttcaagggcatcagcatgggcaacgccgccaccatccccggcaagtgcggggtctccgtctctttcccaatcaacaccaacgtcaactgcaacaacattcactaagttatctgtcagcatcatcacaccaggctctatatggatagctagccgacgcggtgtgtctactgttgctgcttctgcatgtgttcgttgctgctttccacatgtgttcgacctccatctgttgccccctgttacagatcgaatatcaataaaataatgtgttgagcttaattttgtatgacactcactgttatcaagaacgattataaactagtatcatgcccgcatgttgatgctagaaattttagcaagtgttagtaacgtctttgttggtaccaacatggcacattcgtaattttgtaactaaatgcaagaaaaaaaccttgccggtgtcaactt

SEQ ID NO: 28308 - DNA, 1380 bp, Triticum aestivum
  Clone ID: PAT_TA_28308
atgactgtgaacctgttggccttggagctcttgccatggtagttcacggccgaggtcacctgcttcttgagcttcttcccgaggaagttggtcggcgtagaagccggggcaccgacggtggaggagaaggcagcagccatctcggtgctgcttggtcgaccttgctagcaacggtggatgcgcggctgtgctggtgtccgctcagctctagtgttttctctccatccaccgatcgagtgaagctctccgtccgccggacgaaagatcgacgaccatggcgggcacggccaactgcatcgacatcatcctcgccatcatcctcccgcccctcggcgtcttcctcaagttcggctgcgggcacgagttctggatctgcctcctgctcaccttcctcgggtacatcccggggatcatctacgccatctacgccatcaccaagtaaactagctagcaagccgtcccaagtgttcggcgacacaatattttcaggatgatttgatctcttggtctagtccctccttgcttgtgtgggttcgtttaattcttttctgtgtgcgttgatgatgcgaattcctcccgtgggtttccgtggaccgtgtgaagagcatcatcttctttatgtatatgatatatgggagtttatatatgctccccgagtgggaatacttcttcttaaagttaggctggtcacaatgggcaagaacataagctagtaacttacacactttcctagactatattactacctccatagtgtgtaggaacatctatgtagtgtcatgcaacgatgtatttattaggttatagactcattttttcttggagtgtgtgatgtttcggtaacttagctagttaccacaagcacctctctcttcattaaatatgtgccacataagcaaagttatattagagtgtgtgatgttactcctaagttcctccccactgtgatcagcctaacagtggccacaatgctacacagcagcaacagatgttcgcacacaaaatacgggactaagacactgacaacagtaacacacgatgacacgactcacacataaccatagagacaactaccaggacctgtgaaccgatcttccaaagaaatcactggccaccacggaggcggagcaccaggtgcagggtggactccttctgaatgttgtaatcagcaagagtacggccgtcctcgagctgcttgcctgcgaagatcagacgctgctggtccggcgggatgccctctttgtcttgaatcttcgccttaacattgttgatggtgtcggaggactccacctcgagggtgatagtcttcccggtgagggtcttcacgaagatctgcatcttgaaggaggattgcggcgatgttttcgatcgaaatcaggg

SEQ ID NO: 28309 - DNA, 701 bp, Triticum aestivum
  Clone ID: PAT_TA_28309
gccggccggtttcgggccaccaccaccacacatgctaatcaagctctcagctccttcccagctccacggtttccagcaagcaagccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgacggggaaggcgtcggcaccctcgggtgcgtgctgcagcggggtgaggaccctgaacgccaaggcgtccaccccggccgaccggaaggcggcgtgcaactgcctcaagaacctggcggggtcgggcatcagcatgggtaacgccgccaacatccccggcaagtgcggcgtctccgtctctttccccatcagcaccaaaaccaactgcaataaccttcactaagttatgtgccagcatcatcatcacaccaggctacctagcccactcggtgtctactgttgctgcccgctctctgcatgtgttcgttgttgtttttctgcatgtgttcaacctccatctgttgcccttgttacagatcgagcagattactgatcgaatcatcaataaaataatgtgttgagcttaagtttttatgatattcgctgttatcaataatgattataaagtagtttaaaaaaaaaaaaaccccccc

SEQ ID NO: 28310 - DNA, 911 bp, Triticum aestivum
  Clone ID: PAT_TA_28310
taagcttgaaattcaccctactaaagggaacaaaagctggagctccaccgcggtggcggccgctctagaactagtggatcccccgggctgcaggaattcggcaccagtcgactccggccagtctcttcttctctagaaagctagcgaggcttggaggtgagcgaaaatgccggtcagcaggatcgccgtggggagccaccgtgaggtgtacgaggtcggcgccctcaaggcggcgctcgccgagttcatctccacgctcatcttcgtcttcgccggccagggctccggcatggccttcagcaagctgagccccgacggcgcggcgacccccgccggcctgatctcggcggcgatagcgcacgccttcgccctgttcgtggcggtgtccgtgggcgccaacatctccggcgggcacgtgaacccggccgtgaccttcggcgccttcgtgggcggcaacatcaccctcttccgcggcctgctctactggatcgcccagctcctgggctccaccgccgcctgcttcctcctccgcttctccaccggcgggctccccaccggcaccttcgggctgaccggcatcggcgcgtgggaggcggtggtgctggagatcgtcatgaccttcgggctggtgtacacggtgtacgccaccgccgtggaccccaagaagggcagcctgggcaccatcgcgcccatcgccatcggcttcatcgtgggcgccaacatcctggtcggcggcgccttcttccggcgcgtccatgaaccccccgccgtctccttcggccccgccctcgtcagcttgggagtgggggtacccaagggggggactggggcgggcccctcatcggcggggggcttggccggcgtaatctacaagctggtctttatttcccgccacccccgaacaagttcct

SEQ ID NO: 28311 - DNA, 785 bp, Triticum aestivum
  unsure (1)..(785): unsure at all n locations
  Clone ID: PAT_TA_28311
gccggccgggtcggggaagacgggagacggcccaacccaaccgccccttccttcccatcctgctctgctcagcgcctctactgcttcccctccgtccaccgatcgagtgaaaaagctctccgttcgccggaagatccacgaccatggcgggcacggccaactgcatcgacatcatcctcgccatcatcctcccgcccctcggcgtcttcctcaagttcggatgcgggcacgagttctggatctgcctcttgctgaccttcctcgggtacatcccgggtatcatctacgccatctacgccatcaccaagtaaactagcaagccgtcccgagtgttccgcgacacaatattttcaggatgatttgatctgtctagtccctccttgcctgtgtgggttcttttaattcttttccgtgtgcgttgatgatgcgaattcctctgtggtttccatggaccatgtgaagagcatcagcttctgtatgtatatcactcgggctgagaagcaggctttcaaccaagaaccacaagatatgcttgccattgtgccaggtgtcacgccgcaaaacataaagaacttggtactcaaaacagagagtatccgtgagattgctaatatgtctgtacaagaattaacgcccctggtaggcgcagcatccgggcgacagatccatgggttctttacccgtaatgtgatggaagaggacgactagattaataagatgggcgttgggtcaaaannnnnnnnnnnnnnnnnnnnnnnngaanannnaaaaaaaaaaggccccta

SEQ ID NO: 28312 - DNA, 774 bp, Triticum aestivum
  Clone ID: PAT_TA_28312
cggcacgagctcgcccgccggctatttatacccagctccacgggagttccaatccatctccacaagcgccatcaccacacaagctaatcaaggtctcagctccttccgagctccacgatttccagcaagcaagccgaagcactagatcctcgatggctcgcgtggcactgctcgccgtgttcgccgtgctcgcggcactggctgtggcggagatggcgtctggggcggtgacctgcggcgacgtgacgtccgccatcgcgccgtgcatgtcctacgcgacggggaaggcgtcggcaccgtcggcggggtgctgcagcggggtgaggaccctgaacggcaaggcgtccacctcggccgaccggcaggcggcgtgccgctgcctcaagaacctggcggggtcgttcaagggcatcagcatgggcaacgccgccaccatccccggcaagtgcggggtctccgtttctttcccgatcaacaccaacgtcaactgcaataacattcactaagttatcggtcagcatcatcacaccaggctctacatggatagctagccgacgcggtgtgtctactgttgctacttctgcatatgttcgttgctgctttccgcatgtgttcgacctccatcttttgcccttgttacagatcgagcagattactgatcgaatcatgaataaaataatgtgttgagcttaagtttttatgacactcactgttatcaataatgattataaactagtatcatgcccacaaaaaaaaaaaaaaaaaaggccccta

SEQ ID NO: 28313 - DNA, 842 bp, Triticum aestivum
  Clone ID: PAT_TA_28313
agcaggccccacgcgtcgccccgatatttcctccctccctgccttggcctccatctcacctcaccctcaccctcgccgccgtccacccttgacttctatttccccgtctatataacgagagcccggcggatacgtgtttcaccaccccttccttcccatccacctctgctctgctcagctctactgcttcccctccatccaccgatcgagtgaaaagctctccgtccgccggaacatcgacgaccatggcgggcacggccaactgcatcgacatcatcctcgccatcatcctcccgcccctcggcgtcttcctcaagttcggctgcgggcacgagttctggatctgcctcctgctcaccttcctcgggtacatcccggggatcatctacgccatctacgccatcaccaagtaaatcaaggcagccgccccgagtgttccggcggaatagtagtatatttccatgatgatctcgcctgtctattcctagcgtgctcgggttattgcttgtgtgggttctttgaattcttttccgtgtacgttgacgatgcgaatttctctgtggtttccatggaccgtgtgaagagatttcagcttctttatatgtactatgtatatgcactagtatcatgtatgggagtttatgcatacagtacttattgttgaagttagattaccgcctccctgttcaagtctggaatcggcagtgatgtgtatgtagtcgggtttctcatttgatttttcagtttttcttcagtaataataatataaataaagaagcatcaggttctactgggaaaaaaaaaaaaaaaaactcgagacacctgcccgggcggccgctcga

SEQ ID NO: 28314 - DNA, 884 bp, Triticum aestivum
  Clone ID: PAT_TA_28314
ggcccgctccgaggccggccttggccgggcatcaccaccacacaagctaatcaagctctcagctccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgagggggcaagcgtcggcaccctcgggggcgtgctgcagcggggtgaggaccctgaacgccaaggcgtccaccccggccgaccggaaggcggcgtgcaactgcctcaagaacctggcggggtcgggcatcagcatgggtaacgccgccaacatccccggcaaatgcggcgtctccgtctctttccccatcaacaccaaaaccaactgtaacaaccttcactaagttatctaccagcatcatcatcacaccaggctagctagcccactcggtgtctactgttgctgctctctgggtgtgttcgttgttgttttctccatgtgttcgacctccatctgttgccgttaatacagatcgagcagattactgatcgaatcatcaataaaataatgtgttgagcttaagttttatgacattcgctgttatctataatgattataaactactccatctgtaaagaaatatgagagtgtttagatcactatttgctcttatatttccttgcggagggagtagtttcttgcccgcatgttgctgctggaaattagcaagttttattaatgtctttgataccaacatggcacatttgtaaatttttcctaaatgcaaggaaaaaaacttgacgaaaaaaaaaaaaaaaaaaaac

SEQ ID NO: 28315 - DNA, 1013 bp, Triticum aestivum
  Clone ID: PAT_TA_28315
gcacgaggggccttcagcaagctgagccccgacggcgcggcgacccccgccggcctgatctcggcggcgatagcgcacgccttcgccctgttcgtggcggtgtccgtgggcgccaacatctccggcgggcacgtgaacccggccgtgaccttcggcgccttcgtgggcggcaacatcaccctcttccgcggcctgctctactggatcgcccagctcctgggctccaccgccgcctgcttcctcctccgcttctccaccggcgggctccccaccggcaccttcgggctgaccggcatcggcgcgtgggaggcggtggtgctggagatcgtcatgaccttcgggctggtgtacacggtgtacgccaccgccgtggaccccaagaagggcagcctgggcaccatcgcgcccatcgccatcggcttcatcgtgggcgccaacatcctggtcggcggcgccttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactaagcagcgagcttaggatcggagtcgccgtccatccgtccgtgtgatgcttcgtctcccccttccttcccgtcatcagtcgttttagtttctcgcgcggtcgccgcatgccatgatgcatgtatgcggagctcgcctcgtttgctttgaatcaatcagtcctgggatccgtcgatcggtcggtcagtcgagtcagtttgtggtgcgtgcgtggagctgtaaaagcgtggatgatctcgatctgggatgaccgacccagtcaatttgcttctgtaaaactgtgaattcgcccgcccgagtaatttcaagttcagttgagttggatggatcgaccgtgccttgtgaaatgtgaatttgccaatttgaaaaaaaaggggggg

SEQ ID NO: 28316 - DNA, 1729 bp, Triticum aestivum
  Clone ID: PAT_TA_28316
accacacaagctaatcaagctctcagctccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgccgagggggcaagcgtcggcaccctccgggggcgtgctgcagcggggtgaaggaccctgaacgccaaggcgtccaccccgggccgaccgggaaggcggcgtgcaactgcctcaaagaacctggcggggtcggggcatcagcatgggtaacgccgccaacatcccccggcaaatgcggcgtctccgtctctttccccatcaaacaccaaaaccaactgcaacaaccttcactaagttatctaccagcatcatcatcacaccaggctagctagcccactcggtgtctactgttgctgctctctgcgtgtgttcgttgttgttttctccatgtgttcgactcatctgttgccgttaatacagatcgagcagattactgatcgaaacatcaatccagtcagtctcttcttcttctctagcgagcgagcaagctaggcttggaggtgaccgaaaatgccggtcagcaggatcgccgtggggagccaccgtgaggtgtacgaggtgggcgccctcaaggcggcgctcgccgagttcatctccacgctcatcttcgtcttcgccggccagggctccggcatggccttcagcaagctgagccccgacggcgcggcgaccccggccggcctgatctcggcggcgatagcgcacgccttcgcgctgttcgtggcggtgtccgtgggcgccaacatctccggcgggcacgtgaacccggccgtgaccttcggcgccttcgtgggcggcaacatcaccctcttccgcggcctgctctactgggtcgcccagctcctgggctccaccgccgcctgcttcctcctccgcttctccaccggcgggctccccaccggcaccttcgggctgaccggcatcggcgcgtgggaggcggtggtgctggagatcgtgatgaccttcgggctggtgtacacggtgtacgccacggcccgtggaccccaagaagggcagcctgggcaccatcgcgcccatcgccatcggcttcatcgtgggcgccaacatcctggtcggcggcgccttctccggcgcgtccatgaaccccgccgtctccttcggccccgccctcgtcagctgggagtgggggtacccagtgggtgtactgggtcggccccctcatcggcggcggcctcgccggcgtcatctacgagctgctcttcatctcccgcacccacgagcagctccccaccaccgactactaagcaaccaagcttgcatgcgagctcgccgtccatccgtgtgatgatcgatcgcgtctcgtcatcgtctccttccttgccatcgccatgagtcgttttagtttgctttgaatgaatccatccatccctgggtcgatcggtcggccagtagtcgagtcagtttgtggtgcgttcgtgcgtggagctgtaaaagcgtggatgatctcgatctgggacgaccgaccctgtcaatttgcttctgtaaaactgtgaattcgcccgccccgccccgagtaatttcaagttcagttgagtttgaacccgtcgtgccttctaggtaggaact

SEQ ID NO: 28317 - DNA, 3511 bp, Triticum aestivum
  unsure (1)..(3511): unsure at all n locations
  Clone ID: PAT_TA_28317
taccgggcccccccttttttttttttttttttttttttttttttttttttttttttgaaacaaattgagtatttttattttcaactactactacttggtctctttccaaccaaaacacaaactgaagtgacctttatttcagtatggcagaaagtaatcaaccacgcaatgcacactgctccanattgccagcttatttgtgatgcaactaactcgtcccctcatctctctccactccggccggccagccagtctcttcttcttcttctccagcgagcgagcgagctaggctcggaggtgagcgaaaatgccggtcagcaggatcgccgtggggagccaccgtgaggtgtacgaggtgggcgccctcaaggcggcgctcgccgagttcatctccacgctcatcttcgtcttcgccggccagggctccggcatggccttcagcaagctgagccccgacggcgcggcgacccccgccggcctcatctcggcggcgatagcccacgccttcgcgctgttcgtggcggtgtccgtgggcgccaacatctccggcgggcacgtgaacccggccgtgaccttcggcgccttcgtgggcggcaacatcaccctcttccgcggcctgctctactggatcgcgcagctgctgggctccaccgccgcctgcttcctcctccgcttctccaccggcgggctccccaccggcaccttcgggctgagtggcatcggcgcgtgggaggcggtggtgctggagatcgtgatgaccttcgggctggtgtacacggtgtacgccacggccgtggaccccaagaagggcagcctgggcaccatcgcgcccatcgccatcggcttcatcgtgggcgccaacatcctggtgggcggcgccttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactgagcagcgagctcagcgcagccagcctgcttgcttgcgtgcaagcccgccgcctgcctgcccgtccgtccgtgtgatctatgatcgcgtcgtctccttccttgccatcaccatgagtcgtttaagtttgcttcctgggtcgatcagtttgtggtgagttcgtggagctgtaaaaccgtggacgacactgtcaatttgcttctgtaaaactgtgaattcgcccgtcccgcccgagtaatttcaagttgagttgagttcgaccgtgcctctgaaaacttgaattctggaattaatccgtccgtctgagattgccagtgaggtccactactgtttagtttgtttgaggcaggtcataatgggcaagaacatagtctagtaacttacacaccacttttctagactatgttactatctccacagtagataggaacatgcaacaatgtatttattaggttatagactcattgtttcttaaagtgtgtgatgttctgataacttagctagttaccacaaacacttctttttttattaaatatgtgacacataagcaaagttgtgttggagtgtgtgatgttactcctaagttcctccccattgtgaccagccttaaacattatgccatgcaggccacacagtaaaagtagacatccaaacaggccaaattgggctccccagagcatgcatggcccacatgcagcctaccaaacatgccattgggtaatctaatataactattgtcatttacaataatataagtggccacaaaatttctatagctatggagacaagttatatttgatcaaatgacattttttatctctttgaacagataagtaacaggctatatttcatctcccttgggtagcaaaaactgtcaaagtttcagaagaatggcaagctgaaaatgtcatgccgaagttttgctgcccctcacaattggttgttcaccttcaaactctgatatcacgatgagtgaatctgtcatttcaagagaaagtggctgcaacttgttcgtaagatttatatgctgcttctggtccttaacataaccaatggcaacttcacgacgcaaaactgccctttcagacagctcagtgaatgatattttctctccttccttcatgtacagtcctacttccttaatataaatctcatctccttcagcatccagaatatccttccatacttcattcagctcactacattccgcaacttgtgccgtcacaagactcataacgtcctctgctccaataaatgaaagggagggtcttattctagttatttgctttcccagtcccgtgtctacaatttctgatacaagatgctgaaccttaatgtcatttttctggcaaatattttctgcaaggagaagggtatatgccaattgcttatcagcctgtacagtatctccaatgagccagtctctatcagatatcaccacgactgaaagtggaacatttttgtcacacttggcagatttcctaatgttaataatcgcttccttcaaagtatcatagttcataggacatcccaccttatgagtaactttaatatttttaagttggctctgcataagggggttgacaacactcgtccgctctgtaataggggtttctgacaatatttccaatacactaccaggtccaaggtaattatcatattctcgaatcatatcagtaatttttggcctccaaccaacaataagtatgcattcccttggtcccagtgtacattcgctgctcttagagagtgattttgacggccgctctacaatgttctttagccgtgtttccttcagctcagtaaccacactagaagatctttgaccctcttttggttctgagtaattaactgaattatctgttcgttcagatatatttaaaactgaatactgtgattttctcttcccgcagacaggagaaataagaagcaatttatctgtttctttcaatacttcatcgtcacctgggtggaagtgaatcccaccagaccgaaaaataccacaaacgactgcatcttggactttacgtctcacgtccttaaacttcatgcctcctacttcaggaatgctgaaaatgttgaaaacattcttgcgagaattaagcaagtgtctgtagattttaagaaggcccttttgcctagagcactgcacaaacaacttagaggcaaccatctccaccggttgcacatttaagcctgtgattgatttcagaagttcgatagtggtcgagttagaagcctcaacaatggtaggaaccaatgcaattcgtggaagagactggagagccaacagagaaagaaatgcatctgtatccacttcatatcgttcattttttgatggtaagatgattatagactttgctttgtttgctgctgctctctcgaatgattttgtcaagctaaggctacaactcttggtgaatacatcaacatgatttaaatctttagatatgg

SEQ ID NO: 28318 - DNA, 504 bp, Triticum aestivum
  unsure (1)..(504): unsure at all n locations
  Clone ID: PAT_TA_28318
cggacgcgtgggggttaagtgatagtcaaaagattggtgtaggattaactgcatttggagtttttttcatgatgatgggcgtcttattattatttgatgcaggattaatggctattggcaatgtattgttccttggtggtataacagctattattggacctagaagtacttttacattctttagccgaaaagagaaaataaaaggaactatttgtttcttgggtggtatattcttggtgttgagcaaatatccattcattggattcgcagtagaaatatttggtttcttgaatttatttggtgatttctttcctgtcgtctttggatttttgaaacgcttaccaatcattgggcccatcttgtctcatccagccctttctagagttgttcctagagaaagtcgcactcgcgtgtaaatatgtatttatattaaatgataatgaaatagagagcgattttaatcatcatntctngagtcgcctgatggcaatccactgagcccac

SEQ ID NO: 28319 - DNA, 994 bp, Triticum aestivum
  Clone ID: PAT_TA_28319
ccggccccccctttttttgtctaattctttttttttagaacggatccaaatcgttccaaactatgccacaaaggtcagaaccgtgattttgaccgataaaagtcgtgcttactgtcacaaagcaacgtgttgtagaaacaaacaagtttaaaacatcaacgcacatgaacatatcggagagcactccacagccacaggaacacgtagcatcttttatacaactgaccgcccgctggcaaagctcaccaaagccgacggatggcatgcagggcacatgaaatatgtcccgccagccggacgaaggagtggggctggacgcctggttcgatcagcggcttctccggtagagggagtaggcgttgaggacgacgaggaggacgaggaggatggaagcgatgaggccgaggcaggtggcgctgccgatgtggcggcagaacttgtcgtagatgttgcagatcttgttccaccgcgtgtgcgagttgcccttcagccccacccaggccacggcccccgccgtgcccgtcgccgacgccatgatgcccgcgtaaaccacatcaagcagaatgaggacgaagatccccttggcacaggaagccgagcttgacatggacttgacggagctggcggccgtcacaaggctatacaagctcgtcatgcacagcgccacaagaagataaatgagcgctggcgagtctttgaactgggcggggaccggcccgaatctgaacggcggcgtcaggaccaggggcaccatctccgtctgcttggcggtgaccagcacgacgagccccgacagcgagacggcgaacagcagcaccctcaggcccaggtcggcgccgcggagcccggccggagacgacggcgccgtcttcccgctgtcctccaccgtgccggccatgccttcggtcgggccgcgcgcttgtctatagctgggcgggcgggggagtctgcggtttatgagctctagcacagagttattaatggatctatcgcc

SEQ ID NO: 28320 - DNA, 914 bp, Triticum aestivum
  unsure (1)..(914): unsure at all n locations
  Clone ID: PAT_TA_28320
gngnnttgntncgccagctngaaattcaccctcactaaagggaacaaaagctggagctccaccgcggtggcggccgctctagaactagtggatcccccgggctgcaggaattcggcaccaggaaagcgaagagaaggacaatggtgctgaggtggaggtgtgcaaagaagtggtggaagaggagagttacaaggtggaccgaatggaacaaccgattgctgaaccggaccggaccaaccgtatccagaacatcttcaggctgtgtggcaactaccgtgagttggtgaagaaacaaaacgccgacgagtcaccggcgaagcagcaagtgtttggagatgagaacaagcagcccggacagcagcatttgttgggagatgagaacaatcagcagggaaagcaggtgtttggcgatgagaaccaggacccatcagcagcatgggcagccatagaaaaccccatgtgcgacgtcaaggttgccgacagccctgtgtcgtcgcagctctcgcccatcgtttgccatgtcgtggacgataccgagctgacaatgccggaagagctaaaatcatgcaccacagatggcgaagcaaatgagcagagcaagaaggagcgagagggcttgctggacgtctacatcaaatgggagtccggcagtctgatcaaggggctgaagcttctgccgaccgcttgcctttcagacctgaggaagctcatcgaggctcactttgaagaagccggcagcaagcagccacagcaccagttcaccttcctcctcctcggggatccttcgggtgctccggtgtcgagggagaaggagccgacggtgcagatcagcaggctgcccaactggaataaccagaccaacagctacctggcctgcctgcgcgtcgccaagaagccggcgacgacggagcagc

SEQ ID NO: 28321 - DNA, 1068 bp, Triticum aestivum
  Clone ID: PAT_TA_28321
attcggcacgaggcaaaggcctggacctctgcacagcctcgcgcctccgttgatccacaagggcttcaagacgagcaacgtgctggtggacgagaacttcatcgccaaggtgtccgacgccggagtcgaccggctgctcagagggctcgaggaccccggctcgccgctcaacggattccgttccggcatctaccaggatccagaggcacattccttggcacagctctctgcgagcagcgacgtgtacagctttggggttttccttctggagctcatcaccggcagggaggccgccaccttggtttctccggaatcaaccgaattctctcgctcattggttggagacgtcgggaagacgaggtggcggacccgaaggctcggcggcagcttcacctcggagggcatgaaggagctggttggcctgacgatgcagtgcctgagcccgtcggcggtgaggaggcggcccaagatgcggctggtcgcggcggagctcgaccgcatcctggagaaggagatgaccctgacgacggtcatgggggatggcacggccatcatcacccttgggagccagctcttcacgtcaatgatcatccaatatttgttaccacaaaatggatatttttgtgtttcgcgattgctaaactttagttgcctgaaaatcaattgagcatcaattgaattcccctagcatcgagctggaaatcaagacgacgtgacgtcttcgacggaggggagttcaagggttgactgatatgggtgtggtagaggaggacttcaccggagcaaaaaagggggaaggatggttgcagggatgaccggggtgacggccaatggaccggcataggaggcgattcaggcagcccacgcgtccgaggcgacataggctgaaggtggcgggtaccggcggttaggccaatgaaggcgggtggctcaacaatggaagcgtttgtcagcaatggggatgaaggggaaatcgaccaatgtatgtacttttttcaggcaactggcatttagccggtccattttgttttgtacatttgcatataaagcaactgcgtgtgtaatttc

SEQ ID NO: 28322 - DNA, 682 bp, Triticum aestivum
  Clone ID: PAT_TA_28322
gtactattcaaaatggatcattctatgggccattctatggatcactctaataacagcatggatcactctggccataatatgagcaacatgactacaggaaatagtggtagccatatgcatcatatgatgatgggcgctatgggaaccttccactggagtactactggtgatggtatttggataaatacatgggtaccaagttcaaaaggtgcttatgctggtgcctgtttcggaatgcttttcatgacaatcctttataaaggaattcctacgttagatgcctatcttgttgcttggagaaagacacgtgaatccaatatatgcactattcaatcaaacatagaacagcaaacagttaatcatggtatcgaaaaaacccctggctcgttaacatattccccacctatttctccgatgccttcttggacatgtcataccatcagaagcttcctggcggcattttcatcgttcattagctacctattaatgatggtggttatgacaggtaatgctggattcttcttcgttattattggaggagtgtttattggagaaatgatttttggacgacatagagccccaggagggcttgctaatgatcatgaacattaaaatgagtatttgttacttacgcttatatattatacacacgcttttcaagtatacgtatctataatttaat

SEQ ID NO: 28323 - DNA, 726 bp, Triticum aestivum
  Clone ID: PAT_TA_28323
cccacgcgtccgatgagaagcatgggttcctcacaagaaatgccagtggtcaaggcacccaagacagatcccaagagtttcgttcttcgtttcaactcatccgatctcaactcgaatcaaaaacgtctcaagaaatcaacaaaacgtgtgatggaagaaatgatggaacctgaaacgatcaagaaaagaaagtcggtggatgttcaagaagaggatttctatgacaagaaagatgtcattcaaaatgaaatccttcaagacttttggatgcatgaacctgatcaatcacaagaattattacttacgacagaatacaatccattctgttttgatcctgaagcacaaaatatccttgaaggtctacaggcacctgctcctcatgtcatctcttctcatccagacatgaagacaatcgatcttcaactggattcatttgagaaaagtattcattatccacaatcattctctttagatcaaatcaacaatccatcttttatggatgatttaaataattatagcatcgatcaatacattgattttgatatcctcgatgataaattaccttctgatttactcaaagacaccaacgaaagttttactaccatcatgaattcctattggcctgatcaaaccaatcccttattttaattgcccctttataccaacacttttgtaaattattgtatatttattaaataaatctttactttcgtcatttttcatttt

SEQ ID NO: 28324 - DNA, 929 bp, Triticum aestivum
  unsure (1)..(929): unsure at all n locations
  Clone ID: PAT_TA_28324
tgggccgccctcgtgtccgcccaccgcctccgacttgccatgaagaccatgaagagatgcattattcctagcatcctgctgatgctttcactcgaggccgtcctcctcgtcgccgccggccgcccttccacggccaccggcgccgacgatgtgggcaccattctcctgccgagccaaggcaaaggcgaagcaggagtggtggcggcagcgaagaagaagggggaagaggaagagaggccatggaaatgctgcgactttgctctgtgcaccaggtcattcccaccgctgtgccgctgcatggacaaggtcgagcagtgtgctgcgacctgcgagaaatgcgagccggccacgtcggactcatcccgccgcgtctgcaacgactggtaccatggcttcccggggcccatgtgcacggaggctgttgcaacagcgaagaaggagaaggcggaagaagaagagaggccgtggaaatgctgtgacttggctctgtgcaccaggtcgttcccgccgatgtgccgctgcctggacaaggtcgagcagtgtgccgcaaactgcaagagctgcgatccggccgcgtcggactcgtcccgccgcgtctgcaacgactggtaccatggcttccccggcgccaagtgcaccgccgacggtaactagcatgcgcgttgatcacctgatcaacgccgtccagcctgagctttagtagctgcagcagcctgcagtgtctgtaagcaacaaaataaaatggaaagtcaggcaatcacgaataaaaatggaaagtcaggcaatgatgaataagacaagtcgtcgtgcgtgtgtactccgtgaaaatggagttcgtccccatgttttcacgaaataaacgcacttttgttattcttgagctcgagnctaacctgcccgggcggccgctngaaatcaatagtgaattc

SEQ ID NO: 28325 - DNA, 676 bp, Triticum aestivum
  unsure (1)..(676): unsure at all n locations
  Clone ID: PAT_TA_28325
agctcgagtctcaacgacaacgggccgcccgcgcgcgcacttctagacgtgggtgtcatggcagccatggcgggtccggcggagaggaagatgaaggtgtgggagctggtgctgcggtgcctcgtcggcggcttcggcgcggtggcggcggcgctggtggtcaccgacagccagacccggaccttcttctccctcgagcggagggccaagtacaccgacatgaaggcgctggtgctcctggtggccgccaacggcgctgccgtcgggtacagtctgctgcaggcggcgcgctgcgccgtggcgatggcgaggggaggcggcgcgctggtcatgagcagcagggcgctcgcctggtcggtcttctccggcgaccagctgctggcgtacgcgatgctggccgcgacggcggcggcgctgcagtcgtcgctcctcgggaagctcggccagccggagctgcagtggatggggatctgcggcctctacggcgccttctgtaggcaggtcggcgcgggcatcgcgtgcgccgtcgtcgcggggctcgccgccgtgctcctcgcatccttctncgcgttcaacctgtttcgcctctacggcggcaacaaggggagcagnagnactagaaacggctcaacgnggnactaggatagaaagntaagnnacggaagataaaatcgat

SEQ ID NO: 28326 - DNA, 768 bp, Triticum aestivum
  Clone ID: PAT_TA_28326
aactatattatctcctttcctttataaatatcatgaataataacattaatgtacctttggaaaatgtggctgtcaagttgaatacggataaaacaagacgtaagagactcaaggtgattagtgcctgttgtgaatgtagaaggaaaaagacaaaatgcaatggtgaaaagccttgtattggttgtataaagacaaatgttgaatgtaaatacgccaatagcaatcacactcaacagcaacagcaccagcaccagcaccagcaccagcaacaacaacaacaacatcagcaacaacagcatatcatcaagaccaccacctcacaaacatctacaaaaaatgttgatataagtaaacttacacttcaatcgattgaacaacgtcttggagctattgaagatattcttcagttattattacaacaacaatcggaatcccgtaactccggttatctttatcattccggtatttatgacggaggaaaaaggaaacacgaagaaatggatgattactatgttcggttacctcctcctttaaactatcccgaatcttcttcttcttcttccgtctcttcttccccgaaattaaatacaattcaaaatttattgaatgaagagaaaaggcctccttctgctttttatagattaactgccggatcagatttacgttcttctaataattcttctttttattattaaatacttttcataaaataaacaccctctcttctatctttgtatttctctgtctattcaaaatcacttttgactg

SEQ ID NO: 28327 - DNA, 770 bp, Triticum aestivum
  Clone ID: PAT_TA_28327
cccacgcgtccgaacgcactggtatccttcgagtattctatcaaaaaaaataggaaataaattttgtttaattatattaaaccaacccattactcgaatggatatatttcacaagctatgggacaatgcttgtataaagttagtagcagatggaggttcgaatagactttatgatgcttttaaacacgataaagctttattagaaaaattcattcccgatgaaattagaggggacttggattctattcgacctgatgtttgggaatattatgaatccaaaaatgtaaagattacaaaagtagatgaacaagactcgaatgattttatgaaatgtgtatacttgttaaatgaaaaagaaaaagagaacaatgaaacttatgacattgtggctacaccagctttaggtggaagatttgatcaaacaatgtcaagtattcatgtattatatactttaaaggatcaagtacaaaagaaagttattttggttagtagtgaaaatttaacaatgttactggacaagggtaaacatcatattcactgtcaattggatttggaaggacccacttgtggagtgatacctgtgagtgcaccagctgttataagttctcatggtttaaagtgggatatggataatcttcaatgtcagtttggtggaagaataagtacatgtaatgtactcaacaatgaattaattgaaatcacaactgattctcctgttgtttggacagttgaaattaaactttctgttcaataaattttgctcctctctc

SEQ ID NO: 28328 - DNA, 1386 bp, Triticum aestivum
  unsure (1)..(1386): unsure at all n locations
  Clone ID: PAT_TA_28328
gcaacctccgacccacaaacccacagaacacaccaacaccccaagacataggccggaaactcaggcgcgaaggagggaagcagaggcaaaagcttctcttcggctacgcgtcttacaagagagaagtcttcgtttcttcgttccaacaagcagatggagaaggcaggacacaagcatgtgatcggcatcccagtgagcagcactgccatcggcatcgaggagccggagttcaccagcgatagagctacatcagtggccagggatgcaaaaaactcgacgaggacacgtagtggcggcaacatcggcgcgccggaggccaggggacaagttcgctcgaggagtcagagagcatgtgactctaggcccaaaactgtacgagaccgtgaggggcaagctgtcgctgggcgcaagaatcctccaggccggcggacgtggcagaaggtcttccggcggtggttcggccggtggagtaagggcgacgaagcctcctcgaacgcctcgcagtgctacctgtccacgaccgccgggccgatcgccgggatgctcttcgtatcgtccgagacggtggccttccgcagcgaccggtcgctggcgctgacctcgcccaagggcgacacggtgcagggttgccgtacaaggtggccgtcccgctgcggagggtgaaggcggccacgccgagcgagaaccagcaccggccggagcagaagtacgtccagctggtgaccgacgacggcttcgagttctggttcatgggcttcgtcagctaccaggcgtccctgcagcacctcgagcaggccatcgccgagtcacacctctgaccccatcaattgatcaaagaagcacggacgcgcggtgtgtgtgtgctggtgcggctgatttggtcagtagggcttcgtgagggattgatggtcgtttttggtgtcggagttagtacgggatgcataaatggtaggataaatttattggagggcgtgaataattctcgtggtgaataactccgcctgtggaagtacggcaagtggtcaggacagtcgcgcccccaaaacagcgctgcaggaccccgaggttttcgagctggtggcttacgccacctccctatacgtgagccgctggtggggaacgacgaaccgcgcgagcatgggcatggccgtgaagaggccccgagcagggcaagtgggcaacgagccttgctgcgggggccctctaatggcttatcaatgggcgtcgtcatggattggtaggtgatggaagcctgcaaccgatgtgtttggttctaaaacgaactggaatggaatggcacaccaagaatgtcggttccgttgacttgtttggttcgggatatcgaattaaaggttacacttaagtagcattngttnacaagtagaa

SEQ ID NO: 28329 - DNA, 854 bp, Triticum aestivum
  unsure (1)..(854): unsure at all n locations
  Clone ID: PAT_TA_28329
gaggaattcggcacgaggcttccccgctcttcccctccgtctctccccctgccgtggcggcgcggcggcgcgggccctgcgctgcccggcggccgcggctcacgggaccagcggccaggggatcagcgacggcagggctcggctctctcctctcctctccctcctaatcaagctttctctgaagtatggcttgtggacaagtgtagacctgtagacaaagacacaaaggaattgctggcataagtcttcatttgagaaagatcagttggcagcttacaatggctggaaatcagcagccggcttcagttgtgttggattatgcagcagtcctcgacgccaaacccttgcgcacactgacccccatgttccctgcaccgcttgggatgcacactttcacccctaaaagctcatcttcagttgtctgtgtcaccccatttggaccatatgctggaggtaccgaactgggaatgcctggtggtgttccgccaatgttaacatcactgtccgctcctgcagatcccaaccaggtgcagccatatacggctcatatgaatggaacttctaatgctaatggtactacaaacaacacaatggttacccctgtgttgcaaactcctccagcagtcactacacaggaatctggtttcaagatgtgggggcgcccctggcgtgtgcaagataccactactgttccttcggttcctccagttcaaccggttcctacggttcctacagntcatttggttccttcagctnctccagaagttaataatattggtctncagacacctncttcagccgtcacacaggaatctggcaagaggaagaggggacgacccaagcgtgtgccagat

SEQ ID NO: 28330 - DNA, 1148 bp, Triticum aestivum
  Clone ID: PAT_TA_28330
gtttcccaaagcgcctcgcctcccctccgatcccgccacgaagcaagggctcgccatggagaccagcgccagcggggcggagcccgcgaacgccgggatcgaggtgtccgctgacccctgcagctccgcgggcggcggccatcgactctcagtgcaccagatcgttggcggcggcaaagctgctgatatcatcttatggaagtgtaaacgtgctactgttggtgttatatttggtgctactattgcatggtggttgttcgagaagtccgaactatcgttcttgactatctgctgtgatgtactgctcattttgatagttgtacagctcatatgggtcaaaatatctgggttgctaaataagcaacctaggcaactgcctgagttagttctgtcagaggagatggttaataatgctgcggcttcattccgtgttaaagtgaacaacatgctaatgattgcacatgacattactcttggcaaagacttccggctctttttccaggttgtgtcggtcctgtggttgctatctgttattggcaatttctactcttctgtaactcttgcttatataggaaccattgctctggtgacagtacctgtactttaccatagacaccaggagcacgtggacaggtatgctgggatggtccaccggaatatctcaaggcattacaagatcgtcgacgaaaatgtgataagcagactacctagaagcttcatcagagataaagatgattgatctgcctcaaagtttgatgcttgtcatttttatgctcgttaaatagtttgggtttgttgtatttctgcatcgtaggttgcatcaagtaggtatctagatcagtggaaaccgaaacttgatttaggtaccttttcagtgtactgttgatcaataagatcaatgccaaaagggcatgcagaagatcgcagcacctcgaccaatatccttgaacacatctgtatagactgatctacgtgttacccctgatgtttttttttccttctcttttgagatgggccctccccctggtcttcgcagcaaaatgccccgctggcccaacctccggcaccggtggcgggggccccgggtacccaagtttcgcccctgtcacgtactcacactgtatcaaaatatacggatgtttttacag

SEQ ID NO: 28331 - DNA, 547 bp, Triticum aestivum
  Clone ID: PAT_TA_28331
aacattaacaatgggcgtttatttcgatattagcattgacggtcaacctgctggtcgtattgaatttaagttatacgatgacgttgtacccaaaactactgaaaatttccgtgctctctgtacaggtgaaaagggatttgggtacaaaggcagtgctttccaccgtgttattccacaatttatgcttcaaggaggtgactttactcacggtgatggtactggtggaaagtctatctacggtacaaaatttgctgatgaaaatttcaaattgaagcacgataaacctggattgttatccatggctaatgctggccccaacacgaatggctctcaattttttatcacaactgtcccttgttcttggttggatggtgcacatgttgtctttggcgaagttactaaaaatatggacctcgtaaagacgattgaatctcttggttctgctaatggtaaagtcaaaaagaaggttgtaatcacagactctggcgaattataaactgaaacaacgcaaaaataaaaataaaataaaaatcttttatttttttgt

SEQ ID NO: 28332 - DNA, 431 bp, Triticum aestivum
  Clone ID: PAT_TA_28332
cgtccgcccacgcgtccgcccacgcgtccgcggacgcgtggggcttgatgctgcttatcaagcagctaaagacaaatcaagcaattcacctgtatttctattgttctctgtcaacaccagcggtcagttcattggacttgctgagatggttggccaggttgattttaacaagacagttgaatactggcagcaagacaagtggactggctgcttccccgtcaagtggcacattgtaaaggacattcccaacactctattgaagcacattattcttgagtataacgaaaacaaaccagtgacaaacagcagagatacccaggaggttaggcttgagcaagggcttcaggtgcttaagattttcaaggatcatgtctgcaagacatccatgttggatgactttggcttttatgataaccgcgagaagataatgc

SEQ ID NO: 28333 - DNA, 2334 bp, Triticum aestivum
  unsure (1)..(2334): unsure at all n locations
  Clone ID: PAT_TA_28333
gcccactggtggacaaagggtttcaacgaggcctgtaccccgcggggcatcgacccaagcccgacgtttccggagaataccagtctgcgccgcaagaccatgtggtggcggcggccgggtgtggaattgcccccgaagatgctaacccgacagcagcaaggtggggtggcacaaagggctggcgattttttggccggtcgggtagttggtaagggtaccggagagagtggtagtgctggcggcggctcgagcggcagagctcttggatacaatcaaggcaaacatgtagcactgagcgtatttttgcagctactctagcgcattcaagtccgtttcttgtgggagattttccaggtactggtgtcacacacctgcggctgggggttatggtggcatttattgtaacccttaatagggggttcaagagaggaggtatgaggagacgcataaacctgaaaagagtaagcattccaccacccccagattactgcgactaagccacaatacaagtcccaaactggcgaggtagtcgcatgaaaggatatttcctcgactgttgctgatccgctgcatgccgtagtcagtgctcggcaaagccacggcaaacagcgttgatgagggaaaaggtctgaagaagccagcctcaccactgaacccgagtggtgacaattgtatttacctgaaccaaagtagaagaccagcgaatccatggtactgtggccgaatctaccggggaatacaacagaagccttctagtggcaatcctacttcaactgattcaaatcctaaaagcaaggttcagtcgaagaatcagaatactcaacctcttcctcctctgatgagtttacctaactcaccgttggctacaatgtatgctcttgatggaatgtacaacaacaatgcctagggcggcttttggtatgtatccctgttttatgggccgttattgagatggagtgtaaaatagtctgtcgtattgaaactacaagccccgacagaggacagcgtatggatcgtatggatttcccaatgaaaacttggatggtttgaatgagttgaagagaggaccccccgagtggactctataataaccaacagggctttggacctgctgctgcaacagctgtcaaagcacaggatgtttctgctactgatggctctaatgcagttgggcaggatcagtacaacgggtctgacttaggtgacacttatgaaaatgagttatactttattattaagtcgtacagcgaggatgatgttcacaagagcatcaagtacaatgtttgggctagcacacctaatggaaataaaaagcttgacagtacttatctggaagctaaatctgtcaattctcctgtattccttctcttctctgttaacaccagtgggcagtttgttggtctcgctgagatggttggccaggttgattttgacaagacggtggaacactggcagcaagacaagtggactggttgcttccctgtcaagtggcacattgtcaaggatattcccaacaacttgttaaagcatatcattctcgagtataatgaaaacaaaccagtgacaaacagcagagacacacaggaggtcaagctcgagcaagggcttcaggtgttgaagattttcaaggatcatgtctcgaaaacatccatcctggatgacttcagcttttatgataaccgtgagaagataatgcaagagaggaaatcacagcggcagcttcaactgaagaagatcacgagtccgaagttgctgcctactgttgacaacaccgaaaatgattccggcaatgtgcaggaatcgcagaagcctgaagttaccggagagaacaaatctgcggtggaagacaatgtggaggcggctgccgtgagtggcgttgccccgaaagatgctaaccccacagccgcaagcttggctgtcgcaaatggctgctgatatttttgtctgttgagttgtgagtaaggtgacatgacagcttgggagttttggaggaggctggcgcagttcaactgttggaggcaatcagggctctgttggggttccgtaggtgtttttgcagaaagtttgagggatatgattaggtgtctcttgagatttcccccctgtattattatttctctatcttggagttgagttcgtctggtaggagatagagatcatcatttgttgatctggggtggtggtgtgttgtctttttttatcttgtcgtcggtagaaaatgtacctaggtgtggtgatttgtactggttttgcaaaaagtaacttgtctgtttcagtgtttatgtacttcgtgccagatgcgtntcatgtttccttgaaaaaaaaaaaaaaaaa

SEQ ID NO: 28334 - DNA, 797 bp, Triticum aestivum
  Clone ID: PAT_TA_28334
ttcggcacgaggtagttgaaatagatggtcctagtaccatagcaacaaagttcccagagcaggagcccaatttcatcagaagtccaagcccgcacgggcctagtgccacgacaagaattcgtgccagccgtggcgagtcccgcagttctctgttgtctggggctgctcgggttctagatgctgtccgcgtacagcgccctaagtgccgtacaggtcgccgccaatttttaaggatgctgctacctttttggtctagtgcactgccaactttcccagttacagcaccccctaaaaaggaaaatgatgctccacaaaggcggccacgacatcagaggacgtcacgaatcgatcccacaaagatcttacttgcaatggcaatcatggcatgtatagcaacgatgggaattctctactaccggttgtcgcagcgcagtctttctgaaaactttgcccatgatgaggctcagtagtagagttgaaacttccaacttgcagtttgtttctggtactgccttgctgctgattcaagggttttaccctgcctgtattattttccatttccccctttttgggcctttcagggtggttgtggatgggaaggtggaggtagtgattatagttacataagagttatagcagactggttttatatgctgattcatctgttatcttataccagacgggaaattgttgaagttgtcaactattttcttattcctgttgtcgcgccttctgaactgctacaggtgttactttgatcgagccattctaaaacatcgctgtgttatttctccagt

SEQ ID NO: 28335 - DNA, 742 bp, Triticum aestivum
  Clone ID: PAT_TA_28335
cggacgcgtgggcggacgcgtgggttgaagtcaagacccttactgctgaatcactcgccaaagtttttgatcatgctattcttcgtcccgaccagacaacagaggacgtcgttcaaggttgtcaagtggctcgtgaatacaatgtcgcctctgtctgtgtcaagccctgcgacgtgaagcaagccagtgaattacttcagggctcgagtgtcatggtcggcactgtcatctcttttcctcacggcaactcacccacctctgccaaggtagccgaggcacttcaaacggtcgaggatggtgcgattgaactcgacattgtgatcaatattggccacttgcgttcaggtctttacgccgaggtacagcaagaattagaagagatcatgaaggcctgtcgtgcaaagaataaggatgtctcgtttaagatcatctttgaaactgcctatcttacaaatgaacaaatcgtcaaggcttgtgaaatctctcacgcagcaggtgcagaattcgtaaagacatccactggatttgcctctgcaggtgctaccgttgaacacatcaagctgatgaaggcaagtgtacctgaaagtatggaagtcaaggcttctggtggtatcaaaacactggatcaagtccttgaatttttgagtttgggtgctacacgtattggatcctcttcttcagataaaattgttgaagaattcaaaaagagacaaattctaataataaatttttttatattttt

SEQ ID NO: 28336 - DNA, 482 bp, Triticum aestivum
  Clone ID: PAT_TA_28336
gtcaagtgtgaccctcgtcgaggtaaatacatggcttgctgtttgctctatcgtggtgatgtggtccccaaggataccaatgcggccatctccgtcatcaagaccaaacgcaccatccaatttgtcgattggtgtccgacaggtttcaaggtcggtatcaatcatcaaccacccatcactgtgcctggaggcgatgtggccaaggtacagcgagcactgtgtatgctctcgaatacgacagcgattgccgaggcttggtctcgtttggatcataaatttgatttgatgtatgccaaacgtgcctttgtacattggtacgtaggcgaaggtatggaggaaggtgagttttctgaggcgcgtgaggatttggctgctttggaaaaggattatgaggaagtgggagcggattcattgggggattcagaaatggaagaagaatattaagtactctattattaataaataacttatttcacgatttt

SEQ ID NO: 28337 - DNA, 572 bp, Triticum aestivum
  unsure (1)..(572): unsure at all n locations
  Clone ID: PAT_TA_28337
acgcgctgaagctgggagtgtgcgcgaacgtgctcgggctgctgaacctgactctggggagcccgccggtgcagccgtgctgctcgctgatccaggggctggcggacctggaggcggcgctgtgcctgtgcacgacgctgaacctcaaccttctgggcatcaacctgaccttgcccatcgccctcagcctcgtcctcgacaactgcggcaagaacgtcccctccggcttccagtgccccaactgagcccgcccggaccctgcatccgccatatctcatgcatgcatgcatgcatgattggctatttaaagtaccaccacgtacttaattgtgtgctttgattacgtaatcatctgctggtttttatgtgtggctggatttcgattgcggagaagctacgtactacttctccaggttctacgtacgtacaagcacgcactgttacctgcgtgcgtaaggatttcgttgtgtgtgtgtatgatgtgttgtcgtaatcgtcacatgtttgtgatgagttagttattgccagagtgctcataatgtaccgctatctccgnaataaataaaagattt

SEQ ID NO: 28338 - DNA, 1041 bp, Triticum aestivum
  Clone ID: PAT_TA_28338
ccacgcgctgcccttctccctgctccccctcggcgtcttcatccgccagcacctgcaagagagttgctggtcagaagatgatggcgagttcctcattccaattgagtttatattgtgtaggtttcttcgtaatgatttggattaccgcagtcatgttcaagtccaatgatatcttgcgcaagcagaccgctcttaagcaggctacaaggttgggggagcgaccctgccattgtcatgacggctgctccttctggccggatcgaggcatgaagacctgtgggatcccctccttcggcaggacctcctcatctggaggactgcatgtgatgagttaaggcacaagaagatctacgaccatcttagctccagcagttagtacacaaccaatcaatagtgcattttcacgacccaggcttctgaattctgactgacaggctcgcaggcacagccacatctaatctcacgcattcaaaatgctagctacatgaaatacgcccagatttacgagtagaaatccaaggcattgcagtccaattgttctaaggattggaaccagacgtgtggctcaatactgcttggaacatgtgagaaaagtttacgtacatgcaccttcttggatgatacaacttctctatgtttgtacctcctcgtcattaaaactttgcaaactttatgagtaaaaagtaagaagtaatgttctcacttctcttttttatgaccatcattatctcagtctcaacaacatctaggagatgtacctacgtagctactgttagttcaaaagctttatttcacaagttggcaacatgatattcaggatgttaagcatgtgttatagttctaatttgccttcttctcataaaacttgggtatcataaacagtagagactgtagcccgatgttgctcactgcacacttatacttattctgatttttgatggcctcctaaatttgaattattgtcttgatgccagctagaggacctttgcaatcttatcaagcttgacgctaaactggcactcttacttgatcccatattac

SEQ ID NO: 28339 - DNA, 982 bp, Triticum aestivum
  unsure (1)..(982): unsure at all n locations
  Clone ID: PAT_TA_28339
atgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggaggtcaaggggatccccgccccccagctcaagaccatcgaccagatcgacgccgcctacaggaccgccgccaccgccgccgacgctgccccggtcaacgacaagttcaccgtcttcgagtccgccttcaacaaggccatcaaggagaccacgggcggcgcatacgacaactacaagttcgtccccgcccttgagtccgccgtcaagcaggcctacgccgccaccgtcgcctccgcgcccgaggtaaagtacgccgtctttcaggccgccctgagcaaggccatcaatgccatggttgaagccgagaaggataccggcgccgccactgccggtggctacaaagcctgagctcgccaacaacacacatccatcacgcacacatactatgctgtgtatgtatgtagtacgtacgtgtgtggccttggcggccagggattttcctgatgcttccttctngttttcgtttcatgcatgcagccgcgatcgaccgtgt

SEQ ID NO: 28340 - DNA, 796 bp, Triticum aestivum
  Clone ID: PAT_TA_28340
gccggccgggtccggaaccacaccgcaagaaacaaagctccaatctttcccccttccgccgctgtcgccgcgtctcctccccgatccccaatccccgatccgtccgtccgcccccacccccagcccggatccaggcgatggcggccgcgggagacgccggcgagaagaagatggtgacgctcaagagctcggacggggaggagttcgaggtggaggaggcggtcgccatggagtcgcagaccatccggcacatgatcgaggacgactgcgccgacaatggcatcccgctccccaacgtcacctccaagatcctctccaaggtcatcgagtactgcaacaagcacgtccaggccaagcccgccgacgccgccgccgccgcgcccgacgcggcggcgccccccgccgaggacctcaagaactgggacgccgagttcgtcaaggtcgaccaggccaccctcttcgacctcatcctggccgcaaacttcctcaacatcaaggggctgctggacctgacctgccagactgttgcggacatgatcaagggcaagaccccggaggagatccgcaagaccttcaacatcaagaacgacttcacgcccgaggaggaggaggagatccgcagggagaaccagtgggcctttgagtagaggcgtttgaatagaggagcatgtaggatgaacaatgcttagtattcgtcatgtttgcgttttagcgccttttttttatgtcgccataatggtttcatcgaacagcctgaggtattgctcgtgtgaaaaaaaaaaaaaaaaggccccta

SEQ ID NO: 28341 - DNA, 467 bp, Triticum aestivum
  Clone ID: PAT_TA_28341
aaactgtgaaaccccgtcagaaggaagcaccgtcgagagaagtaatggcggactacggtggagagtacgggcacccgtacccgcgcgtcgacgagtacggcaacccagtgccgccggtcgaccagtacggcaaccccatcccaagggaaccgggccaggttccggcgtacacctcggggggcgccgctccgccctacagctctgacggcgcgggcgcggtgacgtcggccgactatggagcgggtgtcacgccgggctacggcctgagcggcgccgtgcacccgcaggagagcgtggtaggcggtgccgttttcccgtccggcacggcgcacacgcacgagggcgcgctaagcggcagcctcgcccctggcgagaccacggcatacgcttatgagggcatggtcggcagtggcatcggcaccggcgaccagatccagcccaccaaagaggggcacacgacgctgggc

SEQ ID NO: 28342 - DNA, 685 bp, Triticum aestivum
  Clone ID: PAT_TA_28342
aatcagtactgacatggtcattttacagagtgtaaaaatggtaggtggtagaatcataacctgggactgagtgccttaagaagttcctttcattatcgttaaataatataatgtttagggccagtttagatgcgtcgtcagaaaatatgagtaaaatcagtgaatattgtgcattgccttggtgtttggtgtgtctattgcataatccttttcttttttgcttctctttccaaagcaaggaccaggctgggaacatatgtttataatgaagttctttcattgcagctacatagtttcttagctaggtatctctgtgcaagtgtagtttgcctgcaggttggacatgtgtttgaatataatccttttcttgcttctcttttcaaagcaaggaccagtctgagaacatatgtttataatgaagttatttcattgtagtctgcatagtatcttagctaggtctctccagcatgctaccacaaaagcggagccatgatgttatgcctatatctgcatcgtctatcagtcctagaagttctgatcttcgtctaccgttaaaccgagttcatctgtctgggtatggctgcacaactttttatgtaattggacattaaaaagtagagaatttggttgtactgcatctgccaaagcactattgaaacaatgaatgtcagctatgttatgagcc

SEQ ID NO: 28343 - DNA, 788 bp, Triticum aestivum
  unsure (1)..(788): unsure at all n locations
  Clone ID: PAT_TA_28343
tcgttcgctcttccgccgccgcgtcttttcgctactaaccagggtttcgtttcgcctcccaatccttcgatcgatggcggccgaggaaggcgagaagaagatgatcacgctcaagagctccgacggtgaggaatttcaggtcgaggaggcggtcgccatggatcgcagaccatccgccacatgatagaggacgactgcgccgacaacggcatcccgctccccaacgtcgactccaagatcctctccaaggtcatcgagtactgcaagaagcacgtccaggccagccccaaaccggctgactccggcgccgccgtcgacgccagctcctccacctctactgcagcagccgcccccaccgaggacctcaagagctttgacgccgagttcatcaaggtcgaccagaacaccctcttcgacctcatcctggctgcaaactacctcaacatcaagggattgctcgaccttacttgccagactgttgcagacatgatcaagggcaagactccggaggagatccgcaagactttcaacattaagaatgacttcacaccagaggaggaggcggagatccgcaaggagaactagtgggcttttgagtagaaaaaagagtaacacctagctaggcactgtttcgttgaattactacttactatttgtctttcttttttagacttcgtattatgcaagaagaaacctatcatggtacttgtcaaactgaattgttatttgtcaagtggatattttgattggtaatatcatccttagctgatttatgcgtgnatttcaaa

SEQ ID NO: 28344 - DNA, 696 bp, Triticum aestivum
  Clone ID: PAT_TA_28344
gtcccgtctccccgccgtctcctcctcctcctccgcgtcgcaaaccctcgtcctaatccgccgaatcccgcgacccacgaaccaaggcagatcgatggcgaagagctcgttcaagctggagcaccctctcgagaggaggcaggcggaggctaaccgcataagggagaagtactctgacagaattcctgtgatcgttgagaaggctgggaagagtgatattcctgacattgacaagaaaaagtacctcgtgctcgcggaccttacagttggacagttcgtgtacgatgtccggaagcggatcaagctcagtgctgagaaggcgatattcatctttgtgaagaacactcttccaccgacagctgccctgatgtctgccatttacgaggagaacaaggacgaggacggcttcctctacatgacctacagcgggcgagaaccaccttgggatggttttagatggcgctggctgccaggcaatcgctctgaatgccacctgtaaataaggcgtgccaatcaactgtgcatatattccgggtttgcctccgtcgtaggatctttaaaattgcacaaatcaagtaaaaacctaattctatcctgaccttaaccctatttgaaatgtctggacttatatgtctattaacgttaagaactttgaaatttccgttcaaaaaaacatactagaaataaacctcgagg

SEQ ID NO: 28345 - DNA, 920 bp, Triticum aestivum
  Clone ID: PAT_TA_28345
tgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccctgcaccaccagctgagcccatcgctgctgcctgaacgaaggtgacctcgttcagccgctaatcctttgcagtagggttatatttgggtgtcggtagagttgttccaggagagatggggaaggagcgtgaaggccacatacgatgcgaggtggtgagatcgtctttgagttcaccacggggaatcatggcggagatacacgcagtgtactattattaatttgagtttgttattatgagcaggagggttgttacttatgggaccagcaaactttattcgttaatattgtcattgcattttgtagagagaaagaggggactggtaagaataaggtaaggctgctgctgtatgtgtttgtatatttatcatcaagtgtggattttggtcagacctg

SEQ ID NO: 28346 - DNA, 754 bp, Triticum aestivum
  Clone ID: PAT_TA_28346
ttcggcacgagggacatgtccggcatgacggcgcacctccccgccaagaaggggctgtcggcgtactaccagggcaagtcgcagtcgttcgcgtgcatggcggaggtgcggtgcctggaggacctgcagaagaaggagaagccgcgcgggcgcgggcacaagatgaagccctgcaagagctacgccgcgctgggaggcatggccatggccaggaagccgccgggctcctcctgcgccaacctcggcctcatggacgccggcagcggcttcatgaacatccccgtcaacgaggactgctaccgccagtaggttcagggtttatttctcggttcatcaggcctcttaaaatgctcttcttctccatgtccttgtccttgttgcttgtttgcaggcgcattagtctgcgaatgattcatgagagcaacttctgtgtgagacagttgatatcttgtgatgtaaatatggagtttgtaactgtgtactgcgaataggggagcagatcaggctgtgtttcacttctgcggtgtgtattttaccatttgtggtcagagcaaaggatacgggaggagcctggccggagagagggctttcgtctccgttttccttcatgttggatgatccaaaattacagtgtagcgctgctttgggcttggaattccacgtagattctgcaatgtttcgatgtctcgcgccgacactcatgtttaacttccacgttgggcgacaattgttatcaaattccgttacaaaacaa

SEQ ID NO: 28347 - DNA, 771 bp, Triticum aestivum
  Clone ID: PAT_TA_28347
aagaagagatcacactcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgatggggctgccgccggagccggagccggagcctcggacgccgcccccgccgcccccgccgaggacctcaagaactgggacgccgagttcgtcaaggtcgaccaggccaccctcttcgacctcatcctggctgccaactacctgaacatcaaggggctgctggacctgacctgccagactgttgccgacatgatcaagggcaagaccccagaggagatccgcaagaccttcaacatcaagaacgactttacgcccgaggaggaggaggagatccgcagggagaaccagtgggcctttgagtagaggagcatctaggcaggcgatgccgccgccgccgccgcgttgaatgaacgaacaacgcttagtattcgtcatgtctgcatttcagcgctcttctttatgtctgtcgtaatgggttgtaattatcctggagtctatgaggtggtgtcggtgaacatgttcggtcagtggttatgtttgcgacaacaagaaaaacctatcgtggtcagtggtcatcacttgtcaaactgaatcttaatcgtcaagtggagtgcttgcttgtttattcaccaaa

SEQ ID NO: 28348 - DNA, 630 bp, Triticum aestivum
  unsure (1)..(630): unsure at all n locations
  Clone ID: PAT_TA_28348
cctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgacggggggngnntccncggccncgacgtcgcgagaagtccattgaaccttatcatttagaggaaggagaagtcgtaacaaggtttccgtaggtgaacctgcggaaggatcattgtcgtgaccctgaccaaaacagactgggcaacgcatattccaacggtcggcgacgggacccgcccgtggtcggccaatgccttgaccacctcccctcctgggagcgggtggggggcttggggtaaacaacccacggggcccaaagggcgaaaggg

SEQ ID NO: 28349 - DNA, 867 bp, Triticum aestivum
  Clone ID: PAT_TA_28349
ttcctccacaacagatacgcgggacaactccagatagcacgtacttcatgttttgttgttttatactccctctttccgaaaatataagaatgtttttaacactacactagtgtaaaaaacgttcttatattatggaacggagggagtagattggaacaacagaaactgctccggcttgctttgagattgtataagttgtatgtacagttagttgccagtgctgcgtgtgtaaaaaaaatccttgcatctattgcaagcaaattgtgctggccaaacaaaaccggaaaagaaattgtctcaagggagatcaactcctgatgaaatatgagttgtgcagcaaccatgattttgagtcgcttttggtggtaccaaagagtgcttgatgaaactatgcaagcgtgcaaaaaaagaaaatggcaagcagcaaaacatgagatgtcttaaacattggcagatctgtctttcctaaattgcatttgatggacatatgtctgaacaaaggaagcgtggtgcgagtattatagagctgtagaacacagctcttaaccagcatttccatagtaaaaaaacaactttttttctgcacaagtagagaagtaaagatagtatagcattgtggtatgtataccaccgttataggataatgaaagcaagatttcatggagctgaatattcacaagcacaagattaaactgcacaatttgtcaaggagatccttttgtgaggagttagtttagtgagttgtgttggtgggtgttggcggtcttgcacatgtttgcatgtttgcaacgcctcttgtaaatgttgacttctttcttccatgtaaacggctaagcttgaaaataaaagtacatgcagtatcccacg

SEQ ID NO: 28350 - DNA, 670 bp, Triticum aestivum
  Clone ID: PAT_TA_28350
acgagggccggctgcgacgccatccgcaaggcctttgccatggggaacggcaaggggaaggccaaggagctgtcgccgcaggatgccgtgctgctcatccagatgaactacagggcgcacctcgcccaccgctcccaggtgctcagctccctgcgcgatctcgccgtcgccaaggccaagctcaaggagctccagtccctcttctacaacctctcctacaggcgccgcctctcacacgaccacgaggagcgccagaggttctccgagaagatcattgtcctgctcctcactgtcgacgcactcgagtccatgtgcgagaagaacggccagacccctccgccgatgccagtcattgctccagcgggcacgcgtaactcccgacaagcatcgaccggtccttctccgtctgccactggtgcaaccggttctacacctacacctacaccttcgtgatgacgatttgcttaagatcacggaagcttgggttgatggagtgcttgtatttagtttttgttttgaccttgtgaaacttgctacctatggatgaaactatgtaatattgatgaaactatgtatatgtatgaatgaaacttgctactatttgtaacatgtattggatatatgtgttcatgactattggtaatatgtgttgaatatgctaaaaaaaaaa

SEQ ID NO: 28351 - DNA, 510 bp, Triticum aestivum
  Clone ID: PAT_TA_28351
cggtccacacgactctcggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgcctgcctgggcgtcacgcacaaggagactctactcgatgctgttaaggagaccaacgagtggctcgacgggcacggcgctgacgccaccgctgaggactttgaggagcagaaggagaagctgtccaacgtcgcttaccccattacctccaagatgtaccagggtgccggtggcgctggtggcgagcaggatgacaacatccacgacgagttgtaagcgcatagactgatgtttgggaaaagaacataaatgaaaccattatggtgtttggttggagcttctaagcgcaacatgcaaaacgcaaagtagatagcgcaatgttatgatgattttcaaaaaaaaaaaaaaaaaaggccccta

SEQ ID NO: 28352 - DNA, 494 bp, Triticum aestivum
  Clone ID: PAT_TA_28352
gctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggagctggctgggtcagcgtcgacggcggcggccgtgtgctcctacgtggcacggcgtgatgctgagtcagccagtggagtggtgctactttttactaggtgtggagtgggagtgctatgcgcggggtcgcgtgacgtgggctaaataaaagtgttgtcggggccagtcgacgcccagtgtcgggtcagcagcgagcgagcgagcgacgcagcgccactcgccggcacccgtgtgcctgcgtctgctcagctggagctttgttgcggtgtgtgtcacagtgtcagttccacctatgatcgatcggtatccaaaaaaaaaa

SEQ ID NO: 28353 - DNA, 724 bp, Triticum aestivum
  unsure (1)..(724): unsure at all n locations
  Clone ID: PAT_TA_28353
tatgcttgtctcaaagattaagcctgcatgtgcaagtatgaaccaatttgaactgtgaaactgcgaatggctcattaaatcagttatagtttgtttgatggtacgtgctactcggaataaccgtagtaattctagagctaatacgtgcaacaaacccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaaccagcttgttcatgattggccgtgggatctacaacatgtctaatgggatcgggaaaaaggagtgaatttctgtgggttttgctagtatctcagtaagcggcatggaagcaatactgcccaagctatgatgtcatcttcgtttgcaaataatattgtcagagaaagactcgggtccatttcatgttntncttttgttggtatttgtggatg

SEQ ID NO: 28354 - DNA, 724 bp, Triticum aestivum
  unsure (1)..(724): unsure at all n locations
  Clone ID: PAT_TA_28354
gcaaagctcccagctttttccccttccgtccgtcgccgccgctgctctagggtttcctcttcccgatcccccgatccagcagcagcagcagcgagcgagcgatggcggccgcgggagacgccggcgagaagaagatgatcacgctcaagagctcggacggcgaaggagttcgaggtggaggaggcggtggccatggagtcgcagacgatccgccacatgatcgaggacgactgcgccgacaacgggcatcccgctccccaacgtcaactccaagatcctcaagaactgggacgccgagttcgtcaaggtcgaccaggccaccctcttcgacctcatcctggctgccaactacctgaacatcaaggggctgctggacctaacctgtcagactgttgccgacatgatcaagggcaagaccccggaggagatccgcaagaccttcaacatcaagaacgactttacgcccgaggaggaggaggagatccgcagggagaaccagtgggcctttgagtagaggaacatctaggcgatgccaccgccgagctgaaagatcaacgcttagtattcgtcatgtctgtatttcagcgctcttctttatgtctgtcgtaatgggttgtaattatcctggagtctatgaggtggtgttggtgaacatcttcggtcagtggttatgtttgcgagaacaagaaaaacctatcgggtctgggtcatcgncttgtcaaac

SEQ ID NO: 28355 - DNA, 962 bp, Triticum aestivum
  unsure (1)..(962): unsure at all n locations
  Clone ID: PAT_TA_28355
cttccgccgccgcgtcttttggctactaataactagggtttcgtttcgcctcacaatactccgatctgtcgatggcggccgaggaaggcgagaagaagatgatcacgctcaagagctcggacggtgaggagtttcaggtcgaggaggcggtcgccatggagtcgcagaccatccgccacatgatcgaggacgactgcgccgacaacggcatcccgctccccaacgtcgactccaagatcctctccaagatcatcgagtactgcaagaagcacgtccaggccaacgccagctcctccacctctactgcagccgccgcccccaccgaggacctcaagagctttgacgccgacttcgttaaggtcgaccaggccaccctcttcgacctcatcctggctgccaactacctgaacataaggggcttttggacctaacctgtcagactgttgccgacatgatcaagggcaagaccccggaggagatccgcaagaccttcaacatcaagaacgactttacgcccgaggaggaggaggagatccgcagggagaaccagtgggcctttgagtagaggagcatctaggcgatacactgcggctcgtcactctcagaccttgctccgtccgtggtacttgtccaagtgctcctctggccagccatcttctccggcctccagtctcaatggcggatcagagcctcgcagcccctatccgccgcgctgaaagaactacgcgtagtattcgtcatgtctgtatttcagcgctcttctttatgtctgtcgtaatgggttgtaattatcctcgagtctatgaggtggtgtcggtgaacatcttcggtcagtggttatgtttgcgagaacaagaaaaacctatcgtggtctgtggtcatcgcttgtcaaactgaatcttaatcgtcaagtggatgctntgcttggttaaaaaaaaatatatnnccannnctctnngggc

SEQ ID NO: 28356 - DNA, 707 bp, Triticum aestivum
  Clone ID: PAT_TA_28356
ggattcccctagtaacggcgagcgaaccgggagcagcccagcttgagaatcgggcggctgtgccgtccgaattgtagtctggagaggcgtcctcagcgacggaccgggcccaagtcccctggaaaggggcgcctgggagggtgagagccccgtccggcccggaccctgtcgccccacgaggcgccgtcaacgagtcgggttgtttgggaatgcagcccaaatcgggcggtagactccgtccaaggctaaatacaggcgagaagctcaagtgggcgctgggggtggtgaacctcgaggcccagcggtggaagcccatcttcagagccgtcagcacggtgctggagagcggcgccgacgacggcaccaaggaggacgcgttcgcccaggccaaggaggagctcaaccgcgagctcggccaggaaggtcccaacgccctcaagatcgacttcgggtatatgtgacgtgcatcgccatttccccacctctgccttagtttctctatcggccttagcgcgcccaagatatctgtggtgttgttagtcatgtatagtgctcccgtccgtgcgctgcggcctgtcgcagctgtcggagcaccgccattatttcccttctgcttcgttctcgacgccttcggctgcggaacgtttgtggttgtccttgcatttccttagtcagcgaggtggttattttctcccaaaaaaaaaaaa

SEQ ID NO: 28357 - DNA, 452 bp, Triticum aestivum
  Clone ID: PAT_TA_28357
gaacatccagggcatcaccaagccggcgatccggaggctggccaggaggggcggcgtgaagcgcatctccggcctcatctacgaggagacacgcggcgtgctcaagatcttcctcgagaacgtcatccgcgacgccgtcacctacacagagcacgcccgccgcaagaccgtcaccgccatggacgtcgtctacgcgctcaagcgacagggacgcaccctctacggcttcggcggctgacctgcgcctgctgctgctccatcgagtcgactctgctggatgctgctcctgttctcgtgctacggtttcgtttctgagtgcgtgagttggtgttctgtcggtctgtgtagtctgtgcctttgtggaaggcgatgggtctgaatgtaatggaattgttggttcttgcaagaaatgaatctgaatgcaacggaaaaattgtactgcaaaaaaaaaa

SEQ ID NO: 28358 - DNA, 712 bp, Triticum aestivum
  Clone ID: PAT_TA_28358
tcgcggccgcgtcgacctccacccgaattcctgttccgcccgccagccgtacacagcacaccactgctctctctctcgcgcgcgcggcggccatggcggacgcgccggtggagctgccgggccggctcgccatactgccgttccgcaacaaggtgctcctcccgggcgccatcgtgcggatccgatgcaccaaccccagcagtgtaaagctggtggagcaggagctctggcagagggaggtggagaggcgtcctcagcgacggaccgggcccaagtcccctggaaaggggcgcctgggagggtgagagccccgtccggcccggaccctgtcgccccacgaggcgccgtcaacgagtcgggttgtttgggaatgcagcccaaatcgggcggtagactccgtccaaggctaaatacatgcgagagaccgatagcgaacaagtgttgccaaatgcatcgagatcggtcttccagagatcatactgctggtggctctttcccagtacatacctcatctggtgcctttgctggggactgcattcgagcggttcgccgtcataatgtcggtggccatcgtgtggctgtacgcgttcttcctcaccgttggcggggcgtacaagaatgctgctccgaaaacccaattccactgccgcactgatcgatctggccttgttgggggtgctccctggataactgtaccatacccattccagtg

SEQ ID NO: 28359 - DNA, 737 bp, Triticum aestivum
  Clone ID: PAT_TA_28359
accaagtacgacgcctacgtcgccaccctcaccgagtcgctccgcgtcatctccggcaccctcgaggtccactccgtcaagcccgccgaggaggaggtcaagggggtccccaccggcgagttgaaggccatcgaccaggtcgacgccgccttcaggaccgccgccaccgccgccgacgctgccccggtcaacgacaagttcaccgtcttcgagtcctccttcaacaaggccatcaaggagaccacgggcggcacatacgagagctacaagttcatccccgccctcgaggccgctgtcaagcaggcctacgccgccaccgtcgccgcggcgccggaggtaaaattcaccgtctttcagaccgctctgagcaaggccatcaatgccatgacccaagccgagaaggatgccaagcccgctgccgcagccacggccaccgccacccctggagccagcgccggcgccactgctggtggctacaaagcctgaactcgccaacactacacatcgaatcaatgagctttattgatcaaaggttttgattacaatcttgccttagaaaattggcaaggaaaggggggatgtaattcagccacaggcatctagccttgactcgctcggcgagcgattttcctgatgcttccttctttgtattcgtttcatgcagccgcgaatcgaccgcgtgtgcatgcgcctgtataacaataaatatatccttataaatgtcatcatattccatt

SEQ ID NO: 28360 - DNA, 513 bp, Triticum aestivum
  Clone ID: PAT_TA_28360
gctattttcttcgtcgacgctggtttttggcccctgactgctggtcgagatgtcgaagatggcggacgagaaggtgatttcggcgccggcgaccggcggaggggaggacgggctgatcgcaggggacctgtcagccgcggaggcgcgggtccgtccgttggagacgctgctgcgcgccgcgggtgtggggctctgcgtcgccgccatggccgttatgctccgtgacgcggggaccaacgagtacggcaccgtctcctactccgacctcggcggattcaagtacgttgctccctcgcatcttgactcctccgtccctggagttcattagccccgtaatttcccctctttgccgtgctccctcaccaattcatctccctgtggttttttggcacaaaatcgaaggtacctggtttatgccaacgggctgtgcgcggcctactccctggtatccgcgttctacactgccgtgccgcggccggcgacgctgtcccgctcctggattgtcttcctcct

SEQ ID NO: 28361 - DNA, 799 bp, Triticum aestivum
  Clone ID: PAT_TA_28361
ggtaagataaagattaagtactgttagacatgagacctactcgcgcacaagtcaatctcaacatgcatcttgttgttccgtgcaaggcacgggcatcttactagtgttatcctaaaattagctaactgtggctcatattgttttccccaggtagctcatggcgagtcatgcgtgagccgtctcgatccttttgctatgttattatattttagccatgaaggatttactgcttgtcagttcgtagtggttccggctgtttgttgaacttctgttcttgcttgtgctattttttttactgtttacatggctcaatttacttccaattttactcttgagttctcccatacatgcatactcttatacccctcctacttgcttgttggttttacgctctgcctttgtgaggtgtaattattaaattttgttcatagtcgagcattggatgatattgtatttgtcatgatgtacatggttcatgaaatatgccaacctgcagctttgttgccctagtgatagtaggataatgcaagttttgccaatccatgcatatttccgcatcataataatctttttttagtctttttttagtcttttttttttaacttttttttttcccattttacggatttgcttaagatcccggaagcttgggttgatggagtgattgtatttagtttttgttttgacgttgtgaaacttgctacttatggatgaaactgtgtaatattgataaaactatgtatatgtacggatgaaacttgttactattggtaacatgtgttggttaaaaaaaaacccc

SEQ ID NO: 28362 - DNA, 645 bp, Triticum aestivum
  unsure (1)..(645): unsure at all n locations
  Clone ID: PAT_TA_28362
caaccctagagcctcgcctccctcctctcctctcccgggcgcctccaccccccgcccagcggcgcgaagcgaccatgacgttcaagcggaggaacggcgggcgcaacaagcatggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtccatgatggatatgtccttcccaagctgtacgccaaggtgcaccactgtgtttcttgtgccatccatgctcacattgtccgtgtccgctcccgtgagaacaggaggaaccgtgagccctcgcagcgtttcaggcgcanggacgacggcccgaggcctggacagggtggcccgccccgtgctggtggccctggaggccctgggtggtgctcttgccgcgctggtgctgtccctggagctcctgctcccgtgtggggcttgatctagtcttgcatgatgggcggnggcgcatccctagttaacccgtgcttgaaatggactattttactagttttgctgcatacggtgactggaagtgggtggtcaaaagcacattgtgaccggctttatggttggcaat

SEQ ID NO: 28363 - DNA, 709 bp, Triticum aestivum
  Clone ID: PAT_TA_28363
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgtccggcccggcccgtcccggcgtgatcgtgatccgccgcgcgcctgccggcctgcgtgcgtgcctggagtccatttccttaccagccgcttatcctaatcaattgtattatttttccctgccagcgctggtttagcgtgaagcatccgatggtttcgaattttcaataacttttttggcttttcaactttgagaggagtggctgtacttactgtactatatatggtgttccgatatgcgatg

SEQ ID NO: 28364 - DNA, 1026 bp, Triticum aestivum
  Clone ID: PAT_TA_28364
tcaatgttcctcatgacatatgctataacctggtctgctacgcagtccacatggcttccacccaaagttgaatgtccgttcgtgaagctaacttggttgaactcgccatcactaagggtcagacaaatctcccattcaccaactctcatacacccttggatgtttctcttctgcttccgcaccagcgccaatgtagtgctcgacatacttgagaaatgtcatctctggtatcaattcatcattgaagtacacatcgatgctttttccaatggtgcaggtcatctcaatgactctttttcgcatcatacagataatatcaccttccagcttcgtcatcctgaacattgcaagatcaggtataaaagacacgcttgtccactcctccagatgtgttgattcctcaggaactatgcggtttttagttacttgcggttgtaccttcaacatgcgttttctgtatgtctgcttgagcaattgttttccatttgtggtgctgaccgtaaacctatttgagagaacattggcaaacactccgttgaactccattgtcggactatattcggtaaattgcaacactgcctcgggccccatagggatatttgttccagtacaagtaaacttgattctgcccttgttctggtccacatctactgtcagtcgagtcattcctcggttcttgttatctgccacaagaagcagtatctggtcgaagatcttgtataatgccatggagtaagacaaatctcctcgaacaatcaaactcttctcatcaaaaatccaaacattatggatcttctgaacttgtagcgcaccaagaacaacactctgaaatgaatgacgcttgtacagcgagcttacttgagatctggggtcgtccgaggatccgggggatgacatgccgtcgcccgccactgaaagacggtgggctaattttgctgcagtgaacaaattcagccacaaaagagcaccaaatcttgctgaggtcaaggttgcaggggaggcggtcgagctgatctgtgcactgcc

SEQ ID NO: 28365 - DNA, 199 bp, Triticum aestivum
  Clone ID: PAT_TA_28365
ggggtatatagccttggccgacaggcccgggtaatcttgggaaatttcatcgtgatggggatagatgtatcagatttcagtggtgttgttgcgtaaataagtgcaccataatgtaatatttgactttggagcttcttttttttggctggttggagaataagcaagttccataaattatatatattcaattcctttttgc

SEQ ID NO: 28366 - DNA, 422 bp, Triticum aestivum
  Clone ID: PAT_TA_28366
atagcactggccggtggtgtcgctgtcattcaggtgggaggacgaacataaactgaacttaaagagaggttgggagttgaggatgctctaatgtaactagatcattcggtggtggtgacccatatgatggcgatttgctctggccattccagttttgacgacggtggtggtggtgctcctatgatggtagactcgtctgatttccctagccgcatccatggtgatgaagctcagcctaggctagaaccccctccgatttgcttaagatcacggaagcttgggttgatggagtgcttgtatttagtttttgttttgaccttgtgaaacttgctacctatggatgaaactgtgtaatattgatgaaactatgtatatgtacggatgatacttgactactattggttacatgtgttgaatatata

SEQ ID NO: 28367 - DNA, 578 bp, Triticum aestivum
  Clone ID: PAT_TA_28367
tttgccgtcatcattattcgataaggaatcaggctccaaatttgtggaacaacagtttcagatattaaatccttcagcagagcaacggatgttactccaagtacagcatgcaagccagaaaattctgtaaccctactatgctggccagctagttgagttgtcgactcaggctcatcctgagggtccttgtaagacgagttcaacacaaatgcctgctcgaactcatcaacttgaaaatttgaaattttcatcgatttcatggatttggtgtcaaattcattcccgaaaatgtcatcatcaaacttcctcttcattctcagtgctggcatcttgatcagcagttcagagtgccaaagctgtctaagttctgttttagacagaaggcttgaaatgaatctgactttgaattgataaaagccatagccggtcaaggagtacaacgcggatcgagacgggacgatgctgccgcgggtagctccggcgcgtcctctctctctccctctctctcggcctctcccggaggcggacggagggaggagagaggagggggaggaaagccggtgcgcgcctcgtgccga

SEQ ID NO: 28368 - DNA, 587 bp, Triticum aestivum
  Clone ID: PAT_TA_28368
cggcacgaggcacgtccctctgcgccgacgcgacggtcaaggtgtcgacccgcgccgaggacctggagtcggaggtggagcggatccaggcggcgatggggtcggagatcgacgtgagcctggactgcgccgggttcagcaagaccatgtcgacggcgctggaggcgacgcgccccggcgggaaggtgtgcctcgtcgggatggggcacaacgagatgacgctgccgatgacgtcggcggcggcgcgggaggtggacgtggtgggcgtgttcaggtacaaggacacctggccgctctgcatcgacttcctgcgcaccgggaaagtggacgtcaagccgctcatcacccaccgcttcggcttctcgcagcgcgacgtcgaggaggccttcgaggtcagcgcccgcggccgcgacgccatcaaggtcatgttcaacctcctaggcggctggctagagctagaccaccgccgccgcctcgatctctcggtccagccggccggctagccgccggcgcgtgagttgtgaccctgcccggctgccccccccccccccacccaggccccagccctggaataaaatgacgagaaa

SEQ ID NO: 28369 - DNA, 511 bp, Triticum aestivum
  Clone ID: PAT_TA_28369
ccgcactgccgcgcaccgccaaatcctcctcgaattccgccgatccggtcggcccctcgtcggaaccgcccgccccgcgcacctccgatccccgccgccggtggtcgcccgcgaggccaggcgagtcggcggcccgtcacccgccccccgcgccgtcgccggctctaccaaggagaagatccttatgagttggttggctgtgaattcatataaattctggtactgtgaaaatgggtcaaaaggtggcaggaagttcgtgacgagattaaccatagacgattgaggcctgagtggatttaggaagatcagatacagtgaaaagggagcgcagtcgtgatggacagagctggcggtaaccaagcaggccaggtgtcgaagaaaggaaagatgatgcacgcgaaagacgagttcagaccggcagaagcagctgagagaagaggcgccgctgagaagcgctgaacttgcggacattcgactgagagagcgagcatcagagacgagagctgcacag

SEQ ID NO: 28370 - DNA, 527 bp, Triticum aestivum
  Clone ID: PAT_TA_28370
agcgcagcagcccgggtatggctctcagcaagcgcagcagcccgggtatggctctcagcaagcgcagcagccagggtatggttctcaccaaacgcagcagttcggatatggctctcagcaagcgcagcagccagggtatggctctcaccaagagcagcagcccaggtatggctctcagcaaggtcaacagccaggatatggctctcagcaagtgcaacaaccaggatatgtctctcaccaaacgcagcagcccaggtatggctctcagcaagcgcagcagccaggatatggctctcagcaagcgcagcagccaggttatggctctcagcaagcgcagcagccagggtatggctcgcaccaagcgcaacagactggatatggcttgcatcaagcgcaacagcctgggtatagctaccaagcccaacagccaaagtatggcgctcaccaagcggaacagccaggatatggtgcttatcaagcgcaacagcctgggtatggcgctcatcaagcacgacagcctgggtatg

SEQ ID NO: 28371 - DNA, 776 bp, Triticum aestivum
  Clone ID: PAT_TA_28371
ggcgtccatccacccatccacccatcactcgcggcggcggcggcggcggcggcggcggttgttcaccatgtcggcagggagcgagcgctcgaacgcggcctacgcgaccccggcggcggtgctggcgggcttctcgcgcggatccggcccgtccgtctccggcgccggcagcggcagcgggaggagccaggcggagggcggggcgaggaagaagcccccgttccgccttgcggcggacgacaccaagcccatcctccgcgacccgatctcgcggtccgaccccatggagaccgagcaggccgtgctgcggctgccgcccttcccctgaagcccagccgcgtcgtcatggatggtacacccctccctctgcccctctgttaacactatcttgtaattttcctctgtgctgcacctgcacacaggctctgtattttgggaatccagtggtagccaactattgggctactgaccccatgagcgatcagggttgcgagggatgtgtcaaatgattaggcagccttcagatttttggtcaacagctgagaaataagtagagcatgtggtgcctctaccttctgattttgtacacactgcaggccgctgaaatgttcgcccaaatggcttggcttttggtgcaatttgattgcaatagaaaatagaacgaacaatagcatcattgtggttggaagttgtgtgtagtctaggcaggtcttgctgatcagtgttggcttaccgtgaccatcttacaattttttattaagattgaaattattgac

SEQ ID NO: 28372 - DNA, 1072 bp, Triticum aestivum
  Clone ID: PAT_TA_28372
atgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccgattcggtctcgaaggcgttcgtgcagcactactaccacacgttcgactccaaccgcgccgcgctggtggggctgtaccaggacggctccatgctcaccttcgagggcgagaagttcggcggccccgccgccatcgccggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgctgccagctggagggagcttctacgtgcagaacgacatgttccgcctgaactatggttaaggaagggcgaccgctctggcggcaaagaacttgttcagggatttatgttgaaacaatgaacatcaaatgatgatgctgcagactctttgtttgttcgccagcttgtgcaatttatcgcaaaaaattgccagacttgataggcatccaccagatcttcttttgttttgtgtttcccatgtattgtcgttgcttgggggcactttct

SEQ ID NO: 28373 - DNA, 589 bp, Triticum aestivum
  Clone ID: PAT_TA_28373
ctactgctcagtgcacaccacccaactcacccacactttccccgcggcgatgggtcgcacgaagcacgcggtggcggcgacggcgacgacgacgacgacggagacgaagaagcggctccgcttcgagctctccccgcgatggaggccgccgccgccgatgcgccaggtaccgccggagccgcagccggagaagaagaagaagcgggcgtaccggttccggccgggcacggtggcgctgcgggaggtcaggaagtaccagaagtccaccgggccgctcatccccttcgcgcccttcgtccgcctggttaaggagatcaccaacgacctcacgaagggcgagctgaaccactggactcctcaggcgctattcgcgctgcaagaggctgcagagtatcacatagtcgatgtatttgaaaaggcaaatctatgtgccatccatgctaagcgtgttaccatcatgcaaaaggacatacagctcgcgaggcgtatcggggggagatggctttggtgatactaatggaagacgttttctgcatcatagggatcaaagactggtgatttggtggtacctgcccgggcggccgctcga

SEQ ID NO: 28374 - DNA, 1005 bp, Triticum aestivum
  Clone ID: PAT_TA_28374
tcagctctgtatggaactctatcagtttcatcaggggaaacccactcgaatccactagtcttcatccgtgttaaaattagaaccggcttcgaacagatattcacttggctagcaacatgacaagcagtcaaagcttggtccccggtgatcataaccaagtcatgggaagattgttccagttcgagcaagacagcggcagaatcactccttataggacagttgaagaccgcaaaaccagcaaaaattaagtcactctccacttgatccctttccagacttctagcttcactaacaggcatctccggaagcagtttgtatgcaagagacaagacccgggagccctgacgcgtgtattttttgtatgtttccacatatgcagcaggtagatcaactaacctctcctgaatggtctccggtgcaccctttatgaaagcataaaatttctcctggatacggacaataacagacattctcttcaaatgagaagcaaagtgatatctgtgtacaatctgtacaggttggccaccaggcctgcaacgaagactcctagacatggctttctcatcagaggtgtagatccagtctatgccttttattgcagctttttcaagggggtcaccaaccagtttgttgtccacaaataccaatgcatggcagctggatagcacttcttgaatgcggagaggcaacttatttgcgtcagatattaattctgcgtcgctttccaaagtaacaactccttggaactccatatcatccgatgtcaatgttccagtcttatcgaagcagcatatgtcaaccttcccagcaaatggtattctgaatggttccgtgcagaaaatgccacgccgtactaaagcaattaaagatgtattaactgctatggacagctccattggcagttcaggagcagcaacgaacagattgacagcaggacctttgatatggtcaaagccgggctccactgttccttgagaatgtcaaggcaaatgctgccgttgctgt

SEQ ID NO: 28375 - DNA, 606 bp, Triticum aestivum
  Clone ID: PAT_TA_28375
cagaataccgtaaacgcagcagcaccaccaacccagcatgtcaaagatcccctaaatacaacatcacatccaccatacatagaatagaactgacgaacagcagttttcttatgcatcccctctactagtagggatcaactcaattaaaccgtgccagcgagactgacaagcctatacaactcttcttgtcaagggactcgtccacgggatttgaatcatgagagagcaggggcagggtgacgcgcctggctgtcatccacccaatgaagggtggcaggcacagctggaatcatgatgtcaaggtagagtgtgacggcggcccagacatactcgtcataggtgtaacgcttgatgatgttgcccgtgtcatagacaatgtagccactaaagatgagtgccgccagcgcgccattgatcatgtgagagagcttgcccagcgggaagaagatctgaatgaacccaaagacgagcaaaatcaccagagaagcaaataggaaaggaccaaggaagctaaagtccttgcccctccttgcagcccagaaggtgtaagcagtgaggctcaagacaaccacgattgtaagaatcccagcctcccaaatgaccttg

SEQ ID NO: 28376 - DNA, 571 bp, Triticum aestivum
  Clone ID: PAT_TA_28376
gccggccgggttcggtctatcaccattaccaacgacaagggccgtctcactcctgaggagattgagcgcatggtcgccgaggctgagaagtacgccgaggaggataaggctacccgtgagcgcattgaggcccgaaacggccttgagaactacgctttctccctcaagaaccaggtcaacgatgaggagggtcttggtggcaagatcgacgaggaggacaaggagactctactcgatgctgttaaggagaccaacgagtggctcgacgagcacggcgctgacgccaccgctgaggactttgaggagcagaaggagaagctgtccaacgtcgcttaccccattacctccaagatgtaccagggtgccggtggcgctggtggcgagcaggatgacaacatccacgacgagttgtaagcgcatagactgatgtttgggaaaagaacataaatgaaaccattatggtgtttggttggagcttctaagcgcaacatgcaaaacgcaaagtagatagcgcaatgttatgatgattttcaaaaaaaaaaaagaaaaaaaaaaaaaaaaaaggccccta

SEQ ID NO: 28377 - DNA, 541 bp, Triticum aestivum
  unsure (1)..(541): unsure at all n locations
  Clone ID: PAT_TA_28377
ccaccacctctgccatggccccgaagaaggataaggccccgccgccgtcgtccaagccggccaagtccggaggcgggaagcagaagaagaagaagtggagcaagggtaagcagaaggagaaggtcaacaacgctgtgctcttccgaccaggccacctacgataagctgctctccgaggtgcccaagtacaagcagatcaccccatccgtcctctccgagcgtctcaggattaatggatcattggcacggagggcaatcaaggatctgatggcaaggggattcataaggatgatctctgttcattccagccagcagatatacaccaaggcaaccaacacatgangggtgttttgcatcttgtcggcggtctctaaacggcttaatgttctattatatcattttattcaatcatggtcaatcagccttacgttgtgtcggtgttggatattttaaattacgtacgtttaactcagttgcaatcaaatatcacctgaggaatacaatcttcccgctcaatatacacaatgttaaaaaaaaaaaa

SEQ ID NO: 28378 - DNA, 819 bp, Triticum aestivum
  Clone ID: PAT_TA_28378
cgcccggttgaagttgctcttatttatttctacatctacttgttgtactacatggggtcgcgatggctcatgtggacgtacaccacctggtacaagagtagaagtgatgtcatctaatccaacgcatcatgactcctcgatgggcatcttgattcccttgatctcgcgcgcgagggtccgcagctcctcgacctcgtcggcggtgaggctccacccaagtgcaccggcgaactccattgcctgcccggcgttcttggcccccgggatgggcaccacgttgccctggcaggtcagccagttgagagacacctgagttggtttcttgccatagcttactccaatctctttgatcctgttcatcagcggttggagcttggcgaggaactcgggagtgtaggtattcccccgaggacccgtgggtggattctccggagtgtatttcccttgtcgatgctggcgtcgaatgctgctttagcctccttcagtctcctgtcgtcccactcggagtcgttccagtaggtggtgtcgccccacgaccacgcgccgatgccgagcttgctcaccgccacgctggactcgcccagcctcaccttgtcctcctccgccaccttcgcccccgcacccgccctcggcggtcgcagcgccgccgtcgctctcctctcctgccgccggccgtccagcgggccgaagcagcaacccacgccgcggccggcgccgacctgcagcgaagccattcctagctagttgcaagctccaccagctagtactgtactttgctcgctcgctcgcttgctcggccgctgaggcaccagccaccac

SEQ ID NO: 28379 - DNA, 452 bp, Triticum aestivum
  unsure (1)..(452): unsure at all n locations
  Clone ID: PAT_TA_28379
atcaagcccccgccccgccgtcgcctgaggtagacaccaatccgccgccatggggcgtatgcacagccgcgggaagggtatctcatcgtcggcgcttccctacaagaggacgcctcctacctggctcaagaccgctgcctccgacgtggaggagatgatcacaaaggcagcgaagaagggacagatgccgtcgcagatcggcgtcctgctccgtgaccagcacggtatcccccttgtcaagagcgtcaccggcagcaagatcctccgcattctcaaggcccatgggctggcaccagaaatcccggaggactgtacttctcatcaagaaggcggtggcgataaggaacactttagaggaacaagaaggacaaagatcnaaatcaagntcatctngtcaaaacaggttcaacgccttgcccgtatanaacgcacaagaacttcancacttgaat

SEQ ID NO: 28380 - DNA, 561 bp, Triticum aestivum
  unsure (1)..(561): unsure at all n locations
  Clone ID: PAT_TA_28380
tttttttttgtatcaatcaatttacttagaatccttaacaaagaacaaatcaatattgtttacattttccagaagtccaaaaatgtataaccaacatcttcgggcatgtacgcgcctacggcttttcagttttgctgcacaatacagggaaatgaaaccagaaagaggtctagcttgtgaacggaggctacatggaattacaaagctgccagtgcacaagacatgtggggtacaacttgtgcatacagactggaaagaataggatctgactatataacgtagcaaaatgatacaatttggattcttctcttattcaagctgttcatcatgaaaaaaatgaattttatgaacaaaatggtcaatgggtgggcatctctgctgtaaaactgatccaagncttcgcaggaatacgtgggagaattcacgggggaatatgcgtacaatgtccatgcaaatcaagtgactgaaaaatgttccgagtacatatgctccttgcgctacaattcctccaaaaggggggcccngtaccaatcgcctatatgatcntataccgcccacggc

SEQ ID NO: 28381 - DNA, 724 bp, Triticum aestivum
  unsure (1)..(724): unsure at all n locations
  Clone ID: PAT_TA_28381
cctcgtgccgaattcggcacgagggacctttcccctccctcccacgccgctcccgtggtcttccccacgaccccacccaccccggcgacctccccccagccccaccgcctccgccgcaccgcgcggcaccgtcctcctcccccgcctcgccgcggcgtccctccgccgccggccggccggcgaagtcccgggctccgattcgcagaaaggggtgctgaagtttgttcggcgccgtgggatgagcgaggatggcgcctagggacagcaaggagatgctgcagcgggccgccgagtccgccatccgctccatcggcctcggctacgacgtcgccgccgacgtccggctcaagttctgcaagcagcgcggctcgcccgacccgtcgctcatcgagctcgaccgcgatgggacccaggacatcgtgctccccggcagcctgaccacggttgccggcgtgcccaagtccatcaagtgcgacaagggcgagcggatgcggttccggtccgatgtcctgtcgttccagcagatttgcttcagatcacggaagcttgggttgatggagtgcttgtctttagtttttgttttgactttgtgaaacttgctacccatgatgaaactgtgtaatttgacaaaactatngtntatgtntggatgaaacttgctancattggtaacatgtnttgggatatgtgttcnataatanacatgtgttcatnnctaaaaaaa

SEQ ID NO: 28382 - DNA, 717 bp, Triticum aestivum
  Clone ID: PAT_TA_28382
gggagagagagagggagggttcgagagtcttccagagagcggatccatccagagagtgctagggtttctctctcccggcggcggcgatgtcgatggcggcggcggcgagggcggcggcgagggccccgggcagggcggcggcgcggttcgtgcagtccaggctccgctcctccggcaaggtgctcagcgaggaggagagggccgccgagaacgtctacatcaagaaaatggaacaagagaagcgggagaagctcgcacgcaagggtcccagcactggagagcaagctccgtccaccccaagcgccgcagcaggcgacgcgaacaccgcaggcgccggttcgaccgcgtcggcgtccgcagcaggcacctcgaccgacaagaacaggaactacgccgtgctggctggcaccctggccggcctgagcgccctgggctggtacctcctgtcgaagcccaagaagacggaggaggtcgtcgactgatcggcccgtctccgtcccgccctggttttttacttccttactgcacatggacctgcgcgatgatgatgatgataataagtttccgacgtcgccgaacagccttgcctttgccttgttagccgcctgcttcgacagaatccgagacttgagatgatgacgatgatgatgatggtctgtagcgcttgttgttttggtgcctgtggttggtgtggtatgggatggtggtcggtgatgc

SEQ ID NO: 28383 - DNA, 488 bp, Triticum aestivum
  Clone ID: PAT_TA_28383
ggccaatctcgccggagaaagaagcgtcgacgatgtccggccgcggcaagggagggaaggggctgggcaagggcggcgccaagcgccaccggaaggtgctccgcgacaacatccagggcatcaccaagccggcgatccgccgtctggctcgccggggcggcgtgaagcgcatctcggggctcatctacgaggagacccgcggcgtgctcaagatcttcctggagaacgtcatccgcgacgcggtcacctacaccgagcacgccagggccgcaccctctacggattcggcggctaggccacgcgaatcgatccccccaccaccatatttgtgctcgtagctagctatggctgtgtattgttcatgggcttcggtgtaatggctgcatctcgctgctgtatgtcctggccttgactgttgttgcttggatgtagtagtcctgggatgaaatggaaattgaagtggtctacccttgaattcaaaaaaaaaa

SEQ ID NO: 28384 - DNA, 436 bp, Triticum aestivum
  Clone ID: PAT_TA_28384
cgtccggaggagatagagaagagagagagagagagaggatggggacggaggaggaggcgtccctcgcgattggacagggcgcgaggaacccgaggagagcgcgcgtgcgatccccgaggcgcggggagtcgattccggcgccgggacagtctcgccctcgccgggccggccgtttcgagcactctatcaccgaggatttggtgggatccggccaagagctggttggtggaggggaggggaggagcacggagggggggggccgaaaagctcaagtgggcgctgggggtggtcaacctcgaggcccagtggtggaagcccatcttcagagccgacagcacggtgctggaaaggggcgcctacgagggcaccaaggaggagcttaacagcgagctctggccagaaggtcccaaccgccctcaagatcgaactttggtat

SEQ ID NO: 28385 - DNA, 434 bp, Triticum aestivum
  Clone ID: PAT_TA_28385
tagcgtggtcgcggccgaggtactgaggccggtcgactctgagcgtgtgcttactcagctcacgaattgtttctggaggaggttggcgcagaactctaaatcaaagcgcccttctggagggtcgccgatgcaatcaaacacagcatccgctatcacaaagtcctcatctgcggtgtacttgaccaagcctgctcttgcaagactgagcgctgtttaccgcagcctccaggttgccaagtccggtgtcaagaagaagaacaggcagtaagcactgaggggccaatgagcttgttttgtggatctgttggtttatgtttccagctttttagatttgttctaagagtatggagattgaatatgatgaatggtgtgctccgcatactggcacaagttttctcagtaggttctatatctgtacctgcccgggcggccgc

SEQ ID NO: 28386 - DNA, 175 bp, Triticum aestivum
  Clone ID: PAT_TA_28386
ttttttttttacatcagcagcagtgaacaaccagtaaccacagcggcatgcatgaacgcatgagcagtagaaattacagaatttcagagtcttacttgatatatataagtcagaacattcttatcctgacttatcgtatttgaatgttctgacttatatatatcaagtaagaacc

SEQ ID NO: 28387 - DNA, 187 bp, Triticum aestivum
  Clone ID: PAT_TA_28387
tagcgtggtcgcgccgaggtacacgcagcaacaccaccaatccagctatcacatccaccatacatagaaccgattgcacagttgtttcctctctactagggatcaactcaactaaactaagcaacatcttcaccgtgccagcgataccagcctatacaattcttcacctgcccgggcggccgctcga

SEQ ID NO: 28388 - DNA, 476 bp, Triticum aestivum
  Clone ID: PAT_TA_28388
cgtccgctcacgcgctcctagccttcacttcctctgctcctgcacggccgcacctcccttccactcccacttccaaagcagtagcgatggctcagggaagcggcagtgccaccgccgtgctcgcgctggtcctcctctgcctgctcctccacggcgacttcgccgagtccaaggtgtacaccgtcggcgaccgcaacggatgggccctcagctccggcggctggcccaggggcaagcgcttccgcgccggcgacgtgctgcgtgagtgctcgccctccctccctcccatgcgtgccacgttaattactttcttcttccagcttcactctcgtctcgtactacgctacaagctcgatcacggcaagcatagctagctagggtcccgttgccctcagtagtcagtagagcagacgtgacatgtctgtggcaagagtacgtcgtgcactgtgggtcgtgcatgcttgctgagtcgcatt

SEQ ID NO: 28389 - DNA, 622 bp, Triticum aestivum
  Clone ID: PAT_TA_28389
agtgtcagttccacctatgaccgatcggtatctacctatgcggtgtgtgttgaaaaaaaaaaaaaaaagggcgaccgcgtctgcctccaccggtgcttcctcagcagcagcgggatcggccggctcggcctcggcagcaggcgccgcctcttccttcacctccccggccgccgccggctctgcctcagccacggcctccttggtctctgtctcgaccacggctggcgcctctgtctctttgggcgcctcggcctccggctcggccgcagctgctggctcggcctccttggcatcctccgtctcggcggcggccggtgcctcctccttggtacggcgtgatgctgagtcagccagtggagtggagtgctactgctttttactaggtgtggagtgggagcgctatgcgcggggtcgcgcgtgacgtgggctaaataaaagtgttgtcggggccagtcgacgcccagtgtcgggtcagcagcgagcgagcgagcgacgcagcgccactctcgccggcacccccgtgcctgcgtctgctcagctggagctttgttgcggtgtgtgtcacagtgtcagttccacctatgatcgatcggtatcctcctatgcggtttgtgttgaaaaa

SEQ ID NO: 28390 - DNA, 832 bp, Triticum aestivum
  Clone ID: PAT_TA_28390
tgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgtgtgtggatgtactataaaactagcttaagttagtgtcttttctctctattgcactggacagtattattgtgtcgtaggattagccattaatcaccccaaaccctccgtttaatctgtatggatacagtaccaaggagaagaaggacggggtctggcttaattttactcatcaacggttgtactttaccttctctcgagtaccagccccatgttggaatgattgactggtgctttttggttccagtgaatgctttgaccttgatgggcaactggcaaccatgtttcctttgttgtgtgtctgccttacgtgtgca

SEQ ID NO: 28391 - DNA, 606 bp, Triticum aestivum
  Clone ID: PAT_TA_28391
gccaaagccttcgcatccagagctccaaaccctaggcgaggcgaggcgcggcgcagcggagggagaggccatggatcccgattcggtctcgaaggcgttcgtgcagcactactaccagacgttcgactccaaccgcgccgcgctggtggggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgctgccagctggagggagcttctacgtgcagaatgacatgttccgcctgaactatggttaaggaagggcgaccgctctggcagcaaagaacttgttcagggatttatgttgaaacaatgaacatcaaatgatgatgctgcagactctttgtttgttcgccaacttgtgcaatttatcgcaaaaaattgccagacttgataggcatccaccagatcatcttttgttttgtgtttcccatgtattgtcgttgcttgggtggcactttctttggaatgttgatgaaaccgtccaggtac

SEQ ID NO: 28392 - DNA, 800 bp, Triticum aestivum
  unsure (1)..(800): unsure at all n locations
  Clone ID: PAT_TA_28392
taggggcctaccatggtggtgacgggtgacggagaattagggttcgattccggagagggagcntgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaataatagagaaagcgaatgccatacgccaggcggtgggaagtgacgacgaagacgacgataattggagcgacacatagagcacccattattttgccctcctgctgttttttccttggcagaaaggtgccaaaccagcaagatcttggacagggtgcacagccatgccatcttatggtcctaacattcttagccttgtctctctcttgtatatatagtatagggaaatgcccatatgttcatgtttttttgccattcttctctgcattctttttggcctcactgtgtgtatacttgcctccccgggcagcaaaaggctgttgaaggtaggcatgttcttaggagaccaatttgttcaggtctgttgtaaatcgttaacctctcttaacccttgtttgcattatagatttgtactcccccccttccaaaaaacttgtcgtggtttgaatactcagtattttggaatgttgggggtggtaggtttttcttgaaatgtgaaatgggttggtgtgctgtgatcctccccaaaaaaaaaaaaaaaa

SEQ ID NO: 28393 - DNA, 1025 bp, Triticum aestivum
  Clone ID: PAT_TA_28393
accttgcattttatccaatgtatatttgggatgccccatgtctatttacatcattgctatcttttgccactttatctaatgtatgaattatcttatctttggtccactttgcaattttaaatgatgtataatctggaaaaaatgctctccgctctgtgggctcaagtgagcttaagctgatcgtccacttgcatctgatggtaacagggtaagatgtatgcataacttcaattcttctcttgcatctgctcggaacttacatattggttgtgtgtaaattcatatcagaaatcattttgcataaaaacattggttatcgaggccagacactgattcttcatctggttgttggatcacagtgatgtctcactttttaaaatacaatttgaacgacatgctattttgtatccagttttggcggcggtggtgctgctgctcctatgatggtagactcgtctgattcccctagctgcatccatggtgacgaagctcgacctaggctagaaccccctccagtgagctcctcaagtcctcttatacccctcctacttgcttgttggttctatgctctgcctttgtgaggtgtaattgttcaattttgttcatagtcgagcattggatgatattgtatttgtcatgatgtacatggttcatgaactatgccaacctgcagctttgttgtactagtgatagtaggataatgcaagttttgacaatccatgcctatttccgcatcataataatcttcttctagtcttcttctagtctttttcttctaactttcttctttcccattttacagatttgcttaagatgacggaagcttgggttgatggagtacttgtatttagtttttgttttgacgttgtgaaacttgctacctatggatgaaattgtgtaatattgatgaaactatgtatttgtacggatgaaacttgctactacttgataacactgtgttggatatatatgtgttcatgactattggtaaaaaaaaaaaaaaaaaaaaaaaataaaaaaaaaaa

SEQ ID NO: 28394 - DNA, 500 bp, Triticum aestivum
  Clone ID: PAT_TA_28394
tccgcccagcgtccgcccagcgtccggcacccgcttgagaggaggcaggcgtaggctaaccgcataagggagaagtactctgacataattcctgtgatcgttgagaaggctgggaagagtgatattcctgacattgacaagaaaaagtaccttgttcctgctgaccttacagttggacagttcgtgtacgttgtccggaagcggatcaagctcagtgctgagaaggccatcttcatctttgtgaagaacactcttccaccgacagtgtttttgttatgcaggttggaagaaaagaagaagatccagagaagatcttagtaataagatagtttttaggaaaatagatatttagttttaggtcatttcttgtaatttcagatatggagtgcttgtctttaatttttgttttgactttgtgaaacttgctacctaaggatgaaactgtgtaatattgatgaaactatgtatatgtatggatgaaacttgctactattggtaac

SEQ ID NO: 28395 - DNA, 560 bp, Triticum aestivum
  Clone ID: PAT_TA_28395
gaggtcacaacgctacccccaatccccagcctccagatccacccgccgccgccggcctccccgtcgcttcccgtcccccgcgcgccccagccagccaggatgacgctagaagaagcaccattttacccacgcaagaagctcgttcagaagcagcagtatttccagaagctgagcaagcatatccaccttaaagggcgctatgatgtggtcacctcagttgccattccccttgcgcttgctggcaccagcttgttcatgattggtcgtgggatccacaacatgtctaacgggattgggaaaaaggagtgaaattctgtgggttttgctagtatctcagtacgcggcggcatggcagggataccgtccaagctatgacgtcttcttcgtatgcaaataatattgtcagagaaagactcagttcatttccagttcccttttgttggtatttgtggatatttgatgtcagcaaattgatgttaaactggcaatgatgattctataacatcggcatcattatcctttcagttaattgcgacgtttttttttctacggtttccttt

SEQ ID NO: 28396 - DNA, 715 bp, Triticum aestivum
  Clone ID: PAT_TA_28396
cggcgagcgaaccgggagcagcccagcttgagaatcgggcggctgtgccgtccgaattgtagtctggagaggcgtcctcagcgacggaccgggcccaagtcccctggaaaggggcgcctgggagggtgagagccccgtccggcccggaccctgtcgccccacgaggcgccgtcaacgagtcgggttgtttgggaatgcagcccaaatcgggcggtagactccgtccaaggctaaatacaggcgagagaccatgcccagccgcgccgaggtctactccaagctgctcggcgcccttaatgggccggccacctccctcgtcaccacgctgcaggcgccagccagggacgtcgtcgccgtgctctccgcctacgtgcgcaagctcgaggaggagtccggcgccggcgccggcgccgcctagtggcagttgcgatatggttgtgcctcctatccccacatctcactctttgcttgtacaattccttgtacctttattactgtctcccgtttgaattgaatcacaagttttccccttcacaatgtgcggcttgtaattgggtagtatctcttgcctgctgggtgtccaaattgggatgaaattggaaaacgatggtttgagaatcgggcaatgtatatcatgttcacgaataatttggtttgtgtaaaacaatttaataaggtatggaccatgaaaaacaatgggaacaaaaaaaaaaaa

SEQ ID NO: 28397 - DNA, 503 bp, Triticum aestivum
  Clone ID: PAT_TA_28397
atccaccttatcgctctacacctcacaaagacaggtcaacctcaccgaggagaagaagggagaagcgagaagatgtcgggccgcggcaagggaggaaaggggctcggcaagggcggcgccaagcgccaccggaaggtcctccgcgacaacatccagggcatcaccaagccggcgatccgtcgtctggctcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggcggctaggcctccgccagattagagtgtctagggttcgtggtcgttgatgtaatcgcagtatctcgctgttgtttgctatcttctgtagaatcgaatggaatagaaattggagtagtttgtctttt

SEQ ID NO: 28398 - DNA, 1068 bp, Triticum aestivum
  Clone ID: PAT_TA_28398
tttgcctattgctaccacagcacgagctagagtcagagccatagcagtttcggtcatggcgaggagcattgctctggtctgcttcctcgtcgtcggtctcggcctcttgggcgccatgtgcgcctcggcagctgcggcaggcggcgagaacggagggcggctggtgaacgccgtgtacgtgttcggcgactcgctggtggacgtgggcaacaacgactacctgccggcgccggcgcccagggcgaaccggccgtacggcatggacctccccggcaagcccacaggccgcttcaccaacggctacaacctcgccgacgtcatctcacaacgtgtggggttcgagatgagccccaagccgtacctctccatgctgccgcacgacaagattttactcggcctctgcaagattggcgcgaactacgcttccggtggatccggcatcctcgacaccacgggaaaagggacgctcacgatgcggacacaagtcgagtacttcaagaaggcggcggacaacatgatttgctacccaagcaaggaggagcacctggcgcggtccctcttcctcctcagcggtggcggcaacgacttctcggccttcgacccctccaccgccagcccccaggcctacgtcgtcaagatggtcaccacctacatcaagcacatccaggcgctctacgacatgggagcacggatggtggggatcctcgacgtgccgccgatcgggtgcacgccagggcagagggtgggcatgcccaacggtgaatgcaacgagcaggccaactccctagcgcaagcgttcaacggcctcctcagggccaagctcgccgaggcctccgcaaccaccatgaaggagctcaagtactccatcgccgccaactacaacatcctcaacgacatgatggacaactccctcgtagccgggctgaggcacgtgaagacggcgtgctgcgggtccgggaagctcaacgcggaggtgatgtgcagccacccgggcacgacggcgtgccccgccggcgagcacgatgactacatgtgtctggacatgctccaccccacgcacgccaccat

SEQ ID NO: 28399 - DNA, 508 bp, Triticum aestivum
  Clone ID: PAT_TA_28399
cgcggccgaggtgcttctggagaggatttgtttgtgtgaggggctttgataggacatcaagagcaccaagaccactctatgcaaggcttcactttccagcaagcaaaattaccaggaataaaaagggcgcagcttctgcaggcacagatgatgcatagcccgtcgaggaaataaaaaaaaaccgagttacatagaagaccctgccagaagatcactgactaataagttgttgtcaccaagttcaaccatcttttagcctttcgtatctgcgaacgttatgaatgccagccactcgcgaatttgtgaagctggcgttgttcagcaacatgatccattactacacagatttatgctcatttggttccctccaaggagttcgatacagcaaatggggatgggaggaagtatgctgtttgggccattctgtttgttgtttcatgggatttgaaccaactgttgtacattggagacgtcatccattcaaagttgttcatgttgttcggtagtt

SEQ ID NO: 28400 - DNA, 552 bp, Triticum aestivum
  unsure (1)..(552): unsure at all n locations
  Clone ID: PAT_TA_28400
tcacaacgctacccccaatccccagcctccagatccacccgccgccgccggccaccccgtcgcttcccgccccccgcgcgccccagccagccaggatgacgctagaagaagcaccattttacccacgcgagaagctcgttcagaagcagcagtatttccagaagctgagcaagcatatccaccttaaaggccgttacgatgtggtcacctctgttgccattccccttgcgcttgctgggcgccagcttgttcatgattgggcgtgggattctacaacatgtctaacgggattcggggaaaaaggagtgaattcctgtggcttttgctagtatctcaattaagcggcatgggaagcgatactgccccaagtatgatgtcatcttccgtatgcaaataatattgtcaagagaaagatccatccatttccattctcttttgtcggatttgtggtatttgatgtcaacaaatngatgctaaactgggaatggatgattccataacatcggnatattacctttcagttattgcgtgttaagcccnaaaaaaaaaaaa

SEQ ID NO: 28401 - DNA, 681 bp, Triticum aestivum
  Clone ID: PAT_TA_28401
gacgaacaccggaacgaagcagatcggcggcgcgtcactccaatcaccggttcataaaatggcgacggtttcggattctctggtctgggagctcgtcaggaagaacaactgcttcctgatcaagcagttcggcaacagcaatgccaaggtccagttcagcaaggagcccaacaacctctacaatgtccactcctacaagtactctggcctggcaaacaagaagactgtgacagtgcagccagctgctgagaaggagatgactgtggtcctctccacaaccaagtcaaagaagcagaacaagcctgccgcgttcacccacaagactgtcatgcgcaaggagttccgcaagatggccaaggctgtcaagaaccaggtcagtgataactactataggcctgacttgaccaagcctgctcttgcaagactgagtgcagtttaccgcagcctccaggttgccaagtccggtgtcaagaagaagaacaggcagtaagcactgaggggccaatgagcttggtttggggatccgttgggttaatgttccagctttttagatttgttctaaaggattgaggttggatatgatgaaaggggtgtgctgcatactggcacaagttttctaataggttctatatctgacccctgactattttgggaaagcttttggaatcattttcacaattt

SEQ ID NO: 28402 - DNA, 594 bp, Triticum aestivum
  unsure (1)..(594): unsure at all n locations
  Clone ID: PAT_TA_28402
gcacgaggatccagagagtgctagggttttctctctctcccggcggcgagggcgatgtcgatggcggcggcgacgagggccccgggcagggcggcggcgcggttcgtgcagaccaggctccgctcctccggcaaggtgctcagcgaggaggagcgggccgccgagaacgtctacatcaagaaaatggaacaagagaagcgggagaagctcgcacgcaagggtcccagcactggagagcaagctccgtccaccccaagcgccgcagcgggcgacgtgaacactggaggcgccgcttcgaccgcgtcggcgtccgcagcaggcacgtcgaccgacaagaacaggaactatgccgtgctggctggcaccctggccggtctgagcgccctgggctggtacctcctgtcaaagcccaagaagacggaggaggttgtcgactgatcggcccatcctgccctggtttttacttccttactgcacatggacctgcgcgatgatgatgatgataataagtttccgatgtcgccgaacagcctttcctttgccttgttagctgcttccacagaatctgagacttgagatgatgatnnnntgatg

SEQ ID NO: 28403 - DNA, 556 bp, Triticum aestivum
  Clone ID: PAT_TA_28403
gatccctctcgcccccttccccgacctttcagacccagcggtaccccatcaccacccccgccttcctgccagtagtagatcccttatgagctggttggctgcggtttcacttcagtttgggggctactaagatgggtcagcagctgggcagagacaagattggatcaaacttaacagctgatgacatagcgagcgctttctacttctcgctcctgctctcccctgttgtctcctactgggattgcatcttccgcaagataagatactccttcagacccgagtgggtgtagcattctgcgccaaccgcttctgcactagttggtccgggagtaaatcggccggcccgtaggaagaaagcatctagacaggagtccaataactatgtactttgcagattttggttttccgtaattataactggtagcggagtttagctgagatagtagtagtcaatagcaagcagtcacagtggtcatggagaaagctgcgggcaatcaggcagggaaagtcttgaagaagggaaagaagaaacaggcgaaagatgagctggaccgcc

SEQ ID NO: 28404 - DNA, 473 bp, Triticum aestivum
  unsure (1)..(473): unsure at all n locations
  Clone ID: PAT_TA_28404
cgaacaccgggacgaagcagatcggcggcgcgtcactccaatcaccggttaggataaatggcgacggtttcggattctctggtctgggagctcgtcaggaagaacaactgcttcctgatcaagcagttcggcaacagcaatgccaaggtccagttcaagcaaggagcccaacaacctctacaatgtccactcctacaagtactctgggcctgggcaaacaagaagactgtgactgtgcagccagctgctgataaggagatgaccgtgggcctctccacaacgaaatccaaagaagcagaacaagcctgctgccttcacccacaagactgtcatgcgcaaggagttccccaaagatggccaaaggctatcaaagaacaagtcaatgacaactactacaggctgacttttaccaacctgtcttgcaaaaactgacgcgntttacggaacccaaantnccaatcccgggtnaaaaa

SEQ ID NO: 28405 - DNA, 393 bp, Triticum aestivum
  Clone ID: PAT_TA_28405
gaaggcgtcaaggaacactgggcctaacccgcaggcatggctagctcgctagccgggccttgtgttgcaaagctatttaatccacacgactctcggcaacggatatctgggttctcgcatcgatgaagaacgtagcgaaatgcgatacctggtgtgaattgcagaatcccgcgaaccatcgagtctttgaacgcaagttgcgcccgaggccactcggccgagggcacgcctgcctgggcgtcacgccaaaacacgctcccaaccaccctcatcgggaatcgggacgcggcatctggtccctcgtctcgcaaggggcggtggaccgaagatcgggctgccggtgtaccgcgccggacacagcgcatggtgggcgtcctcgctttatcaacgcag

SEQ ID NO: 28406 - DNA, 631 bp, Triticum aestivum
  Clone ID: PAT_TA_28406
caggaattcggacgaggggactcccgctgagtttatgcatataaataagcggaggagaagaaacttacaaggattcccctagtaacggcgagcgaaccgggagcagcccagcttgagaatcgggcggctgtgccgtccgaattgtagtctggagaggcgtcctcagcgacggaccgggcccaagtcccctggaaaggggcgcctgggagggtgagagccccgtccggcccggaccctgtcgccccacgaggcgccgtcaacgagtcgggttgtttgggaatgcagcccaaatcgggcggtagactccgtccaaggctaaatacaggcgagagaccgatagcgaacaagtaccgcgagggaaagatgaaaaggactctccatatgaagatatatgtgtggtgctgaaactgggaagttctctgaaaatattgtgtgtttttgtctctagagtattttgttttcccccatgatttgaatctatcgaaggcgctgaaagttgttttacgcccactttgtatttctgaatctctacttctgctttccaaagtgtaattgggtgatgctgttggcacccttgatgttatccatccacaaggatcaagtaggccaacggaaagagttacactttcgc

SEQ ID NO: 28407 - DNA, 916 bp, Triticum aestivum
  Clone ID: PAT_TA_28407
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatccgtctgatccattaaatggagaggctgctgcacttatgatgcgagatcgccctgcttatgaacaaaaagtgaaagaattttgtgaaaaatatgcgaaacccagaggatgctggcataaccccagaagacaagtcccagtgatgaagaggagcttagcgaagacgaagatgactccggcgatgaggatatagtgggcaaaccagatccttagtcactaccacaacccgttgtatacaatgttggttgcaaaatttgcaatcaaattgatccagaaaatctgggaaagagaactttgtatgtcatgtaaataagtgtacttgtatcttatccaatgttgttttcttcagttgaccaattgaatttgcagcattgcatacattcgcgcctgtccgtttttgtagatctgtgatctggttcgtagaataaacaattctc

SEQ ID NO: 28408 - DNA, 773 bp, Triticum aestivum
  Clone ID: PAT_TA_28408
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggccacggcgacgccttcaagctagacgatgacggcgcggccatgctgctcttgatcttttggaagccagatacttatatcgtagtgaaaccgtcgtcgtcgtttttgtcgcgcctctagatcacacccacccatcttcttacctacctagattcgtcattgtgtaaccctatattgggcaaagggaactgagtatctattatacctgtggtggcagtgtttgttatgtttggtggttgcacctcccgtgctattcttttg

SEQ ID NO: 28409 - DNA, 574 bp, Triticum aestivum
  Clone ID: PAT_TA_28409
gcaaccaccaccaccaccagcagcacacactcagaagcgaagatgtccggccgcggcaagggagggaagggcctcggcaagggcggcgccaagcgccaccggaaggtgctgcgcgacaacatccagggcatcaccaagccggcgatccgccgtcttgcccgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgtcaggggcgcaccctctacggattcggcggctgacctgcgcccgctgctccaatctccaatctccatcgactctgactctgagtgcgtgcgttgttggtccatcggtctgtgtagttagtggaaggcgatggatctgaatgcagtcagttcgtcagagtgcgtctgttgatctatcggtctctgtagtcagttcctcagtggaaggcgatgaatatgaatgcaatggggtcgttggttctttctaaaaaaaaaa

SEQ ID NO: 28410 - DNA, 510 bp, Triticum aestivum
  Clone ID: PAT_TA_28410
gagacatagcaaggattgacagactgagagctctttcttgattctatgggtggtggtgcatggacgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggcctttgagtagaggagcatctaggcgatgccaccgccgcgctgaaagaactacgcgtagtattcgtcatgtctgtatttcagcgctcttctttatgtctgtcgtaatgggttgtaattatcctcgagtctatgaggtggtgtcggtgaacatcttcggtcagtggttatgtttgcgagaacaagaaaaacctatcgtggtctgtggtcatcgcttgtcaaactgaatcttaatcgtcaagtggatgctttgcttggttaaaaaaaaaa

SEQ ID NO: 28411 - DNA, 953 bp, Triticum aestivum
  unsure (1)..(953): unsure at all n locations
  Clone ID: PAT_TA_28411
gctcaacagaggaattaatccttgtttcgatttgcactggacaagtcagataaaagccatccagatccaggagcactagtagtatcttacagcggtagtagcagtaccattttaaccagccagcccatcttccaggcatacacacacacacacacacacacacacacacacacttgttgcggtaatcatcctagcggtttttcagttgacaacaacaacaaaacagccagcatcattctcatcatctggcacaaaagcacaacacacacagacacactcaggggactataggacaccgagcgaccaacgaatcaatcagcaacgcttctcgcctgctgctccgggggcgtttcttgacagcggccgagaggcatgcagggggaggttgacagcggaatggcgaacttttcaacatatatgtaggcagccgtcgtcaaaaaagaagggcaaagggaaaagaaaaactgtaaccgtgatccatgttccggcaggtagcttcttttttagcttctagtaagtatatcttgggggtggtgttctcttttctgttgttgtcgtccttgtcgaggcgctgtgctgtgctagcaggaagagcccttgtggcacgacagggcgcccgccccagaggtgatggtggcgaccatggatgaggacttggcaccgaggctggaagcgcgcgagtagctggctgaggcgcctgcccccgatggggtgaagaaggcgccgttcagcagcatatcaccctctgatctccagttccaggccttccaggtggtctgagcggtctcgactctctttgtcacctctttggcaaaagggttggttggggcgaggtagcggttcccctggctgttgatggtcggctcggcgctccctccgatggcgtacatctcccagtgggtgtagtcattgttcaccacatggaagtaaccctcgtgccgaattncctgcag

SEQ ID NO: 28412 - DNA, 855 bp, Triticum aestivum
  Clone ID: PAT_TA_28412
tgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgctgccagctggagggagcttctacgtgcagaacgacatgttccgcctgaactatggttaaggaagggcgaccgctctggcggcaaagaacttgttcagggatttatgttgaaacaatgaacatcaaatgatgatgctgcaaactctttgtttgttcgccagcttgtgcaatttatcgcaaaaaattgccagacttgataggcatccaccagatcttcttttgttttgtgtttcccatgtattgtcgttgcttgggtggcactttctttggaatgttgatggaaaccgtccaggtattagttatgtgtggcatctctgggttttgtttgtgaccatttaagttcacttttgcatgtccc

SEQ ID NO: 28413 - DNA, 792 bp, Triticum aestivum
  unsure (1)..(792): unsure at all n locations
  Clone ID: PAT_TA_28413
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagaatgcggtcgagaagagttgtgcgagcaggccaagaagagccacgtacggcgtcgttgatcctcctccggtgtgtgttgctgccgaactagggccgatctctcaggagatggaataatgcagatggctcccattagtttatcttaccagcttatcatttgtgttcgtccagtgttagcgtctgtgttgctagtgtggcaatgtgcccgtgtcactgtaaaaccatnatcaccacggaaangaagtaa

SEQ ID NO: 28414 - DNA, 516 bp, Triticum aestivum
  Clone ID: PAT_TA_28414
gcaacacaccgatacacagcagtcaagcgcagctcgccggagagagaagcgaagatgtcgggccgcggcaagggagggaagggcctcggcaagggcggcgccaagcgccaccggaaggtgctgcgcgacaacatccagggcatcaccaagccggcgatccggcggctggcgcggcggggcggcgtgaagcgcatctcggggctcatctacgaggagacccgcggcgtgctcaagatcttcctcgagaacgtcatccgcgacgccgtcacctacacggagcacgcccgtcgcaagaccgtcaccgccatggacgtcgtctacgccctcaagcgccagggccgcaccctctacggattcggcggctaggccaagcgaatcggcccccgccatcagatttgtgctcgtagctagctatggttgtgtagtgttcatggtcttcggtgtaatggccgcatctcgctgctgtatgtcttggccttgactgttgtttggatgtagctctgagatggaatggaa

SEQ ID NO: 28415 - DNA, 885 bp, Triticum aestivum
  Clone ID: PAT_TA_28415
ccacgcgtccgcgaccgaccgaccgcgccgcgcgaccgccgggagagcatggggagcgggggcaggacggatctggacggcggcgccgtggcgccgctgaccatctgcgtgatcggcaccggcggcttcatcggctcgcacctctgcgagaagctcatggccgagacccagcagacggtcctcgccgtcgacgtctactgcgacaagatccgccacctcgtcgacccgcccccgccccacctcgccggccgcatctccttccaccgcctcaacatcaagaacgactcccgcctcgagggcctcatcaagatggccgatctgacgataaacctggcggcgatctgcatgccggcggactacaacacgcgcccgctcgacaccatctacagcaacttcatcgacgcgctccctgtggtcaagtactggatccggaagtcgtttgccctgtacgtccaagtcggggcatgcgataaaagaggtcagacttggagaacagcaagcgtctgatccacttctccacgtgcgaggtctacggcaagaccatcggcagcttcctccccaaggaccaccccctccgcaaggttattttgcatcttgattaggagatgatggtgatcatcttttgttgcgggaacctgttagataaagtttatgtgatttgaacctgcaagatacaattctgtataatgttgtgtgagataaaagttgtgaacataggagataagttattgatatgtgttggcctgtctaatgttatgcgagataaagttgtgtgagaaagttttctatacttgtgttattactgtgggaaagaagtactgttgctatactgatttgagagtattggctgtaaataaaagagggcttggccccctattggattgt

SEQ ID NO: 28416 - DNA, 385 bp, Triticum aestivum
  Clone ID: PAT_TA_28416
acctgtcaaggctgcatttgatcagacagcttggtctgggctgtggaacaccaatctattcgtcgccttgggattccttcggtgggaatctccgtccaccatattcagcgagctcaagtccaccttcttccccatgcttactgctggatggaagctgtggccattcgcacacttaattacatatggtgtggttcctgtcgaacatagacttctctgggtcgactgtgtcgagataatctgggtcaccatcttgtcaacttactcgaacgagaaatctgaagcaaggatcttagacgattcctccacaacagatacgcgggtatattacatcggaactactaaatatatgtagaaataagttcagccttgtcatctctgtcatcgt

SEQ ID NO: 28417 - DNA, 1006 bp, Triticum aestivum
  Clone ID: PAT_TA_28417
agcagtagcagcagcagggttccttggtggatacagcagcagcagcagaaagaggacaccatggtgggtacagcagcagcagcagggttccttggtggatacagcagcaacagcagaaagaggacaccatggtgggtacagcagcagcagcagggctgcatcttcaaggtcagcatcagcaggaggtcgatggaccgtgatcccttctccacctctcgtttcatatgcaagcaggcaagatttcatccctacagcagaggacaagggcctcacttgatcatgcctgccagtcaaggtcgcaacccacggaggggggacgcgctgttgttcggcattggctgcgcaaaccgccacggaaggcaccctctatggacggggatgaccatgatgcaggggaggatgaggaccgatacattgagctcgaccacgacggggcaccgcacaagggcatgatgtagtgctcaggatgctcttcggatggctcccaggatgggattgaacctagttgaggtccttgggaaatcaggccctcctgtttccaagatcataggctttcacaaagacaagtataccaaggatgccatggagaaagatcgcctaaaagaacaaggtgataatgttgtaccgagggcataaagttgtatccaggatgggcttgcacctggttgaggtccatcggaaataggaccatcctgcttgcaagatcatggacttccacaaagacaagtataacaaggatgtcaaggagaaagagcacgtaaaaaccaagatttgcttaaaatcacggaagcttgggttgatggagggcttgtatttagtttttttggaccttgtgaaacttgctacctatggatgaaactgtgtaatattgatgaaactatgtatatgtacggatgaaacttgctactattggtaacatgtgttggatacatatgtgttcatgactattggtaatatgtgttgaatatgctatattggtcatataaaaaaaaaaaaaaaaaaaaaa

SEQ ID NO: 28418 - DNA, 1331 bp, Triticum aestivum
  Clone ID: PAT_TA_28418
cctggttgaggtccatccgaaataggaccatcctgcttgcaagatcatggacttccacaaagacaagtataacaaggatgtcaagtagaaagagcacgtaaaaaccaaggtatgtgtgttgtgccatcactactgacgctgagttgagatgcttagagcacagcaaatatattccatgtgctggctattttatttgtaaagaattttgtttttccaaaggggaagggaggagtaaatgagatggtgggattgactctaacctgtcaatctgctgggttttgatggctgtagtatgtgttgttcagttgcaacataagacatggttgtgcatgttttgatccttgttgtggaatcgaaacaactccttgtatagtttatttgattattactgccagtattctgcctgtgagccatggtgttgatttcaagtggaagaaccgctgtccgttgttttcagggtccaagaagtatgttttcttgttttgataggtagagccatgtactgctcacggtgcagctcaccatgacatgacgaaattggttgactttgactagtaatccttctgtaaagaaatacaacctagcatttaacctaggatagctctaaaatgacctatacttagcatttttccttcaaaatgacttaatatgcttagctagcttaaaaatgacctatttaacctaggatagctctaaaatgacctatacttagcatcttttcctataaaatgacttaatatgcttagctagctctaaaatgatatagtatgcttaagaaatgacatattttagctcctaaatgacttcatatgcttagctagctccaaaatgacataataaccttacttagcttcaaaatgacctattcaacctaggctagctctaaaatggcctatacttagcattttttcctccaaaatgacttaatatgcttagctagctcaaaaattacataataagcttaattagctccaaaatgacctaaatgacttcacatgcttagctagctccaaaatgacataataaacttacttagctctagaatgaccttagcatgttttacaccaaaatgaccttagtatgcttagctagctcaaaaatgacataataaccatacttagcttcaaaatgacctattttacaaatataagttgcatcataataatcttcacattgtagttgcatcataataatcttcttcttctaactttcttctttcccattttacagatttgcttaaaatcacggaagcttgggttgatggagggcttgtatttagtttttttggaccttgtgaaacttgctacctatggatgaaactgtgtaatatt

SEQ ID NO: 28419 - DNA, 771 bp, Triticum aestivum
  Clone ID: PAT_TA_28419
tagcaatcggcataacttcaacttcagccaggtgacttggtccttcggatccggcaacggaatcaatctcagaattgactgtcagggcacccatacatatcatcgacgtctcccagaatcaccctcttggtcgacatctccgtctgcaacatcactcatttggtctgcagaatcatttattgacaccagctgttcaggctcacgtttgaaattatagagctttgatgcaagtccgctctccttgcagacacctagaccttttgccctttcttccatggataacataacagatggccggtgtttgttcctcagatcttgcaatcctgtttcatttacagactgatatcccatgcgagctgtcaggacaagctggctgctgtcaaaagtggacccagctaaagactgcaaaagggtaactgcgtcaccagcatcttttgtagtcacaagtgcagggccataaaactccaggagtgcaagggctgtccggaatagcatcacacgattcccatcaaacagaagcacatcccatacacggaggacactttcccacggaagtacattggtgaaaatggataggaaccatggtccagtaacccatgcaacttcaacaccgaggtagtccaagtgatttgctaatttcgggaatttctcacggactagctcctctaaaacaagctgatccacctgggactccatcatttcttcagaaaagtacccatcaaagtagtcatcaataattcctgccaatgtccaaaatgcgcggacgcgtgg

SEQ ID NO: 28420 - DNA, 481 bp, Triticum aestivum
  Clone ID: PAT_TA_28420
ccggtccggaatcccgggtcgacccacgcgtccgggaccacgtgctgcgggcctgggagatcgccaccggcaacaggcgccgatagagaggctctctcacgcgaccgaaacgccggcgagtaattttcgggcatgtgttcacgtatgtcgcccgaacacacgcacacacgcacgtgtaaattgtggagccgtcttcttttcgccccgaataaactgcacgtcccgctggaaaacaatggtgcgtgctttgtggcgtaccgccgctacgatctgaacccgaatacagtgggcgagttcttcatgtaacttcatcagatgtaaggtccttgatgagaatgaataagcaaaactgtaatgctagaacattgttgccttcgctgtttcatgagctgggcactctggagaacaacaaaacagtaaggttctttcgaatccgaggatatataaaacaaaaatggttctgtcaaaaaaaaaaaaaaaa

SEQ ID NO: 28421 - DNA, 1033 bp, Triticum aestivum
  unsure (1)..(1033): unsure at all n locations
  Clone ID: PAT_TA_28421
agaaagccatcggaagcggcggcgagtggtggtggaacctcccgtccctccgccgcaagaacgactcgcgccgccgcggccgccgcaaccaagacgctcgcggccgccgccgcgggcccccgcgggagccgctctcgtcgtcgtcgtcgtcggactccgtcggccaaagccgtggctggcccctcgacttcccgttccagcaggccgtgaccgccgcctgcctcaccctcaccggcgacacaatggcgcaggtccaccgccgcatcgtcgaccgccggaaacgcggccccgaacccgacagcaaggctcttgtgccggatctgttgctcaaccatgattggcttcgtgggctccgtatagcatcttacgggtttcttcctctatggtcctggctcatatgcatggtatcagtttcttgacaaaagcatgcccaagcaaacactcgcgactctgtccgctaaggtcctactgaaccagattgttcttggtccatgtgttatctctgtaatttttgcctggaataacttgtggttaggaaaattgtcagaattgccatctaagtatcagaatgacgcccttcccactcttctcgatcggttcaaattttggattccagtatcgattgttcactttgggatgattcctttgcctgctcgtgttgccttcatgtcctcttgttccatcttctggaacttctatttgtcgaccacaatgaacaaatgaacttctagttctcaacttcagatccattcaactgcagcagaggaggatctgaaggggcttctttcctattatacgtagtatggcggtggtgccttgggcaattctggtggtggtctcttgagtcgacagacatgattgcagatgatccataagtatgtggatacggtcgatggagaaattacagttttttctaaacatctatgagcatgttgctctagtttgacggtgaaagtgttgtaatctgtatcatttgttcagtaacctnaacaaagacattagtgcaggcctcgaatacagttttgtaagtgcc

SEQ ID NO: 28422 - DNA, 1012 bp, Triticum aestivum
  Clone ID: PAT_TA_28422
gcatatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgacgaggagaagctcaaggcctacgacgtcgagttcgtcaaggtcgagcaggcgactctcttcgacctcatcctggctgcgaactacctggacattaaggggctcctggacctgacctgccagaccgtcgccgacatgatcaagggcaagactccggaggagatccgcaagaccttcaacatcaccaacgacttcaccccggaggaggaggaggaagtgcggagggagaaccagtgggcctttgagtgaaggtccgagtccgtgacacgaataaccagcatggaaggaaacgtggcttcgtcgaatgcctgggagcagcgttaaccgtttttgtggttctgagacaacgatcgtagggaagatgtaagtaggttctggttccggtagacctggagggtcctcaccatttggctgactccgcttcgctttttggttgtggtggtattttgctgcactct

SEQ ID NO: 28423 - DNA, 712 bp, Triticum aestivum
  Clone ID: PAT_TA_28423
cgtccgcccacgcgtccgcccacgcgtccgcgcctcctcttcctcctgcttgccttctccgccaggtgcaacagcattggcgctgccagcgcgatgtacaaggcgagggccagtgtgattttcagacatgatgctcgcaccatcgaggtcaaattcgtcctccccgccagcaacagcccagtcgccgctggggacgaggacctgcagctgcggcaggaagccatggcgcaggccattaccgtgatctctcgccacaggccagagaccagcgacgccgagaagctcaagtgggcgctgggggtggtgaacctcgaggcccagcggtggaagcccatcttcagagccgtcagcacggtgctggagagcggcgccgacgacggcaccaaggaggacgccttcgcccaggccaaggaggagctcaaccgcgagctcggccaggaaggtcccaacgacctcaagatcgacttcgggtatatgtgacatgcatcgccagttccccacctctgccttaatttctctatcggccttagcgcgcccaagatatctgtggtgttgttagtcatgtatagtgctcccgtccgtgcgctgcggcctgtcgcagctgtcggagcaccgccattatttcccttgagcttcgttcttgacgcctttggctgcggaacgtttgtgattgtgcttgcatttccttagtcagcgaggtggttattttgtt

SEQ ID NO: 28424 - DNA, 808 bp, Triticum aestivum
  unsure (1)..(808): unsure at all n locations
  Clone ID: PAT_TA_28424
ggtagtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccggcttcttttcgccatgaataaaccacgcgtcgtgtagtactgcacgctgaaaaatagcattgtgtgcttggcagcgtactgctgctaggaactgaacccgaatgccctggggtgagttctttatgtaacttgatcagatgcatggtccttgatgggaattagtaataagcaaaaaaagtttgtaaatgtgacgtttggcattgtcgtcttcgctgcgcgacgggcaccctggagaaacaaacaataaggt

SEQ ID NO: 28425 - DNA, 813 bp, Triticum aestivum
  Clone ID: PAT_TA_28425
cgaggcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaactgcgtgatcgaaatttcactttactctgcccatgctttttcccatcgcctgcccggccagaaagaaacgtgtgtgttccataatggtatccacaattgcccaaactcaaagcgagttaaatttttgtaggtgtgcctttgccatgttattcttttagctgcagtcggatctcaccgcactcgctggtgcctccctccactgtcttgtgaattattacgcatgcagctttcgtgattatatactacggcc

SEQ ID NO: 28426 - DNA, 490 bp, Triticum aestivum
  Clone ID: PAT_TA_28426
ccaccgccgtccctagattccctacatccgctcgcagcttgagatcgtcagccatgtccgggcgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccgccatggacgtcgtctacgcgctcaagcgccagggacgcaccctctacggattcggaggctaggccgccaccagattagctagcctgtgtctagggttcgtggtcgttgatgtaatcgcagcatctcgctgctgtttgctatcttctgtagaatggaattgaatggaaattcaactagtttatccttg

SEQ ID NO: 28427 - DNA, 656 bp, Triticum aestivum
  unsure (1)..(656): unsure at all n locations
  Clone ID: PAT_TA_28427
ccttggtcactgtcgtttcctcacttgagcacttcttgcccaagttgtttcatcgctgtgagggtctggtgttcaacgacctccccgtgcgttcgacgagctccgcccctgcgttcgtgggctgctattgaggcagagagagcgaagacccaggctgcttttgaggagagggaccggcagttggcggagagggaccggcaggcggcggagagggacagggagaatgaggagaggacggctaggctattggaggaggagaggaaccggaacgactcggctgaccgggccatgtacgatctcttcgtgtccatgtgcgagaagaacggccagacccctccgccgatgccagtcattgctccggcgggcacggtgagtttcatttgaatggtcattagttactagtcttcacatttgagttgcatcatgctaacgatacattggaaataatctttggtgcaacataactcccaacaagcatcgaccgatccttctccgtctgccactggcgcgaccggtcctacacctacacctccgtgatgacgatttgcttaagatcatggaagcttgggttgatggagtgcttgtatttagtttttgttttgaccttatgaaacttgctacctatggatgaaactgtgtaatattnataaactatg

SEQ ID NO: 28428 - DNA, 601 bp, Triticum aestivum
  Clone ID: PAT_TA_28428
gcacgaggccaaatccctgaccgccggcggcggcgatgctcctctaccaccgcatcctccctcgcctcctctccctctccctcccctccagccccacctcgaaactcctcatccgcccctcccgcctccctcctcgcggccccttcctgcctcgctgcgccgcgctctctcagctcgcggccccccaaaccgtagaccactccgacgccgaagaatccgctgaccacctcgacgccgaagagccgcaggagccccaggagccgcaggaggtgctggtaaagctccccctcgaccggctcttcctgccaccgggggcgagcgtgaccccgggggacgaggaggtcgtgaccgcgcgtgtcctcaagggttccaacatcgtgctgggcacgtacgcgcggggcgatgcgcaggtggttaacgcggatttcataaagagcagcgtgcgacccgatgactgccccagggatgggctgcccgagttcgcgctcgtcggccgctccaacgtcggcaagtcgtcactgctcaactcgctcgttcgccgcaagcgcctcgcgctcacctccaagaagcctggaaagacccagtgcatcaatcattttaa

SEQ ID NO: 28429 - DNA, 719 bp, Triticum aestivum
  Clone ID: PAT_TA_28429
gtggtgagaacctagaagagtttgatgagcaggaaaacaagtcatcaatggcgatacaggaggaaaccgaggagtcttccattgatcaattatcagggataggaaataagtctgcaacaggtggatggtttgtttcagagggggaagctgttcttcttgctcatggagatggcacctgctcttattatgatattgcaaaccatgagttcaagtctgaatataaacctcctagtgtggtgtcacataatacttggggtgattgctggttgatccgtgccccaggtgtagatggatgctctggtagatatgtggtcgcagcatctgctggtaatgcattggaacctgggttttgcagctgggattactacaatagagaagtgcaagcatttcatgtcgaggaggaggcatctcttgctcctgtaccatcagccaggacagttcttgggcctcttcctaatataggttcatcaagatctagttctgctatttcaaccatagaacggccgcaatggtggtacagaccatgcggacctctcctcctttctactgctagcaagcagaagatggtcacggcttatgacatccgcgatggcgatgtggtgatgaaatgggaagtaagcagtccagtactcggaatggagtactccagcccactacagtggcgtagcagggggaaggtcgttattgctgggaccgaatcaattgggttgtgggatgtg

SEQ ID NO: 28430 - DNA, 678 bp, Triticum aestivum
  Clone ID: PAT_TA_28430
cccacgcgtccgggaaagagtccaccacatcaccagcagccaccaccgttcctccgattccacatctgctcgcagctcgaagaggatcgtcagccatgtccgcccctctcgctcgccgcctcacctcgccgcacccgctccccgccatcatccccatccgccccttccgcgcagccgccttcccaaccccatcccgcgccctcaccaagctcccctccgccgccagcgcccgccaccccgatctgctccggatcgcccgccgccagacccatggcgactcctccgccgtcgccggcctcgagcagcgcatcagccgcgtcgaggcggacctcgcaaaccacgtctctcgcctggaggttgatttggcaaacaacaccgcccgcatcgaggtctatgtggaccacaaggttgtcgcgctcgaggtcaaggtcgaggaggtgtgcctgggcaggcacaaggaggcccatgcttggcacaccacccacgccaaggagctcgccgacctcagctccagcattctcgccctcaagacagcagcgcatgtggccgaggtgagggctgccgaaaatcatgtccagggtctgcgggagatcggcaaggtgtcttggaggggtgtgtcttgtgtgacagtgggtctggggccatgacctcacgtttgcatcattcagtcggcgtcaa

SEQ ID NO: 28431 - DNA, 717 bp, Triticum aestivum
  Clone ID: PAT_TA_28431
ctccgccccacccctctctctctcccgctcgtctctccctcgcgtgagcagctacagctgccgattccggcgagctccggtgggattcgacggcgcccagcacacccacgtgaccccctccccccgctcctccatctcctccgaccagatccgacgcgcgcgtgggatcagatgttgctagtggtagttcggggcgtgcgggcggaccagatcgacctcaagaccctcgacgagcagctcgaccgccacctcgcgcgcgccaggactgggaggccgaccccgctaggctcgtcgtccgaggcttcgtcgcgcgcggcaccttcgacaccgtccaccgcggcatcttcgacggcctcgacgtcgcaggtttcttcgtcatgatctggattgccgcagtcatgttcaagtccaatgatatcttgcgcaagcagaccgctctcaagatacaacggtcctgcatgctgctatggtggtcaagtgtgtgctgcctaggaaaatagatatttagttttaggtcatttcttgtatttcagatatggagtgcttgtctttagtttttgtttttacttcgtgaaacttgttacctatggatgaaactgtgtaatattggtgaaaccatgtatatgtattgatgaaacttgctactattggtaacatgtgttggatatcctatattggtcatatatatatatgtgtgtgtaatattggtgaaactaa

SEQ ID NO: 28432 - DNA, 880 bp, Triticum aestivum
  Clone ID: PAT_TA_28432
tctaaagcaaggtaatgaagttactttgcttttacgaaaacgggccaaaagtacataaacattccaacgggaaattgaggacactagtaaccagttttgacaagagcaacatctcagaacatgaaataactcagctaagaggctactagcaaaatcttaagagtacagagacttgttgcacgagtgagtcactgtaccaccatgggtcataacttggaaatcctcaacgatattggccaaagctcgtagaaggctcgccacttgatgaagactgcatacggtctttcagatatatcatatcaatgttttcttggcccgtacccggtagacttgctctcagtgtgcattgttactggcaggcaccaacagtcaacaccatcctccgagatatatgttatgatggagtcatacacgatcggaccgaaggatgtcttgccgatgtcgccaacccgatatccacgccattgaccatcccggatttgccgcttgcagagaggcttgtactggcacacactcgattcttctaaatgtcttggttctgcccttccaatgtacacctcccggccgttgatgacatggtgtgggtcagcgagggcgcggccagcatcatcggggctagagaactggacaaaggcgcagcagcagggctggcccgtgaggctgtacgtgggaatgaagatgtcagccacgtccccatagcgaccgaagtggcggcggaggtccgcgtcactggtgcctggtgccatgtcatctaagtacagcctcccgtttatatgcagcctgctaatcgctggtgtcatgctgttgtttggttggacacggggcacactcgattcttctaaatgtcttggcctcgtgccgatcactgcagcccggggga

SEQ ID NO: 28433 - DNA, 752 bp, Triticum aestivum
  Clone ID: PAT_TA_28433
cgacgtgcagcgcctggccaggtgggtggagcacgcgctacccttctccctgctcctgctcggcgtcttcatccgccagcacctgcaaggtttcttcgtgatgatctggattgccgcagtcatgttcaagtccaatgatatcttgcgcaagcagaccgctctcaagggggagaggaaaatgccaatgcttattgggattataatagtattcaccattcacgtgtttggagtctactggtggtacaggaatgatgaccttgttagacctttggtgatgcttcctccaaaagaaatacctccattctggcatgctatatttttcatcgctgtgaatgatacaatggtccggcaagctgctatggtggtcaagtgtgtgctgctcatgtactacaaaaacagcaaaggtcgtcactatcgtagacagggccaaatgttgacagttgtggaatattccctacttctgtaccgtgcgttgttgccggctcctgtgtggtatcgttttttcctgaacaaggaatatggaagtcttttttcatctttaacaactggattgtaccttactttcaaggtggcatcaatggtggaaaaggttcgatcacttttggcttcagtgaatgcgctgtctcataaggacttgcattatggttcacatgcaacaactgagcaagttcttgccgctggagatctgtgtgctatatgccaagaaaagatgcatactcccatcctcctgcagtgtaaacatatcttctgcg

SEQ ID NO: 28434 - DNA, 504 bp, Triticum aestivum
  unsure (1)..(504): unsure at all n locations
  Clone ID: PAT_TA_28434
ctccttcgcaacatcaccggcaacccagaagtcagggtcaacaagatggggagggcagcgggagtgcttgagaaccatgaggagggcaggcgctacgccgagcacggcctcagagcctatgtgcaggacaagacccccgagatcatgccaggaatcaacaagttcttcaccagcccaaaatgaagcactttagtctgtctgtgactcgcaattagtaactgttgtggtcaagtgcaaacctatttcaagcattcagtaatgttgttgcgtccataattcaagaggacatcgtcaattacctcttattgaaagaaccatgtgatgtttgatggcttgctatatatgtgatggttgatggcttctaaatatctgcttcattgagattgtggatattccatgcttccgtgtatttctgtgttgtggttgtggagactcagtggtaactcaacgattactgcagacatttgggatattgctacngctggtaaaaanaaaaaaaaaaaa

SEQ ID NO: 28435 - DNA, 885 bp, Triticum aestivum
  Clone ID: PAT_TA_28435
cttaggtctccctcctctcgcaacaacaagacgagatcaaagctcctcttcccccaaaaaagtaagtaagatagtgatccttcctagcgggcgggcgggcgggccgggcatgtcatgtgcctggcctgcttccaacttcaaagagctctctctttagaccaggtaaggttggttcatggccttgtggtttgatcgtggcaacttgcatgcatggtaacttggtttgttcgtccgtccgtccgcgagaccgtgccttttagattattattcagcttgatgattttttagatggacgagatgactttttaatattcatgatttttttttatgttgcccaactttttagattcttcttcttaatattcatgtaatcacgccgaaactactactctataattgagggggttacctttgatttcatgcaacgcactgaattacctttgatcgatcaatttagagatttgttcatcaggcctgcctaggtagctaatgaaaatatgtatgtttgcactggctaggctgggctgtgtggacactaactggtatccatttttaaatcgtagcaagtaattaaaactcattcaaggttggtcactgcacacacacagtcaaagaagaaagtaagaatgaagaagaagagcacatatatgtgcatcgtggagcctcagattctgtctataaatagcacgcccacgcccgcccaaacacacagctagcagaacacacaagtaaacacccactcagccaggccacacaaactcgcgctctagctgtaagaagatggctgaccggaaggtggtggtgatgctcctcctggctcttctgctcaccagccagctggtgatgctagccgaggccggcaatgacgacgtcctaccatccgac

SEQ ID NO: 28436 - DNA, 838 bp, Triticum aestivum
  unsure (1)..(838): unsure at all n locations
  Clone ID: PAT_TA_28436
caacagatcaatccttgtttcaattttgattccaccggacaagtcagataaaagccatccaggagcactagtatcttacagtagtagtagcagtaccattttaaccagccagcacacacacacacacacacacacttgttgcggtaaccatcctagcggtttttcagttgacaacaacaacaaaacagccagcatcatcatcatcatctggcacaaaagcacaacacactcaggggactaataggacaccgagcgaccaacgaatcaatcagcaacgcttctcgcctgctgctccggccgggggcgtttcttgactgcggccgagaggcatgcagggggaggttgacagcggaatggtgaacttttcaacatatatgtaggcagccgtcgtcaaaaaaagaagggcaaagggaaagaaaaaaactgtaaccgtgatccatgttccggtagcttctttagcttctagtagtaagtatatcttgggggtggtgttctcttttctgttgtcgtcgtcgtcgaggcgccgtgctgtgctagcaggaggagcccttgtggcacgacagggcgcccgcgccggaggtgatggtggcgaccatggatgaggacttggcgccgaggctggaggcgcgcgagtagctggctgacgcgcctgctcccgacggggtgaagaaggcgccgttcagcagcatgtcgccctctgacctccagttccaggccttccacgtggtctgggcggtctcgactctctttgtcccctccttggcnaaagggttggttggcgcggggtggcggttcccctggctgttgntggtcggctcggcgctccctccgntggcgt

SEQ ID NO: 28437 - DNA, 377 bp, Triticum aestivum
  Clone ID: PAT_TA_28437
gcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgtgacgtgggctaaataaaagtgttgtcggggccagtcgacgcccagtgtcgggtcagcagcgagcgagcgagcgacgcagcgccactcgccggcacccgtgtgcctgcgtctgctcagctggagctttgttgcggtgtgtgtcacagtgtcagttccacctatgatcgatcggtatcctatccggtttgtgtaaaaaaaaaa

SEQ ID NO: 28438 - DNA, 1547 bp, Triticum aestivum
  Clone ID: PAT_TA_28438
gaactcgtccactcgcgtctccgcaacagcagtcgaagctcctctcccctgttccccgtcgccgcccctcctcttccccaaatccgtcgaaccacaacgccaggccacgatctccgcgccccccggccgatcctcgccaggcaggcaggcgctcgttacatggattggagctgctgggatcgtgccgcggcgtaaaccctcgtgccgagctggttcgtttcggcgtggttggttggtttggtcaggtcttggtggattgagtggttcttggaggagctgtttggggaattctggaagctggtggaattggagtcgctagatcgctttagctttgtggggggttacagaataatatggtatcttggtgcatggaaggtgggcagttgggttagcataaggtggaatcagggatttttgttaggaaggagggggatgggaggcctctgctcaaaggtctctgcggtagacaagtcgccgagcgacaccgcgctcggcaggaaccaggtattcgatcatgagccggtggcggcgttgaaggaggaggagaagaagtcggtgcccgaagaggccgcggcgaagagggtggaagagcagcaggctttctcgttcttggagagcgtcgtgcccggccttgctgtgcacaatggtgcagatgccgagcacacagggtccaggacaccacaactggctcggacactgtcgcaaagggctggtctgggcaagggccaaggtttcggaaatgagcacaattttaggtagagctagcactgttggacttgggaaagctgtggaggttctagacacacttggtagtagcatggcgagtttaaatgctagcagtggctttgtgtcaagttctggagcaaagggaaataaaatttctattttggcttttgaggtggcaaatacaatagttaagggttccaatctaatgcattctctgtcaaattctaacataaagcatataaaagaagtggtgcttcattcagaaggtgtccaacacctgatatccaaagatatggatgaactacttgagattgcagctgctgacaaaagggaagagttagatgtattctcaaaagagattattcgttttggcaatcgttgcaaggatcctcagtggcacaacttggaccgctacttcgaaaagttggtgtcagaaagaacttcccagcattccctgaaacgagatgccgagaccgtgatgcagcagttgataatttgtgttcagtatacagctgaattatatcatgagttgcatgcattggataggtttgagcaagactatcgtcgtaaacatcaagaacatgatgacttgaatttaacaggtgacaatctgcatatactaaagcaggaagtgaagagccaaagtaagcatgttaaaagtttgaaaagaaagtcactttggtccaagaatttggaagaggtgattgaaaagcttgtagacatcgtccacttcttagatctggaaatttatgatgcctttggtcatgctgagagtgaagagccacaagaacccgtgaaacgccaagtcgacgcggccgcga

SEQ ID NO: 28439 - DNA, 737 bp, Triticum aestivum
  unsure (1)..(737): unsure at all n locations
  Clone ID: PAT_TA_28439
gcacgaggcacccatccatagctcgcggcggcggttgaccatgtcggcagggagcgagcgctcgaacgcggcctacgcgacgccggcggcggtgctggcggacttctcgcgcggatccggcccgtccgtctccggcggggccgccggcagcgtcagcggcagcgggacgagccaggcggagggcggggcgaggaggaagccctccttccgcctcgcggcggacgacaccaagcccatcctccgcgacccgatctcgcggtccgaccccgtggagaccgagcaggccgtgctgcgcctgccgcccttcccctgacgccttgatgatgacggtacgctgccctgcccctctgtacggtgtacgcggcatcttgtgattctctctgtgctacacctgcgcttcagtgtttgtgtgtgaactaagtgactgttaagtcatgagtgatcagggttgtgtgggcagaataatcatgtgtccaacaattaggcatgcttcgctcgttttaggtctcctcctctgcttttaaattttttggcaagcatgtcaactaagaaaaataggagtaattttgtgcctctgccttctgattcgtacagacacagacgctcaatgttggtcgactgctaacgttgatcaattattacagtanaaaatggaacgacanacacattgtttgtagtgtaaccccgttgtaangttgctgtacgtccanagtctataatacnncaaaaaaaaaaaa

SEQ ID NO: 28440 - DNA, 840 bp, Triticum aestivum
  unsure (1)..(840): unsure at all n locations
  Clone ID: PAT_TA_28440
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggctggcccgtaggggcggcgtgaagcgcatctcggggctcatctacgaggagacccgcggtgtgctcaagatcttcctcgagaacgtcatccgcgatgccgtcacctacaccgagcacgcccgacgcaagaccgtcaccgccatggacgtcgtctacgcgctcaagcgccagggccgcaccctctacggattcggcggctaggccaccaccagatcagtagcctgatagtcgggtgtagtcgcagcatctcgctgctgtttgtcctgccttgtttgttctctggatgtacttctgtactaggangaangaaattg

SEQ ID NO: 28441 - DNA, 1164 bp, Triticum aestivum
  Clone ID: PAT_TA_28441
attcggacgagggccggcgactcggcccgggagccctacatcgtgacgcacaacatcctgctggcccacgccgccgccgtccagctgtaccggcgaaagtaccagaaggcgcagggcggcgagatcggcatcacgctggtgtgccactggtacctcccctacagcaactccaccgccgacaaggacgccgccaagcgccgggtggagttcatgctggggtggttcatggaccccatcgtgcacggcgactacccggcgtccatgaagagctggctcggcgcccggctgccgagcttcacccgggagcagaaggcgatgctcaaggggtcgcacgacttcttcggcctcaactactacaccacctactacgccatcgccacgcccgccccggccaacgcgctcctccgaggctcctacgacgccgacaaccgctccaacgtcaccggcttccgcaacggcagggccctcggcccgcaggcctacaccgagttcctcttcgtctacccgccgggcatccacgagctcatgctctacgccaagcgcaggtacggcaacccgcccgtctacgtcatggagaacggcatcgacgagggcaacaacagctcgctgcccatcagggaggcgctcaaggaccccgccaggatcaactaccactacaagcacctcctcttcctcaacctcgcaatcaagcagaaggtgaacatcaagggctacttctcgtggacgttcatggactgcttcgagtggggcgacgggttcaaggaccgcttcggcctcatctacgtcgaccgcaacacgctcaagcgctaccccaaggaatccagcaaatggatgggcagattcctcaagaaatgatccatgatccatctgcatgcgcgcatggctggtcttagctcaggtggcgttcgtttttagtatctgcatatgctgcgtgcgtgcatgatttgtgtgttgtgagtttgagtcacggtgacagtgtcggcgttattaacagtacttgaagatgtttagtgctgttaattttaattttaattttatttatgcggggggtgttgagcatgagtcatggctgtgaataagcgtctgccgcatttggccgttgatcgtccgaagaaataaaaaaaatgagattgaggattgttttcaaaaaaaaaaaaaaaaaaa

SEQ ID NO: 28442 - DNA, 755 bp, Triticum aestivum
  Clone ID: PAT_TA_28442
cacggacttgacatggcaagagtacattcatacgagttaacaggggcacgacggcctcaaaagtccattcacttcgtcacggggtggggtgatacttttggctggttatttaggtgataacggttctggctcggcgcatccatggtcaccagctggccgtcaagctctagcccatggcgtacttctgtgtccaggagcgcgccgtggactcatacttggccctatcagtcttgtacatgtgagcgatctcgggcaccagaggatcatcggggttcgggtccgtcagcaacgaacagattgacagcaggacctttgatatggtcaaagccgggctccactgttccttgagaatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcaggcttaatctttgagacaagcatatactacggccctcgt

SEQ ID NO: 28443 - DNA, 1061 bp, Triticum aestivum
  Clone ID: PAT_TA_28443
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaaggaaggcagcaggcgcgcaaattacccaatcctgacacggggaggtagtgacaataaataacaataccgggcgcattagtgtctggtaattggaatgagtacaatctaaatcccttaacgaggatccgaccaccaggccaccccacaaacggcccgatgaatccaggtactcggaagcatgaggccgatggcctatcactgcagatctggctcgggctgagacttaggggatgaaggatggcgaccagacaagcaccgatccggcgagctcttctccaaatcgttttctttcctcatttttctctctgaaaagtttcctcgattttttttgtacgaggtcagatttgtggtgttcaaatctgttttttttcgacgaggacaaatctaggaaattagcggggtttccatgactgtgatttgcaattttcaccttcagaatttggggtgaactgtcctggtcttatctgaaatttcggtgattattcagtgcattttaatccgtgaaattccactctgttgatggatctgtaattacaattatttcttgatgcatcatagaacaatgtcatgaagtattatcactgtcagtgttgtagatttgctgatggatctactgtcttggaatgtatttgctgacgaatcatgttgtctaaaatgtactgtatg

SEQ ID NO: 28444 - DNA, 503 bp, Triticum aestivum
  Clone ID: PAT_TA_28444
atctccaccgcagctaccacaaagacaagtcgacctcaccgagaggagaagaaaggagaagcgagaagaatgtcgggccgcggcaagggaggaaaggggctcggcaagggcggcgccaagcgccaccggaaggtcctccgcgacaacatccagggcatcaccaagccggcgatccgtcgtctggctcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccatcgccagattagagtgtctagggttcgtggtcgttgatgtaatcgcagtatctcgctgttgtttgctatcttctgtagaatcgaatggaatggaaattggagtttattggag

SEQ ID NO: 28445 - DNA, 786 bp, Triticum aestivum
  Clone ID: PAT_TA_28445
cccacgcgtccggagaaggccaccaccaccgtcgccgtcgtccttaattgttcctgcgtctccccccacttccttccaaacagcggtgacctcctccaccatcaccaccaccacctgtccacccaagaggaagagatcgaccatggctgcggacggcgagaggtgggtgggcctggcggtggacttctcggaagggagccgcgccgcgctgcagtgggcggcggacaacctgctccgcgccggcgacaacctgctcctcctgcacgtcctcaaggaccccgactacgagcagggggagaccctcctctgggaggcatccggctcgcctttgatccccctctcggagttctctcacccttcaatcgcaaagaaatatggggtgaagcctgatgctgaaacactggacatgctcaacaccatagctaagcagaaggaggttgccgtggtttccaaagtcctgttcggagatccccgtgagaagctatgccaagccatccatgacatgcccatcagctccctggtcattgggagcaggggccttggcaagctcaagagggtgctcttgggcagcgtcagcgattacgtcgtgaacaacgccgcctgccctgtcaccgttgtcaagccagcgagtacccatgcctgatctcatcgtcgaaaaatccgcatctggttttagtttgtcgagtcctattatccagttggtcgcaacttattgaaccatgcagtgttgtttgtaataataattgacaattagcctgtggatgattcccaggttgtgtaatccgc

SEQ ID NO: 28446 - DNA, 987 bp, Triticum aestivum
  Clone ID: PAT_TA_28446
ctttttcatgtacaggcctacttataaagatctcacatctccgtcgtatgaagaaagtgagacaacacgacggagatgtgagatctttttcatgtacaggcctacttataaagtggcataaaactggtacgcctgttattctgacttcggccagtttggttagaagtcgggttgatgaaaatgagattgatgagaaactgaagattaaggtacttctcccaccgaaacaggtcgttgatgggacactggaactgtaccattcagattataacattgctgtcatcagtcttcagaagcctctatatggtattcggccagagtatattttccgcacggcgaaaaggcctccaagagtagtagctatagggcgtggggctcaggatggattattgatggggacaattggtaaagcggtcaagaagctcgcaggcgacaaacttccttgcgaagaccttaagctttctacttgtaaaatcacgaaggttgggattggagggccacttgttaatattgttaatggattgtttgctggcatgaacttctatggtgaaactgatgtaactccttacctgccgagggcaatcattgtggaagttttaagcgggactgatctcccatctcataaaggaatggaccatgccactgacataatgggtgccgcaacagttaagaaaaacaggtggcgggtgcctaagccatattggtaccatcccctatttgaagatcgtcgtcctctacatttttatggaaggcaactccagtaatcctatctaccgctgcgccagttccactgcctagcaagtattttatcgtggtactttgtagatttatcacattattagggtgttctaatggttctgcataaaactttatattaagcattagaacggctctgcagaagttgaagctgcagacactaatctggactgttgtcaccttgactttgtttgacatcgacttttagttgttattatcacgcatgtggtc

SEQ ID NO: 28447 - DNA, 613 bp, Triticum aestivum
  Clone ID: PAT_TA_28447
accattagccgccgccaccacagctcctcctccatttccatcccagtcaactccatcaaccatgtccggccgcggcaagggagggaaggggctaggcaagggcggcgccaagcgccaccggaaggtgctacgcgacaacatccagggcatcaccaagcccgccatccgccgtctggctcgccgtggcggtgtgaagcgcatctcggggctcatctacgaggagacccgcggcgtgctcaagatcttcctggagaacgtcatccgcgacgccgtcacctacacggagcacgcccgccgcaagaccgtcaccgccatggacgtcgtctacgccctcaagcgacaggggcgaaccctctacggattcggcggctgacctgcgcccgctgctccaatctccatctgctatggtttcgtttctgagtgcgtgcgtgcgttgctgttccatcggtctgtgtagttagtggatggcgatggatctgaatgtaatggacttgttggttcttgcaagaaatgaatctgaattcaatggaagttgtactgcatctcgctatgattgtaccttctggtttgttcctgtacattctgaaatttatcagcaagtaattttcgcttc

SEQ ID NO: 28448 - DNA, 888 bp, Triticum aestivum
  Clone ID: PAT_TA_28448
cactcgcaggggccaaccactgccagagcagagcgtcttcgtgccgtttgagcaacggcacagctcgggagatcgggcggcggaagagggaaagcacccccggggttgagctggttgccgagatgagctacaggatgatgggcgaggaggaggaggacgccttcgaggcgtcgtcgtgcgcgtcctccggcggcgagtcgggcgacgagggggacaggttcccggccagcgggggcgcccgccgccagtccgcgccgccgcaggcgccgctgaggaggatgaactcggacagcatctacgacatgtccggcatgacggcgcacctccccgccaagaaggggctgtcggcgtactaccagggcaagtcgcagtcgttcgcgtgcatggcggaggtgcggtgcctggaggacctgcagaagaaggagaagccgcgcgggcacaagatgaagccctgcaagagctacgccgcgctggggggcgtggccatggccaggaagccgccgggctcctcctgcgccaacctcggcctcatggacgccggcaacggcttcatggcgccccggaacatccccgtcaacgacgactgctaccatcagtaggttcagggtctatttctcgggtcatcaggcctcttaaaatgttcatcttcttcttccccgtttctgctcttcttctcctcgtccttccgcgggagctctgcttgtttgcaggcgcattagtctgcgaatgattcatgggaggaacttctgtgttcgtgtaagggttgagatagatgttgtgatgtaaatacggagtttgtttgtaactgtactgcgaaaacggggagcagatacgggaggtgcgccgtatttatctgctccccgtttttatcctggtaaaaaaaaaaaa

SEQ ID NO: 28449 - DNA, 843 bp, Triticum aestivum
  Clone ID: PAT_TA_28449
tcgccatggagtcgcagaccatccgccacatgatcgaggacgactgcgccgacaacggcatcccgctccccaacgtcacctccaagatcctctccaaggtcatcgagtactgcaacaagcacgtccaggccaagcccgccgacgccgccgccgccgccggggccgccgcgcccgacgcggcggcgcccccccgccgaggacctcaagaactgggacgccgagttcgtcaaggtcgaccaggccaccctcttcgacctcatcctggccgcaaacttccttaacatcaaggggctgctggacctgacctgccagactgttgcggacatgatcaagggcaagaccccggaggagatccgcaagaccttcaacatcaagaacgacttcacgcctgaggaggaggaggagatccgcagggagaaccagtgggcctttgagtagaggcggttgagtagaggagcatgtaggtgatgctgtccgtgctggatgaacaatgcttagtattcgtcatgtctgcgttttagcgccctttgttatgtcatcataatggtttcatcgaacagcccgaggtatcgctcgtgtgaaaccctgaccctgtcgtctgtcgttgtttgctgtggcgtaagtgtgtaaacttgtggcccccctgtcgatgaaaaggcccttctgcctcctcttgctttgctccgctgatcccaaatgtggccgtcaacgccattggttcgctgcaactaaacatatctctagctagcttagattctaaccccaatcgtgctatcaattatggagcctaagtacccctgcacatgtgtgtttatatacctcaagcatatttagtattttcat

SEQ ID NO: 28450 - DNA, 794 bp, Triticum aestivum
  Clone ID: PAT_TA_28450
cccgcactcacccaccaaagctcccagctttccccccttcctccgccgccgccgacgccgacgcttcctagggtttcgtcccccgatccggatcgggcggcggcagcagcagcagcagcagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgcggccggagccggagcctcggacgcctccgccgccgcccccgccgcccccgccgaggacctcaagaactgggacgccgagttcgtcaaggtcgaccaggccaccctcttcgacctcatcctggctgccaactacctcaacatcaaggggctgctggacctgacctgccagactgttgccgacatgatcaagggcaagaccccagaggagatccgcaagaccttcaacatcaagaatgactttacccccgaggaggaggaggagatccgcagggagaaccagtgggcctttgagtaggggagcatctaggcgatgccgccgccgccgccgcgttgaatgaacgaacaatgcttagtattggtcatgtctgcatttcagcgctcttctttatgtctgtcctaatggcttgtaattatcctggagtctatgagtg

SEQ ID NO: 28451 - DNA, 1179 bp, Triticum aestivum
  Clone ID: PAT_TA_28451
gacgagggaggagatgagaggcgcggcgccgcggctgccaccgtaccgccgccggaggagagaggggagaaggaagaggagccgtacccgtccgcttgctccgcttccgccggacctatcgacccgatggactcggagcactggatctcgcgcctggcggctgcgaagcgcttctacgcggcgcagctcggccacagcgatcgggcggggatggaggagctggacatggacgaggaggtcaggcccgagttcgcctgcccctactgctacgaggaccacgacgtcggatccctctgcgcgcacctggaggaggagcacccgttcgagccccaagccgcggcttgccctgtctgctctgagatggttacgaaggatatggttaaccatattactatgcaacatggatatttattcaagaatcgtcgccggttgcgcagattcatcattccaggcagccaggccctttctttactgagccgagatctacgggaagcccatttgcaggtgcttcttggaggcggacatagatcaagcaacaataacagcaccacaaatatttcagctgatcctcttctgtcatcattcggccttagcttccctacatcagatgcagagcaaacatccaaatcgactctttccattcctgatgatgctacgatgataaaagaaacgcctgctcaggcacggaagttaagtatcgattcgtccctcaccagtgaagaaagggagcagaaacggaagcaagccagcgtcagagccacattcgtgcaagacctgctgctctctactctattcggggactaataaatcaggatgagccaagttatcactggaagggtgcttcccggtgcaggtctgcagagactagcgtgctccacccaacttgctgaattcctcgacggaacatatgcgcgcatccggggtgctagcctttcgtcccttccagtgtggtgcagaatcgatgtgggcatgatgtgtcttctaagttattgtaagccggtctctctatcctcagttccttcataactgacgatcagcatgtgatatgcatgcaagtcgcggttgtgcgtgtacctcatctgtgtctgaactctgaagcattggtttgttgtaccaacataataataataatgttacaacaaaaaaaaaaaaaaaaaaaaaaaaaaaaaaaaaaaaaaa

SEQ ID NO: 28452 - DNA, 500 bp, Triticum aestivum
  Clone ID: PAT_TA_28452
cccacgcgtccgactgtctccacccaattccatctgctcggagctccaagccgccatcatgtccggccgcggcaagggcgggaagggcctgggcaagggcggcgccaagcgccaccggaaggtgctgcgggacaacatccagggcatcacgaagccggcgatccggcgtctggctcgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcggcaggggcgcaccctctacggcttcggcggctgatctgctgctgctgctccgtccagtctctgccagctcctgttccatctgagtgtgcgtgttgctccgtcgttctgtgtagtagtggatgccatgagtatggatgcaatgaaatcagagttcttgccgtatt

SEQ ID NO: 28453 - DNA, 512 bp, Triticum aestivum
  Clone ID: PAT_TA_28453
aggtcaaaccgccggattcaaccaacttcacggttgctcgagggccctgcagagttcccttatagcctccaaaattactggcgaaaaagtccctaggactaatttcaggagtgctacttctgcctcaagaggaaaagcccatggctaattcaaggcaatcgctgttttggcgagacaaccatggcgtgtttgtacatatcggtagcttgccgagtatggaagcaaaaggggataggatttgagtgaaggcttttggagctggtgtgtgtgatgtactataaaactagcttaagttagtgtcttttctctctttattgcactggacagtattattgtgtcgtaggattagccattaatcacccccaaaccctccgtttaatccgtatgggatacagtgccaagggagaaaaacgacggggtctgggcttaaacttactcatcaacggttgtactttaccttctctcgagtaccagccccatgttggaatgatcgactggtgcttcttggttcc

SEQ ID NO: 28454 - DNA, 652 bp, Triticum aestivum
  Clone ID: PAT_TA_28454
cgggttgtttgggaatgcagcccaaatcgggcggtagactccgtccaaggctaaatacaggcgagagaccgatagcgaacaagtaccgcgagggaaagatgaaaaggactttgaaaagagagtcaaagagtgcttgaaattgccgggagggaagcggatggggcacaacgagatgacggtgccgctgacgtcggcggcgatccgggaggtggacgtggtggggatcttccgctacaaggacacgtggccgctgtgcctcgagttcctgcggagcggcaagatcgacgtgaagccgctcatcacgcacaggttcggcttctcgcagggggaggtggaggaggccttcgaggtcagcgcgcgcggccgcgacgccatcaaggtcatgttcaacctctagacatccaggctgctactgttgctagggattcaagccatgcttggactggagctgcgtgcgtgcatgccagcgtgtccgcgtgcgcgcggtgtgttgtgtgtcgtgaaacaaaataaaatgactgtgcagactgatttctatcgtgaaactgggatgtcaaagttagaagggagagagggatttgatggaatagttgttgtattgcttgagtctcgcgggcatatatatagaagtacaaagatcaaaaaaaaaaaa

SEQ ID NO: 28455 - DNA, 1161 bp, Triticum aestivum
  Clone ID: PAT_TA_28455
tgtgggagctcgtgaagaaaaacactgcttcttgatcaagcagttcggcaacagcaacgccaaggtgcagttcagcaaggagccaaacaacctctacaatgtccactcctacaagttctctggcttggcgaacagcaagaccgtggcggtccagccatcagcgggagaggacaaggctgtcgtcctgtccacgaccaagaccaagaagcagaacacccctgccaagctccagcacaagactctgatgcgcaaggagttccgcaagatggccaagtccgtcaagaaccaggtattaactccagagttttgtacctgaattgcacttatgcttggcttctaagctacaactcttgtctgttcacatgctttacacatgtactgtaagatttaagatgtatctctgtcaagctaagtctgttttggtcttcgggtttcattggtgagtcattggtgagccaaggtattgctgtgatgagccgtaacacttcagaagtcccaaccgatcaattgggttcttccagtgaaatattcatttacgcttggcttctgagctttacttgttaaagaatctgttttatttgtgtgtttgtgttttaattttgctgaccaaatatttgctgtgatgagccgtaacacttcagaggacccagctgatcaattgggttcttcagtgaaatattatatttacgcttggcttctgagctcaaccttcggatcagttttcctgttattcatctagattattgtattgcgcttaatcagaagaaaattccattaccttctgatttgaacatgtcctgagaattgttctgctttaatgggttgttcctttgccctccaggtctgcgacaactactacaggcctgatctgaccaagccggcccttgcaaggatgagtgccgtgtaccgcagcctccaggtttccaagtctggaatcaagaagaagaacaggcagccaaataagctgtaaactcattgagattgcctttcagcgctcatgttaccatgtctccccccccagttttgagtcataagtgagacccttggaggaaccatgttacaaacccgccctagtttgtaccctgacagtgttagaagaattgtttgtgtcgatctataattattgtttgatttgccctaaaaaaaaaaaaaaaaaaacaa

SEQ ID NO: 28456 - DNA, 769 bp, Triticum aestivum
  Clone ID: PAT_TA_28456
gctcctctgctctccctcgctccgatctggagaactcctccgaggaggggaagccgccgcccccaacctctctctccgactttgatccgctgccgctccgatcctcacccccaccgtcggcgaccctcacctagtccggccccagatcgcgaaggcgctcccagtccggcgacggccgtgcccacgccgatctggaccaggattcctcatgcagacccggtaggcggccagcggcaggatgaaggccaagacaggctcccgcaccggcgactcccttgctgctggcggcaggatgaaggccaaggcaggctcccgcaccggcgactcccttgctgctggcggttggatgaaggccaaggctcgcggtgaagaagagcaaggccgacaaggaccccaacaagcccaagcgccccccgagcgccttcttcgtcttcgcaggggcaccttcaggaaggagtacaaggagaagcacccgacatcatgcaggtctctgtggctcgaaggaggcagtatgcaaggcacctcctgatggatattgcttgctggcctctactttttgaatgcttgtattgccgctacttgtgccgctattccaaaagttatgtatttgtgaacataggagataagttattaatatgtgttggtctgtctaatgttatgcgagataaagttgtgtgagaaagttttctatacttgtgttattactgtgggaaagaagtactgttactatactgatttgagaatattgggtgtaaataaaagagggctt

SEQ ID NO: 28457 - DNA, 441 bp, Triticum aestivum
  unsure (1)..(441): unsure at all n locations
  Clone ID: PAT_TA_28457
tctcgccggnanaaagaagcgtcgacgatgtccggccgcggcaagggagggaaggggctgggcaagggcggcgccaagcgccaccggaaggtgctgcgcgacaacatccagggcatcaccaagccggccatccgtcgtctggctcggcgtggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccagattcactagctagccatcggtcgtccgtgttcatggtctttgttgtaatggaacggccgcatctcgctgctgtctgttgtttcgatgtagtactactagcatggaatggaaatctcagcgtttttacccctgaaaaaaaaaa

SEQ ID NO: 28458 - DNA, 643 bp, Triticum aestivum
  Clone ID: PAT_TA_28458
cccggtcgacccacgcgtccgcaatcgtctcgattcgccatggccgccttccgcctcctcttcctcgtgcttgccttggccttcagctgcaacagcgctgtcgccgcaacggttgacaaccagccgctgccgcagcaggaggcctgcatggcatccacttcttcctcgtgcccggaagccaccgtcgacgccaaggcgctcaaggaggaggccagcttgatgtacaaggagaaggtcggcgcgttcttcagacatgatggtcgcaacatccaggtcgacttcgtcctccccgccagcaacagcgaagtcgccgttggggacgaggacctgcagctgaggcaggaggccatggcgcaggccattaccgtgctctcccgccacagtccagagaccaccgacgccaagacgctcaagcgggcgatgggggtggtgaacctcgaggcccagcggtggaagcccatcttcagggccgtcaacagggtgctggagagcggcgccgacgaccgcaccaaggaggaggcgttcacccaggccagggtgcagctcaaccgcgacctcggccaagaaggtcccaacgccctcaagctcgacttccgctttctgtgacatgcatcgccaattcgccacctctgccttaatttct

SEQ ID NO: 28459 - DNA, 861 bp, Triticum aestivum
  Clone ID: PAT_TA_28459
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaagtcgtgcagcgcggcgaggggcggccggacgtacaactccggcagcgaccgcgtcacgctcgcccgcggcaccaactacttcatctgcagcgtccccggccactgccaggccggcatgaagatggccgtcaccgccgcatgatccgtctctccgtcgtccatcgccccgccggccggccggtgcttattaattaactttagtttactttccatcctcgagtgaccgaagctactgcatggtgcgtagtacgtgttcaataaaatgcccgagttcgtgggggttgggccgtctggccggttggcactagctagagagagattaatatactctgttgttccggttgtacgtgctttaatgcttgtataccagaattttgagttgttgtgt

SEQ ID NO: 28460 - DNA, 655 bp, Triticum aestivum
  Clone ID: PAT_TA_28460
cacccattcactcgcggcggcggcggcggttgttgaccatgtcggcagggagcgagcgctcgaacgccgcctacgcgaccccggcggccgtcctggcggacttctcgcgcggatccggcccgtccgtctccggcggcgccgcgggtaccggcaccggcagcgggaggagccaggcggagggcggggcgaggaagaagccccctctccgcctcgcggcggacgacaccaagcccgtgctccgcgacccgatctcgcggtccgaccccatggagaccgagcaggccgtgctgcggctgccgcccttcccctgacgccttgacgatgacgcaccagcggctctttggggggaggaagctgctggaggttgatcttgacttgatcgtagccaagatggtggagctggggaagtggtgttgtgctgccctgtgcccctgtgtccgttttggtttaatatcgtttgccactttttaggtgtcccctggactatgtaatggattctgcattctgcggctggtgctgcctagattgattctatgttctttagctctacctggaagcagctaatagtgtcaacaaaaagtttggctgcacctaggatgtagtggaaatctgattgcttgatatctcatggaagcaccgaatggtgccacgaacc

SEQ ID NO: 28461 - DNA, 689 bp, Triticum aestivum
  unsure (1)..(689): unsure at all n locations
  Clone ID: PAT_TA_28461
tcgaccccaagcgcggcgacctcggggtcatcgcgcccatcgccatcggcttcatcgtcggcgccaacatcctcgccggcggcgccttcgacggcgcctccatgaaccccgccgtctccttcggccccgctgtcgtcaccggcgtctgggagaaccactgggtgtactggctccggccccttcgccggcgccgccatcgccgccctccgtctacgacatctgcttcatccggccagcggccccacgagcagtccccaccgccgactactgaaaactcactctcaatctcatccatccatcaccgccatgagagattgaaatccgattccaaaaaatccagcaagtgtactccgtccgtgtcatcatcaattagcatttaattcatctctctcctctctctctctccgtgtctttggagaaattcaagggtaaacatgtgancaatcatcaaggaatactcttgtcttggggtatgtccccaattatgaatgctccatccaagggcaagatgagtttgtanaaagggggggccggtaccattcccctataggagcgtttacgcgcgtaatggcgtcgttaaaactcggacgggaaactggggtaccantaacccttganaaacccttccagtgggtanacaagaggcccacgttgctcaantgcnactangnaaggaccccntgggaata

SEQ ID NO: 28462 - DNA, 850 bp, Triticum aestivum
  unsure (1)..(850): unsure at all n locations
  Clone ID: PAT_TA_28462
aactcaccccgccgccacctcccgatccaacactgcccaatccaaccagacccgatccccacgcgcattccctccgctccccgccccggatccgaccgaccgaccgaccgcgccgcgcgaccgccgggagagcatggggagcgggggcaggacggatctggacggcggcgccgtggcgccgctgaccatctgcgtgatcggcaccggcggcttcatcggctcgcacctctgcgagaagctcatggccgagacccagcagacggtcctcgccgtcgacgtctactgcgacaagatccgccacctcgtcgacccgcccccgccccacctcgccggccgcatctccttccaccgcctcaacatcaagaacgactcccgcctcgagggcctcatcaagatggccgatctgacgataaacctggcggcgatctgcatgccggcggactacaacacgcgcccgctcgacaccatctacagcaacttcatcgacgcgctccctgtggtcagacttggagaacagcaagcgtctgatccacttctccacgtgcgaggtctacggcaagaccatcggcagcttcctccccaaggaccaccccctccgcaaggttatttgcatcttgattaggagatgatggtgatcatcttttgttgcgggaacctgttagataaagtttatgtgatttgaacctgcaagatacagttttgtataatgttgtgtgagataaaagttgtgaacataggagataagttattgatatgtgttggcctgtctaatgttatgcgagataaagttgtgtgagaaagttttctanacttgtgttattactgtgggaaagaagtactgttactatac

SEQ ID NO: 28463 - DNA, 1091 bp, Triticum aestivum
  Clone ID: PAT_TA_28463
agcagcaatggcggcggtgcagaagtacacggtggcgctcttactcgccgtcgccctcgtggcggggccggccgtctcctacgccgactacgcccccggcgccccggccacccccgccgccccagggacccagcccaaggcgacgactccagagcagaagctgatggaggatatcaacaacggcttcaaggcggccgtggcggccgcagccggcgtccctgcggcggacaagtacaagacgttcgaggccagcttcagcgcggcttctaacaaggcattcgcagatgtcctcaaggccgccgcctccggccagatggccgcccagtcagcctccatggcctcactctccaagagcctcgaagcctcctacaagctcgcctacgacaaagcccagggcgccacccccgagaccaagtacgacacctacgtcgccagtctcaccgagtcgctccgcgtcatctccggcgccttcgagatccactccgtcaagcccgccgccgaggaggtcaaggggatccccgccccccagctcaagaccatcgaccagatcgacgccgcctacaggagcgccgccaccgccgccgacgctgccccggtcaacgacaagttcaccgtcttcgagtccaccttcaacaaggccatcaaggagaccacgggcggcgcatacgacaactacacgttcgtccccgcccttgagtctgccgtcaagcaggcctacgccgccaccgtcgcctccgcgcccgaggtaaagtacgccgtctttcaggccgccctgagcaaggccatcaatgccatggttgaagccgagaaggatgccaagcccgctgccgctggcgccggcgccgctgccggtggctacaaagcctgagctcgccaacaacacacatccatcacgcacgcatactatgctttgtatatatgtacgtgcgtggccttggcggccagggattttcgtgatgctttcgtttcatgcagccgcgatcgaccgtttgtgcatgtgcctgtaataataacaaaatatttgtaatctttttttatgaattggtaatccccatgacaagcgggatcatcaaatcggcaaaaaaaaaaaa

SEQ ID NO: 28464 - DNA, 517 bp, Triticum aestivum
  Clone ID: PAT_TA_28464
ggggagcaaaacaaacgattcaatccaatgcgagatgaacacccatattagattctggaactcattacaagcaccagcacgcagctgcacacacaggacagcacaccacagaacgacgacccgcctaaccacatctaaatcgatccgggctcagccgccaaagccgtagagagtgcggccctggcgcttgagcgcgtagacgacgtccatggcggtgacggtcttgcggcgggcgtgctccgtgtaggtgacggcgtcgcggatgacgttctctaggaagatcttgagcacgccgcgggtctcctcgtagatcagcccggagatgcgcttcacgccgccccgccgcgccagccgccggatcgccggcttcgtgatcccctggatgttgtcgcgcagcaccttcctgtgccgcttcgccccgccctttcccaggcccttgcctcccttgccgcggcccgacatggctggcgatgctagctgctccgaaggtgggattggaggggattggggaattgtt

SEQ ID NO: 28465 - DNA, 615 bp, Triticum aestivum
  Clone ID: PAT_TA_28465
atctcttctccccgccgccgccgcctcctcctcctcctcgtcgccgctccccctcccgccgccgcgcaaccgccgtcagccatggcaccgaagaaggagaaggccccggcggcgtcctccaagccgtccaagtccggcggaggcaagcagaagaagaagaagtggagcaagggcaagcaaaaggagaaggtgaacaacgcggtgctcttcgaccaggccacctacgacaagctgctcaccgaggtccccaagtacaagcagatcacgccctccgtcctctccgagcgcctcaggatcaacgggtcgctggctcgcagggccatcaaggacctgatggagagggggctcatcaggatggtgtcgatccactcgagccagcagatcttcaccagggcgacaaacacctgatttacctacctcatgtgttagctgcctgttttctagtccagtagactgagatgtcgctgttatattgacgttcattatgttcagcgaggcactttgtgggtcttgtcttgcgctcatgccacaagtatgtttgaattgcttttgagtttttggtacaatctaagacgcaatgaaatctaccttatattatcagactctgtttgtagc

SEQ ID NO: 28466 - DNA, 425 bp, Triticum aestivum
  Clone ID: PAT_TA_28466
cgtccgctcgcctccgctcctagggtttcccgccgcgcaccaccaccaaaaccctcgctccccacctccccggcgatcggaccaatggcggcggacgcggcatcggcggcggtgaagaagctcacgctcaagagctccgacggcgaggacttcgaggtggaggtggcggtggcgatggcgtcgcagaccatcaagcacatggtggaggacggctgcgccgacaacatcatcccgctccccaacgtcaccgccaagatcctctccaaggtcattgagtactgcacgcagcacgccccgaaggcagatgacgccgcccgccgccgactccgccaccgcccgtcaagcccgacgaggagaagctcaaggcctacgacgtcgagttcgtcaaggtcgagcaggcgactctcttcgacctcattctggct

SEQ ID NO: 28467 - DNA, 970 bp, Triticum aestivum
  Clone ID: PAT_TA_28467
aaactttgcgatggcttgtccctattgcccataatacgactgagtacttattatcacctatgacctgttctttttaattacaaaaactatccatatctgatgagaatgtgattatctattcatatcagggcacaccacggctttggttgggttggagagtgggcaaatacaggatctgagctgagctgcaagctatcaggacagatggacttgacccggatcgagacactgtatcatgctgagaaggacaagactgaagcacatatccttgagcttgttgtgtggcttcatcatctcatcagtaaatccagaacagccaatggagatataaggtctcctatcaaatctcctgtccgttcaccgacacaaaagggtcatacaattaggttgcagctggacccagcgaacaattcatcgccgattctcacaccaagaggatcaggatatgctgaggtgtgtcaagtacaggaaattcgtccctgggataagcaaaagtcaagaattcgacacgaagtcaaggcacgacaaacatagcagattgtgcaagagcaatagccattctccaaccagtggaaacaggaaagatctgctatcatttaggaggttctccatgctccctgtcatagacttcgagattgataggacaaaggctttggatttaattgacaggcttgatggtctggaaattcagtcaggaatcaactgaaagaaacgtgaatgaacctggatactgtgtagtcatcttttatcctgaaatccatagctctggcaaggatgtaaaaagtgcaaggccacccgtccgaggtgaaggcctagcagtatgccaaactgagagtaactggtgtagcaaacattgtattatataccatgttctgaacagaggagcggagttattgtaaaaactatctaatgtttagttgcttgtataaaacacaagttttgaagaaaataggatatatgtgttgtgaat

SEQ ID NO: 28468 - DNA, 590 bp, Triticum aestivum
  unsure (1)..(590): unsure at all n locations
  Clone ID: PAT_TA_28468
ctctctctctctctcattttggtaagcaagccgtgaccactgcacttgcactgagcctcctctctctctcggccctccccttatctcatacggccgacgcatcctagcaacaacaagacgagatcaaagctcctcttccccgaaaaaagtaagtaagatagcgatccttcctagcgggcgggcgggcatgtcatgtgcctggcctgcttccaagttcaaagagctctctctttagaccaggtaaggttggtccatcgccttgtggtttgatcgtggcaacttgcatgcatggtaactcggtttgttcgtccgtccgtccgtcctcgagaccgtgccttttttagattattattcagcttgatgattttttagatcgacgagatgaccaacctcatgaagttttttttaatgttgcccaacttaataaattcttcttctaaaatcctggtacaactcaaacacnaccaaaatnaggggtaccttgattaancaagcanggaattccttgtngttattaaatngtaacagcnccaagacaagaaatntagttcaaggtgggcggcggcgttganaaggtcanttaatgacat

SEQ ID NO: 28469 - DNA, 589 bp, Triticum aestivum
  Clone ID: PAT_TA_28469
accacaccagccgccgccaccacaactcctccatttgcatctcagtcagctccaaggaaggaagcggtcagccatatccggccgcggcaagggcgggaaggggctgggcaagggcggcgccaagcgccaccggaaggtgctacgcgacaacatccagggcatcaccaagccggccatccgtcgtcttgcccgcaggggcggcgtgaagcgcatctcggggctcatctacgaggagacccgtggcgtgctcaagatcttcctcgagaacgtcatccgcgacgccgtcacctacacagagcacgcccgccgcaagaccgtcaccgccatggacgtcgtctacgcgctcaagcgccagggacgcaccctctacggattcggcggctgaactgcgctcggctgctctatcgagtcgactctgctggatgctgctgttcctctgctatggtttcgtttctgggtgcgtgcgttgttgttccgtcggtctgtgtagttaggggaaggcgatgaatctgaatgcaatgaaaatggttggttcttgtggtattatcttggcttcatctctcgatatgtatccgtcggaatctgcccg

SEQ ID NO: 28470 - DNA, 756 bp, Triticum aestivum
  unsure (1)..(756): unsure at all n locations
  Clone ID: PAT_TA_28470
cacactctctgatcaagatcagccacagagtcacagtagcactagcttgagctagccaccttctgccactccgggcattttcttgcatccacgaaggcaatggccgaagtcgaagcgcctgctgcccccgtcgaggttgaggagactaaggaggaggcgccggccgccgctgagacggaggagaccaaggagcccgagcccgcagctgcggccgagccggaggccgaggcgccagccgtggtcgagacaagagaccaaggaggcccgtgggctgaggcagagccggcggtggtcgaggaggtgaaggaggaggcggcgcctgctgccgaaccggaggttgcggccgtcgcccgaggaagcaccggctgctgccggaggaggcaacccgccggccgcggcagaggagccgggccgccgcggtggccagcgtcagcgtgtgaggcgccggcgcgcgcggacgaggagctggctgtgtcagcgtccacggcggcagccgtgtgctcctacgtggcacggcgtgatgctcagtcagccagtggagtggactggagtggagtgctactttttactactaagtgtggggtgctttgcgcggggtccgcgtgacgtgggctaaataaaagtgttgtccgggtccacgcccatcccaagtgtccggtcaagcaagagagcgagagaccaatgccaatgtgcaacnccaaatatgtagctccttttcccgnacaagnatgctcaataatttccaaaaaaaaaaaa

SEQ ID NO: 28471 - DNA, 1100 bp, Triticum aestivum
  Clone ID: PAT_TA_28471
tagtaagaaatgacatcgtaaacgcagcagcacaccaccaatccagcatatcaaagaccccctaaatacaacgtcacatctaccatcaatagaaccgacgcatgtcacttttcttacatgtttcctctctagggatcaactcaactaaactaataagcgcctatacagttcttcaagtcaaggactcgtgagcaggtgaaacggcgatgcgcttagctgtcacccgcactaaacagggtgagcagggccatgaacagattgatgatgtcaaggtagagcgagacggcggcccagacatactcgtcataggtgtaacgcttgatgatgttgtccgtgtcatagacaatgtagccactgaagatgagtgccgccagcgcgccatagatcatgtgagagagcttgcccagcgggaagaggatctgaatgaacccaaagacgagcagcatgatgagagaagcaaataagaaaggaccaaggaagctgaagtccttgcccctctttacagcccagaaagtgtaagcagtcaggctgaagacaaccaccgttgtaagaattgctgcctccaaaatgaccttgccgctagtaaaggcacatgtcatgccgacagcgaagctgatggccactgtgaagacgccaagcagcagcaggttgactgggtgcttctggcggtagatgtacaacgggcacaacacgatgaaggggaggatgaggaggaagatgtagagcccgaggccggcgtaggaggaggcgaagaagtgggggatggcggggaccttgacgacgacggcggcgacgacggcagtgaggagaagctgcagggagacgatgacgtagatcttccggatgagcgcccagcgcagctccgggctctccgccatcccggggtacagcgctcccgccggcgccgcggcagtgccgccggaggtccccgcctcgatgtcgccgcccttcatctcgcccggcgaggcgatgagcggcagggaagagaaagaagcagccttcggtcggaggtagggttttggcgggtgtggcggaacggaaggcgagagggaggggacgggaggagcaaaagtggagaagaggggaactgggcctcgtgc

SEQ ID NO: 28472 - DNA, 1028 bp, Triticum aestivum
  Clone ID: PAT_TA_28472
aatccgggttccggaaacgacacgtacatgatgttcgccatgtttgcttgttcccagtctttgatgggtaaactaaaggcccagaatggaaggttcttcgttgggtagacgtgtttggagtctccaggcaattcaatgatgtgagttgaactgggtggttcgattggaaatccagatgcggagtcttccttgcaaggattgaacatctcactcctgctcttggtattggcttgggcttgcctcttctgcaaagatgacactagttctgcatttgcatcaggtgcagggactgcttttgactctctagttcgtctttcaggatgttgctttcctccagcagtaccttgccttcgaccttcctcatctcggcgttttgcatcatactctttgctggggggatatcttggcaaacttgaaggattgcaagcatatggttttgttgtaaaaaactcactttgcaacgcagaagacgctgtccgtcgatcggctgggtctactgaaagaagaacatctactaatgctagagcaggtgaagggaagtctttaaatgtgtctgtaacacgccttgcatatggatgctgtggcttaaaaatggttgcatggggaagtttagacttcctccaatagtcctctgatggcgaaccacagagtttaaatattttatgcaactgctcaactctgttctgccaggcatgataggcttgccagcatatagctcagcaagaatgcagccagtactccacagatctacagcaacaccataatttgtggcaccaagcagaagttctggtggtctataccaaagtgtgaccacacggctagtcaaagggtgcctttgttcaggatcaaagaaacttgctaatccaaaatcagctatcttcagtatgcctcggttatcaatcaagagattggaacccttaatatcacggtgcagaatatgacgactatgacaatgctcaaggccacggagtagctgttgcatgtaacatttaacctgaggctccgtcaattttagtccaggaaaagaa

SEQ ID NO: 28473 - DNA, 742 bp, Triticum aestivum
  unsure (1)..(742): unsure at all n locations
  Clone ID: PAT_TA_28473
gggcaaatgcccagtaaaccattgttgatgctgttgctgctcatgatcgaagcacgatgcgcaaggtttcagaacttgctcccgccacagataagccaaacaccaatgataaaaacttgtggctagagcagataaggaacaaggttggagaacttgcccccaccgcagataagccaaataccaatgacaaaaacttgtggcttgagcaaataagaaacaagacatttgacctgaaaccagtgggttctgctaaaccgacatccatgatagcccctgctagagcctctagtggaaacctgagagttgctgcaataatagagaaagcaaatgccatacgccaggcggtgggaagtgatgacgaagacgacgataattggagtgacacatagagcacccattattttgccctcctgctgttttttccttggcagaaaggtgccaaaccagcaagatcttggacagggtgcacagccatgccatcttatggtcctaacattcttagccttgtctctctcttgtatatatagtatagggaaatgcccatatgttcatgtttttttgccattcttctctgcattctttttggcctcactgtgtgtatacttgcctccccggtcagcaaaaggctgccgaaggtaggcatgttctttggagaccaatttgttcaggtctaatgtaaatcgttaaccctcttttaagtcttaaacttttgncttgtattatatagnatttgtagtagatt

SEQ ID NO: 28474 - DNA, 626 bp, Triticum aestivum
  unsure (1)..(626): unsure at all n locations
  Clone ID: PAT_TA_28474
acactctctgatcantcaccacagtctcggtctatcacggtagcactagcttcagctagccaccctcttcctctccgggcatcttcttgcatcaaccacggcaatggccaccgctgacgtacgtatagcttgtctagatcgactttcctttttcgcatgctcgcatcgatgatcgtttcgatcggttctttaccttttgatctgcttatgtgtgtgatctgacgaacggccgggtccagaacccatcggccgcgctgacggaggaggcgcccgcggcggagacgccagtggccgccgaggaggccgcgaagacggaggaggtccccgcgccggcggaggccgaagtcgaggcgcctgcccccgtcgaggttgaggagaccaaggaggaggcaccggcagccgctgagacggaggagaccaaggagcccgagccagcagctgccgccgagccggaggccgaagcgcccaaagagccagaggcgccagccgtggtcgagaccaaggaggctgtggcagaggcagagccggctgtggtcgaggaggtgaaggaggaggcggcgcctgctgccgagccagaagtggcggccgtcgccgaggaaacaccggctgcagcggaggaggcccca

SEQ ID NO: 28475 - DNA, 1276 bp, Triticum aestivum
  unsure (1)..(1276): unsure at all n locations
  Clone ID: PAT_TA_28475
gccggccgggtcgggaaaaaaacacgactctcggcaacggatatctcggctctcgcatcgatgaagaacgtagcgagatgcgatacctggtgtgaattgcagaatcccgcgaaccatcgagtctttgaacgcaagttgcgcccgaggccactcggccgagggcacgcctgcctgggcgtcacgcaacgccatcctcccccccctctctctctctctctctctctctcagttttgtacccaagccgtgaccactgcacttgcaaatctctctctctctctcggccctccccttgtgtcatacggccggcgcatcctagcttaggtctccctcctctcgcaacaacaagacgagatcaaagctcctcttcccccaaaaaagtaagtaagatagtgatccttcctagcgggcgggcgggcgggcgggcatgtcatgtgcctggcctgcttccaacttcaaagagctctctctttagaccagcaagtaattaaaactcattcaaggttggtcactgcacacacacagtcaaagaagaaagtaagaatgaagaagaagagcacatatatgtgcatcgtggagcctcagattctgtctataaatagcacgcccacgcccgcccaaacacacagctagcagaacacacaagtaaacacccactcagccaggccacacaaactcgcgctctagctgtaagaagatggctgaccggaaggtggtggtgatgctcctcctggctcttctgctcaccagccagctggtgatgctagccgaggccggcaatgacgacgtcctaccatccgacgagctgagccttgaggttctcgcactgatggaggacatcatccactccaagctgtgccctgcagcatgcatcgcttgcctggtgcagatcgggaaggcctgccctctcaacacgatgatgtttgctccctgcgtcctcgggcaggtcatggcgaacgggtgcttcagcaaggagtgaagccatgagtgcggtgcgggtgtgtatgatctgatgcatgtcttgtccatttccttccttgtatgtggtccgatccggtccaggctgctcttttctcttgtgtgtgctgtgcctttcgaggacaagacaggacccgatcctcctgattgttgtgtgttttagttgccactttccttgtctccacttaattaataccatccatgattgtgccatttcctccaagtaaccgtgtatgagatcatccnctcggnatgtatggngcaatagaccccgatgtcctgttggtaaanaaaaaaaaa

SEQ ID NO: 28476 - DNA, 511 bp, Triticum aestivum
  Clone ID: PAT_TA_28476
cccacgcgtccgacgtccctccgattccacatccgctcgcagctcgagatcgtcagccatgtccgggcgcggcaagggaggcaaggggctcggcaagggcggcgccaagcgccaccggaaggtgctgcgcgacaacatccagggcatcaccaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggttctttgccgccgcctgcagattccaaaatcttgatggaaccccgacttgtttagctcgctgtttactctggctctgtagttcgaactgaatcgtggaacaaagttatttcatatctgttgttggaaatgaaaaaaaaaa

SEQ ID NO: 28477 - DNA, 586 bp, Triticum aestivum
  unsure (1)..(586): unsure at all n locations
  Clone ID: PAT_TA_28477
cccacgcgtccggcagccaccaccgttcctccgattccactacatccgctcgcaggtcgaagaggatcgtcagccatgtccgggcgcggcaagggaggcaaggggctcggcaagggcggcgccaagcgccaccggaaggtgctgcgcgacaacatccagggcatcaccaagccggcgatccggcgcctggcgcggaggggcggcgtgaagcgcatctcggggctcatctatgaggagacccgcggcgtgctcaagatcttcctcgagaccgtcatccgcgacgccgtcacctacaccgagcacgcccgccgcaagaccgtcaccgccatggacgtcgtttacgcgctcaagcgccagggccgcaccctttatggcttcggcggctaggttctttgtcgcctcctgcagattccaaaagcttgatggaaccctgccttattcagttcgctgtttcctctgtctgtgtagttcgaactgaatcgtggaacaaagtaatttgcatatcttgttggaaatgatacttgtctttgtcagcctgtcgtaaatctgattttttgctggttgaaaaaaaaaaaannnnanaaaa

SEQ ID NO: 28478 - DNA, 479 bp, Triticum aestivum
  Clone ID: PAT_TA_28478
agcgtggtcgcggccgaggtctcgagttttttttttttttttttttaagaacaaatcaatattgtttacattttccacaagtccaaaaatatataactaacatcttcgggcatgtacgcgcctaaacggcttttcagttttgctgcacaatacagggaaatgaaaccagaaagaggtctagcttgtgaatggaagctacatgggattacaaagctgcccagtgcacaagacatgtggggtacaacttgtgcatacagactgggaaagaataggatctgactatataacgtagcaaaatgatacaagtttgggattcttctcttattcaagctgttcatcatgaaaaaaatggacttttatgaacaaaatggatcaatgggtggcatctctgcctgtagaactgatccaaggtcttcgcaggaatacggtggagaagttcacgggggaatatgcgtagcaatgtccatgccagatcaagt

SEQ ID NO: 28479 - DNA, 1000 bp, Triticum aestivum
  Clone ID: PAT_TA_28479
cggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgcctgcctcggcatcaacacgcgtcagatctggcggaagacgctctccatcctccacccgctccgctccgccgacccgtccctccacgccgacgccgatctctccggccccttcctgttcctcctatccttcggcctcttccagctcctggctgggaagttccacttcgggatcgtcctcgggtgggtcaccgtcgcctccctcttcctctacttcgtcttttccatgctctcgggcggacgccgtggcgaccttgacctctacaggtgcgtcagcctggtcggatactgcatgctccccatggtcatcttctccgccgtctccctcttcctaccacggggcggtggactcatcttcgggatgggcatgggattcgtgctgtggtctaccagggtctgcaccaggttactagcagagcttgcttccagcggcgatgagcataggggactcattgcctacgcgtgttggctcgtctacatgctcttctctctgctcgtgatcttttgatgctgttcttgagatggaagatcacacagtattcttttgccctatggagcgcagaactgcttttgatcagcgactggagtggtttattgatgctacagaactattgatgatctagtcagtttggaaaatattctgtaacaatctactgcttttcatcctttagtttctgtggcatggtagggggctggtatagatcttggtaaagaaacgtaaggcaagatcaggacagtgaaaatattataactaattagcttttgccgaagtttgatggaattagctagcaatttcgaaagagtacacttgtggtccgtttgaacttgttcatcgtgcttgcttaccacgcccgtggtgcctaaaaa

SEQ ID NO: 28480 - DNA, 1387 bp, Triticum aestivum
  Clone ID: PAT_TA_28480
gcacgagcacgcccgggaaatcttgactgctgctaaagctagagcagtgcagggcacgcggtgtgcggagaaagctaaacatgtgcagccacgcggagccgacgacgacgtgcgtgacgtgcccgccgccgtcgcagggtgcggctcatcaccgtgctgagcatacgacgtgcggcggcatccgcggcctcattcccttcaacaatcttccccttttctcgagtccaagctccaggagctggacgggccggacgcgcgcatcgcggactacttcgacgtgatcgccgggacgagcacgggcgcgctggtcacgtcgatgctggcggcccccggcgagaacaagcggcctctcttcgccgccaaggaaatcaacaagttctacctcgacaacgggcccaagattttcccgcagaggagctggggattgctgaccccgatagggaacatgtttggcgccgtcatgggtcccaagtacgacggcaagttcctgcacgataagatcaagagcctcaccaacgacgtcaccgtcgccgacaccgtcaccaacatcatcgtcccgaccttcgacatcaagtaccttcagccgatcatcttcaacacctacgaggccaaggtggacccgctcaagaacgcgcacctctccgacatctgcatcagcacgtccgccgcgcccacctacttccccgcgcactatttcaccacccgcgaccccacgggcaagcagccggaccgcgagtaccacctcatcgacggcggcgtggcagccaacaaccccaccatggccgccatgtccatgatcacccaggaagtgatgcgccggaacccggacttcacgcacggaaagcccgccgagtacagcaactacctcatcatctccatcggcaccgggacggccaagcaggctgagaagtacaccgcgcccgactgcgccaagtggggcgtcctccgctggctcaaagacggccgcttcaccccgctcctcgacatcttctcccatgcaagcgctgacatggtcgacatccacgccgccgtgctattccagtcactacgcgttgagaagaactacctacgcatccaggacgattcactcacggggcacacgtcttcggtggatatctccaccaaggagaacatggaggcgctcatcgggatcggcaacaagctgctcaagatgaacgtggcccgggtgaacatcgacacggggatgtacgagcccgtcgacgacgagggcaccaacgaggaagcgctcgctcgcttcgccaagaagctctccaacgagcgcaagctgcggcaagccaacctcaactcccaatagagaagaggaagattcgagagagagcacagacagtatattataaatttgtaatgcaatgctatgtaatgtggg

SEQ ID NO: 28481 - DNA, 913 bp, Triticum aestivum
  unsure (1)..(913): unsure at all n locations
  Clone ID: PAT_TA_28481
gagcaaagtcttatccttccacttccaagtctggattccgtccatggcgtcccaggatcaccaccaccaccacggcggccactcccacgacgacgaccaccatcaccgccaccatcacggggatgccgccgggaagggggcgggggcggggtcgtgggtcggcgaggacgggcgcgtgtggcactcccacgacggcctggcgccgcactcccacgagcccatctactccgccggggacttctccaagcgcgcgccgccgctcgactcccgcagcttcgccgaccgcgccttcaccgtcggcatcggcggccccgtcggcaccgggaagactgccctgatgttagcactctgcacttgcctccgtgacaaatatagtcttgcagcggttacaaatgatatattcacaaaagaggatggagaattcttggtcaagcatggagctctgcctgaagagcgcatacgtgctgtcgaaactggaggctgccctcatgccgctatacgtgaggacatcagcataaatctgggccctctggaggagctatccaacttgtacaaggccgatttgctgctctgtgaatctggaggagataacctggcagccaacttcagcagggagctagcagactacataatctacatcatcgacgtgtccggtggggacaagataccaagaacaggcggccctgggataacccaagcagatctcttggtcataaacaagacagaccttgcctccgcggttggagccgacctagccgtgatggagcgagacgcccttcggatgcggggaaggagggcccttcctgttcgcccaagtgaaacacggggttggcgtgnaggaacatttgtggaaccacgtgcttgccggccctgggaaatcnccaccggcaacaagnggccnntaanaagaggg

SEQ ID NO: 28482 - DNA, 847 bp, Triticum aestivum
  Clone ID: PAT_TA_28482
aaatgcaagatatatcatgaaccaatagagagaattgattcaactatatatttctataaacaactcagggtcgcctgcgcatgcatacacaccggtcgatgagaccctctcgaccaaggcgctcactctaattgtccaatctcaaacccgctccaccaatctcaccacccaattatcagaaacagggcgtgtgcctagcaagaatacataataataaatcatggataccaatcagcatgattagtatctcggtggcgctggcggcatccggtttggtgtgcgtcggctgctcgagttgggatccccattttcagagcgtctgcgaccgtcagcgcttctcgatcttgattcgatgttcggggcagggccatttgctgctagactatttaaaacagcctcaacataaccgcgaacttcttgagacatccatctaagtcttcttcaggaaccgttgtctccgtatcattgcatctgtggagctatctggctggctttgcttcagtggaccacctcagaattgcagccttgaaagaccactttgctttgaattacagcttttatcttatttacccactcaacttgtcagcagtgctcttcagccttcaatacaacagcgctatgagctttaaggacagtcttataggcgaccctgttagttatcttgaacacaagacttgggcctttttcaggtccattagccttttttgaatcctttaagcttttagaaggttcttcctcatctacttcctcgaggttgcattcctcaagagtgatgacaccacgaaaatgtctttcctcttgcttctttgtgtatccaagctttccactcttctcatttaggacgaac

SEQ ID NO: 28483 - DNA, 777 bp, Triticum aestivum
  Clone ID: PAT_TA_28483
cgtccgcggacgcgtgggctcccgtccccccgtctccccgccgcctcctcctcctcctccgcgtcgcaaaccctcgcccaaatccgccgaatcccgcgacccaggaaccaaggcagatcgatggcgaagagctcgttcaagctggagcacccgctcgagaggaggcaggcggaggctaaccgcataagggagaagtactctgacagaattcctgtgatcgttgagaaggctgggaagagtgatattcctgacattgacaagaaaaagtacctcgtccccgcggatcttacagttggacagttcgtgtatgttgtccggaagcggatcaagctcagtgctgagaaggcgatcttcatctttgtgaagaacactcttccaccgacagctgccctgatgtctgccatttacgaggagaacaaggacgaggacggcttcctctacatgacctacagcggcgagaacaccttcggattgctctagatggcgctggctgccacggcaatcgctctgaatgcctcctgtaaataaggcgtgccaatcaactgtgtatatattccggtttgcctcgtcgtaggatctttaaattgcacaaccaagaaaaacctattcgtatcctgacttatcctatttgaatgttctgacttatatatatatcaagtaagactctgaaattccgtaatttctagtgctcctgcgttcatgcatgccgctgtggttactggttgttcactgctgctgatgtaatgtttaccagtaataaatctggtgttccaaggc

SEQ ID NO: 28484 - DNA, 1489 bp, Triticum aestivum
  unsure (1)..(1489): unsure at all n locations
  Clone ID: PAT_TA_28484
ctccttctcttcgttcgctgctctcgtcgtagcccacgcatcttgttgcttttctcccggcgcttcttcagactttctccctgtgtcggtccgcgctctcgtcatgatgaaccacgccacctttgctgccgaggaggcggtcaccgccgtggcggcgccggcgcagccgggtcgccatttcgtgtcgctcccgccgcggagggcgcgcgattgcaggaaggcctccctgggccgcatggacctcgccacctcggcggtgctgatgggcgggtctctgctggactcgatgaaggcctcctcgccccgccaccccatgtcccccgccggcgccgacaacgaggagtggatcgagaagcacccgtcagcattggagtggttcgagggcgtgctcgcggcggccgaggggaagcagatcgtcatgttcctcgactacgacggcaccctttcgccgatcgtccaggaccccgaccgcgccgtcatgaccgaggagatgagggatgcggtgaggggcgtcgcgcagcatttcccgacggccatcgtgagtgggagatgcagagacaaggtgttcaactttgtgaaactggaggagctgtactatgccgggagccacggcatggacatcaagggccccaccaaagtgtctaaccacaaggcaaaggctgacgaggttctgtgccagccggcgaccaagttcttgcctgtcatccagaaggtgtataagacgctgacggcgaagatggagtccatcccgggggccatggtggagaacaacaagttctgcctctcggtgcacttccgctgcgtcgaggaggcggagtgggacgctcttgggagggaggtgaaggcggtgctggacgtctacgaggacctcgagatcaccgagggaagaaaggtcctagagatccgggcccaccatcgagtggcacaaggggaaggcccttctgttcttgcttgagtgtcttggctttgcggggcgtggcgacgttttcccgatatacatcggggatgaccgcacagacgaggatgcgttcgaagtgctgcgcaacatgggacaaggcatcgggatccttgtgacaaagtttccaaaggagactagcgcatcctattctctgcgtgagcctgctgaggtaaaggagttcctgcacaagctggtgaagagcaacgagacaaagaagggttaattcatcagctagcagccttctagctctaactcaacatggagatcgagcaggctatatagctagctagtacatcaagtctagcttgtttcgtttttggacttggtgtgtctttcgtttcatctagtagaacattgcatgcatgcgtattgggatcgatatataagatccagatcgagcagtgacccttgctaggcaataagcttggtttgaaggttcaataacgtaccttccgcaaggcttgtaatagcttcgttattaactatgacacaaatgggtgtgacaaattaacctccttttccaaaanaaaa

SEQ ID NO: 28485 - DNA, 881 bp, Triticum aestivum
  Clone ID: PAT_TA_28485
cggccgggccccgggaaatacaaaaaaaaaaaaaaaaaaaaaaaaaactgcaccacgatgggctcgacgttcacacgcgccgcgccggtatggcaacccgtgtggtagcagccacactcttggcctctcagtcttcgccatgcgctggcacggcggccgcggacacggccggctataaaaggaggccccgagcaccatcacacacccaagcctccactcctcctagtcttcacttcctctgctcctgcacctcccttcccgagctgctcagtagctagccatggcgcagggaagcggcggtgcgaccgccgtgctcgcgctgctcctcctctgcgtgctcctccacggcgacttcgccgagtccaaggtgtacaccgtcggcgaccgcgccggctgggccctcagctccggcggctggcccaggggcaagcgcttccgcgccggcgacgtgctgctgttcaagtacgggcgcggggcgcacaacgtggtggcggtgaacgcggcggggtacaagtcgtgcagcgcggcgaggggcggccggacgtacaactccggcagcgaccgcgtcacgctcgcccgcggcaccaactacttcatctgcagcgtccccggccactgccaggccggcatgaagatggccgtcaccgccgcatgatccgtctctccgtcgtccatcgccccgccggccggccggtgcttattaattaactttagtttactttccatcctcgagtgaccgaagctactgcatggtgcgtagtacgtgttcaataaaatgcccgagttcgtgggggttgggccgtctggccggttggcactagctagagagagatcaatatactctgttgttccggttgtacgtgctttaatgcttgtatacc

SEQ ID NO: 28486 - DNA, 1029 bp, Triticum aestivum
  Clone ID: PAT_TA_28486
gcacgagaaggagctgaggagccaaatcatccttgaagctgaagagttcaagaagggtttcgtcgagaagcgcaagctgaacctatgagacaagcaaggatcacaaccgggaaagggagaagcttttcctgtccaaccaggagaagttccacaagggcgcagacaagcagtactggaaggcgatatccgaagctcatcccacaggagattgcacacatcgagaagaggacgggcaagaaagacaaggacaagaagcccgggatcatcgtggtccagggccccaagcccgggaaggccacggacatggcacggatgcgccagatcctgtcaaagctgaagcacacacccccgccacacatgaagccacctccaccacccgccgcggcacccgccgggaaggatggagctccggccgccgccggaaaggacggagctaaggcggcagcgacacctgctgccaaggatgcccctgccaacggcactgtccctgagaaggagaacgccgcaccagccgccgccgccgcccccgcagcagccgctcccgcgccaccagctgagcccatcgccgctgcctgaacgagggtggcctcggtcatcccgctaatccttcgcagtagggttatatttgggtgtcagtagagttgttccaggagagacggacggggaaggagcgtgaaggccggccacatacgatgcgaggtggtgaaatcgtccgtctcgagttcgccatggggaatcatggcggggacacacgcggtgtactattattaatttgagtttgttattatgatgagcaggagggttgttacttatgggaccagcaaactttattattcattaatattgtcattgcattttgtatagagaaaaagggtcctggtaacaacaaggttaaggctgttgttgctgatacagtatgtgtttgaatatttatcatcaagtgttggatttttggtctcaaaaaaaaaaaaaaaataaaacaaaagaaaaaagagcggcgctccgatctagaattagcggacgcgtggt

SEQ ID NO: 28487 - DNA, 527 bp, Triticum aestivum
  Clone ID: PAT_TA_28487
tttaaacgaaacagagaccgtctttcattgtgcatagacagagtgacccatggcagctacttgatccgaagccgtttttttcttggattcgacgattcaaatgtcgcttattacattacaaaccagagcagcaaaaatgcacgcagttggatttgaacaaaaaacataaagttcaatcacaatagtgagggtgaggactggctcgccgcatcaaggacacatgccggtaactcagctgctgcccctgtgacctggcggcggtgactacttcttcttgtgcgcctggacgaacttggagttcttgaggtcctcctcggtgaagccggcggtcatcttggtgatgagggcccccgtgacggcgaagccggcgatgaagggccagttgcggccccactcccggcggaagaacaccggccacgggtcgaacgccgagaagaacttcatctccggtggctttgatctcgacctccgccttggattggattggattggatttgagtccgccaagatctgatcggacgaaaagg

SEQ ID NO: 28488 - DNA, 754 bp, Triticum aestivum
  Clone ID: PAT_TA_28488
ctcgtacccacgcacttctcccagtcttcacttcctctgctcctgcaccccccttcccgagctcagcagctagccatggcgcaaggaagcggcagcgctaccgccgtgctcgtgctggtcctcctctgcgtgctcctccacggcgacttcgccgagtccaaggtgtacaccgtcggcgaccgcgccggctgggccctcagctccggcggctggcccaggggcaagcgcttccgcgccggcgacgtgctgctgttcaggtacgggcgcggggctcacaacgtggtggcggtgagcgcggcggcgtacaagtcgtgcagcgcggcgaggggcggcaggacgtacaactccggcagcgaccgcgtcacgctctcccgcggcaccaactacttcatctgcagcgtccccggccactgccaggccggcatgaagatggccgtcaccgccgcgtgatccgtctctccgaccaccggccagccggccggccggtgcttattaatcaactttagtttactttccgtcttcgatttactgaagctacgaactgcatgatgcgtagtacgtgttcaaataaaatgcccgcgtcccggctctcgagttcgtgggtgttgggccgtctggccgcttggtactagctcgagagaaattaatagagcgtgttttgtgtgcagtgcacgtgagcaaaggaataactctggtgttccggttgtgtgtgctttaatgcttgtatatcagatttttgagttgttgtgtgatt

SEQ ID NO: 28489 - DNA, 508 bp, Triticum aestivum
  Clone ID: PAT_TA_28489
cacccgccgccgccggccacccccgtcgcttcccgccccccgcgcgccccagccagccaggatgacgctcgaagaagcaccagcttgttcatgattggccgtgggatctacaacatgtctaatgggatcgggaaaaaggagtgaatttctgtgggttttgctagtatctcagtaagcggcatggaagcaatactgcccaagctatgatgtcatcttcgtttgcaaataatattgtcagagaaagactcgggtccatttcatgttctcttttgttggtatttgtggatgcttgctaaacttgcaatgatgatgctataacatcagcatcgtccactttgcattatttctgctctacgttttattttttttgatcggtgcattctccgtgcatgcccattcgtggcataccttcttgctttatgtgaattcatgatttgtgtggtatgcagcaacttcatacagtttccaggttgaagctctgaataaaaaaaaaaaaaaaaaaaaaaac

SEQ ID NO: 28490 - DNA, 1384 bp, Triticum aestivum
  Clone ID: PAT_TA_28490
caaatccgcctcgaattccccgatccagcagcgcggccagccatctcctctgctcccatccttcctccctcctccacgcccagatccctctcgctcccttccccacacagaaccagcggtaccccaccaccacccccgccttcctgccagtagtagatcccttatgagctggttggctgtggtttcacttcagtttgggggctactaagatgggtcagcagctgggcagagacaagattggatcaaacctaacagctgatgacatagcgagcgccttctacttctcacttcctgctctcccctgttgtctcctactgggattgcatcttccgcaagataagatactccttcagacccgagtgggtgtagcattctgcgccaaccgcttcagcactagtcggtccggaagtaaatcggcgggcccttaggaagaaagcatctagacaggagtccaataactatgaactttgcagattttggttttccgtaattataactggtagaggagtttagctgagatagtaagtactcaatagcaagcagtcacagtggccatggagaaggctgcgggcaatcaggcagggaaagtcttgaagaagggaaagaagaagcaggcgaaggatgagctggaccgccagaagcaagctgagaagaagaggcgtcggctggagaaagcgctcgcaaactctgctgccatcatctcagagctggagaagaagaagcagaagaagaaagaggaacaggaaaggctggacgaggaaggcgcttcgatagccgaagcagtcgctcttcatgttctcgtaggtgaggactccgatgaatcccgccatctggtgctgaacaagcacagaagatgcaacgactgggacccctcggctggtttggacttcactctggacacgcaaggcgcagctgatatctactcccctggtggacttatgtgcggcaatcaagcttatgcttccagggggaggtggattgactgggggaacgcgcatccgctgccaacctggggggaagtgagggacctgaaagcgtcctactaccaaggaacgtgccaccagtcaacagtcgcctgcccaggcttcatggctgcccaggccgtctcgtcgctgcagatccgagaagactcgtcctctcccaggccagggagtcgccgccgcgaccgtcgttaataggatgctcggcggcgccaacaggctcaacctttacagggagatatgaagaaggaagatatatacaacctcgtcgtcatagtgttcttgtacataatagtcaccgaaggtgtgctgactattttgcctgcgtgcagctgttccagccatcaggagaatctgatggcgcaacttgtttcgcccttttgttttcgtcggtcggtgtaata

SEQ ID NO: 28491 - DNA, 828 bp, Triticum aestivum
  Clone ID: PAT_TA_28491
ccacgcgtccgcggagcggtgggctactcataccctccccgtgctccgcttccgcctcgccatctcatttccagagtgttccagagagcggatccagagagtgctagggttttctctctctcccggcggcgagggcgatgtcgatggcggcggcggcgagggcggcgacgagggccccgggcagggcggcggcgcggttcgtgcaggccaggctccgctcctccggcaaggtgctcagcgaggaggagcgggccgccgagaacgtctacatcaagaaaatggagcaagagaagcgggagaagcttgcacgcaagcagggtcccagcactggagagcaagctccgtccaccccaagcgctgcagcaggcgacgtgaacactggaggcgccgcttcgaccgtgtcggcgtccgcagcaggcacgtcaaccgacaagaacaggaactacgccgtgctggctggcaccctcgccggcctgagtgccctgggctggtacctcctgtccaagcccaagaagacggaggaggtcgtcgactgattggcctgtcctgccctggttttttacttccttactgcacatggacctgcgcgatgatgatgatgatgataataagtttccgatgtcgccgaacagcctttcctttgccttgttagctgcttccacagaatctgagacttgagatgatgatgatgatgatggtggtggtctgtagcgcaagttgtttttgcaacctgtggttggtctggtatgttggtggttaacgagaggggcatcttggatgatgcggtttggtccctttgaaagtatgcaatgcatggtttttccggtg

SEQ ID NO: 28492 - DNA, 566 bp, Triticum aestivum
  unsure (1)..(566): unsure at all n locations
  Clone ID: PAT_TA_28492
gcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcagctgcggccgaaccgggaggcccgaggcgcccgccgtggtcgagacagagaccaaggaggccgtggctgaggcagagcccggcgggcgggccgaaggaagtgaaggaagaaggcggcgcctgctgccgaagccgagccgggccgctcccgctgctgctgaagaaacaccggtggagcagccgccgccgccgtggcaactcaacgtnttaagcccaacgccgccggaggaagaatggctggtcaacgtcaacggngcgc

SEQ ID NO: 28493 - DNA, 1417 bp, Triticum aestivum
  Clone ID: PAT_TA_28493
aaaaccatcccttccctctctctcgctcactcgttgctgtggtgagagtgagtgtacaagccagtttgactgttgatatgtacacgagcacctttatgtgtacttacgtaagcattacggcgcctttccgctcgtagcgacacagccaagcaagaaaacaaggcgagaaatagtagactagtgcaaggggagcaaggtgaatcttgtcgtacagtaatattttccatggccaatgcgtcgccgctcacatgcgctgcgcgcccagctggtggcgcgcgacagctatcaaagctgccgcgccggtacggcggctgcaggagcagctttggccccttgcggcggccccgcgcccgcgctcatccaaatttcaaaccccaaaatgcgatccgtgtggctcacagtttctttgaatgctatgatgataatgcagggctgcgacgcgtccatcctgctggacaacgcgcagagcgagaagacggcgccgcccaatggctccctcggcggctacccggtgatcgacgccatcaaggcgcagctcgagaaggcctgcccgggcgtcgtctcctgcgccgacatcgtcgcgctcgccgcccgcgacgccgtctcctaccagttcaaggcctcgctctggcaggtggagaccggccgccgggacggccccgtctcgctcgccagcaacaccggcgcgctgccctcgccctccgccggcttcaacggcctgctgcagagcttcgccgccaaggggctcgacgtcaacgacctcgtcgcgctctccggcgcgcacaccatcggcaaggccagctgctccagcgtcacgcccaggctgtaccagggcaacgccaccagcatcgaccccctgctcgactccacctacgccaagacgctcatgaacgcctgccccaacaatcccgcttccacgtccacggtggacctggacggcgccacgccgttcaagttcgacggcagctactacaccaacctgcagaacaagcggggagtgctcgcctccgacgccgcgctcacgcagaacgccgctgccgcgactattgtcaacgacctgaccaacccgatcaagttctacgccgccttctccatgtccatgaagaagatgggacgcgtcgacgtgctcaccctcaagaacggacaagggaagatcaggaccaagtgcaatgtgccgtgagggttcatccatgagcgccacattttttcttgggattttttttactctctccctctctctctctccctcttatttcatcggcgcggatcaaatatattgtgcccgccatgattaaggtcccaaatctatattgatttgttaagtgctgtgcctggagtatgtaagattattagtcacgacatgcgttgcattcctcttgcaatcaatcaaaagaagtggttcggcaaaaaaaaaaaa

SEQ ID NO: 28494 - DNA, 1084 bp, Triticum aestivum
  unsure (1)..(1084): unsure at all n locations
  Clone ID: PAT_TA_28494
ataataagcttaattagctccaaaatgacctatttaacctaggatagctctaaaatgacctatacttagcatttgtttcctccaaaatgacttaatatgcttagctagcttcaaaatgacctatttaacctaggatagctctaaaatgacctatacttagcatctcttcctccaaaattacttaatatgcttaactagctctaaaatgacataatatgcttaagaaatgacatagtttagctcctaaatgacttcacatgcttagctagctccaaaatcacataataacctaacttagctctaaaatgacctatacttancattttttcctccaaaatgactcaatatgcttagctagctcaaaaattacattataagcntaattagctccaaaatgacctatttaacctaggatagctttaaaatgacctatacttagcattttttcctccaaaatgacttaatatgcttagctagctcaaaaatgacctatttaacctaggatagctctaaaatgacctatacttagaatttttttcctctaattgacttaatatgcttagctagctctaaaatgacttacgaaatgacatattttagctccaaaatgacttcatatgcttagctagctccaaaatgacataataaacttattagttccaaaatgaccttacatagcatttttacaccaaaatgacttagtatgcttagttagctcaaaaatgacataataaccatacttagctccaaaatgacctattttatagatataagttgcatcataataatcttcacattttagttgcgtcataataatcttcttcttctagtcttcttcttctaactttcttctttcccattttgtagatttgcttcagatcacggaagcttgggttgatggagtgcttgtctttagtttttgttttgactttgtgaaacttgctacccatgatgaaactgtgtaatattgatgaaactgtgtaatattgatgaaactatgtatatgtatggatgaaacttgctactattggtaacatgtgttggatatgtgttcaatatatatgtgttcatgactaaaaaaaaa

SEQ ID NO: 28495 - DNA, 825 bp, Triticum aestivum
  Clone ID: PAT_TA_28495
ctacaggctgcgcaatccctttctccctcttatccccaaggccgcaaggcgaggagaggaggcccttctgctgctgctgctgttcttgtttccccgctttccaagatgtcgtccccgagcaagcgccgtgagatggacctcatgaagctgatgatgagcgactacaaggtggagatggtgaacgacgggatgcaggaattcttcgtagaatttaaggggccgaccgaaagtatctaccaaggtggtgtctggaaggttagggtagaactgcctgatgcatatccttacaaatccccctccattggcttcatcaacaagatttatcacccgaatgtcgatgagatgtctggctctgtctgtttggatgtcatcaaccagacatggagcccaatgtttgatctagtaaatgtttttgaagtattccttccacagcttttactgtatccgaatccttctgatccattaaatggggaggctgcagcactgatgatgcgtgatcgtcctgcttatgaacagaaagtgaaagagtattgtgaaaagtatgccaaaccagaggacgctggcatcactccggaagacaaatccagcgacgaagagcttagtgaggaggaagatgactccggggatgaagctatacttggcaatcctgatccttagtttaagttggaaacagtgcagtcagctcatcaatacaatgctcattgcagaaattgcaactaaacaaaaactgaaaaactaaaaaaaactctggatgtcatgtaaataagtgtaccttgtatgttatccaatgttgttccttcattcggttgattgaatttctcactc

SEQ ID NO: 28496 - DNA, 1018 bp, Triticum aestivum
  Clone ID: PAT_TA_28496
acataatattacagatattgccgtgaccgagagtcatctacaaataacttgcgctcaccaacagaaaagaattggacctgactacagataaatacaggaaaatgggccataaggccaatctgttcaattattcaaagctgcccttgccaaaatattggaacactgatcaacaatcagtgattcagtgggaggcatctcggctatagtactggtccaaggtctttgctgggatacggtggagaagctcgcgagggaagatacgaagcaatgtccatgcaagatcaagtgactggaagatgttccgtgtgtcgtatgctccttgtgtcacaaacttcctctcaaacttgtcaaggaactctaagtaaagcagatcctcagacgagagtgcctcctctccaacgactgccttcatggcctgaacatcctttccaattgcatagttggcataaagctgattagacacatccgaatggtcacgacgtgtcatgccctctccaatagcactcttcatcaatcgagagagagatggcaagtcattaataggtggataaatctgtctgttatggagctgcctatcaatgtatatctgtccctcagaaatgaatccagtaaggtcaggagttgggtgtgtgatatcatcgttaggcattgttagaataggaatctgggtaatggagcctgttcttccttcaatacgcccagcacgatcatatattgttgccaaatcagtatacatatatccaggataaccacgcctacctggcacctcttctcgggctgcagaaacctcacgaagtgcatctgcataagagctcatatctgtcaagataacaagtacatgcttcccacattcatatgccaaatattccgctgttgttagagcaatccgaggggtgataatacgttcaatggtggggtcgttagccagattcagaaaaagggtgacccgctccatggaaccattctcttcaaaatcacgtttgaagaattgagctgtttccatgttcactcccatagc

SEQ ID NO: 28497 - DNA, 1174 bp, Triticum aestivum
  Clone ID: PAT_TA_28497
gggggagagggagcggcgggcgggcgagcgagcgagcgaagcatccatggcggagcacaaggaggagtcggtgatggacaagatcacggagaagttccacggggggtcctcctcctcgtcgtcgtcggacgacgacgagaggaagtcggggtcgtcgtcgtccgtcaaggccaagatctaccgcctcttcggccgcgagaagcccgtccactccgtcctcggcggcggcaagcctgccgacctcttcctgtggaggaacaagaagatctctggcggggtgctcgcgggcgccaccgccatctggctgctgtttgaggtcctggagtaccatctcctcaccctcctctgccacggcttcatcctcaccctgggcatcctcttcctctggtccaacgcctctgccttcgtcaacaagtgccctcccaacattccagaggcgaagatccccgaggacctggctgtcaatgttgcccgctcgctgcgatacgagatcaacaggggcttcgctagcctgagggcgattggtcaaggccgtgacctgaagaaattcctgattgtggttgcaggcctgtggatcctctcttttcttggcagctgctgcaatttcctgaccttgttctacataggtatatgtggtttcttgctacagttcgttacttacatatgtgcaataagcttgcctagcattgtttcactgatcatgccttcttgtttgcagtcttcatggtgctttacaccgtgcctgttctgtacgagaagtatgaggacaagatcgatgcttttggagagaaggccatggttgagctgaagaagtactacgccatcttcgatgagaagtgcctgtccaagattcccaagggcccgtccaaggataagaagcagcattagaacggtagagagtaccctgcgcagatttatcttcaaagttgatcactactcgtcggttttcaaggatggttgtgattccatgtccgtagttgatagtagataccactatcttgtcaaaaacctctggcacggtcagtagtcgtgacgtgcaacttctacgaacttaaaaagtcatgccagcttttgctgaatatcctctttccaatgctatggttaacgtagcatcctcacttgcaagttgtgttggtgtaataggcagtatgtttggacctagagactgctacaa

SEQ ID NO: 28498 - DNA, 500 bp, Triticum aestivum
  Clone ID: PAT_TA_28498
ccgttcctccgattccactacatccgctcgcaggtcgaagaggatcgtcagccatgtccgggcgcggcaagggaggcaaggggctcggcaagggcggcgccaagcgccaccggaaggtgctgcgcgacaacatccagggcatcaccaagccggcgatccggcgcctggcgcggaggggtggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctttatggcttcggcggctaggttccttgtcgcctcctgcagattccaaaagcttgatggaaccctgacttgttcagttcgctgtttcctctgtctgtgtagttcgaactgaatcgtggaacaaagtaatttgcatatcttgttggaaaaaaaaaa

SEQ ID NO: 28499 - DNA, 823 bp, Triticum aestivum
  Clone ID: PAT_TA_28499
ttggcttgcttcagcaacaatctcctccgtagagagcccctgaagcttgtcgatggcggcgagtcccagagaacttttgtttacatcaaggatgccattgaagctgttcttctgatgattgaaaaccctgctcgagccaatggtcatatcttcaacgttgggaaccccgacaatgaagtcactgttagggagttggccgaaatgatgacagaggtctacgctaaggtctcaggagagcccccgctggaggagcctgtggtcgacgtgagcgcgaaagaattctacggcgaagggtacgacgacagcgacaagaggatccctgacatgaccctgatcaacaagcagctagggtggaaccccaagacccctctcaaggacctgctggagacgacgctgacctaccagcacaagacctacaaggaggtctgtgaagacgcagatgtgtctggccacggcgacgccttcaagctagacgatgacggcgcggccatgctgctcttgatcttttggaagccagatacttatatcgtagtgaaaccgtcgtcgtcgtttttgtcgcgcctctagatcacacccacccatcttcttacctacctagattcgtcattgtgtaaccctatattgggcaaagggaactgagtatctattatacctgtggtggcagtgtttgttatgtttgggttggttgcacctcccgtgctattcttttgctgttaagtgagagatatattcttgttccggcatagttgatgatgatgtgagattccagtctgggagccttattactgtagtttttagcagagttaatgtcgagtcttcaagc

SEQ ID NO: 28500 - DNA, 543 bp, Triticum aestivum
  Clone ID: PAT_TA_28500
gcacgaggcacaaagacaagtcaacctcaccgaggagaagagaagaaaagagaagcgagaagatgtcgggccgtggcaagggaggcaaggggctcggcaagggcggcgccaagcgccaccggaaggtgctgcgcgacaacatccagggcatcaccaagccggcgatccgccgtctggcgaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgctctcaagcgccagggacgcaccctctacggattcggaggctaggccgccaccaccaccagattaggagctagcccatgtgtagggttcgtggtcctcgttgtaatcgcagtatctcgctgttgttcgctgtgttctgtaggatcgaatggaatggaattgaaattaaactagttcgtcgttgaaatctgcttcgtctgttaaaaaaaaaaaa

SEQ ID NO: 28501 - DNA, 493 bp, Triticum aestivum
  Clone ID: PAT_TA_28501
tcacagtagcactagcttgagctagccaccttctgccactccgggcattttcttgcatccacgaaggcaatggccactgctgatgtacgtatagcttgtctcgatcgtcttcctatagttctattctcttttcgtatgcttggatcgatgatcgtttcgatgggttcttcatcttttgatctgctcactgtttacccgatccaacgaacggccggtcgatcatgatcatgatcatgaccgagctcgagctagatcggtttgtgtatgtgtttgacatgtgcgtggcgctaatgatattaagtgtgcaaacgtgcaggtccagaacccggcggtcgcgctgacggaggaggcgcccgcggtggagacacccctggtcgccgaggaggtcgcgaagacggaggaggcccccacgccggcggtggccgaagtcgaagcgcctgctgcccccgtcgaggttgaggagactaaggaggaggcgccggccgccgctgag

SEQ ID NO: 28502 - DNA, 750 bp, Triticum aestivum
  Clone ID: PAT_TA_28502
ccctactaaagggaacaaaagctggagctccaccgcggtggcggcccgctctagaactatgtggatcccccgggctgcaggaattcggcacgagttctcgtggaggcgaggagatagagaagagagaggaaggggacggaggaggaggcatccctcgcgattggacagggcgcgaggaacccgaggagagcgcgcgtgcgatccccgaggcgcggggagtcgattccggcgccgtgacagtctcgccctcgccgggccggccgtttggagccctctatcgccgaggatttggtgggatccggccaagaactggttggtggacgggtgaggaggagcacgggggggatgggggccggggcggagccgagggaggaggagcccctcgaggcggaggagggctctggcgggaaggaggagaaggcggcggtgtcgtgctcgatctgccttgacgcggtcgttgccgccagcgcgggaaaggtccatgtgtgaggctgcaatggcggccacgtattgcacctcgattggatttggatcgccatttaatgcccaaggagttattcaatgcccgaactggccccaaattgaaattaggtaattggctgtatgccaatgggttccgccccttcaattatatttacatgggttgacggggcttcttataaaggaccctttttaattgtttagtacttttaaattgccctttacagttttcattggtgtccaatcgtgtctacttatccccctcttttc

SEQ ID NO: 28503 - DNA, 1080 bp, Triticum aestivum
  Clone ID: PAT_TA_28503
gaaacgcaacaccaccaacccagcatgtcaaagaccccctaaatacaacatcacatccaccatccatagaacggaaacgacacactgttttcttatgtttcctctctactagggataaactcaactaaagtaagcaacattttcaccgtgccagcgagacagatcagactatacaattcttcatgtcaaggactcatcaggataccaaattcatcgacgggatttcaagcacgcgagagtaggggcagggcgacctgcctagctgtcacccgccctaaacagggtcatcaggcccaggaacagattgatgatgtcaaggtagagcgtgacggcggcccagacatactcgtcatacttgtaacgcttgatgatgttgcccgtgtcatagacaatgtagccaatgaagatgagtgccgccagcgcgccatagatcatgtgagagagcttgcccagcgggaagaagatctgaatgaacccaaagacgagcaaaatcatcagacaagcaaataggaaaggaccaaggaagctaaagtccttgcccctccttgcagcccagaaggtgtaagcagtgaggctcaagacaaccacgattgtaagaatcccagcctccaaaatgaccttgccactagtgaaggcacatgtcaagcccacagagaagctgatggccactgtgaagacgccaagcagcagcaggttgaccgggtgcttctggcggtagaagtgcaatgggcacatcacgatgaaggggaagatgaggatgaagatgtacagcccgaggccgacgtaggaggaggcgaagaaatgcgggatgctgcggaccttgacgaagacgaccgcgacgacggcggtgaggagaagctgcaggcagaggacgacgtaaaccttccggatgagcgcccagcgcaactccgggctctctgtcgtcccggggtacggcgcccccttcggtgccgcggtgcccgcctcgtacgtcgccgcccgcctcaatgtcgccgcctttcatctcgcccggcgatgacgatgcctccggaatgtagggttttcttgggtgtggcggaaggcgagtggggagcctcgtgc

SEQ ID NO: 28504 - DNA, 1068 bp, Triticum aestivum
  Clone ID: PAT_TA_28504
agggggataaagtgcattctatgattcgcaatacagaagcagcctcaagtcagtgcaataaaaaaaacaagagaaaaagaatgtgtaccgacattctttgccacatgtaatagtgtgtggcataatggagctcaggctcacatgagctctttatagaatatcaaaagtgtgtttgcaacattgtcgaagggaattgagatattcgaacatcaagtatcactgctccatgtatggaagtgacaatatcggaccttcacaatgccgcatgccgacgatgatgccgctgacttctcctctgagctcgcagatctcttttcctgaggacagtagctgtgcgctcaggcggtttatcagtctccatgtcgctgtttggagaacccagtatacaggccagtgggtcctccatgaggttcccaaatgatcccgttgtctgggcagacattgttttgtccttatccactgagttgtttgcttcaatctccttcaccctttccagataggtgctgtcaacatacgagtaacgttggcgccaccggaaaagcaatttatcctggtattgatcagtgtagagattctcggcaaagaaatgcttttttacagcttcaaccgataacttttcatcactatgcttagtaagtattatattagcgagctccattttcaagcgctcaaagggctcctctccacggcccaatatgtataggctagatgcatgcaacgattcataatacatcatcttccctgcagtcaaaccaacaccagcagaaacagcaagcctaaatagtcgaggcataggttgacccccaacaattttatgtacttgcccagacgcgaacgctccgacgagacagaccaccgcagaggtcgcggtgtagctcaggttcgagaacagcatgcaggcccggagcagcgcgtcctccgtctgggtcacgttgcccttggcccggatggagacctccagctgcccgcaccgcctgctccctcttgcccatcaatgccccccacatgcccttcagcgtcgtcgccatctccgctccgcgccgcgccgcgcctcttcgctctaggggt

SEQ ID NO: 28505 - DNA, 670 bp, Triticum aestivum
  Clone ID: PAT_TA_28505
tcccaatggcttccaccacattctcctccgccttctccatcctctctctcccctcctcctcaccatccccctccgcctcggcccccaggaccctacccgtcgccaaccgccgccgccgcgccgtcgccgtcgcctccactgccacggagtccccgaaggtccttgagctcggcgacgccattgccgggctcacccttgaggaggctcgcaaccttgtcgaccatctccaagaacgtcttggcgtctctgccgcctcctttgctcccgctgccgcggtcgcggctcccgccgcagcggcggccgaggaggcaccggtcgagaagacggagttcgatgtggtcatcgaggaggtgcccagcagcgcgcgtatcgcaaccatcaaggttgtgcgcgcactgaccaacctggcgctgaaggaggccaaggatcttatcgaggggctcccaaagaagctcaaggaggccgtgagcaaggacgaggccgaggaggccaagaagcagctcgagggagtcggcgccaaggtgtccatagcgtgagactaggtatactaggctcctttttttcccattacatttatgtttcatatcaatcttttgtattcctcttgtaattgccgtggactgttgtttcatacagtatgagattagttcgcatgtggaattattagttc

SEQ ID NO: 28506 - DNA, 1005 bp, Triticum aestivum
  Clone ID: PAT_TA_28506
caataccgggcgcattagtgtctggtaattggaatgagtacaatctaaatcccttaacgaggatccattggagggcaagtctggtgccagcagccgcggtaattccagctccaacgtcggcaagtcgtcactgctcaactcgctcgttcgccgcaagcgcctcgcgctcacctccaagaagcctggaaagacccagtgcatcaatcattttaaaataaatgacagttggtaccttgttgacttgcctggttatggatatgcttcagcaccacaggtagctcgtaaagattgggatgaatttactagaaattacttcctcagcagagacaatttggtctcagtttttctccttattgatgcaagtattcctgctaagaagattgatcttgactatgctagttggcttgggcaaaataaggtcccaatgacactcgtcttcacaaagtgcgacaagcgcaagaagaagaaaaacggcggcaagagaccggaagaaaatgtagaatgcttccagaacctgattcgcgaatatttcgaggcggcacctccgtggataatgacgagcagcgtaacgaaccaaggcagagacgagatacttctgcacatgtctcagctcagaaactattggcgcaagcattaagtggaggagtaacaagagtaagactgaagtaacagcaaactgcatgcatgcaagcggcaacccctgctacggtttgatgcatcggcacctttgcaatcaggatttcaccaaccaatctgccttgccttttgagctgttgattgtccacgattgcacgatgattactcaatcaacaggcagaccggggatacagacaagccgctgaaatcaactaccctgtttttttcttctatatttgtacaaccgtacagtctcaacgttttgtctttgttaccttctgattataagattgtgcgtcctgtatgtagactaaagaaactcccgtgtcagctaatcatcatcgggaatcccacacttttgtttgttaa

SEQ ID NO: 28507 - DNA, 690 bp, Triticum aestivum
  Clone ID: PAT_TA_28507
gcgccgccgccctcccgtccctcccctcctcgcgccccaagaagcgccggctctccccccgcccgccgccgcccgcagccatggcgaccgagctggcgtacgcgccgccgatgaagtccggcaaggccggcttcgagggcccgcaggaggcgcagcaccgcatccgcatcaccctctcctccaagagcgtcaagaacctcgagaaggtgtgctccgatctggtgaggggcgccaaggacaagctgctccgggtcaagggccccgtcaggatgcccaccaaggtgctcaacatcaccaccaggaagtccccctgcggagaaggtaccaacacctgggatcggtttgagatgcgggtgcacaagcgggtgatcgacctcgtcagctccccggacgttgtcaagcagatcacctcgatcaccattgagcccggcgttgaggttgaggtgaccatcagcgaccagtagagagctatgccttttttctttacaagtgtggggagacaccagcgaaccaagacataattttgaacgtttggtagtatgtgaactgggttttgtatggctcattaagttcttcgccctgtgattcagagtactcctgttgtctgagatatcatccctgaaatttcgtcgccctctggtgtgttgcctggattggtattatacatggctcgctattgatgtgttggag

SEQ ID NO: 28508 - DNA, 1145 bp, Triticum aestivum
  unsure (1)..(1145): unsure at all n locations
  Clone ID: PAT_TA_28508
cgtccgctctcacctcacctgagtagagtcgctttccactccacttcgcttgccctgcacacctgctctgccctaccacctcccaagtcccgagggaccaagcaaggaggcgacccacacccacgcacgagccgtgactgacagacgcccagccagccatggccgcgccgccgccgaagcaggaggagctgcagccgcacgccgtccgggaccagctgccggccgtctcctactgcctcaccagcccgcccccatggccggaggccatcctgctgggcttccagcactacctcgtcatgctgggcaccaccgtcatcatccccaccgcgctcgtcccgcagatgggcggcggcaacgaggagaaggcgcgggtggtgcagacgctgctcttcgtcgccgggatcaacacgctgctgcagagcttccttggcacgcgcctccccgccgtcatcgggggctcctacaccttcgtcgcgcccaccatctccatcgtcctcgccgcccgctacagcggcatcgccgacccgcacgagaagttcctccgcaccatgcgcggcacgcagggcgcgctcatcgtcgcctccacgctccagatcatcatgggcttcagcggcctctggcgcattgtcgtcaggctgctgagcccgctgtcggcggcgcccctcgtcgcgctcgtcgggttcggcctctacgagcttggattcccaagtgttgcgaaatgcatcgagatcggtcttccagagatcatactgctggtggctctttcccagtacatacctcacctggtgcctttgctggggactgcattcgagcggttcgccgtcataatgtcggtggccatcgtgtggctttacgccttcttcctcaccgtcggtggggcgtacaagaatgctgctccaaaaacccaattccactgccgcactgatcgatctggccttgttggggggtgctcccctggataactgtaccatacccattccagtggggagcaccgacttttgatgctggtgaatgctttgccatgatggcagctgcttttgttgctcttgtggagtctactggcgctttcattgcggtttcacggtatgccagtgcaacgccatgccctccttctgttatgagtcgtggcatctngttggnagggg

SEQ ID NO: 28509 - DNA, 1059 bp, Triticum aestivum
  Clone ID: PAT_TA_28509
acaagaggactccaccaagcgtgggtcaagaccgccgtcgccgatgtggacgagttaatcaccaaggccgcgaagaagggccagatgccgtcgcagatcggcgtcctgctccgtgaccagcacggcatccccctcgtcaagagcgtcaccgggagcaagatcctccgcatcctcaaggcccatgggctggcgccagaratcccggaggatctctactttctgatcaagaaggcggtggcgataaggaagcacctggagaggaacaggagggacaaggactctaagttcaggctcatccttgtggagagcaggatccaccgcctcgctcgctactacaagcgcaccaagaagctcccgcccacctggaagtgggaggtgaaggcagttctggacgactacccgaaactctgcctcaccaaggggagaaaggtcctcgagatccggccctccatcgagtggaacaagggacacgctctcaagttcttgctcaagtctctcggctatgcggggcgcagcgacgttttcccgatatacatcggggatgaccgtacagacgaggatgcattcaaggtgctgcagaacatgggacaaggcatcgggatccttgtgaccaagtttccaaaggacaccagcgcatcctactctctgcgtgagcctgctgaggtaaaggagttcatgcgcaagctagtgaagagcaacgggataaagaagggttaattcatcaatcaacagccttctagctctaactcgcatgaagatcgagcaggctatatagctagtacatcaagtctagcttgtttcctttttggacttggtgttgtctctcctttcatctagtagaacaatgcatgcatgcgtgtcagggtcgatatagaagatccagatcgatcagtgacccatgccaggccttggctctgaaggtttctattactgtatccttctctcaaggtcttgtaattagccttcgcttagctatgacagaaatggtattgacaaagtagccctcctttttctcgccctgcactataaaattgttttattgtttgcaaaaaaaaaaaa

SEQ ID NO: 28510 - DNA, 766 bp, Triticum aestivum
  unsure (1)..(766): unsure at all n locations
  Clone ID: PAT_TA_28510
gctgagtttaagcatataaataagcggaggagaagaaacttacaaggattcccctagtaacggcgagcgaaccgggcagcagcccagcttgagcaatcgggcggctgtgccgtccgaattgtagtctggagaggcgtcctcagcgacggaccgggcccaagtcccctggaaaggggcgcctgggagggtgagagccccgtccggcccggaccctgtcgccccacgaggcgccgtcaacgagtcgggttgtttgggaatgcagcccaaatcgggcggtagactccgtccaaggctaaatacaggcgagatgaaccactggactcctcaggcgctcttctcgttgcaggaggctgcagagtatcacatagtcgatgtatttgaaaaggcaaatctatgtgccatccatgctaagcgtgttaccatcatgcaaaaggacatacagctcgcgaggcgtatcggggggagaaggccttggtgatactaatggaagatgttttctgcatcatagggagcaaagactggtgatttggtggtactaatggtagatgttttctgtattaggggtgcaatgcaaaggcgctgatggtagtggcccagtatgtttgtgagtgtatcgttaggaagtaatgtaggtgtattttcatttagttagcatgtcttcgaagttgatctggttcattgcatggttgggatcatctgacctccctgctttgctccatttgaattgatctaattcagacagcgtttctgcgaacanccgaggata

SEQ ID NO: 28511 - DNA, 502 bp, Triticum aestivum
  Clone ID: PAT_TA_28511
gcgcaaattacccaatcctgacacggggaggtagtgacaataaataacaataccgggcgcattagtgtctggtaattggaatgagtacaacctgaccttgtccatcgccctcagcctcgtcctcaacaactgcggcaagaacgtcccctccggcttccagtgccccaactgagcccggccggaccttgcatgctgcatccgccatacctcatgcatgcatgcatgcatgattggctatttgaagtaccaccacgtacttaattgtgcgctttgattacgtaattatctgctggtttttatgtgtggctggatttcgattgcggagaaactacgtactacttctccaggttctacgtacaagcacgcactgttacctgcgtgcgtaaggatttcgttgtgtgtgtgcatgatgtcttgtcgtaatcgtcacatgtttgtgatgagttagttattgccagagtgctcatgatgtaccgctatctccggctaaataaaagatttg

SEQ ID NO: 28512 - DNA, 754 bp, Triticum aestivum
  unsure (1)..(754): unsure at all n locations
  Clone ID: PAT_TA_28512
tttttttagctcaaacgttgataagatttttcatatcccaggaggaatttacaaaatacaggatcaaattattccttagccccagcacgcttttgataattgagaacaatgttggtagctacacaatttgcttgagaaatagttacacgggtgtcatatcccaaggaagaattacaaatacaggatcaaattattccctaaccccagcacgctttgataattgagaacaatggtggcagctacacaatttgcatgagaaatagttacacggtgtctttggagagccagttaagcgagggcccccctcgggcattcgtcagctcatccaccgcatctccacgctcgaaaacggcggccgcacccatcccggaacctatgcacatagaaatcactccaaaccggcagtccttgcctcggcgcttcatctcgttgagaagagtgctgacacagcgcgcacctgtggcacccaatggatgtccaagagcaattgcacctccattaacattgacttttgcgggatcgagatccaacttttttgagcagtacacatactgagatgcaaaagcctcattaatctcgaaaaggtcaatatcattaatttgaaggcccgcggccttcactgctgctgggatagcaacagcaggaccaacacccatcacaagctgggatnaaactccaactggcaagcaaagctcctgtagattccaagaattggaagacccttgtgtgtagcaacatctcgcctcattagtag

SEQ ID NO: 28513 - DNA, 870 bp, Triticum aestivum
  Clone ID: PAT_TA_28513
gaagacaaagaccaagtggggcaccgagatccaggcaagggctcgctccagccatggtcgcacgcctacacctgggaggaggacttcgccgcctccgacgacgacgatgatgtgctggagatcgaggagcgcaagccggagaagaagaagaaggaggacaagcccaagaagatcaaggccgccgccaaggaggagaagaaggcgaccaaatgcgtccagatcgaggagatccccgaggacaacaccgccggctgcgacgccatccgcaaggcctttgctatggggaacggcaaggggaaggccaaggagttgtcgccgcaggatgccgcgctgctcatccagatgaactacaggccgcacctcgcccaccgctcccaggtgctccgctgcctgcgtgatctcgccgtcgccaaggccaagctcaaggagctcaggtccctcttctacaacctctcctacaggcgccgcctctcgcatgaccacgaggagtgccagaggttctccgagaagatcattgtcctgctgctcactgtcgatgcgctcgaggtgagctccgtcatgacctgtttacgattgctgattgccattgctgtgttttggatttgaaattcagttactacatatactggctaccactatattattagacaaaaaataaaagcaaagcacaccaggatgattaccatgctatttagctgagcatccgtccaacatatgtatgcacttgagatgatctccatcatcacctgtaccccattgccatggctgtgttgtgaatttgaaatttacttgctggttagtacagtacattgttggtttgaggatggtctatcaaggtttctgtgcataagtatgatttttctagctagt

SEQ ID NO: 28514 - DNA, 816 bp, Triticum aestivum
  Clone ID: PAT_TA_28514
tcaccttcagcaaccccggcgtgcaggaggacgccgcgtgcggcccgctcatcgacgccgtcgccatcaaggagctccccacgccctaccccaccaaagataacctgatcaagaacgacggcttccagatcgggccgcaggtgttcaagaactcgagcgttggcgtgctgctgccgccgaagcagtaaggacgtgacgtcgccgctgccgggctggatcatcgagtcgctcaaggcggtgcggtacatcgacgccgcccacttctcggtgccggcgggccagtacgcggtggagctggtggcggggcgggagagcgccatcgcgcaggtcatccgcaccgtgcccaaccgcgcctacaacctctcctacgtcgtcggcgacgccaagaacggctgccacggctccatgctcgtggaggccttcgccgccaacgtcacgcagaaggtgccgttccagtccacgggcaagggcgggttcaaggcggcgagcctcaggttcgtggccgccggagtccgcaccagggtcaccttctacagctcctactaccacaccaaggtcaccgacggcgtctcgctctgcggccccgtgctcgaccaggtcaagatcatgccgctcaagctctagtcgtccatcggagtagaccagaagctcagatcaatcctgtcgcgttgattcggcatcgtcctctcgtctactatgtagtagtagtgggtatgtaatttgtgacattgatggacctctctctaatcgtgtgccagcgtggtggaatgaattgcctgtgctgtgcgtgaaacagaagaaagagagggacggatg

SEQ ID NO: 28515 - DNA, 1044 bp, Triticum aestivum
  Clone ID: PAT_TA_28515
tgttcttacgttgtgggatcataggtttttgctgcctgtcaactcatggaactattccacagtaagccctatagagaaattgtgcttgcttataccaccacacaactcaatatcttctactgagaagaccactagtttttgtggccgcgggctgcaatgaagtctccttgtggaatgctgagaatggtagctgccaccagatgtttaggacagcaggcaccgagaatgatgctgttacgccaaagacaccatcaaaacctcttaacaagacaaccgccaaagacgtgaggcgagcaggaaactacaagtacagaattgaggaactggccgatccgcctccacgccttccaggcatccggtgcctgcttcctttgccagggggagatctgttgaccggcggaacagatttaaagatacgttactgggaccaggccagacctgagcaaagcttctgcatcgctggtccttcagcaaaaggagttggaaacgacgagttttacgacatacgatccagctatggtgtacaggttgtgcaggaatcgtgcaaaccgcctacaccggcgtccagattgacgcacaagacgcagctcgcgatggccgccgccgattctgccggctgccaccgggacgcgatcctcgcgttggcctccgtcaacttgtcgagccagcggttgatatcggccagcagagacggcgcagtcaaggtgtggaaatagctactccggcctgggtaagccggcgccttctcccacgacgacaagcaggcaggccccttggtgtacataaatatttagcctcgtgacacagtagtacgtatatatcacgactcactgttgtagtgttgtacatatggcgatgatgttaatcaatacagtaccctggccatttgggttagcgtaataaccagtcgtttgttgatacgtttcttgcaccggaacactctgttttagtttaggcttgagattgacgaaaaggggatacttcttgatgcacgttgcgaataagaaatactagtattactaatgctgtaaaaaaaaaaaaaaa

SEQ ID NO: 28516 - DNA, 640 bp, Triticum aestivum
  Clone ID: PAT_TA_28516
ggcgccgcctctcgcatgaccacgaggagcgccagaggttctctgagaagatcattgtcctgctcctcactgtcgatgcgctcgagggacctgacttcatggtgaggacggcgaagaaatctatgctggaggaactggagagcatgctggagatcgtggacccgcagccaccagggaagcagaggtcgttcaaccgccgcaagttcgatcttccagagggcggagcgatcccaaatgagaaaaccgctggcgtgaacaacgctgtcagagtcatcaacactggcaagggcaagcagtaggcactagcgcctcgtttagtgcccggtaccatggccgatcgatggagcttgtagcgccgctttgtctgtgagatagtccggttcgtcttagatttctagtacctttgagatttgagaagggttgaacttgtcgtgcaccattatccgggatgtcgtagcgtgtatgaaccgtattgtttgtttggacttgttgtaatgtatgctgttgttgaactaccagtagaagagtttggtggctgcgggtccacgatctccaacatgctctccaagttcctccagcaataaaatttcttccgccgtcctcaacaagaagtcaggtccccccaaggggggggcccggg

SEQ ID NO: 28517 - DNA, 535 bp, Triticum aestivum
  unsure (1)..(535): unsure at all n locations
  Clone ID: PAT_TA_28517
tctgccccattctacccagnccactcacccagccgtgcccgtgtgcccgtgcccggcgacgacggcgaggaggaaccaaggaagagaaagaaaggggatcgcggagcagcagccatgggcgtgatgggcaggctcaagatcttcgtcgtcaaggagcccgtcgtcgccgcctcctgcctcatcgccggattcggtctatttcttccagcggttgttaggccaatgttggattcttgggagactgagaaaaatgccaaaaccccagttgaactaaaagatgtggtcgcaggtgtcactgggcaagaaagcttagtgatcaacgtctcttcactctgctgatgttgtctacacattttgttccgcctgtttttgggtgcccaagacgaggatgtagtcggatctcggccaaaataatcattgtgtctgaacctattttgaccatagtgcaatgagatggacttgttgtttgagtggttccaagttgtaagaaagtgaatgcatggaaggccgttgttacccttttgaaaaaaaaaaa

SEQ ID NO: 28518 - DNA, 1348 bp, Triticum aestivum
  Clone ID: PAT_TA_28518
ttcggcacgaggcctcagcgcgcacgcgcgtgcgtgtgtggtggtgggaagttcgcagcttggctgtggggctacagcagcggcagcgatggcggcgtccgtggccacctccccggcctgcacccggctcatccccagcagccccctctccgcctcggcttacacggccgcgccgtccctcgttcgcctggcggggtcctccaggcgcctccgccgggccctgcgcgtctcggccgcggcggagccggccgacgcgctgccggggcccggggccggcgatctggacggggtggtgccggcggggctgctcgaggagctgccggagggcctcgccttccagggcgacatgggcggggggttcgcccccggcggcagcggcggcggcggcgacgacggcaacaagatgctcgaccgcggcatcaacgccgctatcgtgctcggcgccagcacctacgcgctcaccaagctcctcaccgtcgaccaggactactggcatggatggaccatctttgagatcctgcggtacatgccggagcacaactggtcggcgtacgaggaggccctcaaggccaatcctgttcttgccaagatgatgatcagcggcgtcgtctactccctcggcgactgggatagcccagtgttacgaagggaagcccatcttcgagtttgaccgcactcgtatgttcaggtctggcctcgtagggttcaccctccatggatccctttcgcactactactaccatttctgcgagtcgttgttcccgttcaaggattggtgggctgtgcctgtcaaggttgcgtttgatcagacggcttggtctgcgctgtggaacagcatctacttcgtcgccctgggcttccttcgctgggaatctccgtccaccatatacaaagagctcaaggccaccttcttccccatgcttactgctgggtgggaaactgtgggccatttggcacacttaatcacatacggtgtgggtcctatccgaacaaagacttctctgggtcgactgtgtcgaattaatctgggtcactatcttgtcaacttactcgaacgagaaatctgaagcaaggatcttaagacgatcctcccacaacagatacgcaggacaactccagatagcacatacttcatgctttgttgttttctacttcctccgtccgaaaaaatttgtcccaagcttgtccctcaaataaatgtatctagcaccaaattagtgctagactagatacatccatttaagggacaaactttttcagacggaggaagtagattggaacaacagaaactgctccggcttgctttgagattgtataaattgtatgtacctcggccgcgaccacgcta

SEQ ID NO: 28519 - DNA, 795 bp, Triticum aestivum
  unsure (1)..(795): unsure at all n locations
  Clone ID: PAT_TA_28519
ttgcctctcccaacccaacccccgcccggcgcgcccgcccgcccgccccagaaaaatggagacctccttcctcccgaccgcgcggcccctccccgcgttccaaaccctagcagcggccccgcgctgcccccgccctctgcgccgctccaccatccgcgctgccatctcccgcgggcgcaaggaggacacggtcgccgtggtccgcgagcagctggaggggtgctacctcctggccggcatccggtacgagggcctgacggtgaagcagttccagggcatccgcgacgcgctgccggagtcgtgccacctcctgggtggcgaagaacacgctggtggggaaaggccatcgagggcaccccctgggaggcgctcaagccgtgcatgaagggcatgaacgcctggctcttccgtccacacggaggaggtccccgtcgcgctcaagccctaccgcgccttccagaaggaggagcgcgtccaaggagaccaacgacttcatccggggcggtgttccgagggaaaantactacgacccggcgattcaatcgctcgagaccatcccacccgcgcccgagtctatccaactctcgggcccttaatgggcggcactccctcgtcacacctgcagggcaccaaggactctccctgtctcgctaactnccaactccagaagatcccggnccgggccggcccctaatggattgcatatggtgtgcctctatcccacattactcttctntanaatcctgnccttatacgtcnccgtttaatgataaantttccctcaaaaaaaaaaaa

SEQ ID NO: 28520 - DNA, 1446 bp, Triticum aestivum
  Clone ID: PAT_TA_28520
gcgacgactccgccagacctcctcccccttcctcctcgccgcccagatccctgctctcgccccctcagacccagcggtaccccatcaccacccccgccttcctgccagtagtagatcccttatgagctggttggctgcggtttcacttcagtttgggggctactaagatgggtcagcagctgggcagagacaagattggatcaaacttaacagctgatgacatagcgagcgccttctacttctcactcctgctctcccctgttgtctcctactgggattgcatcttccgcaagataagatactccttcagacctgagtgggtgtagcattctgcagcaaccgcttcagcactagttggtccgggagtaaatcggcgggcccgtaggaagaaagcatctagacaggagtccaataactatgaactttgcagattttgcttttccgtaattataactggtagaggagtttagctgaggtagtaatagtcaatagcaagcagtcacagtggtcatggagaaggctgcgggcaatcaggcagggaaagtcttgaagaagggaaagaagaaacaggcgaaagatgagctggaccgccaagaagcaagctgagaaaaagaggcgacgtctagagaaagcactcgcaaactctgctgccatcatctcagagctggaaaagaagaagcagaagaagaaagaggaacaggaaaggctggacgaggaaggcgcttcgatagccgaagcagttgctcttcatgttctcataggtgaggactccgatgaatcccgccatctggtgctgaacaagcacagaagatgcaacgactgggacccctcagctggtttggatttcactctggatacgcaaggcgcagctgatatctactcccccggtggactcatgtgcggcaatcaagcttatgcttccagcgggaggtggatcgactgggggaacgctcatcccctgccaacctggggagaagtgagggacctgaaagcgtcctactaccaaggaacgttccaccagtcaacagtcgcctgcccaggctacatggctgcccaggccgtctcatctctgcagatccaagaagactcatcctctccaggccaaggagttgccaccgcgaccgtcgttaataggatgctcggcggcaccaacaggctcaacctttacagggagatatgaaaaaggaagatatatacaacctcgtcgtcatggtgttcttgtacatagtagtcaccgaaggtgtgctgactattttgcctgcgtgcagctgttccagctatcaggagaatctgatggcgcaacttgtttcgcccttttgttttcatcagtcggtgtaataggatattttgcgtctgctattgttggtattgtaatgaaacaaatatgatttcgattctcttgctgctagctgggtttctctcgaaaaaaaaaaaaaaaaaaaaaaa

SEQ ID NO: 28521 - DNA, 1091 bp, Triticum aestivum
  Clone ID: PAT_TA_28521
gcacgaggcgcaagaacaccagagctacgggagcgagctgggtcttgtttcaaattaaaggctctcccactgctagcactagctagagctcaagcgcagtgcagggcacaccccgtgcgaagctaagcatgtgcagccaggcggaccccacgctgacgtgcccgccgccgtcgcaggggcggctcatcacggtgctgagcatcgacggcggcggcatccgcggtctcatcccctccaccatcctcgcctgtctcgagtccaagctccaggagctggacgggccggacgcgcgcatcgcggactacttcgacgtgatcgccgggacgagcacgggcgcgctggtcacgtcgatgcttgctgcgccgggcgagaacaagcggccgctcttcgaggccaaggacatcaacacgttctacctcgagaacgggcccaagatcttcccgcagaggaggttggggttcctgaccccgatggcgaacctgttcggcgccgtgaagggtcccaagtacgacggtaagttcctgcacgacaagatcaagagcctcaccaacgacgtgaccgtcgccgacaccgtcaccaacatcatcgtcccgacgttcgacatcaagtacctgcagccggtcatcttcaacacgtacgaggccaaggtggacccgctcaagaacgcgcacctctccgacatctgcatcagcacgtcggcggcacccacctacttcccggcgcactacttcacgacccatgaccccgcgggcaagctgccggaccgtgagtaccacctcatcgacggtggcgtggcccgccaacaacccgaccatggccgccatgtccatgatcaccaaggaagtgttgcgccgggaacccggacttcacgcatggcaagcccgccgagtaccacaggtacctcatcatctccatcggcacagggacggccaagcaggcggagaagtacaccgcgccaagactgcgccaaatggggcgtcctccgctggctctatgacggtggctcaacccaattatcgacatttctccaatgcaaacgccgacatgtcgacatcacctgctataataatcaaggctctcacattgagaaa

SEQ ID NO: 28522 - DNA, 1210 bp, Triticum aestivum
  unsure (1)..(1210): unsure at all n locations
  Clone ID: PAT_TA_28522
tcggcaccagatcaccaccaccaccaccaccacggcggccgctcccacgacgacgaccaccatcacggggatgccgccgccgcgaccgccgggaagggggcgggggcgggggcgggggcggggttgtgggtcggcgaggacgggcgcgtgtggcactcccacgacggcctggcgccgcactcccacgagcccatctactccgccggggacttctccaagcgcgcgccgccgctcgactcccgcagcttcgccgaccgcgccttcaccgtcggcatcggcggccccgtcggcaccgggaagactgccctgatgttagcactctgcacttccctgcgtgacaaatatagccttgcagcggtcacgaatgatatattcacaaaagaggatggagaattcttggtcaagcatggagctcttcctgaagagcgtatacgtgcagttgaaactggaggctgccctcacgcagctatacgtgaggacatcagcataaatctgggccctctggaggagctatccaacttgtacaaggccgatttattgctctgtgaatctggaggagataacctggcagccaacttcagcagggagctagcagactacataatctacatcatcgacgtgtctggcggggacaagataccaaggaaaggtggccctggtataacccaggcagatcttttggtcataaacaagacggacctcgcctccgcggttggagccgacctggcggtgatggagcgagacgcccttcggatgcgggaaggagggcccttcgtgttcgcccaggtgaaacacggggtcggcgtggaggagatcgtggaccacgtgctgcgggcctgggagatcgccaccggcaaccggcgccgatagagaggctccatcatgtgccacgtaactttcgggcatgtgttaatgtcgcccgcacacgtaaattgtggagccggcttcttttcgccatgaataaaccacgcgtcgtgtagtactgcacgctgaaaaatagcattgtgtgcttggcagcgtactgctgctaggaactgaacccgaatgccctggggtgagttctttatgtaacttgatcagatgcatggtccttgatgggaattagtaataagcaaaaaaagtttgtaaatgtgacgtttggcattgtcgtcttcgctgcgcgacgggcacccggagaaacaaacaataaggttgtttggnataatataag

SEQ ID NO: 28523 - DNA, 859 bp, Triticum aestivum
  Clone ID: PAT_TA_28523
tgttctcgcacgcaccgtcacaagcagctcaatctctttctccttttcttttctctgccccctcccttatccccacgcccaggaaacgcgtctccggaggaggaagggaagatttcatcttttttgcccccaagatgtcctccccaagcaagcgccgcgagatggacctcatgaagctgatgatgagcgactataaggtggagatggtgaacgatgggatgcaagaattcttcgtggaattccgagggcctactgaaagtatttatcaaggtggtgtctggaaggttagagtagaactgcctgatgcatatccttacaaatctccgtcaattggtttcattaataagatttatcacccgaatgtggatgaaatgtctggttccgtatgtttagatgttattaaccagacatggagcccaatgtttgatctagtaaatgtgttcgaagtcttccttccacaacttctgttgtacccaaatccgtctgatccattaaatggagaggctgctgcacttatgatgcgagatcaccctgcttatgaacaaaaagtgaaagaattttgtgaaaaatatgcgaaaccagaggatgctggcataaccccagaagacaagtccagtgatgaagaggagcttagcgaagacgaagatgactccggtgatgaggatatagtgggcaaaccagatccttagtcactaccacaacccgttgtatacaatgttggttgcaaaatttgcaatcaaattgatccagaaatctgggaaagagaactttgtatgtcatgtaaataagtgtacttgtatcttatcccaatgttgtttccttccagtttgaccaattgaattttgcagcatttgccatt

SEQ ID NO: 28524 - DNA, 1418 bp, Triticum aestivum
  Clone ID: PAT_TA_28524
caaaggcaaattggtatgtactagcccgtgacgtcaccatgccgtcgatcgacaaggccaccgacaacggcgagctgaagcagaggcagccggagcaggagctggtctgcgtcacgggggccggaggcttcatcggctcctgggtcgtcaaggagctcctcctccgtggctaccgcgccaggggaaccaccagggaccccgctgaccgcaagaacgctcacctgctggcgctggagggggccgaggaactaacgcgcgcggccgctacctttgcatcggtgccgtgctacaccgcgcgcacttcctccaactcctcggcgacctcttcccgcagtaccacataaccgccaagtgcgaagatgacggcaagcccatggcgaagccttacaagttctcaaacctgaggctgagggagctggggttggagttcactccgctgaggcaaagcttgtacgagacagtgacgtgcttgcagaaaaagggtcacctgcgtctccccattgttcccatagcacagaagcgcgcgtacttgtaacagggcaggacaggggacaagcccatctcataaaacaacaagagcaaagctgcagcagcaaaagcgggactacccgctgagtttaagcatataaataagcggaggagaagaaacttacaaggattcccctagtaacggcgagcgaaccgggagcagcccagcttgagaatcgggcggctgtgccgtccgaattgtagtctggagaggcgtccttcgatggctctatgacggcgggcttcaccccgctcatcgacatcttctcccatgcgagcgccgacatggtcgacatccacgctgccgtgctgtttcaggccctccgcattgagaagaactacctacgcatccaggacgactcgctcacggggcacacatcctcggtcgatatcgccaccaaagagaacatggaggcgcttatccgggatcggtaagaatctgctcaagaagaatgtgtcccgggtgaacattgacacagggatgtatgaatccgtcgaaggtgagggcacccaacgaagaggccctcacgcgcttcgccaggaagctctctgaggagcgcaagctgcgccaaaccaacctcaactccaaatagagaagaggacgatttgagcgaaagagaagagagacgaagaagcactagctagctgctatgcttaaggatgcaaacggccgataatctttgttattttaataaccgtgcatgttttaattatgctttcaatgggacaaacgtcgacgctgtccattttgcatccccttagctatgctatagctaggtccaagagtttgttaatataatgtaatgtgggtgggtaattattatttttaaataaaatctgagttgtggttcgctaccaccctctagatacatttaaaaaaaaaaaaaaaa

SEQ ID NO: 28525 - DNA, 593 bp, Triticum aestivum
  unsure (1)..(593): unsure at all n locations
  Clone ID: PAT_TA_28525
cgtccctcagattcactacatccgctcgcagcttgagatcgtcagccatgtccgggcgcggcaagggcgggaagggactcggcaaggggggcgccaagcgccaccggaaggtgctgcgggacaacatccagggcatcaccaagccggcgatccggcggctggcgcggaggggtggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtccggccgactgtcgcctgtcttcgtcgcagcctgcagattccaaaagcttgatggaaccctgacttgttcagttcgctatttcctctgtctgtagttcgttggaaatgaaacttgtctctgtcagtctgtcgtaaatctgattttgttcgctggttggtcttctgcatctctgttcggtacgattgttgtttcctttgtgatgncttgagtaggctnccgtatnaatcgaac

SEQ ID NO: 28526 - DNA, 1136 bp, Triticum aestivum
  Clone ID: PAT_TA_28526
gcgcgcaatggcggcggtgcagcagtacacgggggcgctcttcctcgccgttgccctcgtggcggggccggccgtctcctacgccgcctacgcccccggcgccccggccacccccgccgccccagggacccagcccaaggcgacgactccggagcagaagctgtttgaggatatcaacaacggcttcaaggcggctgtggcggccgcagccgccgtccctgcggccgacaagtacaaggcgttccagaccaccttcatcgcgtcctctaacaaggctttcgcggatgccctcaaggccgccgcctccggccagacccctgccaagtcagactccatgtccagactctccaccagcctcgaatcctccttcaagctcgcctacgacttcgccgagggcgccacccccgagaccaagtacgacacctacgtcgccagtctcaccgagtcgctccgcgtcatctccggcgccttcgaggtccacgccgtcaagcccgccgaagaggaggtcaagggggtccccgccccccagctcaagaccatcgaccagatcgacgccgcctacaggaccgccgccaccgcccgccaacgctgtctcggccgacaaaaagttcaccatcttcgagtccttcttcaacagggccattaaggagaatacgggcggcaaatacgacaactacaagttcgtccccgcccttgagtccgccgtcaagcaggcctacgccgccaccgtcgcctccgcgcccgaggtaaagtacgccgtctttcaggccgccctgagcaaggccatcagtgccatggttgaagccgagaaggatgccaagcccgccggcgccggcgccggcgctactgccggtggctacaaagcctgagctcgccaacaatacacatccatcatgcacacttactatgctgtgtatgtatgtatgtacgtgcgtcgccttggcggccagggactttcctgatgcttccttggttttcgtttcatgcagccgcgaccgaccgtgtgtgcatgtgcctgtaataataacagaatgtttgtaatctttttctattctatgaatttgtaatccccatgacaagtgggatcaaatcggcatattgtattgtatatctatctatcgttggatcgagtttct

SEQ ID NO: 28527 - DNA, 657 bp, Triticum aestivum
  Clone ID: PAT_TA_28527
aggccctatatatatggatagagggagtatgcagagtaacattttagaaggaaggcttttattattattactcggatctcagggtatcatgcatccatggcagaagatacattctacggtagctcactacagctcagcgtacaggcacgccgcacgcgcgcatttattcagttattctcccctgacatctcctccggcccttccctcgccttcctctcgcacgatcccgtgatcggaactcctcacgcatgcgcgcatggcggcgctggcgccacgattgtgtaggtcccgcatttgctcccgacggggagggcgacgccggcttcgcgggagcagcgtacgagcttctcggggctgatgatccgctcgtcggcggcggtgagcacgcggcagatgcagggcatgtccaccttcctcgcctcgaggcggcagggcatgtctggggtcaggtaggggctccccttcttgatggtccacttgcacatgcggatgacgctgtccctctcgtcgtagcagtccttctcccccgcggcgagatgcgccgcgaacccggccacgatcgacgccaacagcaggaagcggacgagggtggctccggcgcttcccatcttcctgtgctgctgctgagctgctggctaatgtgcttgcgagtggtgt

SEQ ID NO: 28528 - DNA, 797 bp, Triticum aestivum
  Clone ID: PAT_TA_28528
gcaggaattcggcacgaggtcggcccccaggaccctccccgtcgccaccgccgccgccgcgccgtcgccgtcgcctccaccgtcactgagtccccgaaggtccttgagctcggcgacgccattgccgggctcacccttgaggaggctcgcaaccttgtcgaccatctccagaacgtcttggcgtctctgccgcctccttcgctcccgctgccgcggtcgcggctcccgccgcggcggcggccgaggaggcaccggtcgagaagacggagttcgacgtggtcatcgaggaggtgcccagcagcgcgcgtatcgcaaccatcaaggttgtgcgcgcactgaccaacctggcgctaaaggaggccaaggatcttatcgaggggctcccaaagaagctcaaggaggcagtgagcaaggacgaggccgaggaggccaagaagcagctcgagggagtcggcgccaaggtgtccatagcgtgagactagaacaatgtgagtattaccttggacatggcatgtgagtttgggtagttgaagaacacggactccccagatgcagatatatgtgtggcgctgacactgggaagttctctgaaaatattgtgtgttgtttctctagagtattttgttttcccccgtgattcgaatctatcgaagccgttgaatgtttctttacgcccactttgtatttctgaatctctagttctgctttccaagtgtaatcgggtgatgctgttgcacccttgatgttacccatccacaaggatcaagtaagccaacggaaagagtttcactttcgcc

SEQ ID NO: 28529 - DNA, 560 bp, Triticum aestivum
  Clone ID: PAT_TA_28529
gcaccaccgctcctcctccgtttccatctcagtcagctccaagccgtcaaccatgtccggccgcggcaagggagggaagggcctcggcaagggcggcgccaagcgccaccggaaggtgctccgggacaacatccagggcatcaccaagccggccatccggcggctggctcgccgtggaggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgacaggggcgaaccctctacggattcggcggctgacctgcgcccgctgctccaatctccatctgctatggtttctctgctatggttttgtttctgagtgcgtgcgtgcgttgctgttccatcggcctgtgtagttagtggatggcgatggatctgaatgtaatggacttgttggttcttgcaagaaatgaatctgaattcaatggaagttgtaccgcatctaaaaaaaaaa

SEQ ID NO: 28530 - DNA, 880 bp, Triticum aestivum
  Clone ID: PAT_TA_28530
gcggccgcccgggcaggtacaacctggtttcaaacaaatgaaagtgttgcgtcaagacaggaacaccgtctgttttattgagttcgatgatgtgagcactgcttctgctgtgcaccatactttacagggtgctgttgttcctagttctggccgcggtgggatgcgaatccagttttcaaaaaatcccttcgggcgaaggaaggacttagttggtggcatggtcggcactctgaatggtgctcctgtttgaggggatgtatcttgaactttagcatgacatcttgaattatcatctgcattgttttagccaaatctgttcctgtcatgtgcgacatcagcatcttcattgggtggagtttctggggcatgatcatcatcttcattaagtggagtttctgggatatcatcatcatctgatagacattgcattgtcactattttcattgttggcggtttcaacttctttaaattagctattgtggtttgacaaggccactatgaatgtctcctaacatgcatttggcatctgtcatgaatattttgtagtgttatgtagtttttccagtgtgcagttgcaatatttcatgtggtaatggcattgccacattatgatctggacatcctgtaatagtataaccgatttatttggcttgctgacaaatgcatgtctaggagacattcagagtggccttctcaaaccacaatagctaatttaaagaagttgaacccgccctagtttgtaccctgacagtgttagaaagatggtttgtgtcgatctataattattgtttgatttgcactggtgatcgctgcttgttaaaattggtggtgcctgctgttggatttgcacatgctgcatcttctatttaaaaaaaaaaaa

SEQ ID NO: 28531 - DNA, 785 bp, Triticum aestivum
  Clone ID: PAT_TA_28531
tctggaatcacgtttacaagccacaccaaccattcctgctgtcaagaagaatccaatcgctgctaatcgagctaaaaggaaattcgttccttctgcggatagtaacgtgaacaggagggtgctgaaaactcctgacgtttcagccaagactagctcagattctgctgaaccccgaaggtcaaaccgccggattcaaccaacctcacggttgctcgagggcctgcagagttctcttatagcctccaaaattactggcgaaaaactccctaggactaatttcaggagtgctacttctgcctcaagaggaaaagcccatggctgattcaaggcaatcgagacgctgttttggtgagacaaccatggcgtgtttgtacatatcggtagcttgccgagtatggaagcaaaaggggataggatttgagtgaaggcttttggagctggtgtgtgtggatgtactataaaactagcttaagttagtgtcttttctctctattgcactggacagtattattgtgtcgtaggattagccattaatcacccccaaaccctccgtttaatctgtatggatacagtgccaaggagaaggacggggtctggcttaaacttactcatcaacggttgtactttaccttgtctcgagtaccagccccatgttggaatgatcgactggtgctctttggttcccaaaaaaaaaaaaaaaaaaaaaaaaaaaaaaaaaagaaaagaaaaacaaagaaaagaagaaagaaagaagaagaaaagaagaaagaaaagagaaacaaggg

SEQ ID NO: 28532 - DNA, 874 bp, Triticum aestivum
  Clone ID: PAT_TA_28532
tttttttttttttttttttttttttttttttttttttttttttttttttttttttacaccagcacgtgcagtccagcacagtttattgccccatctttattcatacacaaaagtagatacaaccagcgtgttcgagcatcttggcctagaatgctcttgctaacagttccgggaagtgaaaccaaaaaacagctcatgtgcgttggttcaacaatacaggagatgatattacacaagacaataatattacagaagacgccgtgaccaaagaaatctacagataacatatgctcgctgcttcaaaaagaatgggatctgactatataattactacagtaaaaaggccagaagtttgaactgctcaatttattcaatctgcacttgagaaaacattggatctcccaacaaagatcagtgggcagcgtctctgctgtagaacgcgtccaaggtcttcgcagggatacgatggagaagctcgcgagggaagatgcggagcaatgtccatgctaggtcaagtgactggaagatgttccgagtatcgtatgctccctgtgctacaaatttcctctcaaatttgtcaaggaactctagataaagcagatcttcagaagagagagcctcctctcccacgactgctttcatggcctggacatcctttccaatagcatagttggcataaagctgattagacacatctgaatggtctcgacgggtcataccctcaccaatagcactcttcatcaaccgagagagtgatggaaggacattgatgggtgggtatatctgtctgttatggagctgtctgtcaatgtatatctgtccttcagtaatgtaccccgtgagatcaggagttggatgtgtgcccacgcggccg

SEQ ID NO: 28533 - DNA, 1152 bp, Triticum aestivum
  Clone ID: PAT_TA_28533
gcacgaggctctctctctctctctctctctctctccttttctctccttctgccagcttacaagccaaccaacgcagcgcaatggcggcggtgcagcagtacacgggggcgctcttcctcgccgtcgccgtcgccctcgtggcggggccggccgtctcctacgccgcctacgcccccggcgccccggccacccccgccgccccagggacccagcccaaggcgacgactccggagcagaagctgatggaggatatcaacaacggcttcaaggcggccgtggcggccgcagccgccgtccctccggccgacaagtacaagacgttcgaggccaccttcagcgcggcctctaacaaggctttcgcagatgtcctcaaggccgccgcctccggccagatgcccgcccagtcagcctccatggcatcactctccaagagcctcgaagcctcctacaagctcgcctacgacaaagcccagggcgccacccccgagaccaagtacgacacctacgtcgccagtctcaccgagtcgctccgcgtcatctccggcgccttcgaggtccactccgtcaagcccgccgccgaggaggtcaaggggatccccgccccccagctcaagaccatcgaccagatcgacgccgcctacaggaccgccgccaccgccgccgacgctgccccggtcaacgacaagttcaccgtcttcgagtccgccttcaacaaggccatcaaggagaccacgggcggcgcatacgacaactacaagttcgtccccgcccttgagtccgccgtcaagcaggcctacgccgccaccgtcgcctccgcgcccgaggtaaagtacgccgtctttcaggccgccctgagcaaggccatcaatgccatggttgaagccgagaaggataccggcgccgccactgccggtggctacaaagcctgagctcgccaacaacacacatccatcacgcacacatactatgctgtgtatgtatgtagtacgtacgtgtgtggccttggcggccagggattttcctgatgcttccttcttggttttcgtttcatgcatgcagccgcgatcgaccgtgtgtgcatgtgcctgtaataataacaaaatctttgtaatctttttctatgaatttgtaatccccatgacaagcgggatc

SEQ ID NO: 28534 - DNA, 622 bp, Triticum aestivum
  Clone ID: PAT_TA_28534
gccggccgggtcgggccacacgactctcggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgcctgcctgggcgtcacgccaccgaggacattcaagaggtgaacgcggctgtgaatggctcgcgggaggagtaacttgtgttgtgggtgctcgcagtatgaggatgtcgaccgccccatgtactaccaagtccgctgtaatgttgtcaagctaccctctcgctagctacctcaactgcagttctatcagaacagctgtatgtacatgtcagctccaactcaaaagaccactagcacagtagcattctccattctccagcattctataaggcctctagtgcttaatcccatccgttcaccattgttgccgctgcacgaaattgagataaacaaataaaaggtctgcagtaaactctccatggagtgtttctgtcgaatacaaccttttttgtatgaaaaattgtccaatgctcctttctgttgggtttaaaaaaataaaaaaaaaaaaaaaaaaggccccta

SEQ ID NO: 28535 - DNA, 755 bp, Triticum aestivum
  Clone ID: PAT_TA_28535
ggaatataatacaccaatggggtgaaaaggatacattgccagtttgatggaagacttgcaagttacaacaacagagttcagaaccaagatcaactgatctgtggtaacaaaatctcacaggccgagagagcatcagactgatcaatatagcaaaatgatcgcgaaacaaccaccgtagataacctacatatttctataaacaactgaggtcctctggatacacaccattcatgcgatctctcgccagctctctattcttcattccaatttgttttcccatcactatcaggtgggagtgagagcatgccatgaaaaatatgattctcacatatgccaatcaacatgcttagtatttcggcggtgcaggtggcaaccggtttggtgtgcgtcggctgcctgaattggcaccgttggcatccccattttcataccgccgaccacgactgtcagcacttctcgatctcgactcgttctgtgaactggatcggtcggcagagccatttgctgcagcactgaaggcagacctccagtcctcacctgactggccaggactctgtgggccactctccggaccagaagtatcatcagaatatgatgcagctgcagctctgttatcatggacgctgagctgacgagtaagttttgacaggagagtcgattgtttttgggccttttcccgtctacgtttagcattgtggtcctcttggagaagttcttcaatccttgcattgctttgtgaacttattgagctgtac

SEQ ID NO: 28536 - DNA, 895 bp, Triticum aestivum
  Clone ID: PAT_TA_28536
accggagcaaagaaaaatattcatgcagataacttcaatgcaaatcctatagtccaatcttttcataggaaactttcctgtagatctctgatgctatgagattcctgcaaacatcctttgttccaaaaggcattggttggattgcaaggtaggcacatttgccaatgctatgctggtaatcctttctctaaggtgaggtaccaaaatgagacggacgatttcataatgtagcaggggcaatgccaagtgctagagaaatataggatgatttatgaattttccaaggacccggacaattttgcaagtgtcgttgaatgccagccatttctttgtgcaaaatagcggtgtttcttttatattcaaaaccatttaaaactggtggttaccactcttgggaaacttctgtacaagatttatgtacgaggccggtcgactctgagcatgtgcttactcagctcacgaattgtttctggaggaggttggcgcagaactctaaatcgaagcgcccttccggagggtcgccgatgcaatcgaacacggcgtccgctatcacgaagtcctcatctgcggtgtacccgctttttgttacaatgcacttcataccagcagctttggccgctgaaagccctatgttactgtcttcaacaacaacacagctagatggatcaacttccaatgtagttgctgctagcaagtagattgccggatcaggttttttgcgaggaaccacatccccagcgaatatggtaatcttttctgctcggtcaggccccagtaagcacgatactattgctgaaacagctttctcatttgaagtactgcatactgcaactttcacccctttcctagagcttcatcaattaacctttgaacacctggacggagaggaagcaac

SEQ ID NO: 28537 - DNA, 902 bp, Triticum aestivum
  Clone ID: PAT_TA_28537
aatattatgtcaatttgtaagaaaaggcgtacaccagcaggttgacgcgtggaagacccaaaataagcacttctatagaaaggtgcagcatcaggcgtcaaaatgcaagatggatcatgaaccaatagagagaattgattcaactatatatttctataaacaactcagggtcgcctgcgcatgcatacgcaccgtcgatgagaccctcgaccaaggcgctcactctaattgtccaatctcaaactcgctccaccaatctcaccacccaattatcagaaacagggtgtgtgcctagcaagaatacataataataaatcatggatactaatcaggcatgatttagtatctcggtgggcgctgggcggcatccggtttgggtgtgcgtctgctgctcgagttgggatccccattttcaagagcgtctgcgaccgtcaagcgcttctcgatcttgattcgatgtttgggggcagggccatttgctgcagaatcgaaggctgacctccagtcctcaccagggcggccaggtgtcctggggctctcagtttcaggactgtcatttgagtaagaagaagcagcagctcgattgtcatggatactaagttgacgtgtgagctttgacagcagagatgattgcttttggtacttttcccttctacgtttagcattgtggtcttcttggagaagttcttcaatttttgcattgctttgcccgcttatagaactatatagctggttcaacatatcctcctttgctttctccacttggcagagcacaatagccttcgggacatttgctgctagactatttaaaacagcctcaacataaccgcgaacttcttgagacatccacctaagttcttcttcaggatcagctggtctccgtatcattgcatccctcgtgc

SEQ ID NO: 28538 - DNA, 1440 bp, Triticum aestivum
  Clone ID: PAT_TA_28538
tttttttttttttttttttttttttttgctcaacatctcaatccttgtttcaatttccaccggacaagtcagataaaagccattcagatccaggagcactagtagtatcttacagtagtagtagcagtgccattttaaccagccagcccatcttccaggcaaacacacacacacacgcacacttgttgcggttaccatcctagcggtttttcatcagttgacaacaacaacaacaacaaaacagccagcatcatcatcatcatcatctggcacaaaagcacagcacacagacacactcaggggactaataggacaccgagcgaccgacgaatcaatcagcaacgcttctcgcctgctgctccggccgggggcgtttcttgacagcggccgagagccatgcagggggaggttgaccaatgctgaacttttggcttttgggagggtttagggtttccatatacgtagccgtcgtcaaaaaagaagggcaaagggaaagaaaaaaactgtaaccgtgatccatgttccggcaggtagcttcttctttagcttctagtaagtatatcttggggggtggtgttctcttttctgttgtcgtcgaggcgccgtgctgtgctagcaggaggagcccttgtggcaggacagggcgcccgcgccggaggtgatggtggcgaccatggatgaggacttggcgccgaggctggaggcgcgcgagtagctggctgacgcgcctgctcccgccgaggctggaggcgcgcgagtagctggctgacgcgcctgctcccgacggggtgaagaaggcgccgttcagcagcatgtcgccctctgacctccagttccaggccttccacgtggtctgggcggtctcgactctctttgtcacctccttggcgaaagggttggttggcgcgaggtagcggttcccctggctgttgatggtcggctcggcgctccctccgatggcgtacatctcccagtgggtgtagtcattgttcaccacatggaagtaaccatgcctgcaccttggcatcctctggatgagcccttccccgaaatggttgaaagcaattgtgacctgcattgccttgtccttgaggtaggagtcactgtgacccaggagcatcacctcattgtggtgggtgaagtagttgttggagacagtgatggcggtggagcccatgatggcgtcgacgaggccgtcggcgcagttggagagggagcagtggtcgacccagacgtggctggcgccgaagatggagacggcgtccccgtcggccatggtgcgccacccgtagtggctgggcgagctgcgcaccatggcgttgccggtggggcggcagtcgtggatgtgaaggccgtgaatcatgacgttggtaacgtactgaatggtgatgcaggcgccgttggcgatgtgcacgttggcgccggacgcgtggacggacg

SEQ ID NO: 28539 - DNA, 593 bp, Triticum aestivum
  Clone ID: PAT_TA_28539
ggcaacagccaccaccaggccagcagcgcgcacacacaccagccaagctcgccggagagagaagcctcgaagatgtccggccgcggcaagggagggaaggggctgggcaagggcggcgcaaagcgccaccggaaggtgctgcgcgacaacatccagggcatcaccaagccggccatccgccgtctggctcgcaggggcggcgtgaagcgcatctcggggctcatctacgaggagacccgcggcgtgctcaagatcttcctggagaacgtcatccgcgacgccgtcacctacaccgagcacgcccgccgcaaggcagtcaccgccatggacgtcgtctacgcgctcaagcgccagggccgcaccctctacggcttcggcggctaggccgcgcccgtccactcgaatccacctcgcgctggtagccagattcgtagcatatatagctagctatgggtgtccactgttcattgtcttcattgtaatggccgcatctcgctgctcttgttcagtgttcagtgattggatgtacatcagtgatactagaatggaaatcgcagcattttacccaaaaaaaaaaaaaaaaaaggccccta

SEQ ID NO: 28540 - DNA, 927 bp, Triticum aestivum
  Clone ID: PAT_TA_28540
cctagcgctcgccgccgcccgcgccgacgcggccgcgccgtcgccgctcgccgccgcctgggggacccgcgcgctctccaccctcccccgcgatccggccgccgcatcccccgcctcgtcgccgcggcaaccggcggcggtctcgcccgctcggcctctccaagattctaggatatgagcaggcatctcgactcggtggcacacacgtattgcctcgctggttttctactggagcctccaatggatcttctgatcagcagacctcaaagacaattgctgggatggtacaatcggatgcactgaaatcacaggagggagcctcagcgaaggtcgcagcattcagccccattgaagcaaccattagcaagcccagaagcagtccattgacactcgaaagcttgaaagtgaggcggaccgagatgatgacaaaagtcacgttctacatgatcccgactctgctcctggtgtcgaagaacagcatcagcacttctctcctgattgcgtcagtgtaccatcaggtctacatgttccacaaggagatcctcctggactacgtccaccatgacatcaccaggaagtgggccttgatatacttcaagctcctcttgctagtcatggccaaggacacgatggtgtactttgatctgttctaaatgcctccatggtagtagcttctcgagagatgccaccaggaaccctcccatctgtacactggaataatctttgaggtggacaaaatgcccgactgctggttcttcttctgtctcgcatatcaagttgctgcgtttttctgtttcctcttattatggctgtgattgattaatggacaagtaatgttcagttgtcacagagtactagcttatacgggagcaacgtttgccctagttttgtaataatggtatatatcaactcttgacgttctgtcgt

SEQ ID NO: 28541 - DNA, 540 bp, Triticum aestivum
  Clone ID: PAT_TA_28541
ggttcctccgattccacatccgctcgcagctcgagatcgtgagccatgtccgggcgcggcaagggaggcaaggggctcggcaagggcggcgccaagcgccaccggaaggtgctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggtcctgccgactgtcgcctgtctctgtcgccgcctgcagatccgcaaagcttgatggaactctgactttttcagttcgctgtttactctgtctgtgtagttcgaactgaatcgtggaacaaagttatttgcatatcttgttggaaatgaaacttgcctctgtcagcatgtcgtaaaaaaaaaa

SEQ ID NO: 28542 - DNA, 1526 bp, Triticum aestivum
  Clone ID: PAT_TA_28542
tagagcggccgcacccatcccggaacctatgcacatggaaatcactccaaaccggcagtccttgcctcggcgcttcatctcgttgagaagagtgctgacacatcgcgcaccagtccaagaatcaagcaagtgatgagcgccaggtgcacacagcattgattaaaaacagatacctgtggcacccaatggatgtccaagagcaattgcacccccattaacattgacttttgcgggatcgagatccaacttttttgagcagtacacatactgagatgcaaaagcctcattaatctcaaaaaggtcaacatcgttaatttgaaggcccgcggccttcactgctgctgggatagcaacagcaggaccaacgcccatcacagctggatcaactccaactgcagcaaagctcctgtagattccaagaattggaagacccttctgtgtagcaacatctcgcctcattagtaggacagctccagctccatcacttacttggctagcatttccagcagtagtggtcccgtccttagaaaatgctggtttaagttttgacaggactgccagtgtggtattcgatcggattccatcatctgctgagaccacaatctccttttcttcaccagtttttggatccacgatctttgtatgaactggaactatttcttctttaaatttaccagcagcaactgccgccgctgcctttcctgtgagactcaacagcagcttgatcttgctccatgcgtgttatgccaaattgctgtgcaacattctcagaggtaaggcccattgggagaaggcaatcacgtgcttgagcaaatagctcaactttgggattcactttcccaataagatcaactttgttcactgtcatggactctacgccagcagcaataccgatatcatacatccctgcttttatagcagcagcaacatctgcgactgcctgaagcccagaagagcactgccggtttacagtcttcagaggaaccgtgtcagggaaacccgcatacaacgcggccatcctgcattctattgccctttgggacccaggagctaaaacagtaccaacaacaatgtcgccaacttcgctcggatttaactttgttttatccaccaaagccttgaatacgggcactaggaggtcctcagggagtgtatccttgaaactacctctcttggccttgcagattgctgtcctataggcagcgacgatgacgacgtcgtcggcgaagcagggaccccggtggtacgcggcgctctcccccgcggcgcacgcgctggcggagatggcggaggcggcagggctggcgccggccgcgggctccaggtgccgcagcaggatcctctgcctgtcgagcgccttctccattgctggctgctgtctcaaccttgcctcctttcttccttctcccctgcctctcggcgtcctccctgtctcgggaggaattggtggttaatggtgagaatggttggttagtcgagagaactagtctcgagactagttctctctctctctctccctcgtgccg

SEQ ID NO: 28543 - DNA, 623 bp, Triticum aestivum
  Clone ID: PAT_TA_28543
ccggcttacaagcccgcccccaaggtctcaccgccggcttacaagccagcccccaaggtctcaccgccggcgtacaagcccgcccccaaggtctcaccgccggcgtacaagcctgtccccaagccctcaccgccggcgccgaagccgactccaccgccatacaagcccccgacgcctactcctccggcgtacaagccctcaccgccggcgccgaagccgactccaccgccatacaagcccccgacgcctactcctccggcgtacaagccccccaccccgagccccccgcctccgccgtaccaccactaagaagatccaccactctgtcaagctgggagcccagaatgcggtcgagaagagttgtgcgagcaggccaagaagagccacgtacggcgtcgttgatcctcctccggtgtgtgttgctgccgaactagggccgatctctcaggagatggaataatgcagatggctcccattagtttatcttaccagcttatatcatttgtgttcgtccagtgttagcgtctgtgttgctagtgtggcaatgtgcccgtgtcactgtaaaaccattgatcaccacggaaatggaagtaaaaggtgttgtttccaaaaaaagggggggg

SEQ ID NO: 28544 - DNA, 617 bp, Triticum aestivum
  Clone ID: PAT_TA_28544
ggccaccacagctcctcctccatttgcatctcactcagctccaaggaagaagccgtcagccatgtccggccgcggcaagggagggaaggggctgggcaagggaggcgccaagcgccaccggaaggtgctgcgcgacaacatccagggcatcaccaagccggccatccggcggctggcgcggcggggcggcgtgaagcgcatctcggggctcatctacgaggagacccgcggcgtgctcaagatcttcctcgagaacgtcatccgcgacgcccgtgacctacaccgagcacgcccgacgcaagaccgtcaccgccatggacgtcgtctacgccctcaagcgccagggacgcaccctctacggattcggcggctgacctgcgcccgctgctgcccaatcgagtcgaccctgctagctgctgctgctattctcgtgctatggtttcgcttctgaattcagagtgtgtgagttgttgctccgtcggtctgtatagttagtggaaggcaatggatctgaatgcaatcgaaattgttggtttttgcaagaaatgaatctgaatgaaatggagattgtaccgcatctcgctaaaaaaaaaaaaaaaaaaaaaaaaaaaaaaaaa

SEQ ID NO: 28545 - DNA, 772 bp, Triticum aestivum
  unsure (1)..(772): unsure at all n locations
  Clone ID: PAT_TA_28545
gttttttttttttttttttgcagtccagcacagtttattgccccatctttattcatacacaaaagtagatacaaccagcgtgttcgagcatcttggcctagaatgctcttgctaagagttccaggaagtgaaaccaaaaaagagctcatgtgcgttggttcaacaatacaggagatgatattacacaagacaataatattacagaagacgccgtgacccaagaaatctacagataacatatgctcgctgactcaaaaagaatgggatctgactatataattactacagcaaaaagcccagaagtttgaactgctcaatttattcaatctgcacttgagaaaacattggatctcccaacaaagatgagatcagtgggcagcatctctgctgtagaatgcatccaaggtcttcgcagggatacgatggaggagctcgcgagggaagatgcgaagcaatgtccatgctaggtcaagtgactggaagatgttccgagtatcatatgctccctgtgctacaaatttcctctcaaatttgtccaggaattctagataaagcagatcttcagaagagagagcctcctctcccacaactgctttcatggcctggacatcctttccaatggcatagttggcataaagctggttagacacatctgaatggtctcgccgggtcataccctcaccaatagcactcttcatcaaccgagagagagatggaaggacattgatgggtgggtatatctgtctgntatggagctgtctgtcaatgtata

SEQ ID NO: 28546 - DNA, 630 bp, Triticum aestivum
  unsure (1)..(630): unsure at all n locations
  Clone ID: PAT_TA_28546
ctcgtgccgaattcggcacgagagctccaccccccagcgccgccgccgccgcctcctcaaccctagctcgcccgcagcgccgcggcctcctccctcccatcctccccaccggcagccatggcgacggagctggcctacgcgccgcccatgaagtcgggcaagctcgggttcgagggcacgcaggaggtgcagcaccgcatccgcatcaccctctcctccaagtccgtcaagaacctcgagaaggtgtgctcggatctgggtgaagggcgccaaggagaagcagctcaaggtcaaagggccccgtcaaggatgcccaccaaggtgctcaacatcaccaccaaggaagtccccctgcggagaagggaccaacacctgggatcggtttgagatgcgggtgcacaagagggtgattcgacttgtcagtcccccagacttgtcaagcagttaactctatcacatcaacctggcgtccaagtccaaatgaccatcaacgacaattattatctaccccaaatattgtcttaaatcttttaaaggtggagagaactcaantacaagatatttgaacttcgtagatgagatgggttgttacaagttcttgctctatcaatgccaactccaantactccg

SEQ ID NO: 28547 - DNA, 713 bp, Triticum aestivum
  Clone ID: PAT_TA_28547
ggcacagcaagctaagatagaacgcgagggtaagatgtacgattactgcattctccaagatggtcggctatgctcttcaggctgctgagatactgtccaaggaaggaatcagtgctgaggtgatcaaccttcgatcaattaggccactggatagagccgccataaatgcatctgttaggaaaacaaatagattggtgactcttgaagaaggcttcccccagcatggtgttggtgctgagatatgcatgtctgttgtagaagaaagcttcgagtatcttgatgctccaattgagaggattgctggagctgatgtacccatgccctatgctgccaaccttgagagattggctgttccacagatcgaggatatcgtccgagcggccaggcgagcctgctacagagcgttgcccatggcggcaactgcgtgatcgaattttcactttactttgccgctttttcccgtctcccgcccggccagaaacgtgtgtgttccataatggtatccacaattgcccaaactcaaagcgagttaaatttttgtaggtgtgcctttgccatgttatttttttagctgcagtcggatctcaccgcactcgctggtgcctccctccactgtcttgtgaattattacgcttgcagctttggttgattgattattactacggcctaatcatggtggttacataaatggaaaactgaggtgttgtcgtgct

SEQ ID NO: 28548 - DNA, 1219 bp, Triticum aestivum
  Clone ID: PAT_TA_28548
cccgagctactcgatactcccgtgtccagtccaatcagccgcctctccactcacagctgcacacacgccgccacgattcaaggccgccgcccgctagtctcgagggccgcgacgggaggcatggaaggtgacggcgagacctcggcggcggaggcggcgctcggactgagccctcagaccttcatcaacgaggtcctcaacttcgtcgacgacgtctgcttccaggccttcgactactgcctccaggaaggcgcccccacggcggtcggcgccgccacggcgaccaataaggccgaggagctgaaacggggagtaaatgaaattcaccacttggtaaaggatgtattggacaagagaatgaacaattgggagatgtattgccttcggaaatgtttaactgtacctgaaggatttgtggcacctgaagatgataattcttctgcaatggtgttgcataaagatgggaattctgattcggaactggatgcagaacttaattctttgagaaaaaaactggcagatgctaacaaggaatctgaagaacttcaaagagaaatttcttccttggaaaggcaaactacatacaagagtaaccttaattcctctatcgctgaagtactgaagttgtttgaagacaaatctgttcaggagaatatacaagctattgcgaacacaataccaaaattgcaccagaaaatgaaggttatgaaaaggaaaaaggttgagcttgaggccatggtgggccaaaatgtttggaacgtcaattgtcttagagaccagaagcgtttagcaccaggttccgctcctagcaccgaggacattcaagaggtgaacgcggctgtgaatggctcgcgggaggagtaaccttgtgttgtgggtgctcgcagtatgaggatgtcgaccgccccatgtactaccaagtccgctgtaatgttgtcaagctaccctctcgctagctacctcaactgcagttctatcagaacagctgtatgtacatgtcaacatctatacatatgttgtctctccagactcaaaagaccactagcacagtagcactctccagtctccagcattctataagatctctagtgcttaatcccatccgtctaccattgttgccgctgcacgcaattgagataaacaaatagaaagatctgcagtaaactctccatggagtgtttctgtcgaatacaaccttttttgtatgaaaaattgtcca

SEQ ID NO: 28549 - DNA, 1205 bp, Triticum aestivum
  unsure (1)..(1205): unsure at all n locations
  Clone ID: PAT_TA_28549
cgacaagttcaccgtcttcgagtccaccttcaacaaggccatcaaggagaccacgggcggcgcatacgacaactacacgttcgtccccgcccttgagtctgccgtcaagcaggcctacgccgccaccgtcgcctccgcgcccgaggtaaagtaccaccatgtgtcataacttggaagtcctcaacgatattggccaaagctcgtagaaggctcgccacttgatgaagactgcatacggtctttcagatatatcatatcaatgttttcttggcccgtacaagagtagaagtgatgtcatataatccaatgcatcatgactcctcgatgggcatcttgattcccttgatctcgcgcgcgaggggtccgcagctcctcgacctcgtcgaaggtgaggctccacccgagtgcaccggcgaactccattgcctggccggcgttcttggcccccgggatgggcaccacgttgccctggcaggtcagccagttgagagacacctgtgttgggttcttgccatagcttactccaatctctttgatcctgttcatcagtggttggagcttggtgaggaactcgggagtgtaggtattaccccgaggacccgtaggtggattctccggagtgtatttccctgacagaacaccttgggcgatgggggaataggcgatgagcgtgacgccgagctcgtcgcaggcggccttgacgccgttctcctcaggcgtcctgtagatgaggctgtagttcacctggttgacggccagcgggacgcccctcttcttgagccgcccgtgtgcgtcccggaggcgtttctcattgtagttggagactccgacggccttgacgagaccttgctcgtacgcgtccgccaggccatcaaggtacccttcgtttccccatagccctggccagtggagctggtagagctcgacggaggggaggccgaggcgctccagcgacttcttgagcgcggagaggacgctgccacgtccgaacctccagggtagcgccgcaaacttggtggccacggtcacatccaccgcccccttctgctgcctctccctgataaatctcccagtaggctttctgaattcactgctcccatgagcgctgtgccgtatacttcggcggtgtcaaagaaagtcattccgttgtcgatgcnggcgtcgaatgcngcttagcctccttcagtctcctcgnccgaattcct

SEQ ID NO: 28550 - DNA, 565 bp, Triticum aestivum
  Clone ID: PAT_TA_28550
gccggccggtccgggacatcaccaacagccaccaccgttcctccgattccacatctgctcgcagctcgaagaggatcgtcagccatgtccgggcgcggcaaaggaggcaagggactgggcaagggcggcgccaagcgccaccggaaggtgctgcgcgacaacatccagggcatcaccaagccggcgatccggcgcctggcgcggaggggcggcgtgaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgtaccctctacggcttcggcggctaggtccggccgacggtcctcggtctttgtcgcttccggcagattccaagagcttgatgaaaccctgacttgtctagttcgttgtttcctctgtctatgtagttcgaactgaatcgtggaacaaagttaatcgcacatcttgttggaaaaaaaaaaaaaaaaaaggccccta

SEQ ID NO: 28551 - DNA, 772 bp, Triticum aestivum
  Clone ID: PAT_TA_28551
gacccacaccgcaagaaacaaagctcccatcttttcctcttcctccgccgtcgccgcgtctcctccccgatccccaatccccgatccgtccgcccccacccccagcccggatccaggcgatggcggccgcgggagacgccggcgagaagaagatggtgacgctcaagagctcggacggggaggagttcgaggtggaggaggcggtcgccatggagtcgcagaccatccgccacatgatcgaggacgactgcgccgacaacggcatcccgctccccaacgtcacctccaagatcctctccaaggtcatcgagtactgcaacaagcacgtccaggccaagcccgccgacgccgccgccgccggggccgccgcgcccgacgcggcggcgccccccgccgaggacctcaagaactgggacgccgagttcgtcaaggtcgaccaggccaccctcttcgacctcatcctggccgcaaacttcctcaacatcaaggggctgctggacctgacctgccagactgttgcggacatgatcaagggcaagaccccggaggagatccgcaagaccttcaacatcaagaacgacttcacgcccgaggaggaggaggagatccgcagggagaaccagtgggcctttgagtagaggcgtttgaatagaggagcatgtaggatgaacaatgcttagtattcgtcatgtttgcgttttagcgcctttttttatgtcgccataatggtttcatcgaacagcctgaggtattgctcgtgtgaaaaaaaaaa

SEQ ID NO: 28552 - DNA, 765 bp, Triticum aestivum
  unsure (1)..(765): unsure at all n locations
  Clone ID: PAT_TA_28552
cgcctgctcgaaattaccctactaaagggaacaaaagctggagctccaccgcggtggcggccgctctagaactagtggatcccccgggctgcaggaattcggcaccagataatccccagcccagcccaaatccaaccagacccgatccccacgcgcattccccgtcccggatccgatcgtccgaccgaccgcgccgcgcgaccgccggggggagagagggagagcatggcgagcgggggcaggacggatctggacggcgccgccgtggcgccgctgaccatctgcgtgatcggcgccggcggcttcatcggctcgcacctctgcgagaagctcatggccgagacccagcacacggtcctcgccgtcgacgtctactgcgacaagatccgccacctcgtcgacccgcccccgccccacctcgccggacgcatctccttccaccgcctcaacatcaagaacgactcccgcctcgagggcctcatcaagatggccgatctgacgataaacctggcggcgatctgcacgccggcggactacaacacgcgcccgctcgacaccatctacagcaacttcatcgacgcgctcccggtggtcaagtactgctcggagaacagcaagcgcctgatccacttctccacgtgcgaagtctaagggaagaccatcggggaagcttccctccccaagggccaaccccctccgcaaagggaacttgaattttaatgtngcttggacaaaaagatgaagtcaanccttgnattcttttgt

SEQ ID NO: 28553 - DNA, 1090 bp, Triticum aestivum
  Clone ID: PAT_TA_28553
ctcgtgccgaattcggaacaagctcgtgccgaattcggcacgagcacaattcaacactaagctagctgcacaggacaggagccgatccatccatccatccagaaaaaaagagtgtccgtcgaaaatgccggtgagcaggatcgccatcggcgccccgggggagctgtcccacccggacaccttccgcgccgggcgtcgccgagttcatctccatgctcatcttcgtcttcgccggctcaggctccggcatggccttcggcaagctgactgacggcggcgcgacgacgccggcggggctgatcgcggcggcgctggcgcacgcgttcgcgcgtcttcgtggccgtgtccgtgggcgccaacatctcgggcggggcacgtgaaaccgggcgtcacattcggcgccttcgtgggcggcaacatcagcctgctcaaaggcggtggtgtactgggtggcgcagctgctcggctccgtccgtggcctgcctcctcctcaagatcgccaccggcggcgaggccgtgggcgccttctcgctctccgccggcgtcggcgtctggaacgccgtggtcttcgagatcgtcatgaccttcgggctcgtctacacggtgtacgccacggcggtcgaccccaagcgcggcgacctcggggtcatcgcgcccatcgccatcggcttcatcgtcggcgccaacatcctcgccggcggcgccttcgacggcgcctccatgaaccccgccatcgccgccctcgtctacgacatctgcttcatcggccagcggccccacgagcagctccccaccgccgactactgaaaacctcactctcaatctcatccatccatcaccgccatgagagattgaaatcgattcaaaaaattccagcaagtgtacgtcgtcgtgtcatcatcagtaagccagtttagtttcattctctctccctctctctcacgtgtctttgagaaattcagggtaaacagtgtgagtcagtcagtcaggaataatctcttgtcttggtgtatgtcctcaattatgaatgcttctattccatggtcaagattgatgtttgtacaaaggtattgtctgtccggcaacttga

SEQ ID NO: 28554 - DNA, 862 bp, Triticum aestivum
  Clone ID: PAT_TA_28554
atagtgagtcgtattagcagctggaggaggcaagatggccggaggtcgcctgcccctactgctacgaggactacgacctcggctccctctgcgtccacctcgaggaggaccacccctacgagccacaccccgcaccttgccccatctgctctgaaaagattacaagagatatgctaaatcatatcaccatgcatcatggttacttgttcaaggcgcttctaggaggcggtcatagtcataggtcaaggaacaccaccactgccactacaaatatctatgctgatccactgctttcatcgtttggcctgggttttgcaacatcagatgccgaagaaccatcgaaatcatcagttccggttctcgatgatacttcaattcttaaggaggcgcctcctcaaccttgggaatcaagcattgactcgtccctcacaagcgaggaaagggaacaaaagcggaaacaagccacaagcagggcgacctttgtgcaagacctggtcctctccactttatttggagacgactgagtgctcgaatggccctgcattttccttgttagatgggtgcttccttcacgctgattcggatagaacagcagcactccgccatgagtggttagtcttaacttgggcgaaggcaagtgcgtctggtgcacccgtagtcaagtgcggattttatttggacttgacacatacaccttaatttatggtagctgttccatattgccgttttttccaccgaattatcgcccagcagttccttgccttggttgtaacttgttgtgccatcctcttcattgtcaaggaacattggtctgtaccaacatcacacagctgttacatactatagaatgcaatgcaatggg

SEQ ID NO: 28555 - DNA, 681 bp, Triticum aestivum
  Clone ID: PAT_TA_28555
ggacgcgtacgcggacgcgtgggcatggccgccttcggcctcctcttcctcctgcttgccttcgccgccagctgcaacagcgctgccgctgccagcgcgatgtacaaggcgaaggccagtgtgattttcaggcatgatgctcgcaccatcgaggtcaaattcctcctccccgccagcaacagcccagtcgccactggggacgaggacctgcagctgcggcaggaaaccatggcgcaggccataaccgtcatctcccgccacaggccagagaccagcgacgccgagaagctcaagtgggcgctgggggtggtgaacctcgaggcccagcggtggaagcccatcttcagagccgtcagcacggtgctggagagcggcgccgacgacggcaccaaggaggacgcgttcgcccaggccaaggaggagctcaaccgcgagctcggccaggaaggtcccaacgccctcaagatcgacttcgggtatatgtgacgtgcatcgccatttccccacctctgccttagtttctctatcggccttagcgcgcccaagatatctgtggtgttgttagtcatgtatagtgctcccgtccgtgcgctgcggcctgtcgcagctgtcggagcaccgccattatttcccttctgcttcgttctcgacgccttcggctgcggaacgtttgtgagttgt

SEQ ID NO: 28556 - DNA, 798 bp, Triticum aestivum
  Clone ID: PAT_TA_28556
gacccccacttgcctccgctcctagggtttcccgccgcgcaccacccccaaaaccctcgctccccacctccccggcgatcggaccaatggcggcatcggcggcggcgaagaagctcacgctcaagagctccgacggcgaggacttcgaggtggaggtggcggtggcgatggcgtcgcagaccatcaaacacatggtggaggacggctgcgccgacaacatcatcccgctccccaacgtcaccgccaagatcctctccaaggtcatcgagtactgcacgcagcacgcccccaaggcagacgacgccgccgccgccgccgactctgccaccgccgtcaagcccgacgaggagaagctcaaggccttcgacgccgaattcgtcaaggtcgagcaggcgactctcttcgacctcatcctggctgccaactacctggacatcaaggggctcctggacctgacctgccagaccgtcgccgacatgatcaagggcaagactccggaggagatccgcaagaccttcaacatcaccaacgacttcaccccggaggaggaggaggaagtgcggaaggagaaccagtgggcctttgagtgaaggtcgggtccgtgacgcgaataaccagcatggaaggaaacttggcttcgtcgaatgcctgggagcagccgttaaccgttttgtggttctgagacaacgctagtagggaagatgtaagtaggttctggttccggtcgacctggagggtcctcaccatttggctgactctgcttcgctttttggttgtggtggtattttgctgcactct

SEQ ID NO: 28557 - DNA, 603 bp, Triticum aestivum
  unsure (1)..(603): unsure at all n locations
  Clone ID: PAT_TA_28557
gaattcactagtgattagcgtggtcgcggccgaggtgcccaccggccggagggaagggagaaaagagaaagctagctgcctttgtctttgggccatggcggagttcaagcacctttgcatggccaagttcaaggaaggcgtcgtggtggaggacatcatccaggagctcaccaagctcgccgcggagctcgacaccgtcaaatactttgggtggggcaaggacgtgctgaaccaggaggcgctcacgcagggcttcacccacgtcttcgtcatgaccttcgccagcgcccgaggacctggcggcgtgcatggggccacgagaagcacactgccttcgcagccaccttcatggcggcgctcgacaagtcgtcgtcacggacttcccttagtcttcgttaaaccggcgccgccgcttgcctgacccgcctccactatctctacaacaactatcaacaagcatgggaatacctgagcctcctttctctgctgtcctgctgctcaatgttaacttgncaactgcctgtaagatgtaacgcncgtgttccctgaaaagtgtttggngatcaaccttaataaactgtgganttcgttaaaaaaaaaaaa

SEQ ID NO: 28558 - DNA, 544 bp, Triticum aestivum
  Clone ID: PAT_TA_28558
cccaacttttccttccaaacagcggtgacctccaccaccacccaagagccgagcgaggagaagagaagagatcggccatggctgcggacggcgagaggtgggtgggcctggcggtggacttctcggaggggagccgcgcggcgctgcagtgggcggcggacaacctgctccgctccggcgacaacctgctcctcctgcacgtcctcaaggacccccgactacgagcaggggcgagaccctcctctgggaggccctccggctcgcctttgatccccctctcgggagttctctcacccttcaactgcaaagaaatatggggttgaagcctgatgctgaaacgctggacatgctcaacactatagctaagcaagaaggaggctccgtggtttcaaaagtcctgtttgggagattcccgcgagaagctgtgccaagccatccatgacatgcccatcaactccctgggtcattgggaacaagggccttggcaagctcaagaggttgcgaccaccggccaaacgacctccaagctgttcttaagccacat

SEQ ID NO: 28559 - DNA, 661 bp, Triticum aestivum
  unsure (1)..(661): unsure at all n locations
  Clone ID: PAT_TA_28559
tggcacgagattgtcatctctccacccaatcatcactagctaatacggtgcactgttagctacagaccaagaagtgatcatggcccgcgctcaggtaatgctcatggccgtcgccttggtgctgatgctcgcggcggtcccgcgcgctgccgtggccatcgactgcggccacgttgacagcttggtgagaccctgcctgagctacgttcagggcggccccagcccgtctgggcagtgctgcggcggcgtccagagcctccataaccaggcgcaatccaagagcgatcgccaagccgcttgcaactgcctcaaggggatcgctccgtggcatccacaatctcaaacgaggacaacgcccgcagcctcgcccccaagtgcggtgtcaacctcccataccacatcagtctcgacatcgactgcaacagtgtgtaatgagcgacgattcgtcaagctggtgctcaactcatccatccacgtggagtttaagcgcgcaacctctatcctatgtagtatgggcactattatccagttatactgaatatgaataagaatctctctgctggcttgctggacnctctgagganataatacngtgtactanattaaattgncatggcatccatgttaaggctttaaaaaaactctcttatttaaaaaaaaa

SEQ ID NO: 28560 - DNA, 556 bp, Triticum aestivum
  Clone ID: PAT_TA_28560
tcggcacgaggacgcggaggacctcgcgggggagatcgagcgcatccaggcggcgatgggaggcgacatcgacgtgagcctggactgcgccgggttcagcaagacgatgtcgaccgcgctggaggcgacgcggccgggcggcagggtgtgcctggtggggatggggcacaacgagatgacggtgccgctgacgtcggcggcgatccgggaggtggacgtggtggggatcttccgttacaaggacacgtggccgctgtgcctcgagttcctgcggagcggcaagatcgacgtgaagccgctcatcacgcacaggttcggcttctcgcagggggaggtggaggaggccttcgaggtcagcgcgcgcggccgcgacgccatcaaggtcatgttcaacctttaggcctcgagactgctactgttgctagctattcaagccatgcttggaccggagctgcttgcgtgcgtgcgagcgtgtccgcgtgcgcgcggtgtgttgtgtgtcgtgaaataaaataaaatggctctgcagactgatttctatcgtgaaaaaaaaaaa

SEQ ID NO: 28561 - DNA, 1277 bp, Triticum aestivum
  Clone ID: PAT_TA_28561
gcacgagcaccaatgtcttttttttgagagccaaccagcctcagcgcgcgcgcgcgtgcgtgtggtggcgtcggggctagagcagcagcgatggcggcgtccgtggccttctcccccgcatgcaggcggctcccctgcaaccccctctccgcctacaccgccgcgccgtctctcgtccgcctggcgggaacctccaggcgcctccgccgcgcctgtgcctcggcggagccggccggcgagctggacgggctggtgccggcggggctgctcgaggagctgccggagggcctcgccttccagggcgcccctggcggcagcggaggcggcggcggccacacgatgctcgaccgcggcatcaacgcggccatcgtgctcggcgccatcaccttcgcgctcaccaagctcctcaccgtcgaccaggactactggcatgggtggactatcttggagatcctgcggtacatgccacagcacaactggtcggcgtacgaggaggccctcaaggccaatccgcttcttgttaagatgatgatcagtggcatcgtctattccctcggcgactggatagcccagtgttgcgaagggaagcccatcttcgagtttgaccgtgctcgcatgttccggtctggcctcatagggttcacccttcagggatctctttcccactactactacaatctctgcgagtcggtgtttccgtgcaaggattggtgggctgtacctgtcaaggctgcatttgatcagacagcttggtctgggctgtggaacaccatctacttcgtcgccttgggattccttcggtgggaatctccgtccaccatattcagcgagctcaagtccaccttcttccccatgcttactgctggatggaagctgtggccattcgcacacttaattacatatggtgtggttcctgtcgaacatagacttctctgggtcgactgtgtcgagataatctgggtcaccatcttgtcaacttactcgaacgagaaatctgaagcaaggatcttagacgattcctccacaacagatacgcgggacaactccagatagcacatacttcatgttttgttgttttatagattggaacaacagaaactgctccggcttgctttgagattgtataaattgtatgtacagttagttaccagtgctgcgtgtgtaaaaaaccttgcatctattgcaaacaaattgtgctggccaaacaaaacagaaaataaatggtctcaagggagatcaactcccgatgaaaaaaaaaaaaaaaaaaaactcgagac

SEQ ID NO: 28562 - DNA, 730 bp, Triticum aestivum
  Clone ID: PAT_TA_28562
tcgcactcacgcgctcctagccttcacttcctctgctcctgcacggccgcacctcccttccactcccacttccaaagcagtagcgatggctcagggaagcggcagtgccaccgccgtgctcgcgctggtcctcctctgcctgctcctccacggcgacttcgccgagtccaaggtgtacaccgtcggcgaccgcaacggatgggccctcagctccggcggctggcccaggggcaagcgcttccgcgccggcgacgtgctgctgttcaggtacgggcgcggggcgcacaacgtggtggcggtgagcgcggcggggtacaggtcgtgcagcgcggcgaggggcggcaggacgtacaactccggcagcgaccgcgtcacgctcgcccgcggcaccaactacttcatctgcagcgtccctggccactgccaggccggcatgaagatggccgtcaccgccgcatgatccgtctctccgtccatcggccggccggccggtgcttattaactttagtttactttccttcttcgagtgactgaagctactgcatgatgcgtagtacgtgttcaataaaatgcccgagttcgtgggggttgggccgtctggccggttggcactagctagagagattaatatactctgttgttccggttgtacgtgctttaatgcttgtatatcagaattttgagttgttgtgtcctttgtgatactcctcccaaaaaaaaaaaaaaaaaa

SEQ ID NO: 28563 - DNA, 1164 bp, Triticum aestivum
  Clone ID: PAT_TA_28563
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaaatttgtgtgatgtttgatgtgtaaactgtcatgaatgcattgaccttcttgcatcagtcgttgttcccgttcaaggattggtgggctgtgcctgtcaaggttgcgtttgatcagacggcttggtctgcgctgtggaacagcatctacttcgtcgccctgggcttccttcgctgggaatctccgtccaccatatacaaagagctcaaggccaccttcttccccatgcttactgctgggtggaaactgtggccatttgcacacttaatcacatacggtgtggttcctatcgaacaaagacttctctgggtcgactgtgtcgaattaatctgggtcactatcttgtcaacttactcgaacgagaaatctgaagcaaggatcttagacgattcctccacaacagacacgcaggacaacaacttcagatagcacatacttcatggttttgctgttttatagattgaaacagcagaaactgctccggcttcgttacgttgggattgtataaattgtatgtacagttagttgccagcgctgcgtgtgtaaaaaaaaatccttgcatctattgcaagcaaattgtgctggccaaacagaaccgaaaaagaaattgtctcaagggagatcaactcctgatgaaatatgagttgtgcagcaaaaaaaaaaaaaagaaaaaaaaaaaaaaaaaaggccccta

SEQ ID NO: 28564 - DNA, 659 bp, Triticum aestivum
  Clone ID: PAT_TA_28564
tttcccacgcgtccgcccacgcgtccgcgtcccgtcttcccgccgcctcctcctcctccgcgtcgcaaaccctcgtccaaatccgccgaatcccgcgacccaggaaccaaggtagatcgatggcgaagagctcgttcaagctggagcacccgctcgagaggaggcaggcagaggctaaccgcataagggagaagtactctgacagaattcctgtgatcgttgagaaggctgggaagagtgatattcctgacattgacaagaaaaagtacctcgtccctgctgatcttacagttggacagttcgtgtatgtcgtccggaagcggatcaagctcagcgctgagaaggcgatcttcatctttgtgaagaacactcttccacctacagctgccctgatgtctgccatttacgaggagaacaaggacgaggacggcttcctctacatgacctacagcggcgagaacaccttcgggttgctctagatggcgctggctgccacggcaatcgctcagaatgcctcctgtaaataaggcgtgccaatcaactgtgtatatatctggtttgcctcgtcgtaggatctttaaattgcgcaaccaaggaaaacctattcgtatcctgacttatcgtatttgaatgttctgacttatatataatcgactctg

SEQ ID NO: 28565 - DNA, 1002 bp, Triticum aestivum
  Clone ID: PAT_TA_28565
ctacagctcaataatacgtacatactccctccatccggaaatactcatcggagaaatacataaaaatggatgtatctaaaactaaaatacatctagatacatccattcctccgacaaatatttctggacggagggagtacattgattcttgcgtatatacaaacaatgcggtgcattacaaacaagtattacaacagacagcgggaaccatggctagcgactgtagatgaaatagggcacgcgatggcagctgctatccagaggcagctccaatggtattctctatgtgccgcttacatatgtatattttgcaacaatgcccctcagaggaagaagggaaagcccttctgtgattgtggcttggtgcactctgaattggcccatccgatctgcctccgctcattgtcatacacaactagtttgccgcgcagagaaacatctccgacaattatggttgacccatgattgatctctgttccatttagcagccccagacaaacattgcccttttcactgataatcaagtaatcatcgggaacaatggtgaatgttttcggcacgacaaaccatcttctcccaaaatgaaggttcaagggcttgaagaaggacctaacagaaaaatcagctttccagcatagaggtaatgtcgtatctgagctatcctggacaaaactgggagagtcatccttaatagcatcaataaggtttttatacatttcctctggaaggtatgtatatgagctcccgctatcaaaaatcacttgaacagaatttcctgcgtgcccatgcatgctgagctcctgatctccataatttactttctgggcttctgtgtggtataagttgtctggaccacctcgaataggagcccatgtcattccccatcttggtacataatcatcacccagaaacatgtaccccccaccatttgtttctctagtgatacaatgaccgaaaatgttggaaataattcctttgctggccagctgactaggaaggctt

SEQ ID NO: 28566 - DNA, 1192 bp, Triticum aestivum
  Clone ID: PAT_TA_28566
ggaggatttacgaatcttccaaccaagacgaacaatttttgcaagtgtcgctgaatgccagccatttctttgtgcattgtgcaaaatagcggcgtttcttttatattcaaaaccatttacaagtggtggttaccactcttggcaaacttctgtacaagatttatgtacgaggccggtcgacgctgagcgcatgcttactcagctcacgaattgtttctggaggaggttggcgcagaactctaaatcgaagcgcccttccggagggtcgccgatgcaatcgaacacggcgtccgctatcacgaagtcctcgtcggcggtgtacccgctttttgttacaatgcacttcataccagcagctttggccgctgaaagccctatgttactgtcttcaacaacaacacagctagatggatcaacttccaatgtagttgctgctagcaagtagattgccggatcaggttttttgcgaggaaccacatccccagcaaatatggtaatcttttctgctcggtcgggccccagtaagcacgatactattgctgaaacagctttctcgtttgaagtactgcatactgcaactttcaccccttttcctagagcttcatcaattaacctttgaacacctggacggagaggaagcaacttcttctcaattagggccataaacaattctgttttcctcttgtgaagagaagcaataaattcctttctttcttcgtcagtctttagcgctttagctggccacactgtcttgttgaaatgtgctgtcatcctttctttcccaccacctatcttgagcaattctccgtacaattcaacatcccagctcacacctaattccctctcggcgaaagtctcgttgaaggaaatgcggtggccgtccttctcggtgtccacgagcacgccgtcgcagtcgaagagcagcgccgccggcagggctgcagccggcgctccgcccgcgcccgccgcggacgcgcgagctgcctccgctcgccgcgttctcacggcggacaagcggagaggggagggcgacagcatgctctctcctcctgcccttcttgggaggcaccgggcggcgatccatgcgacggggcgggcgcttgagaaggtcctcgccgggagcgacgtggaggcggtggcggtggcggccatggcgttcatttgcgcgggaaatgatgtggatagcgcgccc

SEQ ID NO: 28567 - DNA, 808 bp, Triticum aestivum
  Clone ID: PAT_TA_28567
ccgcaaccctagagctcctccatcccctcctctcccgggcgcctccaccccccgcctagcggcgcgaagcgaccatgacgttcaagcggaggaacggcgggcgcaacaagcacggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtacatgatggatatgttcttcccaagctgtatgccaaggtgcaccactgcgtttcctgtgccatccatgctcacattgtccggtgtccgctcccgtgagaacaggaggaaccggggagccccccgcagcgtttcaggcgcagggacgacggcccgaggcctggacagggtgggcccgccccgtgccggcggccctggtgcccctggtggtgcgcctgctggcgccggtgccgttcctggtgcccctggtggtgcgcctgctggcgccggtgccgttcctggtgcccctgctccccgtgtctagtttgggaatgctttgtccgtgatatgcgccagccctagttttactcgtatctggatattggactattctacctagtttttgctgtaatcggttgtactgaaagttggttggtcaagcacaatttgtgatcaggtctttaatgttttgacaatttcgctgctatctatatcggagagaaccttttggtttgtctggggattgccccttgtggttttgtgttcatgcatcatatcatcttgtagttctttcaaaaaaaaaa

SEQ ID NO: 28568 - DNA, 1276 bp, Triticum aestivum
  Clone ID: PAT_TA_28568
ggaggggggactcgccgtaccagggctacgacgtgcagcgcctggccaggtgggtggagcacgcgctgcccttctccctgctcctgctcggcgtcttcatccgccagcacctgcaaggtttcttcgtcatgatctggattgccgcagtcatgttcaagtccaatgatatcttgcgcaagcagaccgctctcaaggggagaggaaaatgccaatgcttatcgggattgtaacagtattcaccattcacgtgtttggagtctactggtggtacaggaatgatgaccttgttagacctttggtgatgcttcctccaaaagaaataccaccattctggcatgctatatttttcatcgctgtgaacgatacaatggtccggcaagctgctatggttgtcaagtgtgtgctgctcatatactacaaaaacagcaaaggtcgtcactatcgtagacagggtcaaatgttgacagttgtggaatattcccttcttctgtaccgtgcgttgttgccggctcctgtgtggtatcgttttttcctgaacaaggaatatggaagtcttttttcatctttaacaactggattgtaccttactttcaaggtggcatcaatggtggaaaaggttcgttcacttttggcttcagtgaatgcgctgtctcataaggacttgcattatggttcacatgcaacaactgagcaggttcttgctgctggagatctgtgtgctatatgccaagaaaagatgcatactcccatcctcctgcagtgtaaacatatcttctgcgaagactgtgcctctgaatggttggagcgggagcggacatgcccgttatgcagggcgctggtgaagccaggggacatccggtcattcagcgacggttcaacgaccctcttctttcagctcttctaacaagaaacaagaagcgctaaccttcggcctgcagatgttggatcgccccctgttactctccatcagcctgccgtgtgctgagacttattccagtccaggtccttttccgccacttcgtgacaagtagtaggtgccgtgggtgtgcatattaccctgtataggtccttgcgggattctccatcagaaaaaagaggaatgttatgatgaaataactgaatctatagaggtgaatttccattagcatgtggctgggtgggtgccgccacatctgcaaaattcagaattgaccttatacaagatcacaaatgttaactcttgactcctgagccaacgtagcttgttgcttgtaaaatgagatgaacatatcccttt

SEQ ID NO: 28569 - DNA, 1578 bp, Triticum aestivum
  Clone ID: PAT_TA_28569
tcggcacgagggagctagctacgagcagcgcacgcccgggaaatcttgactagcaccagcttagctaaagctcaatagagcgctgtgccaagaagcagctaaagatgtgcagccatggccacgcggagccggcgacgacgtgcgtgacgtgcccgccgccgtcgcaggggcggctcatcacggtgctgagcatcgacggcggcggcatccgcggtctcatcccctccaccatcctcgcctgcctcgagtccaagctccaggagctggacgggccggacgcgcgcatcgcagactacttcgacgtgatcgccgggacgagcacaggcgcgctggttacctcgatgctggcggcgcccggagagaacaagcggccgctcttcgaggccaaggaaatcaacaacttctaccttgagaacgggcccaagatcttcccgcagaagagctggggatttctgaccccgatggcgaatatgtttggcgcggtgatgggtcccaagtacgacggtaagttcctgcacgacaagatcaagaacctcaccaacgacgtcaccgtcgccgacaccgtcaccaacatcatcgtcccgacgttcgacgtcaagtacctgcagccgatcatcttcaacacgtacgaggccaaggtggacccgctcaagaacgcgcacctctccgacatctgcatcagcacatcggccgcgcccacctacttccccgcgcactacttcaccaccggcgaccccgcgggcaagctgccggaccgcgagtaccacctgatcgacggcggcgtggccgccaacaaccccaccatggccgccatgtccatgatcaccaaggaggtgttgcgccgcaaccccgacttcacgcacggcaagcccgccgagtacggcaactacctcatcatctccatcggcacggggtccgccaagatggcggagaagtacaccgcgcccgactgcgccaagtggggcgtccttcgatggctctatgacggcggcttcaccccgctcatcgacatcttctcccatgcgagcgccgacatggtcgacatccacgctgccgtgctgtttcaggccctccgcattgagaagaactacctacgcatccaggacgactcgctcacggggcacacatcctcggtcgatatcgccaccaaagagaacatggaggcgcttatcgggatcggtaagaatctgctcaagaagaatgtgtcccgggtgaacattgacacagggatgtatgaatccgtcgaaggtgagggcaccaacgaagaggccctgcacgccgcttcgccaggaagctctctgaggagcgcaagctgcgccaaaccaacctcaactccaaatagagaagaggacgatttgagcgaaagagaagagagacgaagaagcactagctagctgctatgcttaaggatgcaaacggccgataatctttgttattttaataaccgtgcatgttttaattatgctttcatggacaaacgtcgacgctgtccatttgcatccctagctatgctatagctaggtcgagagttgtaatataatgtaatgtgggtgggtaattattatttttaaataaaat

SEQ ID NO: 28570 - DNA, 980 bp, Triticum aestivum
  Clone ID: PAT_TA_28570
gccggccgggctgcgacgactctcggcaacggatacctcggctctcgcatcgatgaagaacgtagcgaaatgcgatacctggtgtgaattgcagaatcccgcgaaccatcgagtctttgaacgcaagttgcgcccgaggccactcggccgagggcacgcctgcctgggcgtcacgcgcaaaggcgacgttcggtgagggatgcgacgccgacctccaggagcagttcttgtctgcgatcggcgtggcactggagtaaacggcaccgcacatcgtcgtcaaaatggtcaacattcccaagacccgtaacacctactgcaagggcaaggagtgccgcaagcacacccagcacaaggtcacccagtacaaggctggaaaggcctccctgttcgcccagggtaagcgtcgatatgaccgcaagcagtccggttacggtggtcagaccaagcccgtcttccacaagaaggccaagaccaccaagaaggttgtccttcgattggagtgtgtcaagtgcaagaccaagctccagctggcgctgaagcgatgcaagcacttcgagcttggtggtgacaagaagacaaagggtgctgctctcgttttctaagtgctttgtgtttgggtctcagggtcaccatttctatgcttacctcggcggcatttgggcatcatggatggacacaggcgaaaggaggtacacgtcctcggtttgaggcttgtttcatagggaatgaatgaaaagaaaaaatctctgtgttgcaccaacacaactttcaaaaccacaacacgagaacatgtctatccggtgatgaacaagatttgttcgttgagtcattacccctcagcaccgctcacgatgggtgaggggagggggcggcttatgagtcatggttatggttcagcaagcttcaaaacagcaacagtgtataggtctataggtctaatactcgatatactccaaaaaaaaaaaaaaaaaaggccccta

SEQ ID NO: 28571 - DNA, 1040 bp, Triticum aestivum
  Clone ID: PAT_TA_28571
tttttttttttttttttttagagaacaaaatgtatactgacactctttgccacatgtagtgtgtggcgcaatggagctcagactcacatgagctctttatagaatatcaaaagtgtgtttgcaacaatgtcgaagggaatggaaatattcgaacatcaagtatcactgctccatgtatggaagtgacaatatcggaccttcacaatgccgcatgccgacgatgatgccgctgacttctcctccgagctcgcaggtctcttttcctgaggatagtagctgtgcgctcaggcggtttatcattctccatgtcgctgtctggagaacccagtatacaggccagtgggtcctccatgaggttcccaaatgatcccgttgtctggacagacattgttttgtccttatccactgagttgtttgcttcaatctccttcatcctttccagataggtgctgtcaacatacgagtaacgttggcgccaccggaaaagtaatttatcctggtattggtcagtgtagagattctcggcaaagaaatgcttttttacagcttcaactgataatttttcatcactatgcttagtaagtattatattagcaagctccattttcaagcgctcaaagggctcctcttcacggcccaatatgtataggctagttgcatgcaatgattcataatacatcatcttccctgcagtcaaaccaacaccagcagaaaaaccaagcctgaatagtcgaggcataggttgacccccaacaattttatgtacttggccagaagcgaacgctccaacgagactgaccaccgcagaggtcgcggtgtagctcaggttcgagaacagcatgcaggcccggagcagcgcgtcctccgtctgggtcacgttgcccttggcccggatggagacctccagctcccgcatcgcctctcccttcttgcccatcacttgcccccacatgcccttcaacgtcgtcgccatctccgcgccgcgcggcgcctttttgctctagcccacgcgtccgcccacgcgtccgcccaagcgtccg

SEQ ID NO: 28572 - DNA, 760 bp, Triticum aestivum
  Clone ID: PAT_TA_28572
agtcaactgctctaccaactgagctaacgacccgaagtggtgggtgatgacgggatcgaaccgccgaccccctccttgtaagggaggtgctctcccagctgagctaatcacccacttcggtacttcacatttttacaagaaatttagctggcgagaaagtggtgggtgatgacgggatcgaaccgccgaccaccaccgcaacaaccaagccaatctcgccggagaaagaagcgtcgacgatgtccggccgcggcaagggagggaaggggctgggcaagggcggcgccaagtgccaccggaaggtgctccgcgacaacatccagggcatcaccaagccggcgatccgccgtctggctcgccggggcggcgtgaagcgcatctcggggctcatctacgaggagacccgcggcgtgctcaagatcttcctggagaacgtcatccgcgacgcggtcacctacaccgagcacgcccgccgcaagacggtcaccgccatggacgtcgtctacgccctcaagcgccagggccgcaccctctacggattcggcggctaggccacgcgaatcgatccccccaccaccatatttgtgctcgtagctagctatggctgtgtattgttcatgggcttcggtgtaatggctgcatctcgctgctgtatgtcctggccttgactgttgttgcttggatgtagtagtcctgggatgaaatggaaattgaagtggtctacccttgaattcttctgccaaaaaaaaaaaaaaaacca

SEQ ID NO: 28573 - DNA, 1688 bp, Triticum aestivum
  unsure (1)..(1688): unsure at all n locations
  Clone ID: PAT_TA_28573
ttctgatgtacgtggggatccagcatcagcactgctagaagtacttgaccctgagcagaacaaaacattcaatgaccactatttgaatgttccatttgacctgtcaaaggttgtatttgttgcaactgccaacaggatgcaacctatcccccctgccctgttagataggatggaagtcattgagttaccaggctacacgcctgaagaaaagctgaaaatagccatgaaacatctcctaccaagggtattggaacagcatggcttgagctccgcatatcttcagattcctgaggctgtagtcaaacttatcatcgagagatacacacgggaagctggtgtgcgtaatcttgaaagaaacctagctgcattggctcgtgcagctgctgtcaaggttgcagagctagatagtacgcttagacttggcaaggaaatgcagccaataactacaactctactggactcgaggctcgccgatggtggtgaagttgaaatggaagttattcctatgggtcaggacatatcaaatacatatgaaaacccatcgcccatgattgttgatgaggctatgctagaaaaagtgcttgggcctcctagatttgatgacagagaggctgcggatcgggtgtcatcaccgggagtgtcagttgggcttgtctggacttcttttggtggggaagttcagtttgtagaggctacagccatggtgggtaagggtgacttgcatctgacaggacaacttggcgatgtaattaaggaatcagcacagttagctctgacatgggtgagagcaagatctgctgaccttaatctgtcacccacttctgatattaacatattggagagccgtgatatccacatacatttccctgctggtgctgtgccaaaggatggtccttctgcaggagtgacactggtaacatcactggtgtcattgtttagtaaccgaaaagtcagagcagacactgcaatgaccggagagatgactcttaggggcctagtgttgccagttggtggagttaaggataaggtgcttgctgcacatcgatatggcatcaagagagtaatattaccagaaagaaacttgaaggacctggctgagattccagcgccgatcctcgctggcattgagattctgctcgtgaagcgcattgaggaagtacttggccatgcttttgagaatggattccctttgaggctacactccagtctatagcacgggcaaatctcaattggcgcctgatgtggtatttcctcggtggccatgtacctgttttgaagattcgtcgccattcaccgcccagatatctacaaatgagcgttgagcgtaggcgagcaattgctccatcggagtgaaatctcatgacgccagcatccctcgtccaactcagttaagctaatatgcggaatgtgtatatggatacttgctatccacaaaagcggcagggagatctgctctggtctttgtaattgtatttatagagggatgctcatctatctatgctcggtttgctatggtagcaaggaggtccacctgttgttgtcggtttgggtgtatatgtaacctatttcagccagggagaattgaatgttgcagtatcataaaaaaaggagtgttgatagcacaagtaattgtcgtatataaagagtgaacaaacacactgaaacgtgtccatatacatcnattcaga

SEQ ID NO: 28574 - DNA, 562 bp, Triticum aestivum
  unsure (1)..(562): unsure at all n locations
  Clone ID: PAT_TA_28574
gcctcacactctctgatcagtcaccacagtctcggtctatcacggtagcactagcttcagctagccaccctcttcctctccgggcatcttcttgcatcaaccacggcaatggccaccgctgacgtccagaacccatcggccgcgctgacggaggaggcgcccgcggcgggagacgccagtggccgccgaggaggccgcgaagacggaggaggtccccgcgccgggcgggagggccgaagtcgaggcgcctgcccccgtcgagggttgaggagaccaaggaggaggcaccggcagccgctgagacggaggagaccaaggagccccgagccagcagctgccgcccgagccggagggccgaagcgcccaaaagagccagaggcgccagccgtgggtcgagaccaaggaggctgtggcaaaagcaaagccggctgtggtccaagaggtgaaggaagaagcggcgcctgctgccgagccagaagtggcgggcgtcgccgangaaacaccggctgcaacggangaggcccaacggccgccgcaaaagagccggcgccgccttgncaac

SEQ ID NO: 28575 - DNA, 753 bp, Triticum aestivum
  Clone ID: PAT_TA_28575
ataacctgatcaagaacgacggtttcgagatcgggccgcaggtgttcaagaactccagcgtgggcgtgctgctgccgccgaagcagaaggacgtgacgtcgccgctgccgggctggatcatcgagtcgctcaaggcggtgcggtacatcgacgcggcccacttctcggtgccggcggggcagtacgcggtggagctggtggcggggagggagagcgccatcgcgcaggtcatccgcaccgtgcccaaccgcgcctacaacctctcctacgtcgtcggcgacgccaagaacggctgccacggctccatgctcgtggaggccttcgccgccaacgtcacgcagaaggtgccgttcgagtccacgggcaagggcaggttcaaggcggcgagcctcaggttcgtggccgccggagtccggaccagggtcaccttctacagctcctactaccacacaaaggtcaccgacggcgtctcgctctgcggccccgtgctggaccaggtcaagatcctgccgctcaagctctagtcatccatcggaatagaccagaagctcagatcagatcaatcctgtcgcgttgattcggtatcgtcgtctcgtctatgtagtacgtagtcggtacgtaatttgtgacattgctggacctctctctaatcgtgtactagcgtggtggaactggcgatgacttgcctgtgctgcgcctgaacctcaacttgtcttcaatttgtttggatttgcgtaggctttctactagtat

SEQ ID NO: 28576 - DNA, 634 bp, Triticum aestivum
  Clone ID: PAT_TA_28576
ctgcaggaattcggcacgagccacagctcctcctccatttccatctcagtcaaactccaagatgtccggccgcggcaagggagggaagggcctcggcaagggcggcgccaagcgccaccggaaggttctccgcgacaacatccagggcatcaccaagccggcgatccggcggctggcgcggcggggcggcgtgaagcgcatctcggggctcatctacgaggagacccgcggcgtgctcaagatcttcctggagaacgtcatccgggacgccgtcacctacaccgagcacgcccgccgcaagaccgtcaccgccatggacgtcgtcctacgcgctcaagcgacaaggacgcaccctctacggattcggcggctgacctgcgcccgctgctgctccatcgagtcgactctgctgcatgctgctgttcctctgctatgcgtttcgtttctgagtgcgtgcgttgctgttccatctgtctgtgtagttagtggaaggcgatggatctgaatgcaatcgaaattgttggctatgattgtaccgcgtctcgctatgattgtataccttctggcttgttcctgtacattctaaaatttatcagcaagaacgtcgatgttgactctttcagtaaaaaaaaaa

SEQ ID NO: 28577 - DNA, 956 bp, Triticum aestivum
  Clone ID: PAT_TA_28577
gccaacccaacccccgcccggcgcgcccgcccgcccgccccagaaaaatggagacctccttcctcccgaccgcgcggcccctcccggcgttccaaaccctagccgcggccccgcggtgcccccgccctctgcgccgctccaccatccgcgccgccatctcccgcgggcgcaaggaggacacggtcgccgtggtccgcgagcagctggaggggtgctacctcctggccggcatccgctacgagggcctgacggtgaagcagttccagggcatccgcgacgcgctgccggagtcgtgccacctcctggtggcgaagaacacgctggtggggaaggccatcgagggcaccccctgggaggcgctcaagccgtgcatgaagggcatgaacgcctggctcttcgtccacacggaggaggtccccgtcgcgctcaagccctaccgcgccttccagaaggaggagcgcgtcgaggagaccaacgacttcatcggggcggtgttcgagggcaagtactacgcgcccgccgagttcaagtcgctcgagaccatgcccagccgcgccgaggtctactccaagctgctcggcgccctcaatgggccggccacctccctcgtcaccacgctgcaggcgcccgccagggacgtcgtcgccgtgctctcggcctacgtgcgcaagctcgaggaggaatccggcgccggcgacggcaccgcctagtggcagttgcgatatggttgtgcctcctatcctcacatctcactccttgtttgtacaattccttgtacctttactgtctcccatttgaattgaatcacaagttttccccttcccaatgtgcggcttgtaattgggtagtattttttgcctgctggtgtccaaattgggatgaaattggaaaaggatggtttgagaatcgggcaatgtatatcatgttgatgaataatttggtttgtgtaaaaaacc

SEQ ID NO: 28578 - DNA, 834 bp, Triticum aestivum
  unsure (1)..(834): unsure at all n locations
  Clone ID: PAT_TA_28578
ggaggatgacaagaagaagaagaagccggcgaggacgtgcgtccagatcgaggagatccccgaggacaacaccgccggctgcgacgccatccgcaaggcctttgccatggggaacggcaaggggaaggccaaggagctgtcgccgcaggacgccgcgctgctcatccagatgaactacagggcgcacctcgcccaccgctcccaggtgctccgctgcctgcgcgacctcgccgtcgccaaggccaagctcaaggagctcaggtccctcttctacaacctctcctacaggcgccgcctctcgcatgaccacgaggagcgccagaggttctccgagaagatcattgtcctgctcctcactgtcgatgcgctcgagggacctgacttcatggtgaggacggcaaagaaatctatgctggaggaactcgagagcatgctggagatcgtggacccgcagcctccagggaagcagaggtcgttcagccgccgcaagtttgatcttccggagggcggagcgatcccgaatgagaaaactgcgggtgtgaacaacgcggtcagggtcatcaacactggcaagggcaagcagtaggcactagcgcctagtttagtggccggtaccattgtcgattgatggagcttgtagcgccgctttgtctgttagatagtccggttcatcttagatttccagtgtctttgagatttgagaaagattgaacttgttgtgtaccatcattcgggatgtcgtagcgtgtatgatccatatcgtttgtttggacttgttgtaatgtatgctgttgttgaactaccagtagaagagttggtgcttnattatcagct

SEQ ID NO: 28579 - DNA, 844 bp, Triticum aestivum
  Clone ID: PAT_TA_28579
attcggcacgaggcggatccagagagtgctagggttttctctctctcccggcggcgagggcgatgtcgatggcggcggcggcgagggcggcgacgagggccccgggcagggcggcggcgcggttcgtgcagaccaggctccgctcctccggcaaggtgctcagcgaggaggagcgggccgccgagaacgtctacatcaagaaaatggaacaagagaagcgggagaagctcgcacgcaagggtcccagcactggagagcaagctccgtccaccccaagcgccgcagcgggcgacgtgaacactggaggcgccgcttcgaccgcgtcggcatccgcagcaggcacgtcgaccgacaagaacaggaactatgccgtgctggctggcaccctggccggtctgagcgccctgggctggtacctcctgtcaaagcccaagaagacggaggaggttgtcgactgatcggcccatcctgccctggttttttacttccttactgcacatggacctgcgcgatgatgatgatgataataagtttccgatgtcgtcgaacagcctttcctttgccttgttagctgcttccacagaatctaagacttgagatgatgatgatgatggtctgtagcgcaagttgtcttgctacctgtggttgatatggtatggtggtggttaacgagagaggcgtcttggatgatgcggcatggtccttttcaaagtaatgcaatgcatgggttttccggtgaattttgttggagttgcttgctttgtcagttttggccaaagtatgcatgcaatgcatggtttcaaatgagtgtacttgcagtttgatgcaattcttcaccaggaaa

SEQ ID NO: 28580 - DNA, 1171 bp, Triticum aestivum
  unsure (1)..(1171): unsure at all n locations
  Clone ID: PAT_TA_28580
gagagagagggagagaacagagagagaaagaatggcgtcgcgattgctgaccagatccaaagccctagcgctcgccgccgcccgcgccgacgcggccgcgccgtcgccgctcgccggggcctggggtgcccgcgcgctctccaccctcccccgcgatccggcggccgcatcccccgccccgtcgccgcggcaaccggcggcggtctcgccgctcggcctctccaagattctaggatatgagcaggcatctcgactcggtggcacacacatgttgcctcgctggttttctactggagcctccaatggatcttctgatcagcagacctcaaagacaatcgctgggatggtacaatccgatgcactgaaatcacaggagggagcctcagcgaaggtcgcagcattcagccccatggaagcaaccattagcaagcccagaagcagtccattgacacttgaaagcttgaaagtgaggcggaccgagatgatgacaaaagtcacgttctacatgatcccgactctgctcctggtgtcgaagaacagcatcagcacttctctcctgatcgcgtcggtataccatcaggtctacatgttccacaaggagatcctcctggactacgtccaccacgacatcaccaggaagtgggccttgatatacttcaagctgctcttgctagtcatggccaaggacacgatggtgtactttgatctgttctaagtgcctccatggtagtagtttctcgagagatgccaccaggaaccctcccgtctgtacactggaataatcatcgaggtggacaaaatgcccgactgctggttcttcttctgtctcacatatcaagttgccgcgtttttctgtttcctcttattatggctgtgattgattaatggacaagtaatgttcagttgtcacagagtactagcttatatgggagcaacctttgccctagttttgtaataatggtatatatcaacccttgatgttccgtcgtcgattgctcttgttctgcaaaaatttagtaaatgccctgttattacctgttataatgtgatgttgcgctgcaagtgttctctgttgtagcagtgtctgtttggagcatgagaggccttgttgcctttatagctctgccatcagccggtgccatacnnnanaaaaaaaaaaaaaaaaaaaaaa

SEQ ID NO: 28581 - DNA, 1814 bp, Triticum aestivum
  Clone ID: PAT_TA_28581
tagcgtggtcgcggccgaggtacacgcagcaacaccaccaacccagcatcacatccaccatccatagaaccgattgcacagttttcatatgtttcctctctactagggatcaactcaactaagctaagcaacatcttcaccgtgccagcgataccagcctatacaattcttcaagtcaaggactcgtcgggataccaaattcgtccacgggatttcaagccacagggcgatgcgcttagctgtcacccgccctaaacagggtcagcagggccaggaacagattgatgacgtcaaggtagagcgagacggcggcccagacatactcgtcgtaggtgtaacgcttgatgatgttgtccgtgtcatagacaatgtagccactgaagatgagtgccgccaatgcgccatagatcatgtgagagagcttgcccatcgggaagaggatctgaatgaacccaaagacgagcaacatgatgagagaagcaaataggaaaggaccaaggaagctgaagtcctggcccctctttgcggcccagaaggtgtaagcagtgaggctgaagacaaccactgttgtaagaatcgcggcctccagaatgaccttgccgctagtaaaggcacatgtcatgcccacagcgaagctgatggccactgtgaagacgccaagcagcagcaggttgaccgggtgcttctggcggtagaagtacaacgggcacagcacgatgaaggggaagatgatgaggaagatgtagagcccgaggccggcgctggaggagacgaagaagtgcgggatggcgcggaccttgacgacgacggcggcgacgacggcggtgaggaggagctgcagggagaggatgacgtagatcttccggatgagagcccagcgcagctccgggctctccgtcatcccggggtacagcccccgggtcggcgcggtggtgccggtgccgccgccggaggtccccgcctcgatgtcgacgcccttctggtaccccatcatctcgcccggcggtgcggtgaccggggaagggaagggaagcggcctccggaggtagggttttcggtcaggcgggactacccgctgagtttaagcatataaataagcggaggagaagaaacttacaaggattcccctagtaacggcgagcgaaccgggagcagcccagcttgagaatcgggcggctgtgccgtccgaattgtagtctggagaggcgtcctcagcgacggaccgggcccaagtcccctggaaaggggcgcctgggagggtgagagccccgtccggcccggaccctgtcgccccacgaggcgccgtcaacgagtcgggttgtttgggaatgcagcccaaatcgggcggtagactccgtccaaggctaaatacaagcggaggcctccggctcccctttgatccccctctcggagttctctcacccttcaactgcaaagaaatatggggtgaagcctgatgctgaaacacttgacatgctcaacaccatagctaagcagaaggaggttgctgtggtttccaaagtcctgtttggagatccccgcgagaagctgtgccaagccatccatgacatgcccatcagctgcctggtcattgggagcaggggccttggcaagctcaagagggtgctcttgggcagcgtcagcgattacgtcgtgaacaacgccgcctgcccggtcaccgttgtcaagccagcgagtaaccatgcctgatctcatcgtcgcaaatgtctacatttgttttagtttgctggagtcctatatatccagttggccgcaacttattgaaccatccagtgttatttgtaataataatt

SEQ ID NO: 28582 - DNA, 1033 bp, Triticum aestivum
  Clone ID: PAT_TA_28582
gcctctgcaagatcggcgccaactacgcctccggtggatccggcatcctcgacactacgggaaaagggacgctcacgatgcggacacaagtagagtacttcaagaaggcggcggacaacatgatttgttacccaagcaaggaggagcacctggcacggtccctcttcctcctcagcggcggcggcaacgacttctcggccttcgacccctccaccgccagcccccaggcctacgtcgtcaagatggtcaccacctacatcgagcacatccaggcgctctacgacatgggagcacggatggtggggatcctcgacgtgccgccaatcgggtgcaccccggggcagagagtgggcatgcccaacggcgagtgcaacgagcaggccaactccctggcgcaagcgttcaacggcctccttagggccaagctcgcggaggccgctgaggcgactatgaaggagctcaagtactccatcgccgccaactacaacatcctcaacaacatgatggacaactcgctcgtagccgggctgaggcacgtgaagacggcgtgctgcgggtccgggaagctcaacgcggaggtgatgtgcagccacccgggcacgacggcgtgccccgccgccgagcacgacgactacatgttctgggacatgctccaccccacgcacgccaccatcgagcgcggcgtcgtcgccctcttctacggcaacggccccaagtacggcgagcccgtcaacttcggcacgctcgtcgcgggcaagaacgtatctcctgcgatcaagatggtcgtcgacgagcagtagagggcgacgttcgtgggcatgcttgcccaattcgaaataatgatgatttaaaatttgcagcagctgctagctagctaggagctagctgctagcacttgataagaggatgattttcccgttaattattccatgcgtgctggctagctccatcttgtgttgtgttctctgtccctcgattattcgtatgtggaactaataaagtggttaagtaactaaaaaaaaaaaaaaaaaaa

SEQ ID NO: 28583 - DNA, 851 bp, Triticum aestivum
  Clone ID: PAT_TA_28583
gaccccgcgtccgatggcacggagcggcggtctactcgtacccaccccgtgctccgcttccgcctcgtcatctcatttccagagagagggagagagagggttcgagagtcttccagagagcggatccatccagagagtgctagggttttctctccgggcggcggcgatgtcgatggcggcggcggcgagggcggcggcgcgggccccgggcagggcggcggcgcggttcgtgcagaccaggctccgctcctccggcaaggtgctcagcgaggaggagagggccgccgagaacgtctacatcaagaaaatggagcaagagaagcgggagaagctcgcacgcaagggtcccagcactggagagcaagctccgtccaccccaagcgctggagcgggtgacgtgaacaccgcaggcgccggttcaaccacgtcggcatccgcagcaggcacgtcgaccgacaagaacaggaactacgccgtgctggctggcaccctggccggcctgagcgccctgggctggtacctcctgtcgaagcccaagaagacggaggaggtcgtcgactgatctgcccgtctccgtcccgccctggtttttacttccttactgcacatggacctgcgcgatgatgatgatgataataagtttccgacgtcgccgaacagccttgcctttgcctttttagccgcttccacagaatccgatacttgagatgatgacgatgatgatgatgatctgtagcgctagatgttttgctacctgttgttggtttgacggtggtggttaacgagagaggcgtcttggatgatgtggtttggtccttttgaaagtatgcaatgcatggttttttctggtg

SEQ ID NO: 28584 - DNA, 1641 bp, Triticum aestivum
  Clone ID: PAT_TA_28584
gaacacaagagctagctacgagcagcacacgcccgggaaatctttactagcactagctaaagctcaatagagcgctgtgccaagaagcagctaaagatgtgcagccatggccatgcggagccggcgacggcgtgcgtcacgtgcccgccgccgtcgcaggggcggctcatcacggtgctcagcatcgacggcggcggcatccgcggtctcatcccctccaccatcctcgcctgcctcgagtccaagctccaggagctggacgggccggacgcgcgcatcgcggactacttcgacgtgatcgccgggacgagcacgggcgcgctggtcacgtccatgctggccgcgcccggcgagaacaagcggccgctcttcgaggccaaggaaatcaacaagttctacctcgacaacgggcccaagatcttcccccagaggagctggggattgctgaccccgatagggaacatgttcggcgccgtcatgggtcccaagtacgacggcaagttcctgcacgacaagatcaagagcctcaccaacgacgtcaccgtcgccgacaccgtcaccaacatcatcgtcccgacgttcgacgttaagtacctgcagccgatcatcttcaatacctatgaggccaaggtggacccgctcaagaacgcgcacctctccgacatctgcatcagcacgtccgccgcgcccacctacttccccgcgcactacttcaccacccgcgaccccgcgggcaagctgccggaccgcgagtatcacctcatcgacggcggcgtggccgccaacaaccccaccatggccgccatgtccatgatcaccaaggaggtgctgcgccgcaaccccgacttcacgcacggcaagcccgccgagtacggcaactacctcatcatctccatcggcacggggtccgccaaaatggccgagaagtacaccgcgcccgattgcgccaagtggggcgtcctccgctggctctatgacgggtggcttcaccccgctcatcgacatcttctcccatgcgagcgccgacatggtcgacatccacgccgccgtgctgtttcaggccctccgcatcgagaagaactacctacgcatccaggacgactcgctcacggggcacacgtcctcggtcgatatcgccaccaaagagaacatggaggcgctcatcgggatcggtaagaatcttctcaagaagaatgtgtcccgggtgaacattgacacagggatgtatgagtccgtcgacggcgagggcaccaacgaagaggcgctcgcgcgcttcgcccggaaactctccgtcgagcgtaagctgcgccaaaccaacctcaactctaaatagagaagaggtcggttcgaaagagaagacagatgaagaagcaccatctgctatgcttggagatgcagacggacgcgcggcggaagatacgcaaacctttgttattttaataattgtgcttgttataattatgctttcgtggacaaaagtcgacgaatgttgatttgcatctctgcctatgttaggtcgaccaaccgagagttgtaatataatgtaatgtgggtgagtaattatttttctaaataaaatctgggttgttcttcggtaaaaaaaaaaaaaaaaaaaaaaaaaaaaaaactcgagactagctc

SEQ ID NO: 28585 - DNA, 1402 bp, Triticum aestivum
  Clone ID: PAT_TA_28585
gcacgaggcactgatactcctgatattattcacttgcgcggcaattgctggaagtgttgtgctgtatgttggccagggcaaattccatgcaagcacaacgaccaccttggatttcgtcgtcgaccaggcggatttcactgttgaaaaccttaggaacctctcggatagtctatccgctgcaaaaaaggttgacataggacagttcttacttcctccaaatgtgatgggtgagatcaatgaaattcaggcaaaattgaacacatcagctaccgatctttctactagaacatctgaaaattctgtgaagatccaaaaattgctgaatcaagtgcggctagctttgattatcattgcagcagtaatgcttcttctggcatttattggcttcctgttatccatcctcgggctggaattccttgtcaacattttggttgttgttggatggatactagtcaccgggacctttatcctgtgtggtgtattccttcttctgcacaatgttgttggtgacacctgtgtttcaatggacgagtgggttgctcatccaacagaacacactgctctggatgacattatcccctgtgttgaaccggctacggcgaacgagaccctgacacgaaccaaggaagtcacatcacagctagtgaatctggtgaaccaggtgctctccaatgtgtcaaaccgaaacttccctccggcggcgactcccttttattacaaccagtcagggccactgatacccacactctgcaacccgtttggacccaatctgagcaagcgcaactgcgcccgcggagaggtcaccttggacaatgcaacccaggtcttcaggagcttcgagtgccagacgaggattgtgtcagggaccgaggtgtgcacgacggtggggcggctgacccctcggatcttcgggcagatggcggcgggcctgaacgtgagcctggggctgtaccagtacgggccgttcctggtgcagctgcaggactgcaccttcgtgcgcgacaccttcagcaacatcagccagaactactgcccggggctggagcggtacagcaggtgggtgtacatcgggctggtgctggtgtcggcggccgtgatgctgtccctcatcttctgggtgatctacgccagggagcggcgccaccgggcgtacaacaaggcgcaccggggcgacaagccggcgccgatgggcgggaatgcctgatcagcgacgaccgtttcgcgcgttcggtcgccacggatggcgtcagtgagtgtagagagtagaggaccgccgcgtggttgacttgattgctgcctgttgattgattctttcttcgtttttgtgaatctgatgcttgctagtatatttgtttgtgttcctgctcggttgatgtacagtttgtgatctactaggaatgaa

SEQ ID NO: 28586 - DNA, 815 bp, Triticum aestivum
  Clone ID: PAT_TA_28586
cgtccgctctaatcagatcaaccacagactcacagtaggactagcttcagctagcctgcagcgtctgccactccgggcattttcttgcatcaaccacggcaatggccaccgctgatgtccagaacccgacggccgcgctgacggaggaggcgcccgcggtggagacgcccgtcgccgccgaggaggttgctaagacagaggaggtccccgcgccggtggaggccgaagtcgaggcgcctgcccccgtcgaggttgaggcgaccaaggaggaggcaccggccgccgccgagacggaggagaccaaggagcccgagccagcagctgctgccgagccggaggccgaggcgccgaaagagccagccgtggtcgagacagagaccaaggaggcggtggcagaggaggtgaaggaggaggcggcgcctgctgccgagccggaggtggcggccgtcgccgaggaagcacctgctgctgcggaggaggagccggccgccgcggtggccagcgtcagcgtgtgaggcgcgcggtggagggcaactggctgggtcagcgtccacgacggcggccgtgtgctcctacgtggcaacggcgtgatgctgagtcagccagtggagtggactggagtgctactttttactacgagtactaggtgtggagtggagtggagtgctatgcgcggggacgcgtgacgtggcctaaataaaagtgttgtcggtcagcatcgagcgagcgacgcagtgccactctagataatgtatgctttttattttgtcgacaagacatgattcattattttatttctacggacatctgttttc

SEQ ID NO: 28587 - DNA, 1247 bp, Triticum aestivum
  Clone ID: PAT_TA_28587
gtcaaatgctagagatatattggaggatttatgaattttccaaggggacgaataattttgcaagtgccgttgaatgtcagccatttctttgtgcaaaatagcggcatttcttttatattcaaaaccatttacaactggtggttaccactcttggcaaacttctgtacaagatttatgtactgaggccggtcgactctgagcgtgtgcttactcagctcacgaattgtttctggaggaggttggcgcagaactctaaatcaaagcgcccttctggagggtcgccgatgcaatcaaacacagcatccgctatcacaaagtcctcatctgcggtgtacccgctttttgttacaatgcacttcataccagcagctttggctgctgaaagccctatgttactgtcttcaacaacaacacagctagatggatcaacttccaatgtagttgccgctagcaagtagattgccggatcaggttttttgcgaggaaccacatccccagcgaatatggtaatcttttctgctcggtcaggccccagtaagcacgatactattgctgaaacagctttctcatttgaagtactgcatactgcaactttcaccccttttcctagagcttcatcaattaacctttgaacgcctggacggagaggaagcaacttcttctcaattagggccataaacaattctgttttcctcttgtgaagagaagcaacaaattcctttctttcttcgtcagtctttggcgctttagctggccactctgtcttgttgaaatatgctgtcatcctttccttcccaccacctatcttgagcaattctccgtacagttcaacatcccagctcacacctaattccctctcggcgaacgtctcgttgaaggaaatgcggtggccgtccttctcggtgtccacgagcacgccgtcgcagtcgaagagcagggccgccggcagggctgcagccggcgctccgcccgcgcccgcggcggacgcgcgagctgcctccgctcgcagcgttctcgcggcggatgagcggagaggagagggcgacagcatgctccctcctcctgcccgtcttgggaggcaccgggcggcgatccatgcgacggggcgggcgcttgagaaggtcctcgccgggagcgacgtggaggcggtggcggtggcggccatggcgttcattttgcgcgggaaacgatgtggatagcgcgccctgtggtcgatgatcccgggttgggatttgatggcaaagccc

SEQ ID NO: 28588 - DNA, 756 bp, Triticum aestivum
  unsure (1)..(756): unsure at all n locations
  Clone ID: PAT_TA_28588
gcaaagtgcaaagccagcagaggagaaagcttggatcaactttgcacttgttgagccatggagttcaagcacctgtgcctggtgaggttcaaggagggcgtggtggtggaggacatcattgaggagctcaccaagctcgccgcggagctcgacaccgtcaaattcttcgggtggggaaaggacgtgctgaaccaggaggcgctgacgcagggcttcacccacgtcttctccatgagcttcgccagcgccgaggacctggcggcgtacatgggccacgagaagcactctgcgttcgccgccaccttcatggccgtgctcgacaaggtggttgtcctggacttccccttcgtcgtcgccaagccggtgccatcgcctgaggccgcttgaatgatacaccccaccccagtatctatctgttactacttcctccgtctaaaaaagcttgaatgatatatacaccccaccccactgtctatctgttactactaagcaagtataagcatctaccatcgccagcaactgtaaggtgcctaccttttcaggtaataccaccatctatntatctgaaggctgcagctgtgatgtacctaaagcctcctatttttttgcttgcttgtcctgctaccacggcattaaccggccgtctagcctgtaaagccactgtaaggtgtaactctattccgtgcattcccttcgaaagttgcttggttatcacccttgaataaacatcggtggttttgctttaaaaaaaaaaaa

SEQ ID NO: 28589 - DNA, 491 bp, Triticum aestivum
  Clone ID: PAT_TA_28589
gctaccacaaagacaagtcaacctcaccgaggagaaggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccgccatggacgtcgtctacgcgctcaagcgccagggacgcaccctctacggattcggaggctaggccgccaccagattagctagcctgtgtctagggttcgtggtcgttgatgtaatcgcagcatctcgctgctgtttgctatcttctgtagaatggaattgaatggaaattcaactagtttatcctgg

SEQ ID NO: 28590 - DNA, 886 bp, Triticum aestivum
  unsure (1)..(886): unsure at all n locations
  Clone ID: PAT_TA_28590
caccccagtaagcggactcccgtgagttaagcatttaatagcggaggagaagaaacttacaaggattccctataacggcagcgaaccgggacacccacttgagaatcgggcggctgtcccgtccgaattgtagtctggagaggcgtctcagcgacggaccggcccaagtcccctggaaaggggcgcctgggagggtgagagccccgtccggcccggaccctgtcgccccacgaggcgccgtcaacgagtcgggttgtttgggaatgcagcccaaatcgggcggtagactccgtccaaggctaaatcccgtgtctgcgtccggcgaccgacggcgaggaaccaaggaaaggaaaggggatcgcggagcagcagcagcagccatgggcgtgatgggcaggctcaagatcttcgtcgtcaaggagcccgtcgtcgccgcctcctgcctcatcgccggattcggtctatttcttccagcggttgttaggccaatgttggattcttgggagactgagaaaaatgccaaaaccccggttgaactaaaagatgtggtcgcaggggtcactgggcaagaaagcttagtgatcaacgtctcttcactctgctgatgttgtctacacattttgttccgcctgtttttgggtgcccagacgagggggctctcttctgggatgtagtcggatctcggccaaaataatcattgtgtctgaacctatttttaccatagtgcaatgagatggacttgttgtttcagtgattccaagttgtaagaaagtgaatgcatggaaggccgttgttacccttttgatcgaatgcgtgccattgtcacttgttcttgatttgnctggccaaggcaaanaatgcttggcaccatgactcaaaaaaaaaa

SEQ ID NO: 28591 - DNA, 1068 bp, Triticum aestivum
  Clone ID: PAT_TA_28591
gcttcagagaccgagagaacagagagagaaagaatggcgtcgcgattgctgaccagatccaaagccctagcgctcgccgccgcccgcgccgacgcggccgcgccgtcgccgctcgccgccgcctggggcgcccgcgcgctctccgccctcccccgcgatccggcggccgcatcccccgcctcgtcgccgcggcagccggcggtggtctcgccgctcggcctctccaagattctaggatatgagcaggcctctcgactcggtggcacacacgtattgcctcgctggttttctactggagcctccaatggatcttctgatcagcagacctcaaagacagttgctgggatggtacaatcggatgcactgaaatcacaggagggagcctcagcgaaggtcgcagcattcagccccattgaagcaaccattagcaagcccagaagcagtccattgacactcgaaagcttgaaagtgaggcggactgagatgatgactaaagtcacgttctacatgatccctactctgctcctggtgtcgaagaacagcatcagcacttctctcctgatcgcgtcagtgtaccatcaggtctacatgttccacaaggagatcctcctggactacgtccaccacgacatcaccaggaagtgggccttgatatacttcaagctgctcttgctagtcatggccaaggacacgatggtttactttgatctgttctaagtgcctccatggtagtagtttctcgagagatgccaccaggaacccgcccatctgtacactggaataatcgtcaaggtggacaaaatgcccgaccgctggttcttcttctgtctcgcataccaagttgctgcgtttttctttttcctcttattatttctgtgattgattaatggacaagtaatgtccagttgtcacagagtactagcttatatgggagcaacgtttgccctagttttgtaataatggtatatatcaacccttgacgttctgtcgtttattgctcttgttctgcaaaaaattagtaaatgccatgtttacctgttgcaaaaaaaaaaaaaaaaaaggccccta

SEQ ID NO: 28592 - DNA, 985 bp, Triticum aestivum
  Clone ID: PAT_TA_28592
gcacgaggctcctcttcctcccgctcactcccgaaccgaagcctcaagagctcccaatggcttccaccacgttctcctccgccttctccatcctctctctcccctcctcctcaccatccccctccgcatcggcccccaggaccctccccgtcgccaaccgccgccgccgcgccgtcgccgtcgcctccaccgccactgagtccccgaaggtccttgagctcggcgacgccattgccgggctcacccttgaggaggctcgcaaccttgtcgaccatctccaagaacgtcttggcgtctctgccgcctccttcgctcccgctgccgcggtcgcggctcccggccgcggcggcggcccgaggaggcaccggtcgagaagacggagttcgatgtggtcatcggaggaggtgcccagcagcgcgcgtatcgcaaccatcaaggttgtgcgcgcactgaccaacctggcgctaaaggaggccaaggatcttatcgagggtctccccaaagaagctcaaggaggcagtgagcaaggacggaggccgaggaggcccaagaagcagctcgagggagtcggcgccaaggtttccatagcgtgagactagaacaatgtgagcattacattgggcatggcatgtgagtttgggtagtagaagaacatgaactctccatatgcagatatatgtgtggcgctgaaactgggaagttctctgaaaatattgtgtctgtgtctagagtattttgttttcccgcgtgatttgaatctatcgaagccgctgaaagttgttttatgcccactttgtatttctgaatctctagttctgctttccaaagtgtaattgggtgatgctgttggcacccttgatgttacccatccacaaggatcagtcaggtaggccaacggaaaaagttgcactttcgcctctcgctttggtacgtgtatattggtaggcatcaccccatcagcaatatttggccggagagaccttgc

SEQ ID NO: 28593 - DNA, 670 bp, Triticum aestivum
  Clone ID: PAT_TA_28593
agaaagcttggctcagctttgcacttgtgacttgtgacttgttgagccatggagttcaagcacctgtgcctggtgaggttcaaggagggcgtggtggtggaggacatcattgaggagctcaccaagctcgccgcggagctcgacaccgtcaaattctttgggtggggaaaggacgtgctgaaccaggaggcgctgacgcagggcttcacccacgtcttctccatgagcttcgccagcgccgaggacctggcagcgtgcatgggccacgagaagcactctgccttcgccgccaccttcatgggccgtgctcgacaaggtggttgtcctgggacttccccttcgtcgtcgccaagccggcgccatcgcctgaggccgcctgaatgatactccccacctgtctgttactaagcaagtaagcatctaccatcggcagccactgtaaggtgcctacatctatctgaaggctgcagctgtgatgtacctaaagcctcctttttttttgcttgcttgtcctgctactacggcgtttgttaaccgtctagcctgtaaagcctccggccggtgtaactctattccgtgcattcagttcaaaagttgcttggttatcacccttgaataaacatcgctggttttgctttaaaaaaaaaaaaaaaaaaactcgagacctcgg

SEQ ID NO: 28594 - DNA, 764 bp, Triticum aestivum
  Clone ID: PAT_TA_28594
cctgtgcggcgctcaggcggcgggtcaaaaaaaaacttaccaactccggctcccaacgcccaaagccttcgcatccagagctccaaaccctaggcgaggcgaggcgcggcgcagcggagggagaggccatggatcccgattcggtctcgaaggcgttcgtgcagcactactaccagacgttcgactccaaccgcgccgcgctggtggggctgtaccaggacggctccatgctcaccttcgagggcgagaagttcggcggccccgccgccatcgccggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgctgccagctggagggagcttctacgtgcagaatgacatgttccgcctgaactatggttaaggaagggcgaccgctctggcagcaaagaacttgttcagggatttatgttgaaacaatgaacatcaaatgatgatgctgcagactctttgtttgttcgccaacttgtgcaatttatcgcaaaaaattgccagacttgataggcatccaccagatcatcttttggtttgggtttccatgtattgccgttgcttgggtggcacctttttttgggatggtgatgggaaaccgtccaggtctaattatgcgggggatttcttgggtttggtt

SEQ ID NO: 28595 - DNA, 888 bp, Triticum aestivum
  Clone ID: PAT_TA_28595
cgcctcacagtaggactagcttcagctagccaccctcttccactccgggcattttcttgcatccacgacggcaatggccaccgctgatgtccagaacccgacggccgcgctgacggaggaggcgcccgcggtggagacgcccgtcgccgccgaggaggccacgaagacggaggaggtccccgcgccggcggaggccgaggtcgaggcgcttgtccccgtcgaggttgaggagaccaaggaggaggcgccggcagccgctgagacggaggagaccaaggagcccgagccagcagctgccgccgagccggaggccgaggcgcccaaagagccagaggcgccagccgtcgtcgaggcagagaccaaggaggccgtggctgaggcagagccggcagtcgtcgaggaggtgaaggaggaggcggcgcctgctgccgagccagaggtgccggccgtcgccgaggaagcaccggctgcagcggagcgggcacccgctgccgcggcagaggagccggccgccgcggtggccagcgtcagcgtgtgaggcgccggcgcgcgcggaggaggggctggctaggtcagcgtccacggcggcggccgtgtgctcctacgtggcacggcgtgatgctgagtcagccagggagtggagtggactggagtgggtgctactgctttgtactacgaggtgtgaggtgctttgcgcggggtggcgcgtggcgtgggctaaataaaagaagtgttgtcgggtcgacgcccagtgtcggccagcatccagtgagcgagcggctctttttttcttttctttcttcttcttttctcgacaagatatgcttcattatatttgttttcgcatggcaaacataaaggttaatttcgattcctaaaaaaaaaaaa

SEQ ID NO: 28596 - DNA, 700 bp, Triticum aestivum
  Clone ID: PAT_TA_28596
cggcttccgcacggcaggcccctcggcccgcaggcctacaccgagtttctcttcgtctacccgccgggtatccacgagctcatgctctatgcaaagcgcaagtacgggaaccccgccatctacgtcatggagaacggcatcgacgagggcaacaacagctcgctgcccatcagggaggcgctcaaggaccccgccaggatcaactaccactacaagcacctcctcttcctcaacctcgccatcaagcagaaggtgaacatcaagggttacttctcgtggacgttcatggactgcttcgagtggggtgacggctacaaggaccgcttcggcctcatctacatcgaccgcaacacgctcaagcgctaccccaaggagtccagcaaatggatgggcagattcctcaagaaatgatccctgatccatcatctacgcaggcctggtctcagctcaggcggccttcgtttttggtatctgcatatgctgcacgctgcgcatggtttgttgcgagttcgagctgtggtgactgtatcggcgttgggttgagtgtttgctatttttatttttatttatgtggggggtgttgagcgtgagtcatggctgtgaataagcgtttgctgcatttggccgttgaccgccccaagaaataaaaactgagattgaggattgttattccccagtcagtttgaaaaaaaaaaaaaaa

SEQ ID NO: 28597 - DNA, 840 bp, Triticum aestivum
  Clone ID: PAT_TA_28597
acgccgcgtgcggcccgctcatcgacgccgtcgccatcaaggagctccccacgccctaccccaccaaagataacctgatcaagaacgacgggttcgagatcggtccgcaggtgttcaagaactctagcgtgggcgtgctgctgccgccgaagcagaaggacgtgacgtcgccgctgccgggctggatcatcgagtcgctcaaggcggtgcggtacatcgacgcggcccacttctcggtgccggcggggcagtacgcggtggagctggtggccgggcgggagagcgccatcgcgcaggtcatccgcaccgtgcccaaccgcgcctacaacctctcctacgtcgtcggcgacgccaagaacggctgccacggctccatgctcgtggaggccttcgccgccaacgtcacgcagaaggtgccgttcgagtccacgggcaagggcggcttcaaggcggcgagcctcaggttcgtggccgccggagtccgcaccagggtcaccttctacagctcctactaccacaccaaggtcaccgacggcgtctcgctctgcggccccgtgctggaccaggtcaagatcgtgccgatgaagctctagtcatccatcggagtaagaccagaagctcagatcaatcctgtcgcgttgattcggtatcgttgtatcgtctatgtagtagtgggtacgtaatttgtgacattgctggacctctctctaatcgtgtggcgtggaactggcgatgaattgcctgtgctgtgcgtgaacctcaacttgtcttgcgattttgtttgatatttgcgtagactttccactggttaggggcggtgtgcaccggcacaagagctac

SEQ ID NO: 28598 - DNA, 920 bp, Triticum aestivum
  Clone ID: PAT_TA_28598
caaagctcccagctttttccccttccgtccgtcgccgccgccgctcccgctctagggtttcgtctcccgatccccgatccccgatccccgatccggatccagcagcagcagcagcagcagagagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatccccgctccccaacgtcaactccaagatcctctccaaggtcatcgagtactgcaacaagcacgtccaggccaagcccgccgacggggccgccgcggccggagccggagcctcggacgccgccgcccccgccgcccccgcagaggacctcaagaactgggacgccgagttcgtcaaggtcgaccaggccaccctcttcgacctcatcctggctgccaactacctgaacatcaaggggctgctggacctaacctgtcaaactgttgccgacatgatcaagggcaagaccccggaggagatccggcaagaccttcaacatcaagaacgactttacgcccgaggaggaggaggagatccgcagggagaaccagtgggcctttgagtagaggagcatctaggcgatgctcaccgccgcgctgaaagaacaacgcttagtattcgtcatgtctgtatttcagcgctcttatttatgtctgtcgtaatgggttgtaattatcctcgagtctatgaggtggtgtcggtgaacatcttcggtcagtggttatgtttgcgagaacaagaaaaaacctatcgtggtcagtggtcatcgcttgtcaaactgaatcttaatcgtcaagtggatgctttgcttgttaaaaaaaaaaaa

SEQ ID NO: 28599 - DNA, 541 bp, Triticum aestivum
  Clone ID: PAT_TA_28599
atcagccaccgtagccaccacacagacaagtcaacctcaccgaggagaagagaagaaaagagaagcgagaagatgtcgggccgtggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccgccaccaccaccagattaggagctagcccatgtgtagggttcgtggtcctcgttgtaatcgcagtatctcgctgttgttcgctgtgttctgtaggatcgaatggaatggaattgaaattaaactagttcgtcgttgaaaaaaaaaaaaaaaaaa

SEQ ID NO: 28600 - DNA, 824 bp, Triticum aestivum
  Clone ID: PAT_TA_28600
attcggcacgaggcctcgtgccgaatcggcacgagggtcagctccaagcctcaaccatgtccggccgcggcaagggagggaagggcctcggcaagggcggtgccaagcgccaccggaaggttctccgcgacaacatccagggcatcaccaagccggccatccgccgtctggcgcgcaggggcggcgtgaagcgcatctcggggctcatctacgaggagacccgtggcgtgctcaagatcttccttgagaacgtcatccgcgacgccgtcacctacacggagcacgcccgccgcaataccgtcaccgccatggacgtcgtctacgcgctcaagcgacagggccgcaccctctacggattcggcggctgacctgcatcttcagagtcgactctgccagctgctgcagctgtcccggtgctatggtttcgtttccgagtgcgtgtgttgctgttccatgggtctgtgtagttagtggaattgcgatggatctgaatgtaatggagttgctggttcttgcaagaaacgaatctgaatgaaatcgaaattgtacctcgtccctgctgatcttacagttggacagttcgtgtatgtcgtccggaagcggatcaagctcagcgctgagaaggcgatcttcatctttgtgaagaacactcttccacctacagctgccctgatgtctgccatttacgaggagaacaaggacgaggacggcttcctctacatgacctacagcggcgagaacaccttcgggttgctctagatggcgctggctgccacggcaatcgctcagaatgcctcctgtaaacctcggccgcgaccacgcta

SEQ ID NO: 28601 - DNA, 1376 bp, Triticum aestivum
  Clone ID: PAT_TA_28601
gcacagcgttggtcaccgcgaatccccaccgtctcgcagttggacaccccgtaccgcatccccccgattcctctcctcttcctcgccgaggccaaaacccaactccccgatctagccaactacccagatctcggaaccctcgccgtcaccgcggccatggcgaaggagccccccttctccctgcccccggtggtcttcaacccctccacaccggcccaccgccgccaccctatccccgggcccggcgcctccccgccacccgccttcgcgcctccccgcccctccacctcctccgccgccaaccccctgcccttcatgtccttcgacatacccgctcagtccaactccacgccgcccatcttcaccgggcccatcggcggctccagcgcctccttcgaagacgagccgccgctgctcgaggagctcggcatcaacacgcgtcagatctggcggaagacgctctccatcctccacccgctccgctccgccgacccgtccctccacgccgacgccgatctctccggccccttcctgttcctcctatccttcggcctcttccagctcctggctgggaagttccacttcgggatcgtcctcgggtgggtcaccgtcgcctccctcttcctctacttcgtcttttccatgctctcgggcggacgccgtggcgaccttgacctctacaggtgcgtcagcctggtcggatactgcatgctccccatggtcatcttctctgccgtttccctcttcctgccacggggcggtgggctcatcttcgggatgggcatgggattcgtgctgtggtctaccagggtctgcaccaggttactagcagagcttgcttccagcggcgatgagcataggggactcattgcctacgcgtgctggctcgtctacatgctcttctctctgctcgtcatcttttgatgctgttcttgagatggaagatcacactcagtattcttttgccctgtggagcgttgaactgcttttgatcagcgactggagtggtttattgatgctacagaactatcgatgatctagtcagtttggaaaatattctgtaacagtctactgcttttcatcctttagtttctgtggcatggtagggggctggtatagatcttggtaaagaaatgtaaggcaagatcaggacagtgaaaatattataactaattagcttttgccgaagtttgatgggattagctagcaattttcgaaagagtacacgtgtggtccgtttgaacttgttcatcgtgcttgcttaccacgcccgtggtgcctaatttcctttatgtgttacctttttttttctgcatttcagtttgataatagaattgtcctatcgttagagacgctggcaaaaaaaaaaaaaaaaa

SEQ ID NO: 28602 - DNA, 1174 bp, Triticum aestivum
  unsure (1)..(1174): unsure at all n locations
  Clone ID: PAT_TA_28602
gcacgaggctcagccaagagagccagcagcagggagtgtagtgagagtagagtgagcgagaatgggtggcaaagccgctctcctggtggccctcctggccgtgagcctggtcctcgaggcccaggcgggcagcggctacggcggcgggcaccccccttccccgacgccggtcgccccaccccccaagcacgagaagccacccaaggggcacaagccccctcaccaccaccaccacgccaagccaccgggccgcttcccacgctccggcgccacccacccacggccccccgacgcctaaacctatccctcccgcccctaaacccacaccacccacctacgccccgatcccgaagccgccgaagccatctccctcgcctccggcctaccaccctacgcccaagcctgcacctcccacgtacaaaccaccaacccagcctaggccctcaccgccggcgcacaagcctgcacctcccatgtacaaaacaccaacccagcctaagccctcgccgccggcgtacaagccagcccccaagggtctcaccgccggcgtacaagccagcccccaaggtctcaccaccggcgtacaagcccgcccccaaggtctcaccgccggcgtacaagccagcccccaaggtctcaccgccggcgtacaagcccgcccccaaggtctcacctccggcgtacaagcctgtccccaagccctcaccgccgccgtcgccaactccgccggcgccgaagccgactccaccgccctacaagcccccgacgcctactcctccggcgtacaagcctcccaccccgagccccccgcctccgccgtaccaccactaagaagatccaccactgtcaagctgggagcctaggatgcggtcgagaagagttgtgcgagcaggccaagaagagccacgtacgtacggcgtcgttgatcctcctgcggtgtgtgagttgctgccgagctactagggccgatctctgaggagatggaataatgcagatggctcccattagttatcttaccagcttatcgtttgtgttcgtccagtgttagcgtctgtgttgctagtgtcgcaatgttgccagtgtcactgtaaaaccattaatcaccccggaaatggaagtaaaaggtgttgtttcnccgttgcatgtaaaaaaaaaaaagtcgacgcggccgcga

SEQ ID NO: 28603 - DNA, 998 bp, Triticum aestivum
  Clone ID: PAT_TA_28603
tggttcccttccctctgcatccatccatccatcatcgtccgtcgtcttcctcccccctccaatcccatcccctctccgctcggcggccgtgtccctttcccctctgctttcctcatctcctttcccatcgcagacgcaggcgacccgatcccccctctctctcccctacctcgtcttatccccaatagggcacgccacgttcttgattgtcgggccgggcagggatgtcgtctccgagcaagcgccgggagatggacctcatgaagctgatgatgagcgactacaaggtcgagacggtgaacgacgggatgcaggagttcctcgtcgaattccgcgggccccaagaaagtctctaccagggaggtgtatggaaggttcgggtagaactgcccgatgcgtatccttacaggtccccctcgattggtttcgttaataagatatatcacccgaatgtcgatgaactgtctggctccgtctgtttggatgtcattaaccagacatggagcccaatgtttgatcttgtcaatgtgttcgaagtcttccttccacaacttctattatatccaaatccttctgatccattgaacggagaagctgctgcactcttgatgcgtgatcgccctgcttatgagcaaaaagtgaaagaattctgcgagaaatatgccaagccagaggatgcgggtataaccccagaagataattcgagcgacgaagagctgagcgaagaagatgacgacgactccggtgacgatgagcccatactgggccatgcagacccctagtcgatgcaggacctatttctccggctcaattcgcacaccttgttttgttgcagcaactgcaattaaacagcctgtagttcgtccacacccaagtctgaatgccatgtaaataagtgcactgtcagtgttttctaatgttacctccagcctcagtttaatatgcagcagcacttaaatttaaaaaaaaaaataaaaaaaaaaaaaaaaaggccccta

SEQ ID NO: 28604 - DNA, 711 bp, Triticum aestivum
  Clone ID: PAT_TA_28604
gccggccgggccggggccgctctccactcccctcctcgcgccccaagaagcaccagctctcctcctccccacactcgccgccgcccgcagccatggcgaccgagctggcgtacgcgccgccgatgaagtccggcaaggccggcttcgagggcccgcaggaggcgcagcaccgcatccgcatcaccctctcctccaagagcgtcaagaacctcgagaaggtgtgctccgatctggtgaggggcgccaaggacaagctgctccgggtcaagggccccgtcaggatgcccaccaaggtgctcaacatcaccaccaggaagtcgccgtgcggagaaggtaccatacctgggatcggtttgagatgcgggtacacaagcgggtgatcgacctcgtcagctccccggacgttgtcaagcagatcacctcgatcaccatcgagcccggcgttgaggtcgaggtgaccatcagcgaccagtagagagctatgccttctttttttacaagtggagagacaccagcgaaccaagacataattttgaacgtttggtagtatgtgaactgggttttgtatggcttattaggttcttcgccttgtgattctgagtacctcttgtcgtctgagatatcatcttgaattttcgtcgccctttggtgtgttgcgctggattggatatttatacatggcttggtattcatgtgtttgagatttggtgt

SEQ ID NO: 28605 - DNA, 624 bp, Triticum aestivum
  Clone ID: PAT_TA_28605
gcacgaggcaccgccgcaaccaccaccaccaccagcagcacacactcagaagcgaagatgtccggccgcggcaagggagggaagggcctcggcaagggcggcgccaagcgccaccggaaggtgctgcgcgacaacatccagggcatcaccaagccggcgatccgccgtcttgcccgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgtcaggggcgcaccctctacggattcggcggctgacctgcgcccgctgctccaatctccaatctccatcgactctgactctgctagctgctgttctggtgctatggtttcgtttctgagtgcgtgcgttgttggtccatcggtctgtgtagttagtggaaggcgatggatctgaatgcagtcagttcgtcagagtgcgtctgttgatctatcggtctctgtagtcagttcctcagtggaaggcgatgaatatgaatgcaatggggtcgttggttctttctaaaaaaaaaa

SEQ ID NO: 28606 - DNA, 1608 bp, Triticum aestivum
  Clone ID: PAT_TA_28606
cacaagaacacaagagctacgaacacgcccgggaaatcttgacgggagcgagctgggtctggtttcaaattgaaggccaccgctagcactagctagagctcgagcagtgcagggcacacccgtgcgaagctcaacatgtgcagccaggcggacccgacgctgacgtgcccgccgccgtcgcaggggcggctcatcacggtgctgagcatcgacggcggcggcatccgcggtctcatcccctccaccatcctcgcatgcctcgagtccaagctccaagagctggacgggccggacgcgcgcatcgcggactacttcgacgtgatcgccgggacgagcacgggcgcgctggtcacgtcgatgctggcggcgccggggcgagaacaagcggccgctcttcgaggccaaggacatcaacaagttctacctcgacaacgggcccaagatctttccgcagaagaggttggggggtcctgaccccgatggcgaacctgttcggcgcagtgaacggtcccaagtacgacggcaagtttctgcacgacaagatcaagagcctcaccaacgacgtgaccgtcgccgacaccgtcaccaacatcatcgtaccgacgttcgacatcaagtacctgcagccggtcatcttcaacacgtatgaggccaaggtggacccgctcaagaacgcgcacctctccgacatctgcatcagcacgtccgcggcgcccacctacttcccagcgcactacttcacgacccgcgaccccgcgggcaagctgccggaccgtgagtaccacctcatcgacggtggcgtggccgccaacaaccccaccatggccgccatgtccatgatcaccaaggaagtgttgcgccggaacccggacttcacgcacggcaagcccgccgagtaccacaggtacctcatcatctccatcggcacagggacggccaagcaggcggagaagtacaccgcgccggactgtgccaagtggggcgtcctccgctggctctatgacggtggcttcaccccacttatcgacattttctcccatgcaagcgccgacatggtcgacatccacgctgctatattattccaggctctcaacattgagaagaactacctacgcatccaggatgactccctcacgggccacacgtcctcggtggatatctccaccaaggccaacatggaggcgctcatcgggatcggcaacatgttgctcaagaagaaagtggcccgggtgaacatccgacacgggggtgtatgagcccgtcgacaatgagggcacccaatgaagaggcgttggctcactttgccaagaagctctccgacgagcgcaagctgcggctgagcccaaaccaccctcaactcccaatagacaagagaacgattcgaaagagaacaaagacgaataaactagctgctatgctagatggaccgatctagagttgtaatatattgttatgtaatgtaatttttggtgagtaattattatttttaatccgacaatatcgttgtttaaacttcaaaaaatatattttaccacctaaaacgatggatgcaagtcggatcaaacaatatcaggcaacttgtctcaaaaaaaaaaaaaaaaaactcga

SEQ ID NO: 28607 - DNA, 649 bp, Triticum aestivum
  Clone ID: PAT_TA_28607
ttttgcatgcagagtaaaattttagtagaaggaaggcttttattattactactactcagatctcagggtaacatgcatgctatggcagaatggcagaagatacattctacggtagtagtagctcactctagctgagtatacaggcacgctcgcacttattcagttattctcccctgacatctcctccggtcctcctcccctcgccttcctctcgcacgatcccgtgatcggaactcctcacgcatgcgcgcatggtggcgctggcgccaggatggtgtaggtcccgcatttgctcccgacggggagggcgacgccggcttcccgggagcagcggacgagcttctcggggctgatgatccgctcgtcggcggcggtgaggacgcggcagatgcagggcatgtccaccttcctcacctcgaggcggcagggcatgtcagggatcacgtaggggctccccttcttgatggtccacttgcacatgcggatgacgctgtccctctcgtcgtagcagtccttctcccccgcggcgaggtccgccgcgaacccggcgaagagcgacgcgaacagcagggcccggacgaggctggctccggtgctgcccatctttgttgcttaggtagtgtgacgctgctgtgcttgcgagtggtgt

SEQ ID NO: 28608 - DNA, 1447 bp, Triticum aestivum
  Clone ID: PAT_TA_28608
acgcgacatcacagatcaccaccctccccctccccatccccatcccctcgagctccagatcccgagcccatggcgaccgccttcgactcgccgacctcctccccggcggccgcgcccttccacgacgaccccttcctcagcttcgccgactcccccacccccgccgcggccgacgtccacgtctccggggacgacttcccggcctcccccgacccctacgccttccggcacgactccgccgccgcgcaccccttcggcatgcccgactccaacggcaacggcatgcaccacgaggcggacgacgacgacggcctcttcaccgactccggccccgtcctccccgaccccgcccagatgggggccgacgagggcttcctcctccgcgagtggcgccgtcaaaatgcactccttctggaggaaaaggagaagcacgagaaggagctgaggagccaaatcatccttgaagctgaagagttcaagaagggtttcgttgagaaacgcaagctgaaccttgagacaagcaaggatcacaaccgggaaagggagaagcttttcctctccaaccaggagaagttccacaagggagcagacaagcagtactggaaagcgatatccgagctcatcccacaggagattgcacacatcgagaagaggacgggcaagaaggacaaggacaagaagcccgggatcatcgtggtccagggccccaagcctgggaaggccacagacatggcacggatgcgccagatcctgtcgaagctgaagcacacaccaccgccacacatgaagccacctccaccacccgccgtggcacccgccgggaaggacggagctccggccgccgctggaaaggacggagctaaggcggcagcgacgcctgctgccaaggatgcccctgccaatggcactgtccctgagaaggagaacgccccacccgccgccgctgctgcccccgcagcagcagctccggcgccaccagctgagcccatcgccgctgcctgaatgaggatggctttgatcagccgctaatccttcgcagtagggttatatttgggtgtcagtagagttgttccaggagagacggatggggaaggagcgtgaaggccacatagcatgcgaggtggtgaaatcgtctgagttcaccacggggaatcatggcggagatacacgcagtgtactattattaatttgagtttgttattatgagcaggagggttgttacttatgggaccaacaaactttattcgttaatattgtcattgcattttgtagagagaaagagggtactggtaagaataaggtaaggctgtcgctgctgctgtatgtgtttgtatatttatcatcaagtgttggatttttggtaaaagacctgtgattgatgttgtatggaatttaagttggacactgtaaaaaaaaaaaaaaaaaaaaaaaaaaaaaaaaaaactcg

SEQ ID NO: 28609 - DNA, 616 bp, Triticum aestivum
  Clone ID: PAT_TA_28609
caccgttcctccgattccacaaccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaagcgcatctcagggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggcggctagggcctgcagattcgaaaagcttgatggaaccccgacttgtctagttcgctgtttcctgagtagctccaattgaatcgtggaacaaagttaatcgcatgtgtttgttggaaatcaaacttctctctgcaaataccgcgtttctgaatttgtttcgctgtttggtctctgccgggtcgatattgaggtggcgatgagttgatttgccataatttactaggagccccggattagccgtacttgtttgcagtataatttg

SEQ ID NO: 28610 - DNA, 618 bp, Triticum aestivum
  Clone ID: PAT_TA_28610
gccggccgggttgccgaaaaaccccccaattttagccagtctttggaacttgcatcaccaaacacacccaaacggcaccgcacatcgtcgtcaaaatggtcaacattcccaagacccgtaacacctactgcaagggcaaggagtgccgcaagcacacccagcacaaggtcacccagtacaaggctggaaaggcctccctgttcgcccagggtaagcgtcgatatgaccgcaagcagtccggttacggtggtcagaccaagcccgtcttccacaagaaggccaagaccaccaagaaggttgtccttcgattggagtgtgtcaagtgcaagaccaagctccagctggcgctgaagcgatgcaagcacttcgagcttggtggtgacaagaagacaaagggtgctgctctcgttttctaagtgctttgtgtttgggtctcagggtcaccatttctatgcttacctcggcggcatttgggcatcatggatggacacaggcgaaaggaggtacacgtcctcggtttgaggcttgtttcatagggaatgaatgaaaagaaaaaatctctgtgttgcaccaacacaactttcaaaaccacaaaaaaaaaaaaaaaaaaggccccta

SEQ ID NO: 28611 - DNA, 693 bp, Triticum aestivum
  Clone ID: PAT_TA_28611
caattcaacactagctagctgcacaggacaggagccgatccatttatcccgaaaaaaagagcgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcgccttcgacggcgcctccatgaaccccgccgtctccttcggccccgccgtggtcagcggcgtctgggagaaccactgggtctactggctcggcccctttgccggcgccgccatcgccgccctcgtctacgacatctgcttcatcggccagcgcccacacgagcagctccccaccgccgactactgaaaatatcaatccgaatcccatccatcagtcatcgccatgagagactgaaattgcttcaagaatcaagcaggtgttatcgtgtcatcagcaagcccgtttagtttcatcgtctctctctcttgtctttgagaaattcagggtaaacagtgagtcagtcagtcagtcaggaataatctcttgtcttggtgtacgtacgtcctcaattatgaatgcttctattccatggtcatgattgatgtttgtccaaatgtattgttttctccctagcaacttgatgtcttgcc

SEQ ID NO: 28612 - DNA, 1852 bp, Triticum aestivum
  Clone ID: PAT_TA_28612
gttccctggatgtgtaacatttgtacctactagaatcatctatatttacagggctgaactataaaggcaaactgattaaaattggtacaaataatgccaagttgtaagaaaaaggcgtacgccagcagggtgacgcgtggaaggcccaaaaaacactatgaaggtacagcatcaggcgtcaaaatgcaagatagatcatgaatcaatagagagaattgattcaactatatatttctataaacaactaagggtcgcctgcgcatgcatacacaccgtcgatgaaacctctcgaccaaggcgctcactctattcgtccaatctcaatctgctccaccaatctcaccacccaattatcagaaacagggcgtgtgcctagcaagaatacataataatatatcatggatactaatcagcacgattagtatctcggtggcgctggcggcattcggtttggtgtgcgtcggctggtagagttgggatccccattttcggagcgcctgcgaccatcggcacttctcgaccttgattcgatgttcggggcagggccatttgctgcagaatcgaaggctgacctccagtcctcgccagggcggccgggtgtccgagggctctcagcttcagggctatcatttgaataagaggaagcagcagctcgattgtcatggatactaagttgacgtgtgagctttgacaacagagatgattgcttctggtacttttcccttctacgtttagcattgtggtcttcttggagaagttcttcaatttttgcattgctttgcccgcttatcgagctgtatagctggttcaacatatcttcctttgctttctccacttggcagagcacgatggcctttgggacatttgctgctagactatttagaacagcctcaacataaccacgaacttcttgagacatccatctaagttcttcttcaggatccgctggtctccgtatcattgcatctgtggagctatcttggctggctttgcttcagcggtccaccctcagtatttgcagccttgaaagaaccacctttgctttgaattacagcttttatcttatttacccactcaaccttgtcagcagtgctctcagccttcaatacaacagcgctatgagctttaagaactgtcttataggcgaccctgttagttatcttgaacacaaggcttgggcctttttcaggtccattagccttttttgaatcctttaagcttttagaaggttcttcctcatctacttcctcgaggttgcattcctcgagagtgatgacaccacgaaaatgcctttcctcttgcttctttgtgtatccaagctttccactcttctcatttaggacgaaccacctcctgctccacccgttagcttttgcacttttcttcaaaaggtaacctgcagtaatttcaccagcaggaccagcaacctgcaaatttggtccctcttttgtgtctttgtctggacttggtttttctttcgttgattttgagctaccgccggcttgctcagattttgtttggggactggaggccctgtttgtcacggattgttcagactcttgtcctatcttgaaaggtcggtttttcatttcgtcctcacggcgctgcctctccattcttctttgtactagacggatgaaatgttgagcaggaaccccggcacgctccatgtcaacaagagcaactaccatctttttggcgtcacttttaaagctatccaatgcattcgatgctattgcaacgacctcacgcttgaatggaggatatcttccaagcccaggtgtggcattagcggatgcattgactatgtccaacaatacacggtgtacctcgtcaacacatagtcgtgatg

SEQ ID NO: 28613 - DNA, 1723 bp, Triticum aestivum
  unsure (1)..(1723): unsure at all n locations
  Clone ID: PAT_TA_28613
ctcctcatcgagtccaactcgaaaggctccactgctccaggcgcttcgctccaccagctgacgacatggcctcgccggcgagcggcgattccgatcaggtactggtggaagcaaatggctctacacggacattggttttgaataggccaaagcagttaaatgctctctcctctgcaatggttacaggacttctgaaatgtttcacttcttatgaggaagaaaacacagttaaactgttgattgtcaagggaaaaggaagggcattttgtgctggaggtgatgttgctgaagttgcccaatctataaataatgatacctggaaatatggtgctgattttttccatactgaatttttgttaaactatatcattgcaacttatagcaaaccacaggtttctctacttactggaattgtcatgggtggaggtgctggtgtttctatacatggaaggtttcgggttgccacagagaacacggtttttgcaatgccagaaacagcactgggactctttccagatataggggcttcttattttctttctagactacctgggttctatggagagtatgttggccttactggtgcaaggttggatggtgcagaaatgcttgcatgtggcctggcaactcattttgtccctttgaacaggatgtcactgcttgaagaatcacttaaaaaggtggacacttctgatccatttgctatatgtggaattattgatcaattttcacaacagccatctgtgaaaggaagtagtgctatgaataggatggaaatcatcaacagatgcttctccaaaagaacagtcgaagaaatcatatccgctcttgaacaagaagctccaagtatggccgataaattggttactgctgcaatccactcattgcggaaggcttctcctactagtctgaaaatctctctcacatcgataagagaagggaggctgcaaactgttggtgagtgcttgcgccgagaatatagaatggtttgccatgtgatgcgcggtgacttcagcagagacttctttgagggatgcagggcgatacttgtagataaagatcgaaacccaaagtggatgccgccaactctggataaagtgcatgacggggtagttgcaaaatatttctccaaggtcgacgatccacagtgggaagatttgaacctgccaactagaccttcccatggaagaagaattgttcccaagctctgatggaagtctcaggctggtcatagtgaggagtaacttatattagtgtcatgcatataatactagcctaagttactaccttcatagtgcaaaataacatagtagtagtgtcatggaggactttattaattagtttgtagactcatcttgtcttgaaaagcgctatgttacagtaacatattatgttaccacttctcattaactacatgccacataagcaaaaaaatctcggagtgcgctatgttacttgctaagttactcccactataactagtctaagcatgtgcatagccgattaatgacgggactaagagacgtacttctcagtctctcatgcagcagtgtagttgagtgcattgatgacagtgagcttgaactgtgaactacataaatctgacagtgcatgcggttttagagaaagtataataaggtgacgtaagcggattgcaaggatttaaatattatattattactaagttgaaagtgagagaagaatagagagaagnnnnncggtt

SEQ ID NO: 28614 - DNA, 586 bp, Triticum aestivum
  Clone ID: PAT_TA_28614
acctcctccacagcgactccaagtttccctcggtaggcagcttccatctcatctccggcgatgtctgggcgcggcaagggcggcaaggggctcggcaagggcggcgccaagcgccaccggaaggtgctccgcgacaacatccagggcatcaccaagccggcgatccggaggctggcgaggaggggcggcgtgaagcgcatctcggggctcatctacgaggagacccgcggcgtcctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctgagcgccgtgagctcgccggctgaccctgctgtttcctgcgtggctgcgttgctctgtagtcgtaccccccccccccccccccccccccccctgtcgtgaatccagtttgctggctatgtctgtttctgtagtttgtctagtgagatccaacttctagttgtaactcctatcgtttcgtttcgctgcaatgacaagttaattccaatctgagaaaa

SEQ ID NO: 28615 - DNA, 1400 bp, Triticum aestivum
  Clone ID: PAT_TA_28615
gctgccagcagccatacataagttctatgcgtttaaatcaacttgactggaatgcaaatgcccatgaccatattctggacaatcgccagccaatcattgaggagccagcaagtcctgaaccagaaccagagactgcagagatgagagagagtgccatagaggatatttttcttgatgatcctgaagaaattcctacaatcaagcttaatttcgaggagtttgcacagaatctcaagaattatatgcaagtcaataacattgaaatggaagatgctgatatgtcaagtgccttggttgccataactccagaagctgcatctatcccaactcctaggctcaagaatgttagtcgcctaagaacagagcatcaagtctatgaactgccggactcgcatccacttctggaaggatatgaccaaagagagcctgatgatccttgcccgtatctactctctatatggaccccaggtgaaacagctcagtcaattgatgcacccaagacagcatgcaactccaatgagagtggtaaactatgtgacagcagtgcatgcttcagttgcaacagtatgcgagaggcgcaggctcaaacagtcagaggaacaattttggtaccgtgtcgaacagctatgagaggaagctttccacttaatgggacatatttccaagtaaatgaggtatttgctgatcatgactcaagccgaaacccagttgatgttccgaggagatggatatgggacctccctaggagaacagtttacttcggaacttcagttccttcaatctttaaaggtttaacaactgaagacatacagcagtgcttctggagaggatttgtttgtgtgaggggctttgataggacatcaagagcaccaagaccactttacgcaaggcttcactttccagcaagcaaaattaccaggaataaaaagggcgcagcttctgcaggcacagatgatgcatagcccgtcgagggaaataaaaaaaaaacgagttacatagaagaccctgccagaagatcactgacatgaaaatggatcactgaccaataagttgttgtcaccaattcaaccatgttttagcctttcgtatctgtgaacgttatgaatgccagccactcacgaatctgtgaagctggcgttgttcagcaacatgatccattactacacagatttatgctcatttggttccctccaaggagttcgatacagcaaatggggaggggagaaagtctgctgtctggtccattctgtttgttgtttcatgggatttgaaccaactgttgtacattggagacgtcatcccttcaaagttgttcatgttgttcggtagttcatgcgaacgttgtcagattattcgtcaattatttgattgtttcattgaggaggccatttcactctccc

SEQ ID NO: 28616 - DNA, 1378 bp, Triticum aestivum
  Clone ID: PAT_TA_28616
gcacgaggaccaaacacgaacacaaacacaaaacgaaaagcattccttccctctcgctctcgctcctccatctccgtttcgtctcgcagtctcaagatcagcgccgctcccaagagttaagaagagagagagagagagagagggataggaaggaaggagatggggatgcaatcagtgtgcggaggagcagggcggtggcggcgagcagtggcgtggtggggggccgtcctggtcctcgcccatttactcaactgcggcagcgcggggctcctggacaccaacccgggcttggcctataacttctacgcgacgacgtgccccagcgccgaggccaccgtccggagcatcacctgggcgcaggtcgccggcaaccaggccctccccggccagctcctcaggctgcacttccacgactgcttcgtcaagggctgcgacgcgtccatcctgctggacaacgcgcagagcgagaagacggcgccgcccaacggctccctcggcggttacccggtgatcgacgctatcaaggcgcagctcgagaaggcctgcccgggcgtcgtctcctgcgccgacatcgtcgcgctcgccgcccgcgacgccgtctcctaccagttcaaggcttcgctctggcaggtggagaccggccgccgggacggccccgtctcgctcgccagcaacaccggcgcgctgccctcgccctctgccggcttcaacggcctgctgcagagcttcgccgccaaggggctcgacgtcaacgacctcgtcgcgctctccggcgcgcacaccatcggcaaggccagctgctccagcgtcacgcccaggctgtaccaaggcaacgccaccagcatcgaccccctgctcgactccacctacgccaagacgctcatgaacgcctgcccgaacactccagcttcgacgtccacggtggacctggacggcgccacgccgttcaagttcgacggcaactactacaccaacctgcagaacaagcggggagtgctcgcctccgacgccgcgctcacgcagaacgccgccgccgcgacgattgtcaacgacctgaccaacccgatcaagttctatgccgccttctccatgtccatgaagaagatgggccgcgtcgacgtgctcaccctcaagaacggacaagggaagatcaggaccaagtgcaatgtgccgtgagggttcatccaggagcgccacacattttcttggatttttttactctctccctctccctcttatttcatcggcgcgggtcaaatatattgtgcccgccatgattaagctcccagatctatattgatttgttaagtgctgtgcctgagtatgtaagattatagtcacgacaggcgtgcattcctctgcaatcaatcaaagaagg

SEQ ID NO: 28617 - DNA, 682 bp, Triticum aestivum
  unsure (1)..(682): unsure at all n locations
  Clone ID: PAT_TA_28617
tttttttttttttttttttttttttttttttcttttttttttttagattgaaggctttattgttactattattattattgggatctcacggtaacatgccatggcagattacattacattctacgtatgacgatagctcactagctcagcatacacacgcacgcacgcactttatttagagtagttattctgccatgatctctccatctccttcaccggccttcctctcgcgcgatccccatgaccgaagctcctcacgcatgcgcggatggtggtggcacccgccccccgatggtgtaagttccgcatttgctcccgacggggagtttgattttgcagtcgtgggcgaggtggacgagcttcacggggctgacggtccgctcgtcggaggcggtgaggacgcggcagatgcagggcatgtcgaccttcttcacctctttgctgcagtccgggcttgggggcgtgtagaagccctgcttcttgatgctctctatgcagatgctcatgatcatgtccttctcgtcgtagcagtccttctcccccgcggcgagatgcgccgcgaaccccgcgaagagcgacgcaaacagcagggcacggagtaggctggctccggtgcggcggcccatctttgttgcttaggtagtgtgacgctgctgtgtcnggacgcggggcggacgctggg

SEQ ID NO: 28618 - DNA, 1702 bp, Triticum aestivum
  Clone ID: PAT_TA_28618
cgacgcggtttccttccctcccgcactcgccacggcccacggacacgcgacccccatccaccgccggccgggccccggacgccccgtgcgcccacccgtcatcgcctcactacacccgtcgccacggggtagctgtcggcccggccgctgctgctgaccgggacggcgaccggtactaccccgcacgaaaaggccccgcgccccgatttctcacccatttcctcttcctcccctcataagaagaagcttcctcgtcgtctccccctccccctcctcttctccgtcaactgaaaaatccaccccaccttgaggagctaggtcactgctgggctaagcaaccacaggcgaatcccccaaagaaaaggcttcgtttcagaaatcaagaggttcacttgttgagttctcgctgtcggagttcggcggcggagggagacggagtcggatcccctgaaaagtctaggtggtagctgcggaggtgaggcccggaggaagcggctggctcagtaagcgcgtctagcacaggaaccaagaggaggaaggaagaggaacccaatcatggactcggagcactggatctcgcgcctcgccgccgccaagcgcttctacgccgcgcagctcggccacatcgacgatatggcggggatggggatggaggaagtggacatggacatggaagacgacggggagatggacatggagatggagatgcagctggaggaggccagatggccggaggtcgcctgcccctactgctacgaggactacgacctcggctccctctgcgtccacctcgaggaggaccacccctacgagccacaccccgcgccttgccccatctgctctgaaaagattacaagagatatgctaaatcatatcaccatgcatcatggttacttgttcaagaatggcagccggttgcgcagattcgttattcccgagcgccgtgcactttctttactgagccgagatctacgtgatgctcatttgcaggcgcttctaggaggcggtcatagtcataggtcaaggaacaccaccaccgccactacaaatatttatgctgatccactgctttcatcgtttggcctgggttttgcaacatcagatgccgaagaaccattgaaatcatctgttccggttctcgatgatacttcaattcttaaggaggcacctcctcaaccttgggaatcaagtattgactcgtccctcacaagtgaggaaagggaacaaaagcggaaacaagccacaagcagggcgacctttgtgcaagacctggtcctctccactttatttggagacgactgagtgctcgaatggccctgcattttccttgttagatgggtgcttccttcacactgattcggatagaactgcagcaactccgccctgagttggttaatcttaacttgggcgaagtcaagtgcgtctggtgcacccgcagtcaagtgcggattttatttgggcttgacacattacaccttaatttatggtagctgtcccatattgccgtttttttcaccgaattatcggccagcagttccttgccttggttgtaacttgttgtgccatcctcttcattgttaaggaacattggtctgtaccaacatcacacagctgttacatactatagaatgcaatgcaatgggaaattacagaagctccacctgtgtggaagcaataagcagaaaaaaaaaaaaaaaaaacg

SEQ ID NO: 28619 - DNA, 827 bp, Triticum aestivum
  Clone ID: PAT_TA_28619
gcccccctccgtccccgcttcctcctcctcttcctcccgctcactcccgaaccgaagcctcaagagctcccaatggcttccaccacgttctcctccgccttctccatcctctctctcccctcctcctcaccatccccctccgcatcgggcccccaggaccctccccgtcgccaaccgccgccgccgcgccgtcgccgtcgcctccaccgccactggagtccccgaaaggtcctttgagctcggcgaacgccattgccgggctcacccttggaggaggctccgcaaccttgtcgaccatctccaaagaacgtcttgggcgtctctgccgcctccttcgctcccggctgccgcggtccgcggctcccgccgcggcggcggccgaggaggcaccggtccgagaagacggagttcgatgtggtcatcgaggaggtgcccagcagcgcgcgtatcgcaaccatcaaggttgtgcgcgcactgaccaacctggcgctgaaggaggccaaggatcttatcgaggggctcccaaagaagctcaaggaggcagtgagcaaggacgaggccgaggaggccaagaagcagctcgagggagtcggcgccaaggtgtccatagcgtgagactaggtatactaggctccttttttctcccattacattttatgtttcatatcaaccttttgtattcctcttgtaattgccgtggactgttgtttcatatgagattagtgcgcgtgtggaattattagttcatgttcgtgtgttgtattcagtcttgtataattactggatgttgcattctttagattcctaatgggtactattggttttgg

SEQ ID NO: 28620 - DNA, 1629 bp, Triticum aestivum
  Clone ID: PAT_TA_28620
cgtccgctcctctccatccatctgcctcaccctcccccgccgtctcaacacggcgccatcctcatcacgaacccaccaaacaaacaaaaggcggacccaactccccctcctccaccttccccggagcacaaatctcccatcccaatccccgcccccgtcggtagccgatcgcgtcgacgatgctgggcgccgcgaggagatccggatgcgtgctggggcaactgatgcagaccctccgcccggcggccacggcggcgaggagctactccgcgaccccgaaggagatgactgtgcgtgaagcattgaattccgcccttgacgaggagatgtctgccgacccttctgttttcttaatgggagaagaggttggagagtaccaaggtgcgtacaagataacaaagggtttgctggacaagtatggtcctgatagggttctcgatacaccaatcacagaggctggttttactggcattggcgttggtgctgcctaccaaggtcttagacctgtagtagagttcatgacatttaacttctcaatgcaggcaattgatcacatcatcaattcagctgccaaatcaaactacatgtcagctggtcagatatccgttcctattgtttttcgaggaccaaatggggcagctgctggagttggtgctcaacactcgcagtgctatgcagcatggtatgctcatgttccaggattgaaggtcctaactccctattctgcagaagatgctcgaggcttgctaaaagctgcaatcagggatccagaccctgttgttttcctggaaaatgaattactctatggtgaatcgtttcctattaaggctgaagtacttgattctagcttcagtgtcccaattgggcaaagctaagatagaacgggaaggaaaagatgttacaattactgcattctctaagatggttgggtatgctcttcaggctgcagagatactgtccaaggagggaatcagtgctgaggtgatcaaccttcggtcaattagaccgttggatagagctgctatcaatgcatctgtcaggaaaaccagcagattggtaaccgttgaagaaggctttccacaacatggtgttggtgctgaaatatgcatgtccgtagtggaggacagctttgagtatcttgacgcaccagttgagaggattgccggagctgatgtacctatggccctatgcggcaaaccttgaaagattggcagttccacaggttgaggacatcgtccgtgcagcaaagcgagcttgctacagatcatcatccatggcggcaaacgcctaataagcacaaatgcaagttttgtttcttggccttcttctttgttccttgtccagaaaaaatgtaccgaatcgcataattgtatcccccaactcgtgtgagctaattttgtagatctgcatgcattgttgattccgatctgtcggcggcagttggatgactgcattgagttcatggttcatcccgagacatttgaatcatgcaacttctggaggtttacatcactgagggatgtataaataacatgtatgtaactgaattaaacacggtcaggtaccagtacacgattttgctctgacttgggctgatctgttcgtgtgatcaaaaaaaaaaaaaaaaaa

SEQ ID NO: 28621 - DNA, 1058 bp, Triticum aestivum
  unsure (1)..(1058): unsure at all n locations
  Clone ID: PAT_TA_28621
gcttccctctgcctccatccatccatcgtccgtcgtcttccttccccctcccatcccctctccgctcggcggccctgccctgtccctttcccctccgctttcctcaccccctttcccatcgcagaagcaggcgacccgatccccccctctctctctcccccccacctcgtcttatccccaatagggcacgctcgccacgttcttgattgtcgggccgggcagggcagggatgtcgtctccgagcaagcgccgggagatggacctcatgaagctgatgatgagcgactacaaggtcgagacggtgaacgacgggatgcaggagttcctcgtcgaattccgcgggcctcaagaaagtctctaccagggaggtgtatggaaggttcgggtagaactgcccgatgcgtatccttacaggtccccctcgattggtttcgttaacaagatatatcacccgaatgtcgacgaactgtctggctccgtctgcttggacgtcattaaccagacgtggagcccaatgtttgatcttgtcaatgtgtttgaagtcttccttccacaacttttattatatccaaatccttctgatccattgaacggagaagctgctgcactcttgatgcgtgatcgccctgcttatgagcaaaaagtgaaagaattctgcgagaaatatgccaagccagaggatgcgggtatagccccagaagataattcgagcgacgaagagctgagcgaagaagacgacgatgactccggtgacgatgagcccatactgggccatgcagacccctagtcgatgcaggacctatttctctggctcaattcgcacgccatgttttgttgcagcaattgcaattaaacagcctgtagttcgtccacacccaagtctgaatgccatgtaaataagtgcactgtcagtgttttctaatgttacctccagcctcagtttaatatgcagcagcacttcaatttaccttctggagatggttctgcgtcgattaaaaaacaattgtttggttaagatcatgggttgaaaagcgagatcctcgtcgattccntacggg

SEQ ID NO: 28622 - DNA, 811 bp, Triticum aestivum
  unsure (1)..(811): unsure at all n locations
  Clone ID: PAT_TA_28622
ggccgggactctccagtagccagtagccaccgccgttcctccggttccacatccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccaggggcgcaccctctacggcttcggcggctaggcccggccgacggtcgcatgtctctctcgccgcctgcagattcgaaaagcttgatggaaccccgacctgtctagttcgctgtttcctgtgtagctcgcatgtgtttgttggaaatcaaacttctctctgcaaatgccgcgtttctgaatttgtttcgccgtttggtctctgttgggtcgatattgaggtggcgatgagttgatttgccataatttaccaggagccccggattagccgtacttgtttgcagtctaatttgatgttacttctgtggtgcaatgtgtgaaaatggagatggtgatttgtctgcatttcatactacatcgagttgtagattgagtttctatccttgaccggacttcctggtgtacaaatttgttgcctacttgtactgnaaacatctcagnaccaattcatcatg

SEQ ID NO: 28623 - DNA, 887 bp, Triticum aestivum
  Clone ID: PAT_TA_28623
cgagttttttttttttttttttttttaatttcaagacgcgctattgacttcaatataggctgaaattctatctacagctcataatacgtacatacattgattcttgtgtatatacaaacaatgcagtgcattacaaacaagtattacaacagaaagcgggaaccatggctagtgactttagatgaaatacggcactgatggcagctgctatctagtgtgcagctccaacggtattctctattgtgccacttacatacgtatattttgcaacaatgcccgtcagaggaagaagggaaagcccttctgtgattgtggcttggtgcactctgaattagcccatccgatctgcctccgctcattgtcatacacaactagtttgccacgcagagaaacatctccgacaattatggtcgacccatgattgatctctgttccatttagcagcccaagacaaacattgcccttttcactgataatcaagtaatcatcgggaacaatggtgaatgttttcggcacgacaaaccatcttctcccaaaatgaaggttcaagggcttgaagaaggacctaacagaaaaatcagctttccagcacaaaggtaatgtcgtatctgagctatcttggacaaaactgggagaatcatccttaatagcatcaataaggtttttatacatttcctctggaaggtatgtatatgagctcccgctatcaaaaatcactggacaagaaatttcaggcgtgccaaggcatgctgagctcctgatctccataatttactttctgggcttttgtgctggtataagttgtctggaccacctcgaataggagcccatgtcattccccatcttggtacataatcatcacccagaaacatgtaccccccaccatt

SEQ ID NO: 28624 - DNA, 627 bp, Triticum aestivum
  unsure (1)..(627): unsure at all n locations
  Clone ID: PAT_TA_28624
gccgcagcgaccaccaccagcaactctcgctcgctcagcagccaagcgaagctcgccggagagggaagcgtcgaggatgtcgggccgcggcaagggagggaaggggctcggcaagggcggcgccaagcgccaccggaaggtgctgcgcgacaacatccagggcatcaccaagccggcgatccggcggctggcgcggaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggacgcaccctctacggattcggcggctaggccgcgccggtccagtcgaatccgcctcgcgccgccagattcgtatttagctagccatcggttgttcagtgttcatggtcttcggtgtaatggaatggccgcatctcgctgctgtctgttgtttcgatgtactactagcatggaatggacatctctgcattttacccctgaattcgtctgcaatctcttgctnctgttgttaaatcttatcagtggctctgttaaatcttatcagtgcg

SEQ ID NO: 28625 - DNA, 1248 bp, Triticum aestivum
  Clone ID: PAT_TA_28625
ccgggcgaaaaaaaggtctgatgggccatttattccatatatagcccacaaaaaaccccatccaaaaaacgggccaaaaaacaaattcatatgggctaggaaacaattttgccctcgcccaaaacccccccagctacataaacccagcaccaccagtccagcatgtcaaagacccagctaaataaacccagcaccaccaatcgaccaatccagcacgtctaaatacagcatcacatccaccatccataggatagaaccgacgcacggttttcttacgttttctctctactagtataggatcaactcaactaaagtaagcaacattttcaccgtgccagcgagacagaccagactatacaattcttcatgtcaaggactcatcaggataccaaattcgtcgacgggatttgaagcacgagagagagcaggggcagggggacgtgcctagttgtcacacgccctaaacagagtcagcaggcccaggaacagattgatgatgtcaaggtagagcgtgacggcagcccagacatactcgtcatacttgtaacgcttgatgatgctgcccgtgtcatagacaatgtagccactgaagatgagtgccgccagcgtgccatagatcatgtgagagagcttgcccagcgggaagaagatctgaatgaaagcaaagacgagcaaaatcatcagagaagcaaataggaaaggaccaaggaagctgaagtccttgcccctccttgcagcccagaaggtgtaagcagtgaggctcaagacaaccacaattgtaagaatccccgcctgcaaaatgaccttgccgctggtaaaggcgcatgtcaagcccacagagaagctgatggccactgtgaagacgccaagaagcagcaagttgattgggtgcttctggcggtagatgtgcagcgggcacagcacgatgaaggggaagacgagaatgaagatgtacagccccagtccggcgtaggaggagacgaaaaagtgcgggatggccgtgactgtgacgaagacggccgcgacggcggcggtgaggagaagctgcaggcagaggacgacgtagatcttccggatgagcgcccagcgcagctcggggctctccgtcgtcccggcgtacggcgcccccttcggtgccgcggtgcccgcctcgatgtcgccgcccgcctcgacgtcgccgccgcccttcatctcgcccggcgatgaggtagggttttcgcgggtgtggaggcgagtggggagtgggat

SEQ ID NO: 28626 - DNA, 579 bp, Triticum aestivum
  Clone ID: PAT_TA_28626
gccggccgggttcgggctcactcggcccctccctctcccattctgcccagtccactcacccacccgtgtctgtgtccggcgacgacggcgaggaaggaagggaagaaggggatcgcggagcagcagcagccatgggcgtgatgggcaggctcaagatcttcgtcgtcaaggagcccgtcgtcgccgcctcctgcctcatcgccggattcggtctatttcttccggcgtttgttaggccaatgttggattcttgggagactgagaaaaatgccaaaaccccagttgaactaaaagatgtggtcgcaggtgtcaccggcaagaaagcttagtgatcaacgtctcttcgctctgctgatgttgtctacacattttgttctgcttgtttttggtgcccagacgagcgggctctcttctgggattgtaatcggatcggctgaaataatcattgtgtctggacctattttgaccatagtgcaatgagatggacctgttgtttaaggagtgattccaagttgtaaggaatgaattgaaggtcattgttacccttttcatcaaaaaaaaaaaaaaaaaaggccccta

SEQ ID NO: 28627 - DNA, 698 bp, Triticum aestivum
  Clone ID: PAT_TA_28627
caggaattcgcggccgcgtcgacaagcagtggtaacaacgcagagtacgcgggcacgactctcggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgcctgcccgaacactcccgcttccacgtccacggtggacctggacggcgccacgccgttcaagttcgacggcagctactacaccaacctgcagaacaagcggggagtgctcgcctccgacgccgcgctcacgcagaacgccgccgccgcgaccattgtcaacgacctgaccaacccgatcaagttctacgccgccttctccatgtccatgaagaagatgggccgcgtcgacgtgctcaccctcaagaacggacaagggaagatcaggaccaagtgcaatgtgccgtgagggttcatccaggagcgccacacattttcttggatttttttactctctccctctccctcttatttcatcggcgcgggtcaaatatattgtgcccgccatgattaagctcccagatctatattgatttgttaagtgctgtgcctgagtatgtaagattattagtcacgacatgcgttgcattcctcttgcaatcaatcaaagaaggtgattcggc

SEQ ID NO: 28628 - DNA, 591 bp, Triticum aestivum
  unsure (1)..(591): unsure at all n locations
  Clone ID: PAT_TA_28628
gaattcggcacgaggcaccgttcctccgattccacatccgctcgcagctcgagatcgtcagccatgtccgggcgcggcaagggaggcaaggggctcgggaagggcggcgccaagcgccacaggaaggtgctgcgcgacaacatccagggcatcaccaagccggcgatccggcggctggcgcggcgcggcggcgtgaagcgcatctcggggctcatctacgaggagacccgcggcgtgctgaagatcttcctcgagaacgtcatccgcgacgccgtcacctacaccgagcacgccccgacgcaagaccgtcaccgccatggacgtcgtctacgcgctcaagcgccagggccgcaccctgctacggcttcggcggctagggccgtccgacggtcgtcggtctttgtcgccgccctgcagattccaaaagcttgatgaaaccccgacttgtctagttatagctgtttcctctgtagtttcgaactgaatcgtggaacaaagttatttgcgtaccttgtcggaaatgaaacttgtctctgtcagtctgtcgtaaatctgattttgttcgctggttggtcttctgcnnaaaaaaaa

SEQ ID NO: 28629 - DNA, 544 bp, Triticum aestivum
  Clone ID: PAT_TA_28629
cgatccaaggcgagatgaacacccatattataatctggaactcattacaaccaccagcacgcagctgcacacgcacacacaggacaagcacacaccacagaacgacgacccgcctaaccacatctaaatcccacgcgaggcacgaccctggctcagccgccaaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccacgggtctcctcgtagatcagcccggagatgcgcttcacgccgccccgccgcgccagccgccggatcgccggcttcgtgatcccctggatgttgtcgcgcagcaccttcctgtgccgcttcgcgccgccctttcccaggcccttgcctcccttgcctcggcctgacatggctggcgacgcttgctggctgctgtcccgaaggtgggattggaggggattggggattggggatttgatgtcagatcccg

SEQ ID NO: 28630 - DNA, 1292 bp, Triticum aestivum
  Clone ID: PAT_TA_28630
gcacgagggccaagagagctactagtagccgggagtgtagtgagagtagagtgagcgagaatgggtggcaaagccgctctcctggtggccctcctggccgtgagcctggtcctcgaggcccaggcgggcagcggctacggcggcggccacgcccccaccccgacgccggtcgccccaccccccaagcacgagaagccacccaagggccacaagccccctcaccaccaccaccacgccaagccaccggccgcctcccacgggccgccaacgcacgctccggcgccacccacctacagtcccccgacgcctaaacctacccctccggcccccaaacctacaccacccacgtacgccccgatcccgaagccgccgaagccatctccctcgcctccggcgtaccaccccacgcccaaggcctgcgcctcccacgtataaaccaccaacccagcctaagccctcaccgccggcgtacaagcctgcccccaaggtctcaccaccagcgtacaagcccgcccccaaggtttcaccgccggcttacaagccagcccccaaggtctccccgccggcgtacaagcccgcccccaaggtctcaccgccggcgtacaagcccgcccccaaggtctcaccgccggcgtacaagcccgcccccaaggtctcaccgccggcgtacaagccagcccccaaggtctcaccgccggcgtacaagccagcccccaaggtctcaccgccggcgtacaagccagcccccaaggtctcaccgccggcgtacaagccagcccccaaggtctcaccgccggcgcacaagcctgtccccaaggtctcaccgccggcgtacaagcctgtccccaagccctcaccgccgacgtcgccgactccgccggcgccgaagccgactccaccgccctacaagccgccgacgcctactcctccggcgtacaagccccccaccccgagccccccgcctccgccgtaccaccactaagaagatccaccactctgtgaagttgggagcccaggatgcggtcgagaagagttgtgcgagcaggccaagaagagccacgtacggcgtcgttgatcctcctccggtgtgtgttgctgccgaactagggccgatctctgaggagatgcaataatgcagatggctcccattagttatcttaccagcttatcatttgtgttcgtccagtcttagcgtctgtgttgctagcgtggcaatgtgccagtgtcactgtaaaaccattaatcactatggaaatggaagtaaaaggtgttgttttccgttgcaaaaaaaa

SEQ ID NO: 28631 - DNA, 785 bp, Triticum aestivum
  Clone ID: PAT_TA_28631
ggtccaagcaattaagaaaagtttatccgaacgtccagtctcatcattaacataatgataaacataacataatccctttaactaggcatgaagcaaaatgatattgcacgggcacctcacaatccatttcgttgacaaaaagatgggaaactactagccgcaaaaggtagatagataagtagacaagcagtacgccaccgtcgccatacccaagaggacttctcgcagagatcaacggtaagacttctggaaacgcgcgcgggcgccacgaccgccgaacttcttgggctcgcagcggcgcgggtcggcgacgaggagcgtccggtcgtagcggccgaagatctccttcacctccttcttggccgcctcgtcgacgtacttctggtagtaggcgacgagcgacttggcgatggcctggcggatggagtagatctggctcgtcttcccgccgccgcgaacgcggatgcgcatgtcgatgtccttgaagcgggacctgccggcaagcaggatcggctcgaaggccttcagacggagcatctcagggcggatgagctcgatcggcgcgccgttgaccttgatgaggccgcgcccgggcttgcagtaggccacggcgacggcggtcttcttccggccgaagcactggacggtgcccggcgtcgggcgggtgagaacggctgccatggtggctgcggcggtgtgcttggttgctgtgagcgcggcggtgtgcttggctgctggtagcgcggcggcgaggcggcgcgggtcggggtttcgcggacgcgtgg

SEQ ID NO: 28632 - DNA, 1569 bp, Triticum aestivum
  Clone ID: PAT_TA_28632
tacgccctccattccaccgttccgagcggcgtctgcgtctcctccccacgccccgtccctctcgctgcctccagcccggcgacacatccaccgccgcgccaccgtcggattcgcgcccccccgcccgccgctccgatcgcgtggacgaagatgctgggcgccgcgaggaggcagctcggatccggccccatgctggggcagttgctgcggaggctccgcccggcggcggcggcgtccacggaggcggcaagggggtactcctccgcggccaaggagatcaccgtacgtgacgcgttgaactctgccctagatgaagaaatgtctgctgatccttctgtctttttgatgggtgaagaggttggagaatatcaaggtgcatacaagattacgaagggcttgcttgacaagtatggtcctgatagggttcttgataccccaatcactgaggctggttttacaggcattggtgttggtgcagcctatcaaggtcttcggccagttatagagttcatgacatttaatttctcaatgcaggcaatcgatcatatcatcaactcagctgccaagtcaaactacatgtcagctggtcagataaatgtcccaattgttttcagaggaccaaatggtgctgctgctggagttggtgctcaacactcacagtgttatgcagcttggtttgcgcatgttccaggacttaaggttctggctccatattcttcagaagatgccagaggcttgctaaaagctgcaattagggatcctgatcccgttgtttttctggaaaatgaattactctatggagagtcattccctgtttctgatgaagtgcttgattctagttttgctctgccgattggcaaagctaagatagaacgcgagggtaaagatgttacgattactgcattctccaagatggtcggctatgctcttcaggctgctgagatactgtccaaggaaggaatcagtgctgaggtgatcaaccttcgatcaattaggccactggatagagccgccataaatgcatccgttaggaaaacaaatagattggtgactcttgaagaaggcttcccccagcatggtgttggtgctgagatatgcatgtctgttgtagaagaaagctttgagtatcttgatgctccaattgagaggattgctggagctgatgtacccatgccctatgctgccaaccttgagagattggctgttccacagatcgaggatatcgtccgagcggccaggcgagcctgctacagagcgttgcccatgacggcaactgcgtgatcgaaatttcactttactctgcccatgctttttcccatcgcctgcccggccagaaagaaacgtgtgtgttccataatggtatccacaattgcccaaactcaaagcgagttaaatttttgtaggtgtgcctttgccatgttattcttttagctgcagtcggatctcaccgcactcgctggtgcctccctccactgtcttgtgaattattacgcatgcagctttcgttgattgattattactacggcctaatcacggtggttacataaatggaaaattgaggtgttctca

SEQ ID NO: 28633 - DNA, 1569 bp, Triticum aestivum
  Clone ID: PAT_TA_28633
ttttttttttttttttttttttatcaatcaatttacttcaaatccttgacaaataacaaatcaatattgtttacattttccagaagtccaaaaatgtataaccaacatcttcgggcatgtacgcgcctacggcttttcagttttgctgcacaatacagggaaatgaaaccagaaagaggtctagcttgtgaacggaggctacatggaattacaaagctgccagtgcacaagacatgtggggtacaacttgtgcatacagactggaaagaataggatctgactatataacgtagcaaaatgatacaagtttggattcttctcttattcaagctgttcatcatgaaaaaaaatgaatttttatgaacaaaatggatcaatgggtggcatctctgctgtagaactgatccaaggtcttcgcaggaatacggtggagaagttctcgggggaatatgcgtagcaatgtccatgccagatcaagtgactgaaaaatgttccgagtatcgtatgctccttgcgctacaaatttcctctcaaacttgtcgaggaattctaaatagagcaggtcctcagatgaaagagcctcctctccgacaactgctttcatggcttgaacatccttcccaatggcgtagttggcatacagctgattggacacatctgaatgatcccggcgtgtcataccttcaccaatagcactcttcatcagacgagaaagagatggcaggacgttgatgggtgggtatatctgtctattatgaagctgtctgtcaatatatatctgcccttcggtaatgtatcccgtaagatcaggagttggatgagtgatatcatcattaggcattgtaagaataggaatttgggtaattgatcctttccttccctcgatacgcccagctcgctcatatatggtggccagatcagtatacatatacccaggataaccacgcctaccaggtacctcttctcgtgctgctgagacctcacgaagtgcatcggcatatgagctcatatctgttagaatcacaagaacatgcttcccacattcatatgccaaatattcagcagttgttaaggcaattcgaggagtgataatacgctcaatagtggggtcatttgccaaattcaggaaaagtgtgacccgctccattgaaccattttcttcgaagtcacgcttgaaaaattgtgccgtttccatgtttactcccatagcagcaaacacaattgcgaaattgtcttcttcacctccctctgctgcatgcttgctttgctccaaccttttaacgaggccagcttgacgacaaatttgagcagcaatttcattatgaggaagtccagcagcagagaaaagaggaatttttttgccctcgagcaatcgagttcatgacatcaatggtggatattcctgtttgaatcatctcttctggataggttctctcacttgggttgatagaacttccagaaatatccaagtaagcctcgggcaatataggggggccattatcaataggttttccagaaccattaaaaatgcgtccaagccccacgcgtccgcccacgcgtccgcggacg

SEQ ID NO: 28634 - DNA, 797 bp, Triticum aestivum
  Clone ID: PAT_TA_28634
acccacgccctcccgtcccgtctccccgccgcctcctcctcctcctccgcgtcgcaaaccctcgtcctaatccgccgaatcccgcgacccacgtaagcatccgccctggttctcgatcgattccgcgccggcttccgtcgaatcggggatttggcccgatcgatttggtgttccggcccaaatcatcgcggggattttctcgggaaccaaggcagatcgatggcgaagagctcgttcaagctggagcaccctctcgagaggaggcaggcggaggctaaccgcataagggagaagtactctgacagaattcctgtgatcgttgagaaggctgggaagagtgatattcctgacattgacaagaaaaagtacctcgtccccgcggaccttacagttggacagttcgtgtacgttgtccggaagcggatcaagctcagtgctgagaaggcgatattcatctttgtgaagaacactcttccaccgacagctgccctgatgtctgccatttacgaggagaacaaggacgaggacggcttcctctacatgacctacagcggcgagaacaccttcggattgctctagatggcgctggctgccacggcaatcgctctgaatgcctcctgtaaataaggcgtgccaatcaactgtgtatatattccggtttgcctcgtcgtaggatctttaaattgcacaaccaagaaaaacctattcgtatcctgacttatcctatttgaatgttctgacttatatatatatcaagtaagactctgaaattccgtaaaaaaaaaaaaaaaaaaaaa

SEQ ID NO: 28635 - DNA, 651 bp, Triticum aestivum
  Clone ID: PAT_TA_28635
gccgcttcgagccggccgggccgggatctcttctcctcctccccgccgccgccgccgtctcctcctactcttcgccgctcccgctcccgccgccgcgccaccgccgtcagccatggcacccaagaaggagaaggccccggcggcgtcgtccaagccggccaagtccggcggcggcaagcagaagaagaagaagtggagcaagggcaagcaaaaggagaaggtgaacaacgcggtgctgttcgaccaggccacctacgacaagctgctcaccgaggtgcccaagtacaagcagatcacgccctccgtcctctccgagcgcctcaggatcaatgggtctctggctcgcagggctatcaaggacctgatggagaggggactcatcaggatggtctcaatccactcaagccagcagatcttcaccagggcgacaaacacctgatttatcattatcatgtgttccatgtctgtttttagtccagtagactgaggtgttgctgttatattcaagttcactatgtccaggggggcacactgtgccaccagtaatgttgaattgcttttgagttttggtacactttaaagatcgttttgtcagcgcaatgaaatctaccttatatattgccctatttgctgctgtccaaaaaaaaaaaa

SEQ ID NO: 28636 - DNA, 685 bp, Triticum aestivum
  Clone ID: PAT_TA_28636
gggccaccaccgttcccccgattccacatccgctcgcagctcgagatcgtcagccatgtccggccgcggcaagggaggcaaggggctcggcaagggcggcgccaagcgccaccggaaggtgctgcgcgacaacatccagggcatcaccaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcacggccatggacgtcgtctacgcgctcaagcgccagggccgcaccctctacggcttcggcggctagggccgtccgacggtcgtcggtctttgtcgccgcctgcagattccaaaagcttgatggaaccccgacttgtttagctcgctgtttactctggctctgtagttcgaactgaatcgtggaacaaagttattcgcatgtgtttgttggaaatgaaatttgtctctgtcagcatgtcgtaaatctgtttttgttcgctggtttgtcttctgcatctctgttgggcatgattgttgtttcctttgtgatgcttgagtcggccataatttactaggagccccgggtgaattgaacttgtttgcaggctaatttgtaatgtgatgg

SEQ ID NO: 28637 - DNA, 1196 bp, Triticum aestivum
  Clone ID: PAT_TA_28637
tagtccagttttttttttttttttttcaaaaagaatggaagaaatataatacaccaatgggtgaaaatgatacattgccagtttgatggaagacttacaagttacaacaacagagttcagaaccaagatcaactgatctgtggcaacaaaatctcacgggcccagagagcatcagactgatcaatatagcaaaatgatcgcgaaacaaccaccgtagataacctacatatttctataaacaactgaggtcctctggatacacaccattcatgcgatctctcgccagctctctattcttcattccaatttgtttcccaatcactatcaggagggagtgagagcattccatgaaaaatatgattctcacatatgccaatcaacatgcttagtatttcggtggtgcaggtggcaaccggttgggtgtgcgtcggctgcctgaattggcaccgttggcatccccattttcataccgccgaccacgactgtcagcacttctcgatcttgactcgttctgtgaactggatcgggcggcagagccatttgctgcagcactgaaggcagacctccagtcctcaccggactggctagggctctgtgggccactctccggaccagaagtatcatcagaatatgatgcaactgcagctctgttatcatggacactgagctgacgagtaagttttgacagaagagtcgactgtttttgggccttttcccgtctgcgtttagcattgtggtcctcttgggagaagttcttcaatccttgcattgctttgtgaacttattgagctgtacagctggtttagcatatcttcctttgctttctccacttggcaaagcacaatagcctttggaacatttgctgccaggctgttcaacacagcctcaacataaccgcgaacttcttgagacatccatcggagttcttcttcaggatcagcaggcctccgggccatcgtatcaagagatccatctgaatggctttgtctcatggaaccgccctcgggagtatttgaactcttgacagacccacctttgctctgaataataccttttatcttcttcacccattcaatcttgtcagccatactctcagccttcaatacaacggcactatgagctttcagcacagttttgtaggcaaccctgttagtaatcttaaatacgagacttgggcctttctctggccccggacg

SEQ ID NO: 28638 - DNA, 861 bp, Triticum aestivum
  Clone ID: PAT_TA_28638
cgtccgcggacgcgtggggcccagtcgccgctggggacgaggacctgcagctgcggcaggaaggcgatggcgcaggccattaccgtggtctctggcctgtggcgaggggggttcgagagtcttccagagagcggatccagagagtgctagggtttctctctctcccggcggcgagggcgatgtcgatggcggcggcggcgagggcggcgacgcgggccccgggcagggcggcggcgcggttcgtgcagaccaggctccgctcctccggcaaggtgctcagcgaggaggagagggccgccgagaacgtctacatcaagaaaatggaacaagagaagcgggagaagctcgcacgcaagggtcccagcgcaggagagcaagctccgtccaccccaagcgccgcagcagccgatgtgagttcgaccgcgtcggcatccgcagcaggcacgtcgaccgacaagaacaggaactacgccgtgctggctggcaccctcgccggcctgagcgccctgggctggtacctcctgtccaagcccaagaagacggaggaggtcgtcgactgatcggccggtctccgtcccgccctggtttttacttccttactgcacatggacctgcctgtggttggtgtggtatgatgatgatgatgataataagtttccgacgtcgccgaacagccttgcctttgccttgttagctgcctgcttcgacagaatctgagacttgagatgatgatggtctgtagcgcaagttgttttgctacctgtggttggtgtggtatggtggtggttaacgagagaggcgtcttggatgatgcggtttggtccttttcaaagtatgcaatgcatggttttttccggtgaa

SEQ ID NO: 28639 - DNA, 1509 bp, Triticum aestivum
  Clone ID: PAT_TA_28639
gaacttaatcacagttcttattacagatgtttgttagcatggatgtacattttttcttcaagactcacaagaatgaacccagagccatcaaatgggcttgcttcacaaactgtacagtaataaaaaaaacgaagcattcagatgaaaagcccacacacacatcaacagcattctggacaccggtactgtcgctccatgtagacgattccaaggattttgaactttacaagcttttatcatgtgcaagatggtaaaacatattcactgacaccgtcctgctttttctaaatcaagaggactgatggcatactttcacctgcacaaaggatatgggaataaatcccctgttaactagcctagtgcatagaattgaaggagagtaagcacagatctgatgactggcgagcaccatccatgtcaaccatcttgaatcctacatgatcatagagcctccgagctggcaagttatccttatgtacatgaatataaatgctttcagcaccatcgagtcttgcagcatcgatggccaataacaacatgttgctggcaatcccttgacgccgtgcatacttagcaacacaaacattggttaaatatccaaattttggctgatctggctgatagattctagagtaaaatggcgtgtttccaggctccgcgggatatgtctccccatatagaggatgcctgacacatagatctaccgtaccaacaaccactattcaccacagttcgtgtgacgtcatcattctttaccgcaacaaaacaggtatacttctctccaacctgcctgccacatcgcttctttaaagcatgaaattcctgtgatgcaaactttcttttaaagctttcaaacataagcgatcgcctgaacttgattcttcatagtgatcttctgctctcaacccatgcggcgatcccagtattcctcatccattatagcctcccggagcaacatagcgaccggaaatatcttgtgtatttgcaatcacttttctcaatcgagggtcgaagacgattgaaacggagatcggatggttctgctggatgcaaaggtgttggtgtcactggtgtcctattggatatgtttgatgagacactagggatggatgcttttctggcaacattaacactatgagcaatcatttcctcttttccgctgtttgtagaaatcacgggctcatctttcatcggcgtggcggcgaggcgccggcggaggaggactccccggccaccgaagccgcgccgcccgccggccagcggcggcggcggcggcgcgacggctccgctcgccatcccggacttgctagcgcctggtccaagggggcggggggtggaggtactcctcggcggcgcggcgaggggaaatgctgggcgcggcggggtccgggttggcgtgcgccgtggtctacccgggcaccgcaccaccaacctcgcggctgcttccccccctctctgccttgggctctctgctagagtgctagtagcagttgttctgctctatccgtt

SEQ ID NO: 28640 - DNA, 568 bp, Triticum aestivum
  Clone ID: PAT_TA_28640
acgctacccccaaatccccagcctccagatccacccgccgccgccggccacccccgtcgcttcccggcccccgcgcgccccagccagccaggatgacgctcgaagaagcaccattttacccacgcgagaagcttgttcagaagcagcagtatttccagaagctgagcaagcatatccaccttaaaggccgttatgatgtggtcacctccgttgccattccccttgcgcttgctggcaccagcttgttcatgattggccgtgggatctacaacatgtctaatgggatcgggaaaaaggagtgaatttctgtgggttttgctagtatctcagtaagcggcatggaagcaatactgcccaagctatgatgtcatcttcgtttgcaaataatattgtcagagaaagactcgggtccatttcatgttctcttttgttggtatttgtggatgcttgctaaacttgcaatgatgatgctataacatcagcatcgtccactttgcattatttctgctctacgttttattttctttgatcggtgcaaaaaaaaaaaaaaaaaaaaaaaaaaaaactc

SEQ ID NO: 28641 - DNA, 567 bp, Triticum aestivum
  Clone ID: PAT_TA_28641
gcacaacgctacccccaaatccccagcctccagatccacccgccgccgccggccacccccgtcgcttcccgccccccgcgcgccccagccagccaggatgacgctcgaagaagcaccattttacccacgcgagaagctcgttcagaagcagcagtatttccagaagctgagcaagcatatccaccttaaaggccgttacgatgtggtcacctccgttgccattccccttgcgcttgctggcaccagcttgttcatgattggccgtgggatctacaacatgtctaatgggatcgggaaaaaggagtgaatttctgtgggttttgctagtatctcagtaagcggcatggaagcaatactgcccaagctatgatgtcatcttcgtttgcaaataatattgtcagagaaagactcgggtccatttcatgttctcttttgttggtatttgtggatgcttgctaaacttgcaatgatgatgctataacatcagcatcgtccactttgcattatttctgctctacgttttattttttttgatcggtgcaaaaaaaaaaaaaaaaaaggccccta

SEQ ID NO: 28642 - DNA, 652 bp, Triticum aestivum
  Clone ID: PAT_TA_28642
ggcaacaaccaccaccaccagcaacaaagccaagctcgccggagagggaatcgtcgaggatgtccggccgcggcaagggagggaaggggctgggcaagggcggcgccaagcgccaccggaaggtgctccgcgacaacatccagggcatcaccaagccggcgatccggcggctggcgcggcggggcggcgtgaagcgcatctcggggctcatctacgaggagacccgcggcgtgctcaagatcttcctggagaacgtcatccgcgacgccgtcacctacacggagcacgcccgccgcaagaccgtcaccgccatggacgtcgtctacgccctcaagcgccagggacgcactctctacgggttcggcggctaggccgcgcgaatcgatccccccaccaccagatttgtgcgcggctgtgtagtgttcatgggcttcggtgtaatggccgcatgctcgctgctgtatgtcttggccttgactgttgtttggatgtagttctgagatggaattgaaattgaagcagcttacccttgaattcttctccaatctctcactctgttgatgctgatttgtgtgagcagttagaaattactaatttcccactctgtaatttacccctgaattactagtttacccttgaattcttctgcaaa

SEQ ID NO: 28643 - DNA, 612 bp, Triticum aestivum
  Clone ID: PAT_TA_28643
cgtccgaccaccaccagcaacagccaagccaagctcgccggagagagaggatgtcgggccgcggcaagggagggaaggggctgggcaagggcggcgccaagcgtcaccggaaggtgctccgcgacaacatccagggcatcaccaagccggccatccgccgtcttgcccgcaggggcggcgtgaagcgcatctcggggctcatctacgaggagacccggggcgtgctcaagatcttcctggagaacgtcatccgcgacgccgtcacctacacggagcacgcccgccgcaagaccgtcaccgccatggacgtcgtctacgccctcaagcgccagggacgcaccctctacggattcggcggctaggccgcgcgaatcgatccccccaccaccagatttgtgctcgtagctagctatggctgtgtagtgttcatgggcttcggtgtattggccgcatctcgctgctgtatgtcctcctggcctcgattgttgtttggatgtagtcctgggatgtttacccttgaattcttctgcaatctctcactctgttcatgttgatttgtgttcgttgtcaggtgttactaatttccaattggtccctcgctcaaaaaaaaaa

SEQ ID NO: 28644 - DNA, 1265 bp, Triticum aestivum
  Clone ID: PAT_TA_28644
cccctacacggctacacatctcatctcatctcattcccccacctccccctcccgataaggcggacagcgaccgagagaagctcccggctcgcctcctccctccctccctcccctgtctcctctcccggctccatccatccaccgggaggagagggcagcaggcggaggaggccacacctacctacctatctatctatctgtctgtctaagccgccggcatggactcggagcactggatctcgcgcctggccgccgccaagcgcttctacgccgcgcagctcggccacgccggcgcagatcgggcgggcatggacgagctggacatggacggcgacgagaacgccggcaggcccgacttcacctgcccctactgctacgaggaccacgacgtcgcctccctcatcgcccacctcgaggaggaccaccccttcgagccccacgccgcgccttgccctatctgctctgaaaaggtttctaaagatatgctgaaccatatcaccatgcaacatgggtacttgttcaagaatcgccgcaggttgcgcagatttgctgttccaggcagccagtcgctctctctgctgagccgggatctacgtgaagcccatttgcaggtgcttctgggaggtggtggacataggtcgagcaacaataatgccgcaaatatttcagctgatcctcttctgtcatcatttggccttagcttcccaacattagatgctgaggaaacatcaaaattgtctactcccgctcagagtgatgtaccagtgctaaaagaggcagctgctcggccgtggcggtcaagtatggactcgtcgctcacaagggaagaaagggagcaagccagcgtgagagcggcatttgtgcaagacttgctgctctccaccctattcagagaccaataactcagaggcgagccgatgttaccgctacccgggtgccccctggaccctgatgcagactccgaaaggtcggtgcccccagaccaagttgccgaatgtgacatccatggaagatagatagggtttggcaccccagcaaggaaggaaggaggtgcatcagagtcgatgtgggcatgaggtgtcctaagttatttgtagccggtctttgtgttgtcagttaccgcgatctctgcaggcgatagatgtctgcgcaggtcgcggtggtgtctgtaccgtaccgctgcttctttgtttacaagcattggtttgttgtaccagttttacataataatgaatgttgctatgcagtttatttcaaaaaaaaaa

SEQ ID NO: 28645 - DNA, 904 bp, Triticum aestivum
  Clone ID: PAT_TA_28645
cagagtaggactagcttcagctagccagcctctgccactccggtcattttcttgcatccacgacggcaatggccaccgctgatgtccagaacccgacggccgcgctgacggaggaggcgcccgcggtggagacgcccgtcgccgccgaggaggttgccaagacagaggaggtccccgcgccggcggaggccgaagtcgaggcgcctgcccccgtcgaggttgaggcgaccaaggaggaggcaccggccgccgccgagacggaggaggccaaggaggccgagccagcagctgcggccgagacggaggccgaggcgcccaaagagccagccgtggtcgagacagagaccaaggaggccgtggcagaggcagagccggcagtcgtcgaggaggtgaaggaggaggcggcgcctgctgccgagccggaggtgccggccgtcgccggaggaagcaccggctgcagcggaggaggcaccccgcggccgcggcagaggagcccggccgacgccgtggccagcgtcagcgtgtgaggccgccggcgcgcgcggaggaggagctggctgcgtcagcgtccacggcggcggccgtgtgctcctacgtggcacggcgtgatgctcagccagtggagtggagtggactggagtgctactttttactactgtactctactaggtgtggagtggagtggagtgctatgcgcggggtcgcgtgacgtgggctaaataaaagtgttgtcggtgagcatccgagccgagcgacgcagtgccactcctaagataatgtatgccttttattttgtccgataagacatgattcattatatctacggacatctgttttctcaaaaaaaaaaaaaaaaaaaaactcgagggggggcccggtacccaattcgccctatagtggctgt

SEQ ID NO: 28646 - DNA, 605 bp, Triticum aestivum
  Clone ID: PAT_TA_28646
gcaccaccgttcctccgattccacatccgctcgcagcttgagaccgtcagccatgtccgggcgcggcaagggaggcaagggtctcggcaagggcggcgccaagcgccacaggaaggttctgcgcgacaacatccagggcatcaccaagccggcgatccggcgcctggcgcggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgacatggacgtcgtctacgcgctcaagcgtcagggccgcaccctctacggcttcggcggttagggccggccggccgacggtcgtcactctttgtcgccgcctgcagattccagaagcctgatgaaaccccgacttgtttagttcgccattttctctgtagctcgaactgaatcgtggaacaaagttattcgcatgtgttgttggaaatgaaacttgtctctgctaatgccgtgtttctgattttgtcttgctggttggtctctgttgggtacgatattgaggtggtgatgagttgatttgccat

SEQ ID NO: 28647 - DNA, 1493 bp, Triticum aestivum
  Clone ID: PAT_TA_28647
cgggaggcaacagctcgaatcattcaaccaatcaaatgacaataataaattactgatacaacaaacaaaatctctggcacttgatcatgcctcatggtatcactgttacaaaccccgcatagtatgtattacacaaaggttggccattaggccatactatgaaaaacaaacacaccggggaccaatgtttctctgaactgtgggcaaggtttttgatacggcagcacgacacatgatagcacacaatgccctgacatcccatcaaccgagtcagatccagtcagtgatcttgctctactctaagaaaatcttggttgcgactgctggtagcttccttccagatgcctcgtgcagttcataggtgatatccatatccataagccggtgattctctttcgagcgaaccatcgagaaagaaacattgatactgtccccttcatttactctcggagctggagtcatcaagaacacctgctgaccccagtgtgtcccaccattctcatctggggctgtattcaattcaacttcctcaactgcagggttttgcttgctacctctaaagtgaacatcaaaccacccagccaatgcagctagccttgttctatcctggttgattggcaatgtaacttgtgctctaacttctcgaatctcttcaacggttgctgtcaagcaatccatctccttgacgacagcaggttgcccaataagttggttcggatgaagattgttccaaatcgaagacttgagatagaacttctcatgttctgcacgatatgcctttgtcaaggcattcatgttgaccccataataagcctgggtgtcctcagacaaaatgattccagtcattcatagcaatctcgaaatcttccatctttttgtcacccaaaccacttcttattggtgctaaccacatccgggcatgactaggatacattacaccacctggattcaaccagcggtcgcgtgcgcatatgacggaatcaaacatggactctctcaagagatagtagcccatccactcagagataatgacatcaactttctccggcagcacgatgtcctccatggtcccctgaatgacctcgacgatgtcggcgaccccgttcgcgcggacgagctcgcgggcgtgctccgccacgttggtggcctcgacggcatacaccttcctggcgccggcctgagcgctccagatggcgaggatgccgctcccagtgccgacatcaagaaccaccttgccgcggaagtggtgggggttgcggaagacggcggagtggtaggcgtccatgcggacgcggtcgcagagcatctccttctggtggtagaggtaggcgtaggtgcagaagtagttggcgaagtcgacctccttgtcgacggggggcgcgcccccggcggccgaggaggcggcggcggcgccgttggggagggacgccatggggaggggtgtgggggcgggagaggggggaagacgggaggggttttcccccacgcgtccg

SEQ ID NO: 28648 - DNA, 617 bp, Triticum aestivum
  Clone ID: PAT_TA_28648
ttttttttttttttttttgatccacgaaacgaaatagagagcgtcttcattgtacatagacagagtgacccatggcagctactttatccgaagccgttttttttcttggattcaacgattcaaatgtcgcttattacattacaaaccagagcagcaaaaatgcatgcagttggatttgaaaaaaaaaacataaaagctcaatcacaatagtgagggtgaggactggctccccgcatcaaggacacatgctggttactcagctgctgcccctgtgacctggcggcggacgggccgggcgggcggcgactacttcttcttgtgcgcctggatgaacttggagttcttgaggtcctcctcggtgaagccggcggtcatcttggtgatgagggcccccgtgacggcgaagccggcgaggaagggccaggtgcggccccactcccggcggaagaacaccggccacgggtcgaacgccgagaagaacttcatctccggtaggtttgatctcgacctccgccttggattggattggattggattcgagtccgccaagatctgattctctctctcggttgcgttgcggcgtggacggggggtgaggattccccttgtccgtacca

SEQ ID NO: 28649 - DNA, 655 bp, Triticum aestivum
  Clone ID: PAT_TA_28649
gccggccgggctctggacagcaccagacgccacccaccaccgttcctcccatcccacactcgctcgcagctcgagatcgtcggccatgtccgggcgcggcaagggaggcaagggcctaggcaagggcggcgccaagcgccaccggaaggtcctccgcgataacatccagggcatcaccaagccggcgatccggcggctggcgcggcggggcggcgtgaagcgcatctcggggctcatctacgaggagacccgcggcgtgctcaagatcttcctcgagaacgtcatccgcgatgccgtcacctacaccgagcacgcccgccgcaagaccgtcaccgccatggacgtcgtctacgcgctcaagcgccagggccgcaccctctacggcttcggcggctaagggccggccggccgacgggagtcactctttgtcgccgcctgcagattccagaagcctgatgaagccccgacttgtttagttcgctatttcctctgtagtttgaactcaatcgtggaacaaagttattcgcatatattgttggaaatgaagcttgtctgttgtctctgtgctgataccctgtttctgattttgcctcgctggttggtctctgttgggtacgatattgaggcggcgatcagttgatttgccacaatttac

SEQ ID NO: 28650 - DNA, 675 bp, Triticum aestivum
  Clone ID: PAT_TA_28650
cgtccgcttccattcgccatggccgccttccgcctcctcttcctcctgcttgccttggccgccagctgcaacagcactgctgctgctagcgcgatgtacaaggcgaaggccagtgtgattttcaggcatgatgctcgcaccatcgaggtcaaattcctcctccccgccagcaacagcccagtcgccgccggggacgaggacctgcagctgcggcaggaagccatggcccaggccgttaccgtgatctcccgccacaggccagagaccagcgacgccgagaagctcaagtgggcgctgggggtggtcaacctcgaggcccagcggtggaagcccatcttcagagccgtcagcacggtgctggagagcggcgccgacgagggcaccaaggaggagctcaacagcgagctcggccaggaaggtcccaacgccctcaagatcgacttcgggtatatgtgacatgcatcgccagttccccacctctgccttagtttctctatcggccttagcgcgccccagatatctgtggtgttgttagttatgtatggtgctcccatccgtgcgctgcggcctgtcgcagctgtcggagcaccgccattatttcccttctgcttcgttctcgacgccttcggctgcggaacgtttgtgattgtgcttgcatttccttagtcagcgagg

SEQ ID NO: 28651 - DNA, 1693 bp, Triticum aestivum
  unsure (1)..(1693): unsure at all n locations
  Clone ID: PAT_TA_28651
ccacgcgtccgcccacgcgtccgaccgccacggcacccccgccgtaccaccgacatcgccgccggatagataatcccatcccagcccgaatccaaccagacccgatccccacgcgcattccctccgctccccgccccggatccgaccgtccacccgaccgcgccgcgcgaccgccgggggagggagagcatggcgagcgggggcaggacggatctggacggcgccgccgtggcgccgctgaccatctgcgtgatcggcgccggcggcttcatcggctcgcacctctgcgagaagctcatggccgagaccccgcacgtcgtcctcgccgtcgacgtctactgcgacaagatccgccacctcgtcgacccgcccccgccccacctcgccggacgcatctccttccaccgcctcaacatcaagaacgactcccgcctcgagggcctcatcaagatggccgatctgacgataaacctggcggcgatctgcacgccagcggactacaacacgcggccgctcgacaccatctacagcaacttcatcgacgcgctcccggtggtcaagtactgctcggagaacagcaagcgtctgatccacttctccacgtgcgaggtctacggcaagaccatcggcagcttcctccccaaggaccaccccctccgcaaggaacctgaattttatgtactgacagaagatgagtcaccctgcatctttggtccaatcgtgaaacagagatggtcctacgcgtgcgcaaagcagcttatcgagaggcttgtttttgctgaaggcgcagaaaatggccttgaattcacgattgtgagacctttcaattggattgggccaaggatggacttcattcctggcgttgatggtcctagcgagggtgttcctcgggttttggcttgcttcagcaacaatctcctccgcagagagcccctgaagcttgtcgatggcggcgagtcccagagaacttttgtttacatcaaggatgccattgaagctgttcttttgatgattgaaaaccctgctcgagccaatggtcatatcttcaacgtggggaaccctgacaatgaagtcactgttagggagttggctgaaatgatgacagaggtctatgctaaggtctcaggagagcccccgctggaggagcctgtgatcgacgtgagcgcaaaagaattctacggcgaagggtacgacgacagcgacaagaggatccccgacatgaccctgatcaacaagcagctagggtggaaccccaagacccctctcaaggacctgctggagacgacgctgacctaccagcacaagacctacaaggaagccgtcaagacgcagatgtgtctgggccacggcgacgccttcaagctagacgatgacggcgcagctatgctgctcttgatcttttggaagccagatacttatatcgtagtgaaaccgtcgtcgtcgtttttgtcgcgcctctagatcccacccacctatcttcttacctacctagattcgtcattgtgtaaccctatatcgggcaaagggaactgagtatctgagtatctattacatatacctgtggtggcagtgtttgttacgtttggttggttgcacctccagtgctattatttttttgctgttagtgagagagagagagagagagatattcttgttcggcatagttgatgatgatctggaagtcttaanattt

SEQ ID NO: 28652 - DNA, 584 bp, Triticum aestivum
  Clone ID: PAT_TA_28652
tttttttttttttttttttgagcagaacacatgattcaatccaatgcgagatgaacacccatattagaatctggaactcattacaagcaccagcacgcagctgcacacgcacacacaggacaagcacaccacagaacgacgacccgcctaaccacatctaaatcccacgcgaggcacgaaccgcgctcagccgccgaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatgagcccggagatgcgcttcacgccgccccgccgcgccagccgccggatcgccggcttcgtgatcccctggatgttgtcgcgcagcaccttcctgtgccgcttcgccccgccctttcccaggcccttgcctcccttgccgcggcccgacatggctggcgacgcttgctggctgctgttccgaaggtgggattggaggggattggggattggatgtctgatgccccgacccggccggc

SEQ ID NO: 28653 - DNA, 609 bp, Triticum aestivum
  Clone ID: PAT_TA_28653
gccggccgttccgggatcccaccagccgccaccaccaccgctcctcatccgtttccatctcagtcagctccaagcagtcaaccatgtccggccgcggcaagggcgggaagggcctcggcaagggcggcgcgaagcgtcatcggaaggtgctgcgggacaacatccagggcatcaccaagccggcgatccgtcgtctggctcgccgtggcggcgtgaagcgcatctcggggctcatctacgaggagacccgaggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggcttcggcggctgacctgcgcctgctgctgctccatcgagtcgactctgctggatgctgctcctgttctcgtgctacggtttcgtttctgagtgcgtgagttggtgttctgtcggtctgtgtagtctgtgcctttgtggaaggcgatgggtctgaatgtaatggaattgttggttcttgcaagaaatgaatctgaatgcaacggaaaaattgtactgcaaaaaaaaaa

SEQ ID NO: 28654 - DNA, 941 bp, Triticum aestivum
  Clone ID: PAT_TA_28654
caacattctacctctcatcctcccagttctgttcctcggccattctagccaccatgccgggctccatcgccttcggtcgcttcgatgactccttcagcttggcctctttcaaggcctacatcgctgagttcatctccaccctcatcttcgtcttcgccggcgtcggctctgccatcgcctacactaaggtgagcggcggcgcgccccttgacccatccgggctgattgccgtggcgatatgccacgggttccgggctgttccgtcgcggtccgccatcggcgccaacatctccggcggccacgtgaaccctgccgtcaccttcgggcctcgccctcggcgggccagatcaccatcctcaccggcatcttctattggggttgcccaactcctcggtgccatcgtcggcgccttcctccgtccagttctgcaccggcgtggcgacccctacacacggggctttccggcgtggggcgcctttgagggcgtcgtgatggagatcatcgtcaccttcgggctcgtctacaccgtgtacgccaccgccgccgaccccaagaagggttccctcggcaccatcgcccccatcgccatcggcttcatcgtcggcgccaacatcctcgttgccggccccttctccggcgggtccatgaaccctgcacgctccttcggcaacgactactaagccagccatgggaagagtcgtcgggtccataatgccttcggcaacataaaagtgcgtacgtggtgggcagtctcacgaatgtctcgatgatgtgaagaacatcctgttgtttggttcagatcgaagctgtagcacctggatgatgcatgttcctttatctgtaaaatgtgatgttgtgaagttggtggggtttgagaattcttcagttgagtttccttatgcgattcaataagaacatcattgtttagtgcaaaaaaaaaa

SEQ ID NO: 28655 - DNA, 1452 bp, Triticum aestivum
  Clone ID: PAT_TA_28655
ctcgtgccgaattcggcacgagcgacatcacagatcaccaccctcccctccgcccgacctccagatcccgaccccatcgtccgtccatggcgaccgccttcgactcgccgacctcctcgccggcggccgcgcccttccacgacgaccccttcctcagcttcgccgactcccccgcccccgccgcggccgacgtccacgtctccgggggcgccgacgactcctccttcccggcctcccccgacccctacgccttccgccacgactccgccgccggcgcaccccttcggcatgccccgactccaacggcaacggcatgcaccacgacgcggaggatgacggcctcttcaccgactccggccccgtcctccccgaccccgcccagatgggggccgacgagggcttcctcctccgcgagtggcgccgtcaaaatgcactcctcctggaggaaaaagagaagcacgagaaggagctgaggagccaaatcatccttgaagctgaagagttcaagaagggtttcgttgagaagcgcaagttgaaccttgagacaagcaaggatcacaaccgggaaagggagaagcttttcctctccaaccaggagaagttccacaagggcgccgacaagcagtactggaaggcgatatccgagctcatcccacaggagattgcacacatcgagaagaggacaggcaagaaggacaaggacaagaagcctgggatcatcgtggtccagggccccaagcccgggaaggccaccgacatggcacggatgcgccagatcctgtcgaagctgaagcacacaccgccgccacacatgaagccacctccaccacccgctgttgcacctgccgggaaggacggagctccggccgccgctggaaaggacggagctaaggcggcagcgacacctgctgccaaggatgcccctgccaacggcactgtccctgagaaggagaacgcagcacccgccgtcgctgccgccccagcagcagcagctccggcgccaccagctgagcccatcgccgctgcctgaacgaggatggcttcggtcagccgctaatccttcgcagtagggttatatatttgggtgtcagtagagttgttccaggagagacggggaaggagcgtgaaggccacatacgatgcgaggtggtgaaatcgtctgagttcaccacggggaatcatggcggagacacacgcagtgtactattattaatttgagtttgttattatgagcaggagggttgttacttatgggaccagcaaactttattcgttaatattgtcattgcattttgtagagagaaagaggggactggtaagaataaggtaaggctgtgctgtatgtgtttgtatatttatcatcaattgttggatttttggtaaaagacctgtggtttgttgcatatattatatcatttggtttttcaaaaaaaaaaaaaaaaaaaaaaaaaa

SEQ ID NO: 28656 - DNA, 1274 bp, Triticum aestivum
  Clone ID: PAT_TA_28656
cgtccgcacggctacacatctcatctcatctcattcccccacctccccctcccgataaggcggacagcgaccgagagaagctcccggctcgcctcctccctccctccctcccctgtctcctctcccggctccatccatccaccgggaggagagggcagcaggcggaggaggccacacctacctacctatctatctatctgtctgtctaagccgccggcatggactcggagcactggatctcgcgcctggccgccgccaagcgcttctacgccgcgcagctcggccacgccggcgcagatcgggcggggatggacgagctggacatggacggcgacgagaacgccggcaggcccgacttcgcctgcccctactgctacgaggaccacgacgtcgcctccctcatcgcccacctcgaggaggaccaccccttcgagccccacgccgcgccttgccctatctgctctgaaaaggtttctaaagatatgctaaaccatatcaccatgcaacatgggtacttgttcaagaatcgccgcaggttgcgcagatttgctgtttcaggcagccagtcgctctctctgctgagccgggatctacgtgaagcccatttgcaggtgcttctgggaggtggtggacataggtcgagcaacaataatgccgcaaatatttcagctgatcctcttctgtcatcatttggccttagcttcccaacattagatgctgaggaaacatcaaaattgtctactcccgctcagagtgatgtaccagtgctaaaagaggcagctgctcggccgtggcggtcaagtatggactcgtcgctcacaagggaagaaagggagcaagccagcgtgagagcgatgtttgtgcaagacctgctgctctccaccctgttcagagaccaataactcagaggcgagccgatgttaccgctacccgggtgccccctggaccctgatgcaaactccgaaaggtcggtgcccccagaccaagttgccgaatgtgacatccatggaagatagatagggtttggcaccccagcaaggaaggaaggaggtgcatcagagtcgatgtgggcatgaggtgtcctaagttatttgtagccggtctttgtgttgtcagttaccgcgatctctgcaggcgatagatgtctgcgcaggtcgcggtggtgtctgtaccgtaccgctgcttctttgtttacaagcattggtttgttgtaccagttttacataataatgaatgttgctatgcaacagcagaaggctatgcagtttatttct

SEQ ID NO: 28657 - DNA, 1114 bp, Triticum aestivum
  Clone ID: PAT_TA_28657
aagtaagcaagcagaggagagggaccgggaccgggagtgagaggaagttgagctattttcttcgtcgacgctggtttttggcccctgactgctggtcgagatgtcgaagatggcggacgagaaggtgatttcggcgccggcgaccggcggaggggaggacgggctgatcgcaggggacctgtcagccgcggaggcgcgggtccgtccgttggagacgctgctgcgcgccgcgcctctggggctctgcgtcgccgccatggccgttatgctccgtgacacgcagaccaacgagtacggcaccgtctcctactccgacctcggcggattcaagtacctggtttatgccaacgggctgtgcgcggcctactccctggtatccgcgttctacactgccgtgccgcggccggcgacgctgtcccgctcctggattgtcttcctcctagaccaggtgttcacgtacctgatcctggcggccggcgcggcgtcggcagagctgctctacctggcgtacaacggcgacaaggaggtgacgtggagcgaggcgtgcggcgtgttcggcggcttctgcaggcaggcccgaacgtcggtggccatcaccttcggctccgtcgtctgctacatcctcctctccctcatctcgtcctaccgcctcttcagcgcctacgacgcacccatgccctcgctcggcaacaagggcgtcgagatcgctgccttcccgcgctgagccgagaggatccctggctgctctggcttggctactcgatgacgggtcaaaactcaaaacacgtacgtacgtagtagtatcgctgtgtgtgtaggcgaacgaaataatctgtaagggctcatagttaatttcaagctacatatagtgcatctgcctctcttctttttacttgattctatatacactgtactagctttgaatcttctgctgtgaggctgtggtggattaattgatgcgttccaaaaatgcgaacctagttccgttgcaggcacccaggtgatctatgtaactacgatgagcttcctcatttaaggagttcagttgcttgtaaggtgcttgaagcaaagcaaaatcaatatctttccgttcacaaaaaaaaaaaaaaaaaaa

SEQ ID NO: 28658 - DNA, 1067 bp, Triticum aestivum
  Clone ID: PAT_TA_28658
ctgctctcctcatcccctctgccccgcctttcccatcgcagacgcaggcgcaggcgcaggcgactcgatcctctccctccctccctccctccctccctcgtcctatccccaatagggcaaaccgcgttcttgattgtcgggccgggccgtcccgccgggcacggatgtcctctccgagcaagcgccgggagatggacctcatgaagctgatgatgagcgactacaaggtcgagacggtgaacgacgggatgcaggagttcctcgtcgaattccgcgggcccgaagagagtctctaccaaggaggtgtatggaaggttcgagtagaactgcccgatgcgtatccttacaggtctccgtcgattggtttcgttaataagatatatcacccgaatgtcgatgaactgtctggttccgtctgcttggatgtcattaaccagacatggagcccaatgtttgatcttgtcaatgtgtttgaagtcttccttccgcaacttttgttatatccaaatccctctgatccattgaatggagaagctgctgcactcttgatgcgtgatcgccctgcttatgagcaaaaagtgaaagaattctgcgagaaatatgccaagccagaggatgcgggtataaccccagaagataattcgagcgacgaagagctgagcgaagaagacgacgatgactccggtgacgatgagcccatactgggccatgcagacccatagtcagttcaggacctgtttctccggcgcaatttgcacacaatgttttgttgcagcaactgcaattaaacagcctgtagttcgtccaagcccaagtctgaatgccatgtaaataagtgcactgtcagtgttttcaaatgttacctccagcctcagtttaatatgcagcagcacttaaatttaccttctgagatggatgtgcgtcatcgatcgaaaacaagttgtttgttaaaggtcacagttgaaaagcgagaattctcgtcgatttcctacgggatcgagctgttttctggtgaaattcctgcgctccaaactgttcctagctgaatgaacactataagttggtgc

SEQ ID NO: 28659 - DNA, 1627 bp, Triticum aestivum
  Clone ID: PAT_TA_28659
atccatctccctcgccctcccccgccgcctcaacacggcgccatcctcatcacgaaccaaccaaacaaacaaaaggcggacccaactccccctcctccaccttccccggagcgcaaatctcccctcccaatccccacccccgtcggtagccgatcgcgtcgacgatgctgggcgccgcgaggagatccggatgcgtgctggggcaactgatgcagaccctccgcccggcggcgtcggcggccacggcggcgaggagctactccgcgaccccgaaggagatgactgtgcgtgaagcattgaattccgcccttgacgaggagatgtctgccgacccttctgttttcttaatgggagaagaggttggagagtaccaaggtgcgtacaagataacaaagggtttgctggacaagtatggtcctgatagggttctcgatacaccaatcacagaggctggttttactggcattggcgttggtgctgcctaccaaggtcttagacctgtagtagagttcatgacatttaacttctcgatgcaggcaattgatcacatcatcaattcagctgccaaatcaaactacatgtcagctggtcagatatccgttcctattgtttttcgaggaccaaatggggcagctgctggagttggtgctcaacactcgcagtgctatgcagcatggtatgcccatgttccaggattgaaggtcctaactccttattctgcagaagatgctcgtggcttgctaaaagcagcaatcagggatccagaccctgtagttttcctggaaaatgaactactctatggtgaatcgtttcctattaaggctgaagtacttgattctagcttcagtgtcccaatcggcaaagctaagatagaacgggaaggaaaagatgttacaattactgcattctctaagatggttgggtatgctcttcaggcggcagagatactgtccaaggagggaatcagtgctgaggtgatcaaccttcggtcaattagaccattggatagagctgctatcaatgcatccgttaggaaaaccaacagattggtaaccgtcgaagaaggctttccacaacatggtgttggtgctgaaatatgcatgtccgtagtggaggacagctttgagtatcttgatgcaccagttgagaggattgccggagctgatgtacctatgccctatgcggcaaaccttgaaagattggcagttccacaggttgaggacatcgtccgtgctgcaaagcgagcttgctacagatcatcatgaatggcggcaaccgcctaagcacaaatgcacgttttgtttatcggccttcttctttgttccttgtccagaaaagatgtactgaatcgcataattgtatcccccaactcttgtgagctaattttgtagatctgcatgcattgttgattccaatctgtcggcggcagtcggatgactgcattcagttcatggttcatcctgaggcgtttgaatcgtgcaacttctggaggtttacatcactgagggatgtctcaataacatgtatgtaactgaattacagacgttcacatgattttgctgtggcttaggccgatctgtaagtgtgatcaatatcgcggagaaaactggaacattgaaaaaaaaaa

SEQ ID NO: 28660 - DNA, 1788 bp, Triticum aestivum
  Clone ID: PAT_TA_28660
ttttttttttttgaaagaagaaattttggaggggttcactttcatttctaacagttattatgtacaaaattctataacagtgtttgaggatatgtacaattcacgaggaatagctctgccaccaaaattctcgatcctatgaaacacatgtaaataaagttaagaaaaaggcaagtctcgactaactcagtcaatgtgtcatgtaagttcttgttcctctatgtgagtaaccaacaaactcttcctaacacgtgctggaaaacctcagccattgtccttttagttgccaaacctcttggcaattatgggtcggacgtcatcagcaacagcaagcgtatccaggaatggaatcagctgaggtaacccctcatcaaaggggttgttataccagctctctatgggtataccattattcacttgcaactggaaaacctgcggagtgttgtcaattatggcaacctttgcaaggtcaactccaataacagtcagatcttttgtgtagccattttccgtaaatacacatgactcacggaaaaaacgcttcaagaacaatgtgttctctggatcgagcctgtcaagcagctggtctgcataaacactttggcttgctgtgaatataacaacgtcaaacatctcagccatcttctggaggaacatatgcaaatgtggtctcttcctcacatacaccagatgttctttcataccaaaggacactggaaaagaaaaatctgcatcatcacagtgctccatagttgaatgaacaagggtttcatccaaatcaagcacaagagtgaccttcctggccccttgctctttagatacacaagtagcatttgagctcaactcggtataatcaataagattaggtaaatcctcctcatccatatatggattaagccactctaaaacctcagaatggccaaagcactccccacccgagttattaaagcacatatcccctggtgatgggcatggttcattgccaatgccaccttccacggtgctctcattaagtggaaatactccgcatatgccactcatgtctatcaatgaatcaatgggtacaaattcatcacaaaatgtactgtaactagccaggagaccagttggaacatcaaataagaaaggaaaagcatcatcaggattataaatatccaacaggctgcaatccgggtttgagcccaggcttttctcatgatcattgacagcacagatatcttgtgctgcagaatttacatcttcatctgcaaactctttatcacaggtgttcactacatttgactgagatttgccgtcatcattattcgataaggaatcaggctccaaatttggtggaacaacagtttcagatattaaatccttcagcagagcaacggatgttactccaagtatagcatgcaagccagaaaattctgtaaccctactatgctggccagctagttgagttgtcgactcaggctcatcctgagggtccttgtaagacgagttcaacacaaatgcctgctcgaactcatcaacttgaaaatttgaaattttcatcgatttcatggatttggtgtcaaattcattcccgaaaatgtcatcatcaaacttcctcttcattctcagtgctggcatcttgatcagcagttcagagtgccaaagctgtcgagacgggacgatgctgccgcgggtagctccggcgcgtcctctctctctccctctctctcggcctctcccggaggcggacggagggaggagagaggagggggaggaaagccggtgcgcgcaggcagagaggagcggacg

SEQ ID NO: 28661 - DNA, 535 bp, Triticum aestivum
  Clone ID: PAT_TA_28661
ggcaccaccagcaagccacacagagcagccaagcgaagctcgccggagagagaagcgaagatgtcgggccgcggcaagggagggaaggggctgggcaagggcggagccaagcgccaccggaaggtgctccgggacaacatccagggcatcaccaagccggccatccgtcgtctggctcgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggccgcaccctctacggcttcggcggctaggccgcgcccgtccggtcgaatccgcctcgcgccgccagattcgtagctagccatcggttgttcagtgttcattgtcttcgctgtaatggaatggccgcatctcgctgctgtctgttgtttcgatggaatggaaatctcagcattttatccctgaaaaaaaaaa

SEQ ID NO: 28662 - DNA, 1638 bp, Triticum aestivum
  Clone ID: PAT_TA_28662
ccacctccacctactacgcccttcaattccaccgttccgaggcggcgtctgcgtctcatccccccatcccccgtccctctcgctgcccccagcccggcgacacacccaccgccgcgccaccgtcggattcgccccctcccccctgcccgccggtccgatcgcgcggaggaagatgctgggcgccgcgaggaggcagctcggatccggccccatgctggggcaggtgctgcggaggctccgcccggcggcggcggcgtccacggaggcggcaagggggtactcctccgcggccaaggagatcactgtacgtgacgcgttgaactctgccctagatgaagaaatgtctgctgatccttctgtctttttgatgggtgaagaggttggagaatatcaaggtgcatacaagattacgaagggcttgcttgacaagtatggtcctgatagggttcttgataccccaatcactgaggctggttttacaggcattggtgttggcgcagcttatcaaggtcttcggccagtcatagagttcatgacatttaatttctcaatgcaggcaatcgatcatatcatcaactcagctgccaagtcaaactacatgtcagctggtcagataaatgtcccaattgttttcagaggaccaaatggtgctgctgctggtgttggtgctcaacactcacagtgttatgcagcttggtttgcgcatgttccaggacttaaggttctggctccatattcttcagaagatgccagaggcttgctaaaagctgcaattagggatcctgatcccgttgtttttctggaaaatgaattactctatggagagtcattccctgtttctgatgaagtgcttgattctagttttgctctgccgattggcaaagctaagatagaacgcgagggtaaagatgttacgattactgcattctccaagatggtcggctatgctcttcaggctgctgagatactgtccaaggaaggaatcagtgctgaggtgatcaaccttcgatcaattaggccactgggatagagccgccataaatgcatctgttaggaaaacaaatagattggtgactcttggaagaaggcttcccccagcatgggtgttggtgctgagatatgcatgtctgttgtagaagaaagcttcgagtatcttgatgctccaattgagaggattgctggagctgatgtacccatgccctatgctgccaaccttgagagattggctgttccacagatcgaggatatcgtccgagcggccaggcgagcctgctacagagcgttgcccatggcgggcatctgcgtgatcgagatttcactttactctggcccatgctttttcccgtcgcccgcccgggcccagaaagaaacgtgtgtgttccataatggtatccacaattgcccaaactcaaagcgagttaaatttttgtaggtgtgcctttgccatgttattcttttagctgcagtccagtcggatctcaccgcactcgctgctgcctccctccactgccttgtgaattatttacgcatgcagctttcgttgattgattgttactacggcctaatcatggtggttacataaatggaaaactgaggtgttctcatgaaaaaaaaaaaaaaaaaaaaaaaaaaaactcg

SEQ ID NO: 28663 - DNA, 1360 bp, Triticum aestivum
  Clone ID: PAT_TA_28663
tcctctcctcctccccgccgccgcagccgtctcctcctcctcttcgccgctcccgctcccgccgccgcgccaccgccgtcagccatggcaccgaagaaggagaaggccccggcggcgtcgtccaagccggccaagtccggcggcggcaagcagaagaagaagaagtggagcaagggcaagcaaaaggagaaggtgaacaacgcggtgctcttcgaccaggccacctacgacaagctgctcaccgaggtgcccaagtacaagcagatcacgccctccgtcctctccgagcgcctcaggatcaacgggtctctggctcgcagggctatcaaggacctgatggagaggggactcatcaggatggtgtcaatccactccagccagcagatcttcaccagggcgacaaacacctgatttatcatcatcatgtgttctgtgtctgtttttagtccagtagactgaggtgttgctgttatattcaagttcactatgtccaggggggcacactgtgccaccagtaatgttgaattgcttttgagttttggtacactttaagatcgttttgtcagcgcaatgaaatctaccttataaaaaaaaaaaaaaaaaactcgagactagttctcttctcgtgccgaattcggcacgaggcgccgccgccctcccctcccctcctcgcgccgcaagaagcgccggctctcccacacccgccgccgcccgcagccatggcgaccgagctggcgtacgcgccgccgatgaagtccggcaaggccggcttcgagggcccgcaggaggcgcagcaccgcatccgcatcaccctctcctccaagagcgtcaagaacctcgagaaggtgtgctccgatctggtgaggggcgccaaggacaagctgctccgggtcaagggccccgtcaggatgcccaccaaggtgctcaacatcaccaccaggaagtcgccgtgcggagaaggtaccaacacctgggatcggtttgagatgcgggtgcacaagcgggtgatcgacctcgtcagctccccggacgttgtcaagcagatcacctcgatcaccatcgagcctggtgttgaggttgaggtgaccatcagcgaccagtagagagctatgccttttttttacaagtgtggggagacaccagcgaaccaagacataattttgaacgtttggtagtatgtgaactgggttttgtatggcttattaggttcttcgccttgtgattcagagtagctcttgtcgtctgagatatcatcttgaattttcgttgccctttggtgtgttgcgctggactggatatttatacatggctcgctattgatgtgttggaaaaaaaaaaaaaaaagtcgacgcggccgcga

SEQ ID NO: 28664 - DNA, 1233 bp, Triticum aestivum
  Clone ID: PAT_TA_28664
gattattcagcggcgacggcaggcaggcaggcagaaaaggcgttgccgaacggaagcgtcgggttggggagagagagagagagggggagagggagcggcgggcgggcgagcgagcgagcgaagcatccatggcggagcacaaggaggagtcggtgatggacaagatcacggagaagttccacggggggtcctcctcctcgtcgtcgtcggacgacgaggggaagctcgggtcgtcgtcgtccgtcaaggccaagatctaccgcctcttcggccgcgagaagcccgtccactccgtcctcggcggcggcaagcctgccgacctcttcctgtggaggaacaagaagatctctggcggggtgctcgcgggcgccaccgccatctggctgctgtttgaggtcctggagtaccatctcctcaccctcctctgccacggcttcatcctcaccctgggcatcctcttcctctggtccaacgcctctgccttcgtcaacaagtgccctcccaacattccagaggtgaagatccccgaggacctggctgtcaatgttgcccgctcgctgcgatacgagatcaacaggggctttgctagcctgagggcgattggtcaaggccgtgacctgaagaaattcctgattgtggttgcaggcctgtggatcctctcttttcttggcagctgctgcaatttcctgaccttgttctacatagtcttcatggtgctttacaccgtgcctgttctgtacgagaagtatgaggacaagatcgatgcttttggagagaaggccatggtcgagctgaagaagtactatgccatcttcgatgagaagtgcctgtccaagattcccaagggtccgtccaaggataagaagcagcattagaacggtagagagtaccctgtgcagatttgtcttcaaagttgatcactactcgtcggttttcaaggatggttgtgattccatgtccgtagctgatagtagataccactatctggtcaaaaccctggcacggtcagtagtcgtgacgtgcaacttctacgaacttaaaagtcatgccagcttttgctcaatatcctgtttccaattctatgtttaacgtagcatcctcacttgcaagttggtgttggtgtaatatggcagtgatgtttgcgactttagtagacttgctacaatgaatgaagtggctcttttgggtgttatgtcattcctggggttcatatccacaatgaagtggctcttt

SEQ ID NO: 28665 - DNA, 883 bp, Triticum aestivum
  Clone ID: PAT_TA_28665
aattgtgaacccccctgttgatcgtatgacattcgttatcatttacaagtggtttagctcaagatttaggttacgtttgcagatgaattgctcgcttgttcatttgccctggagcatcttcgcgatttggtgaatttaagtacagtatatcttttctgttgtatgggaagagcggctatatttctaatcaattgtggatgtgttctaaatttaataggtatttatcaaggtggtgtctggaaggttagagtagaactgcctgatgcatatccttacaaatctccgtcaattgggttcattaataagatttatcacccaaatgtggatgaaatgtctggttccgtatgtttagatgttatcaaccagacatggagcccaatgtttgatctagtaaatgtgttcgaagtcttccttccacaacttctgttgtacccaaatccgtctgatccattaaatggagaggctgctgcacttatgatgcgagatcgccctgcttatgaacaaaaagtgaaagaattttgtgaaaaatatgcgaaaccagaggatgctggcataaccccagaagacaagtccagtgatgaagaggagcttagcgaagacgaagatgactccggcgatgaggatatagtgggcaaaccagatccttagtcactaccacaacccgttgtatacaatgttggttgcaaaatttgcaatcaaattgatccagaaaatctgggaaagagaactttgtatgtcatgtaaataagtgtacttgtatcttatccaatgttgttttcttcagttgaccaattgattttgcagcattgcatacattcgcgcctgtccgtctttgtagatctgtgatctgggtcatagaataaaacaaggggttagcttcaaa

SEQ ID NO: 28666 - DNA, 595 bp, Triticum aestivum
  unsure (1)..(595): unsure at all n locations
  Clone ID: PAT_TA_28666
gaattcactagtgattagcgtggtcgcggccgaggtggccggagggaagagagaaaagagaaagctagccgcctttgggccatggcggagttcaagcacctttgcatggccaagttcaaggaaggcgtcgtggtggacgacatcatccaggagctcaccaagctcgccgcggagctcgacaccgtcaaatacttcgggtggggcaaggacgtgctgaaccaggaggcgctcacgcagggcttcacccacgtcttcgtcatgaccttcgccagcgccgaggacctggcggcgtgcatgggcccatgagaagcactctgcgttccgccggccaccttcatggcccgcgctccgacaagtcgtcgtcatggacttcccctttggtcttcgtcaagccagcgccgcctgccttgatccgcctccagtatctctaacaaagcatggatgtgccaactatctatctatctgctgcagctctggtgttatggtaggagtacctgagctccttctcgctcatgttaactggtgaactgcctgcctgtaaactgtatgccggtgtccttgaaatgttggtaccaccttgataacttgtcnattt

SEQ ID NO: 28667 - DNA, 1067 bp, Triticum aestivum
  Clone ID: PAT_TA_28667
gcggccgcgtcgacctctcatcctcccacttccttttctcggccattctaagccaccatgccgggctccatcgccttcggtcgcttcgatgactccttcagcttggcctctttcagggcctacatcgccgagttcatctccaccctcatcttcgtcttcgccggcgtcggctctgtcatcgcctacaccaaggtgagcggcggcgcgccgcttgacccatccgggctgatcgccgtggcgatttgccacgggtttgggctgttcgtcgcggtcgccatcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttctgcaccggcgtggccacccctacacacgggctttccggcgtgggcgcctttgagggcgtcgtgatggagatcatcgtcaccttcgggctcgtctacaccgtgtacgccaccgccgccgaccccaagaagggatccctcggcaccatcgcccccatcgccatcggcttcattgtcggcgccaacatcctcgtggccggccccttttccggcgggtccatgaaccctgcacgctccttcggccccgccgttgccagcggcgacttcaccaacatttgggtttactgggccggcccgctcatcggcggtggcctcgccggcgtcgtttaccgatacctatacatgtgggacgaccacagccccgtcgccggcaacgactactaagccagccatgggaagagtcgttcggtccataatgccttcggcaacataaaaagtgcgtacgtggtgggcagtctcacgaatgtttcgatgatgtgaagaacatcctgttgtttggttcagatcgaagctgtagctggatgatgcatgttcctttatctgtaaaatgtgatgttgtgaagttggtggggtttgagaatttttcagttgagtttccttatgcgattcaataagaacaaaaaaaaaaaaaaaaaaaaaaaaaaaaa

SEQ ID NO: 28668 - DNA, 599 bp, Triticum aestivum
  Clone ID: PAT_TA_28668
ctcgaggtcggcctggccgggactaaacgacacacaggggtaccaccagcaacccattcgagcagccaagcgaagctcgccggagagggaagcgaagatgtccggccgcggcaagggagggaaggggctcggcaagggcggcgccaagcgccaccggaaggtgctccgcgacaacatccagggcatcaccaagccggccatccgccgtctggcgcgcaggggcggcgtgaagcgcatctcggggctcatctacgaggagacccgcggcgtgctcaagatcttcctcgagaacgtcatccgcgatgccgtcacctacaccgagcacgcccgccgcaagaccgtcaccgccatggacgtcgtctacgccctcaagcgccagggccgcaccctctacggattcggcggctaggccccgacggtccagtcgaatccacctcgcgccgccagtttcgtagctagccatcggttgttcagtgttcggtgtaatggaatggccgcatctcgctgctgtctgttgtttcgatgtagaatggaaatatctgcattttacccctgaattcgtctgcaatctccaaaaaaaaaaaaaaaaaaggccccta

SEQ ID NO: 28669 - DNA, 1267 bp, Triticum aestivum
  Clone ID: PAT_TA_28669
ttttttttttttttttttttttttttttttttctggcctgagacaaagatggccaagctagccactgcgccagactctggtcaacgtgcagtgtagagatagaaatgataccagacacagttatagtaagagacgataccgtacacgcagcaacaccaccaatccagctatcacatccaccatacatagaaccgattgcacagttttcttacgtttcctctctactagggatcaactcaactaaactaagcaacatcttcaccgtgccagcgataccagcctatacaattcttcaagtcggactcatcgcgataccaaattccgtccaccggatttgaagcccacagggcgatgcgcttagctgtcacccgccctaaacagggtcagcagggcccaggaacagattgatgacgtcaaggtagagcgagacggcggcccagacatactcgtcataggtgtaacgcttgatgatgttgtccgtgtcatagacaatgtagccactgaagatgagtgccgccagcgcgccatagatcatgtgagacagcttgcccatcgggaagaggatctgaatgaacccaaagacgagcaacatgatgagagaagcaaacaggaaaggaccaaggaagctgaagtcctggcccctctttgcggcccagaaagtgtaagcagtgaggctgaagacaaccactgttgtaagaatcgcggcctccagaatgaccttgccgctagtaaaggcacatgtcattcccacagcgaagctgatagccactgtgaagacgccaagcagcagcaggttgactgggtgcttctggcggtagaagtacaacgggcacagcacgatgaaggggaagatgatgaggaagatgtagagcccgaggccggcgctggaggagacgaagaagtgcgggatggcgcggaccttgacgacgacggcggcgacgacggcggtgaggaggagctgcagggagaggatgacgtagatcttccggatgagcgcccagcgcagctcggggctctccgtcatcccggggtacagcccccgcgtcggcgccgcggtgccggtgccgccggaggtccccgcctcgatgtcgacgcccttctggtaccccatcatctcgccccgcccggcggtgcggtgaccggggaagggaagcggcctccggaggtagggttttcgtgggtgtggcggaacgaaggcggaaggggagggagggaggggaggagcaaagcgaacgggaacttggggacgagaagaccggacgcgtgg

SEQ ID NO: 28670 - DNA, 599 bp, Triticum aestivum
  Clone ID: PAT_TA_28670
gcaacacacacacacagagaagccaatctcgccggagagggaagcgtcgacgatgtcgggccgtggcaagggagggaaggggctcggcaagggcggcgccaagcgccaccggaaggtgctccgggacaacatccagggcatcaccaagccggcgatccgccgtctggctcgcaggggcggcgtgaagcgcatctcggggctcatctacgaggagacccggggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggcggctaggccacgccggtccagcagaacccacctcgcgccgccagattcactagctagccatggttgttgagtgttcatgttcctcggtgtaatggaatggccgcatctcgccgctgtctgttgttttgatgtacttctagcatggaatggaaatctcagcattttatccctgaatgtgtctgcaaagaaaaaaacaaaaaactcgagggggggcccggtgcccaattcgtcctatagcgag

SEQ ID NO: 28671 - DNA, 862 bp, Triticum aestivum
  Clone ID: PAT_TA_28671
ccccaggtaggcgggactacccgctgagtttaagcatataaataagcggaggagaagaaacttacaaggattcccctagtaacggcgagcgaaccgggagcagcccagcttgagaatcgggcggctgtgccgtccgaattgtagtctggagaggcgtcctcagcgacggaccgggcccaagtcccctggaaaggggcgcctgggagggtgagagccccgtccggcccggaccctgtcgccccacgaggcgccgtcaacgagtcgggttgtttgggaatgcagcccaaatcgggcggtagactccgtccaaggctaaatacaggcgagagaccgatagcgaacaagtaccgcgagggaaagatgaaaaggactttgaaaagagagtcaaagagtgcttgaaattgccgggagggaagcggatgggggccggcgatgcgccccggccgtatgcggaacggctcttgctggtccgccgccttcctttccttggcctttcccgccattgccattcttccctccaactgcaagcccttcggtgccatctcctccaccttcaaggcattaccgcaaagatccgagcacctggtcctcttccaaaacccaaccataaataaagaaataatagtaatgagtacataatagcaatttgttatgctcgtgttggggacggatggataatgggtgtactaggcagatgaactccttttctgtttgattcacagtgagtccgtgcctatgtcagattgtaaaaagaagaagacttaatttcctctttttgagatgaaaagactctctttagagagaaaatgcagttttattgcggcttaataatacagaattaccatttcccaaaaaaaaaaaa

SEQ ID NO: 28672 - DNA, 955 bp, Triticum aestivum
  unsure (1)..(955): unsure at all n locations
  Clone ID: PAT_TA_28672
agccgggacgaagcagatcggcggcgcgtcactccaatcaccggtgagaagaagcctttccctcctttccacggcctccgcccctacgaggccactctatcaactcccaattgttcaatttgctcccacagtcccgacccattcgggatttgaggcgctagagatttaggtttacgggtgaaatctctagtgttcctaggttaggataaatggcgacggtttcggattctctggtctgggagcttgtcaggaagaacaactgcttcctgatcaagcagttcggcaacagcaatgccaaggtccagttcagcaaggagcccaacaacctctacaatgtccactcctacaagtactctggcctggcaaacaagaagactgtgacggtgcagccagctgctgagaaggagatgactgtggtcctctccacaaccaagtcaaagaagcagaacaagcctgctgcgttcacccacaagactgtcatgcgcaaggagttccgcaagatggccaaggctgtcaagaaccaggtcagtgacaactactgcaggcctgacttgaccaagcctgctcttgcaagactgagcgcagtttaccgcagcctccaggttgccaagtccggtgtcaagaagaagaacaggcagtaagcactgaggggccaatgagcttgttttgtggatccgttggtttatgtttccagctttttagatttgttctaagagtatggaggttgaatatgatgaatggtgtgctctgcatactggcccaagttttctcagtaggttctatatctgtacccatgactatgttgtgaagcctcttgaaatcatttccacaattattggccttccacatttattgtttttgctgagttgcttggagttgggactgctggtgatgcgtgtttttcntgttatgcatgtgctcgtttaagtgctaacttaacgtcgacgcggccgcg

SEQ ID NO: 28673 - DNA, 1450 bp, Triticum aestivum
  Clone ID: PAT_TA_28673
cgcgtccggcctgtgactgagtgggagggaaagaagagggagatcaggagatggggaagggagggaaaggcgaggcggcggcggccgtggccggcgagggggagaacatggcggcgtggctcgtggccaagaacaccctcaagatcatgcccttcaagcttccgccgctcggtccttatgatgtgcgagtccggatgaaggcggtgggcatctgcggcagcgacgtgcattacctcaaggagatgcgcattgcgcatttcgtggtgaaagagccgatggtgatcgggcacgagtgcgctggcatcatcgaggaggtgggcgacggcgtgaagcacctcgccgtgggagaccgcgtggcgctggagcccggcatcagctgctggcgctgcaggcactgcaagggcggccgctacaacctctgcgacgacatgaagttcttcgccaccccaccttaccatggatcacttgctgaccagattgtgcatccaggtgacctgtgcttcaagcttccagacaacgtgagcctggaggaaggcgccatgtgcgagcccctgagcgtgggggtgcacgcttgccgccgagccgacgtgggcgccgagaagagcgtgctcatcatgggagccgggcccgatcggcctggtcaccatgctctccgcgcgcgcctttggagcgcccaggatcgtcatcgccgacgtcgacgaccaccgcctctccgtcgccaagtccctccggcgcggacgccgtcgtgaaggtctccggcaacacggaggacctcgcgggggagatcgagcgcatccaggcggcgatgggaggcgacatcgacgtgagcctggactgcgccgggttcagcaagacgatgtcgacggcgctggaggcgacgcggcccgggcgggagggtgtgcctggtggggatggggcacaacgagatgacggtgccgctgacgtcggcggcgatccgggaggtggacgtggtggggatcttcccgttacaaggacacgtggccgctgtgcctcgagttcctgcggagcggcaagatcgacgtgaagccgctcatcacgcacaggttcggcttctcgcagggggaggtggaggaggccttcgaggtcagcgcgcgcggccgcgacgccatcaaggtcatgttcaacctctagacctcgagaccgctactgttgctagggattcaagccgtgcttgaactggagctgcgagcgtgtccgcgtgcgcgcggtgtgttgtgtgtcgtgaaataaaataaaatggctgtgcagactgatttctatcatgaaactgggatgtcaggaatcgttcgagcgcactcgccgataacaagccgttctctcgcactttcgaccactctgtactataatcaagcacatcaccgcattgcacaatcgtatgcacaataacacaaagaacatcatattttatactcctataacaaaaaaaaaa

SEQ ID NO: 28674 - DNA, 1525 bp, Triticum aestivum
  Clone ID: PAT_TA_28674
cgtccgcactgctccaggtgcttcgctccaccagctgacgacatggcctcgccggcgaccggcgattccgatcaggtactggtggaagcaaatggctctacacggacattggttttgaataggccaaagcagttaaatgctctctcctctgcaatggttacaggacttctgaaatgtttcacttcttatgaggaagaaaacacagttaaactgttgattgtcaaggggaaaggaagagcattttgtgctggaggtgatgttgctgaagtcgcccaatctataaataatgatacctggaaatatggtgctgattttttccatactgaatttttgttaaactatatcattgcaacttatagcaaaccacaggtttctctacttactggaattgtcatgggtggaggtgctggtgtttctatacatggaaggtttcgggttgccacagggaacacggtttttgcaatgccagaaacagcactgggactctttccagatataggggcttcttattttctttctagactacctgggttctatggagagtatgttggccttactggtgcaagattggatggtgcagaaatgcttgcatgtggcctggcaactcattttgtccctttgaacaggatgccactgcttgaagaatcacttaaaaaggtggatacttctgatccatttgctatatgtggaattattgatcaattttcacaacagccatctgtgaaaggaagtagtgctatgaataggatggaaatcatcaacagatgcttctccaaaagaacagtcgaagaaatcatatccgctcttgaacaagaagctccaagtgtggccgataaattggttactgctgcaatccagtcattgcggaaggcttctcctactagtctgaaaatctctctcgcatcgataagagaagggagactgcaaactgttggtgagtgcttgcgccgagaatatagaatggtttgccatgtgatgcgcggtgacttcagcagagatttctttgagggatgcagggcgatacttgtagataaagatcgaaacccaaagtggatgccgccaactctggatcaagtgcatgatggggtagttgcaaaatatttctccaaggtcgacgatccacagtgggaagatttgaacctaccaactaggtcttcccatggaagaagaattgttcccaagctctgatggaagtctcatgcggaggattcagatgaagccttgacgggtgctcgtgagtaaaacatatgtcttgaatgaatccatagacataactgatggaataaatcggaagtacatcttgtagatagattaactgttattaccacacaaatttctttgtcagttgctactagtataatactggaaggaagttgtaagtgttagtgatataatcctggctgcggttgctctccaaagctggagcttatgttacaggctaccggcttccacggtgcaatggcagcatatttgtacggcccgctggtcccctgatggcggcccatggcggcgtacacacgtacag

SEQ ID NO: 28675 - DNA, 1211 bp, Triticum aestivum
  Clone ID: PAT_TA_28675
gcacgaggggggattccagcggcgacggcaggcattcaggcagaaaaggcgttgccgaacagaagcgtcgcgttggggagagagagagagagaggggagagggagcggcgagcgagcgagcgaagcatccatggcggagcacaaggaggagtcggtgatggacaagatcacggagaagttccacgggtcctcgtcgtcgtcgtcgtcgtccgacgacgacgagaggaagtcgggatcgtcgtcgtccgtcaaggccaagatctaccgcctcttcggccgcgagaagcccgtccactccgtcctcggcggcggcaagcctgccgacctcttcctgtggaggaacaagaagatctccggtggggtgctcgcgggcgccaccgccatctggctgctgtttgaggtcctggagtaccatctcctcaccctcctctgccacggcttcatcctcaccctgggcatcctcttcctctggtccaacgcctctgccttcgtcaacaagtgccctcccaacattccagaggtgaagatccctgaggacctggctgtcaatgttgcccgctcgctgcgatacgagatcaacaggggctttgctagcctgagggcgattggtcaaggccgtgacctgaagaaattcctgattgtggttgcaggcctgtggatcctctctttccttggcagctgctgcaatttcctgaccttgttctacaatagtcttcatggtgctttacaccgtgcctgttctgtacgagaagtatgaggacaagatcgatgcttttggagagaaggccatggtcgagctgaagaagtactacgccatcttcgatgagaagtgcctgtccaagattcccaagggtccgtccaaggataagaagcagcattagaacggtagagagtaccctgcgcagatttactttcaaagttgatcactactcgtcggttttcaaggatggttgtgattccatgtccgtagctgatagtagataccactatctggtcaaaaccctggcacggtcagtagtcatgacgtgcaacttctacgaacttaaaagtcatgccagcttttgctcaatatcctgtttccaattctatgttcaacgtagcatcctcacttgcaagtcgtgttggtgtaatatggcagtgatgtttgcgactttagtagacttgctataatgaatgaaagtggctcttttggtgttaaaaaaaaaaaaaaa

SEQ ID NO: 28676 - DNA, 1847 bp, Triticum aestivum
  Clone ID: PAT_TA_28676
ctcgaaacaaccctcactaaagggaacaaaagctggagctccaccgcggtggcggccgctctagaactagtggatcccccgggctgcaggaattcggcaccagaggagccgagagagagatcacagggacaagtccatcccgcgatccgccaatggcgtcctccgagctcacctaccgcggccagcaggcggcggcggccgacggcgcgcacggcccggccgagagcaagccgcggaccaggcagcagctgccgcagcctctccggtacgtgctgggcgagcaacgcctcgtcttctccttggtcggcatggccctcgccaccctcgtcttcctcctcctctccccctccaccaccaccaccacctcctcaagcagcagcgtggcgcacctggcggcggtggggctggtgtcgcggcagtaccagtcgggcggcgcggggcggatggcgttcgaggagtccggcaccggcggggtgcgccacggccgcgtgccgctggggctgaagcgcaagggcctgcgggtggtggtgaccggcggggccgggttcgtgggcagccacctggtggaccggctgctggcgcgcggggacagcgtgatcgtggtcgacaacttcttcacggggcgcaaggagaacgtggcgcaccacgccgggaaccccaacttcgagatgatccggcacgacgtcgtcgagccgatcctgctggaggtggaccagatctaccacctcgcctgcccggcctcccccgtgcactacaagttcaaccccgtcaagaccatcaagaccaacgtggtgggcacgctcaacatgctcggcctcgccaagcgcgtcggcgcgcgcttcctcctcaccagcaccagcgaggtctacggcgaccccctccagcacccccaggtcgagacctactggggcaacgtcaaccccatcggcgtgcggagttgctacgacgagggcaagaggacggcggagacgctgaccatggactaccaccgcggcgccaacctcgaggtgaggatcgctcggatcttcaacacctacgggccgcgcatgtgcatcgacgatggccgggtcgtcagcaacttcgtcgctcaggcgctgaggaaggagcccctgacggtgtacggcgacggcaagcagacgaggagcttccagtacgtctccgatctggtggagggtctgatgaagctgatggagggggagcacgtggggcccttcaacctggggaacccgggggagttcaccatgctggagctggccaaggtggtgcaggacaccatcgaccccaacgcgcgcatcgagttccgggcaaacaccgccgacgacccgcacaagcgcaagcccgacatcaccaaggccaaggagctgctcgggtgggagcccaaggtggcgctcaggaacggcctccccctcatggtccaggacttccgcacccgcatcttcggcgaccagaagcagcagcagcaacaaccagacggctccgagtagtgatcacccgtcgtcgtccatcgacgcaccgccccgccgcagggcggtgccgtttcatcatcttgttatgtaggatggatttgttgagggaggaagaagaaacatgtgacagtaacagcaaggatacctggaaatgaatgaatgaaagcggggaatatacaccatcatatcgactgtgtagctttttagcgccatgtatcatgggtgaagtagctagatgggtgcgccaagagcaggccgcgatcttaactatgaccgtgaccgaaatttgttcgatcgcattcttctaattttacgtcataatatttgaaaatttcgatgttgatttaaaaaaaaaaaaaaaaaactcgagactagttctcc

SEQ ID NO: 28677 - DNA, 650 bp, Triticum aestivum
  Clone ID: PAT_TA_28677
aattcggcacgaggcaccggccggagggaagggagaaaagagaaagctagctgcctttgtctttgggccatggcggagttcaagcacctttgcatggccaagttcaaggaaggcgtcgtggtggaggacatcatccaggagctcaccaagctcgccgcggagctcgacaccgtcaaatactttgggtggggcaaggacgtgctgaaccaggaggcgctcacgcagggcttcacccacgtcttcgtcatgaccttcgccagcgccgaggacctgggcggcgtgcatgggcccacgagaagcacactgccttcgcagccaccttcatggcggcgctcgacaaggtcgtcgtcatgggacttccccttagtcttcgttaagccggcgccgccgcttgcctgacccgcctccactatctctaccaacaactatcaccaagcatgggagtacctgagcctcctttctctgcttgtcctgctgcttcagtgtttagcttgtgcagctgcctgtaagactgtaacgccgcgtgttcccctgaaaagttgtttgggtgatccacccttgaataaacttgtgcgattttcgtttgttaaaaaaaaaaaaactcgagactagacctgcccgggcggccgctcgaaatcactagtgaattc

SEQ ID NO: 28678 - DNA, 1403 bp, Triticum aestivum
  unsure (1)..(1403): unsure at all n locations
  Clone ID: PAT_TA_28678
agggtcttgagggggtacctatatgtaacacagctatccttcatacaggatttggctattgttcaaacatgagacctcttgtctggcctcagacaaagatggccaagctagccaccgcgccactttggtcaaagtgcagtgtagagatagaaatgatatcagaaacagttatagtaagaaacgataccgtacacacagcaacaccaccaatccagcatcacacccaccatccatagaaccgattgcacagttttcttatctttcctctctactagcaagtagcaactcaactaaactaagcaacatcttcaccgtgccagcgataccagcctatacaattcttcaagtcaaggactcatcaggataccaaattcgtccacgggatttgaagccacagggcgatgcgcttagctgtcacccgccctaaacagggtcagcagggccaggaacagattgatgacgtcaaggtagagcgagacggcggcccagacatactcgtcatacgtgtaacgcttgatgatgttgtccgtgtcatagacaatgtagccactgaagatgagtgccgccagcgcgccatagatcatgtgagagagcttgcccatcgggaagaggatctgaatgaacccaaagacgagcaacatgatcagagaagcaaataggaaaggaccaaggaagctgaagtcctggcccctctttgcggcccagaaggtgtaagcagtgaggctgaagacaaccactgttgtaagaatcgcagcctccagaatgaccttgccgctagtaaaggcacatgtcatgcccacagcgaagctgatggccactgtgaagacgccaagcagcagcaggttgaccgggtgcttctggcggtagaagtacaatgggcacagcacgatgaaggggaagatgatgaggaagatgtagagcccgaggccggcgctggaggagacgaagaagtgcgggatggcccggaccttgacgacgacggcggcgacgacggcggtgaggaggagctgcagggagaggatgacgtagatcttccggatgagcgcccagcgcagctcggggctctccgtcatcccggggtacagcccccgggtcggcgccgcggcgccgccggaggtccccgcctcgatgtcgacgcccttctggtaccccatcatctcgcccggcggtgcggtgaccggggaagcggcctccggaggtagggttttcgctggcgtggcggaaggcggaaggcgagaggggaggggaggagcaaagctggtgccgaattcctgcagcccgggggatccactagttctagagcggccgccaccgcggtggagctccagcttttgttccctttagtgagggttantttcgagcangggtatnaaannnttnaaaagggttttaaattttttttt

SEQ ID NO: 28679 - DNA, 1431 bp, Triticum aestivum
  Clone ID: PAT_TA_28679
cacgcgtccgagctgcctttgcctattgctagcacagcacgcacgagctagagtgagagccatagcagtttcggccatggcgaggagcattgctctggtctgcttcctcgtcgtcggtctctgcctcgtcggcgccgtgtgcgcctcggcggcggcggtcggcggtaacggggcgcggctggtgaacgcggtgtacgtgttcggcgactcgctggtggacgtgggcaacaacgactacctgccggcgccggcgcccagagcgaaccggccctacggcatggacctccccggcaggcccaccggccgcttcaccaacggctacaacctcgccgacgtcatctcacaacgtatggggtttgagatgagccccaagccctacctctccatgctgccgcacgacaagattctgctggggcctctgcaagatcggcgccaactacgcctccggtggatccggcatcctcgacactacgggaaaagggacgctcacgatgcggacacaagtagagtacttcaagaaggcggcggacaacatgatttgttacccaagcaaggaggagcacctggcacggtccctcttcctcctcagcggcggcggcaacgacttctcggccttcgacccctccaccgccagcccccaggcctacgtcgtcaagatggtcaccacctacatcgagcacatccaggcgctctacgacatgggagcacggatggtggggatcctcgacgtgccgccaatcgggtgcacgccggggcagaggatcgacatgcccaacggcgagtgcaacgagcaggccaactccctggcgcaagcattcaacggcctactcaggtccagtttcgcgaaggccgccgctgccaacatgaaggaactcaagtattccatcgccgccaactacaacatcctcaaagacatgatggccaactctttcgtagctgggctgaggcaggtaaagacggcgtgctgcggttcggggaagctcaacgcggaggtgatgtgcagccaccagggcacgacggcgtgccccgccgctgagcacgacgactacatgttctgggacatgctccaccccactcacgccactatccagcgcggtgtcgtcgccctcttctacggcaacggccccaagtacggcgagcccgtcaacttcggcacgctcgtcacgggccagaacgtatctcccgcgatcaagatggtcgtcgacgagcagtagacggcgacattcgtcggcatgcttgcccaattcgaaataatgatgatctaaaatttgcagcagctgctagctagctgagctagcacttactaatagaatgattttcccgttaattattccatgcgtacgtgctggtagctccatcttgtgttgtgttctgtccttggattattagtatgtggaactaataaagtggttaagtaaataaatattgtcc

SEQ ID NO: 28680 - DNA, 545 bp, Triticum aestivum
  Clone ID: PAT_TA_28680
gccggccgggctgcgatcagcaccgcagcagccacctcccaaagacaagtcaacctcaccgaggagaagcagagagaagggagaagatgtcggggcgcggtaagggaggaaaggggctcggcaagggcggggccaagcgccaccggaaggtgctccgggacaacatccagggcatcaccaagccggcgatccgtcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcgctcaagcgccagggccgcaccctctacggcttcggcggctaggccaccgccagattagctagcctgtgtctagggttcgttgtccatgatgtaattgcagcatctcgctgttgtttgctatcttctgtagaatcgaatggaatggaaattgaactagtttaccaaaaaaaaaaaaaaaaaaggccccta

SEQ ID NO: 28681 - DNA, 2967 bp, Triticum aestivum
  Clone ID: PAT_TA_28681
ggtcgacccacgcgtccgcacatttgtgcctaactacctgggtggtaagggtgctgagcaaagaataatcttttcagaacagatcagtggtgcagtggaccaatctatggaccaagccaaaggtgcaagcatgtactccgaggaggcacttaggcacagtgaaggtgtgtggaaccacttatccacaaactcaaggagcaaattacctgcagaagtagaacaaaagcttacttcagcagctgctgctgcttctgcagcagtttctgttgcgaaggctgctgcagaagctgctaaaatggcgtcgctggctgcattgcaggcaaaaatgatggcagaagaagcccttggctctacgaaatctgctaattccttgcagaggcgtgacactggcgaagttgatgtaaataatatggcaagtgtgtcaagtttgacgcccaaatcatcatggaaaataaaggacagcactaatgccccaggttccaccatttcggtggcacgggaggttgctagaaaaagggttgaagaggcatctgcagctgcaaaacgtgcagaaaacttagatgctatacttaaagctgcagagcttgctgcagaggctgtgttcaaagcaggaacaatcatagggatgggtgagcctctgccttttactctaagtgagctgttggaggctggtcccgatggctactggaagtctgatagagtgaagaatacgaaggctggtaacaccagtgagaatgcggtaacagaagaattggagatacctactaataaatctggcaaaaagcatgatagcaaagctaaatatgatcaagcaatacagaacttggagccatcttccagtgtcaaaagtttgcagccagataagatgccctcagggaatgggattgaagataatcccactgctggcccactcaatggcaacacaactgatacagcaccaagcataatttggaatggcattggaaaaggatctcttgttgaggtttttgctgctgagggtggttctagagcagcttggttttctgcgaaggtccttgatataaatgaagatagtgcatgcatccactatgaagcccacggtgaaggtactggtctttccaaggaatgggtgtcactgaagcaggagggggagaaggcacctcacatacgtcttgcccatcctgctactatatctaatttgaaaggtactagaaagcgccgtagggacacagcaggaaattattcttgggctattggtgatcacgtggatgcatggataaaaaatagttggcgggagggagtcatttctcagaatggtgaatttggtgacacaaagttcgttgtgcaattttcagctggtgattccttagtccttgatgcttggaatcttcgtccatcacttgtttggcaggatggtgaatggacagagtggtcccgtgcacgagagaggaaagataaatcaaataagggtgattctccatatgagaaacgccagcggacagcagtgaacgatcctgtgcctactgttgaagaagcacgtcccccttctaaagacaagaagagcactaacactgtagtgagcgaccctgtgcctactgttggagaagcacgtccccctaccaaagacaagaagagcactaacactgtagtgagcgaccctgtgcccactgctggagaagcacgtccccctaccaaagacaagaagagcactaacactgtagtaaaaccagatgagccaaagccactggctttatctgatagggacgtgctttttaacattggaaaaggtgcaactgagattaaaaccaccaggcgacctgggactgcagaaggaaggaacaaaggtcttcggtgttccaaaacctggaaagaagaagaagttcatggatgtaagcaaacattatgttggcgatcaatctgatagaatttctgagggtagtgcatccaccagatatgcaaaacatccagtgccacaggtgccaagaccacgggaaagtaccctaaaactcgaccagagagccaagagggcaagtgacatgcgatccagaggacttaaatctgccaagcctcagacaacatcaactaacggtgttcctggcgaggatcctttatccactcctgtcccaagctctagtgctcttgaaagtacttttgcttttgcggcaagtacgacaagctcttccaaccctgtgaacccaactgtagaaaagaataatttggctcatgccactgatcttagaactgaagatgcttctattctggaatcacgtttacaagccacaccaaccgttcctgctgtcaagaagaatccgattgctgctaatcgagctaaaaggaaatttgttccttctgcggatagtaacgtgaacaggagggtgctgaaaactcctgacgtttcagccaagaccagctcagattctgctgaaccccgaaggtcaaaccgccggattcaaccaacctcacggttgctcgagggcctgcagagttctcttatagcctccaaaattactggcgaaaaactccctaggactaatttcaaggagtgctacttctgcctcaagaggaaaagcccatggctaattcaaggcaatcgagacaaccatggcgtgtttgtacatatcggtagcttgccgagtatggaagcgaaaggggataggatttgagtgaaggcttttggagctggtgtgtgtggatgtactataaaactagcttaagttagtgtcttttctctctattgcactggacagtattattgtgtcgtaggattagccattaatcacccccaaaccctccgtttaatctgtatggatacagtaccaaggagaagaaggacggcgtctggcttaattttactcatcaacggttgtactttaccttctctcgagtaccagccccatgttggaatgattgactggtgctttttggttccagtgaatgctttgaccttgatgtggcaactggcaaccatgtttcttttgatgtgtgtca

SEQ ID NO: 28682 - DNA, 1183 bp, Triticum aestivum
  Clone ID: PAT_TA_28682
cgtccgctcagccaagagagccagtagcagggagtgtagtgagagtagagtgagcgagaatgggtggcaaagccgctctcctggtggccctcctggccgtgagcctggtcctcgaggcccaggcgggcagcggctacggcggcgggcacgcccccaccccgacgccggtcgccccaccccccaagcacgagaagccacccaaggggcacaagccccctcaccaccaccaccacgccaaaccaccggccgcctcccacgggccgccgacgcacgctccggcgccacccacctacagtcccccgacgcctaaacctacccctccggcccctaaacccacaccacccacctacgccccgatcccgaagccgccgaagccatctccctcgcctccggcgtaccaccctacccccaagcctgcacctcccacgtacaaaccaccaacccaacctaagccctcaccgccgggcgtaccaccctacgcccaagcctgcacctcccacgcacaaatcaccaacccagcctaagccctcaccgccggcgtacaagcccgcccccaaggtctcaccgccggcgtaccaccctacgcccaagcctgcacctcccacgcacaaaccaccaacccagcctaagccctcaccgccggcgtacaagcccgcccccaaggtctcaccgccggcttacaagccagcccccaaggtctcaccgccggcgtacaagcccgcccccaaggtctcaccgccggcgtacaagcctgtccccaagccctcaccgccggcgccgaagccgactccaccgccatacaagcccccgacgcctactcctccggcgtacaagccccccaccccgagccccccgcctccgccgtaccaccactaagaagatccaccactctgtcaagctgggagcccagaatgcggtcgagaagagttgtgcgagcaggccaagaagagccacgtacggcgtcgttgatcctcctccggtgtgtgttgctgccgaactagggccgatctctcaggagatggaataatgcagatggctcccattagtttatcttaccagcttatcatttgtgttcgtccagtgttagcgtctgtgttgctagtgtggcaatgtgcccgtgtcactgtaaaaccattgatcaccacggaaatggaagtaaaaggtgttgtttccaaaaaaaaaa

SEQ ID NO: 28683 - DNA, 887 bp, Triticum aestivum
  Clone ID: PAT_TA_28683
tcggctatttagaagtccagccattagccactcaccaagctgattatatagatagcaccggtcgcctatcccctcgcctcatcttatccccctccgtccccgcttcctcctcctcttcctcccgctcactcccgaagcgaagcctcgagagctcccaatggcttccaccacgttctcctccgccttctccatcctctctctcccctcttcctcaccatccccctccgcctcggcccccaggaccctccccgtcgccaaccgccgccgccgcgccgtcgccgtcgcctccaccgtcactgagtccccgaaggtccttgagctcggcgacgccattgccgggctcacccttgaggaggctcgcaaccttgtcgaccatctccaagaacgtcttggcgtctctgccgcctccttcgctccccgctgccgccggtcgcggctcccgccggcggcggcggccgaggaggcaccggtcgagaagacggagttcgacgtggtcatcgaggaggtgcccagcagcgcgcgtatcgcaaccatcaaggttgtgcgcgcactgaacaaacctggcgctgaaggaggccaaggatcttatcgaggggctcccaaagaagctcaaggaggcagtgagcaaggacgaggccgaggaggccaagaagcagctcgagggagtcggcgccaaggtgtccatagcgtgagactaggtatactaggctccttttttctcccattacattttatgtttcatatcaaccttttgtattcctcttgtaattgccgtggactgttgtttcatatgagattagtgcgcgtgtggaattattagttcatgttcgtgtgttgtattcagtcttgtataattactggatgttgcattctttaaaaaaaaaaaa

SEQ ID NO: 28684 - DNA, 1206 bp, Triticum aestivum
  Clone ID: PAT_TA_28684
attcaacactagctagctacacaggacaggagccgatccatccttccagaaaaaaaagagcgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcggcgcgacgacgccggcggggctgatcgcggcggcgctggcgcacgcgttcgcgctcttcgtggccgtctccgtgggcgccaacatctcgggcgggcacgtgaacccggccgtcacattcggcgccttcgtgggcggcaacatcagcctcctcaaggcggtggtgtactgggtggcgcagctggctcggctccgtcgtggcctgcctcctcctcaagatcgccaccggcggcgaggccgtgggcgccttctcgctctccgccggcgtcggcgtctggaacgccgtggtcttcgagatcgtcatgaccttcggcctcgtctacaccgtctacgccaccgccgtcgaccccaagcgcggcgacctcggggtcatcgcgcccatcgccatcggcttcatcgtcggcgccaacatcctcgccggcggcgccttcgacggcgcctccatgaaccccgccgtctccttcggccccgccgtggtcagcggcgtctgggagaaccactgggttctactggctcggcccctttgccggcgccgccatcgccgccctccgtctacgacatctgcttcatcgggccagcgcccacacgagcagctccccaccgccgactactggaaaatatcaatccgaatcccatccatcagtcatcgccatgagagactgaaattgcttcaagaatcaagcaggtgttatcgtgtcatcaagcaagcccgtttagtttcatcgtctctctctcttgtctttgagaaattcagggtaaacagtgagtcagtcagtcagtcaggaataatctcttgtcttggtgtacgtacgtcctcaattatgaatgcttctattccatggtcaagattgatgtttgtacaaatgtattgtctctcctagcaacttgatgtcttgccaatctcgtgtccattttttctgtacatactctggattttgtcctgtccatattttctaaaaaaaaaaaaaaaaaagtcgagagtagt

SEQ ID NO: 28685 - DNA, 587 bp, Triticum aestivum
  Clone ID: PAT_TA_28685
tcgcaccgccgccacaaccacgggggagcaacacacacacagcagcccagccaatctcgccggagaaagaagagtcgacgatgtcgggccgcggcaagggagggaaggggctgggcaagggaggcgccaagcgccaccggaaggtgctgcgcgacaacatccagggcatcaccaagccggccatccgccgtctggctcgccggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggattcggcggctaggtcacgccggtcctgtcgaatccacctcgcgccgccagattcgtagctagctagccatggtttgttcagtgttcatggtcttcggtgtaatggaatggccgcatctcgctgctgtctgttgtttcggtgtatcgctagcgtggaatggaaatctcagcattttatccctaaaaaaaaaaaaaaaaaaggccccta

SEQ ID NO: 28686 - DNA, 759 bp, Triticum aestivum
  Clone ID: PAT_TA_28686
ctgtgcggcgctcgaggcggcctggatcggaagccgtcctctctctctctctctttcccattttggtacctcctctcacatacggccggcgcatcctagcttaggtctccctcctctcgcaacaacaagacgagagatcaaagctcctcttcccccaaaaaagtaagatagtgaaccttcctagcgggcgggcgggcgggcgggcatgtcatgtgcctggcctgcttccaacttcaaagagctctctctttagaccagccgccagctggtgatgctagccgaggccggcaacaacgacgacatacttccatcggacgagctgagccttgaggttctcgctctcatggaggacatcatcaggtccaagatgtgccgtgcagcatgcatcgcttgtttggtgcagatcgggaagacctgccctctcaacatgatgatgttcgctccctgcgtcctcgggaaggtcatggcgaatgggtgcttcagcaaggagtgaagccatgagtgcggtgcgggtgtgtatgatctgatgcatgtcttgtccatttccttgtatgtggtccgatccggtccaggctgctcttttctcttgtgtgtgctgtgctttcgaggacctgtgtgttttagttgctactctcttatctccacttaattaataccattcatgattgtgccgttttcttctagtaactgtgtatgagattcattctcgtccgcatgtatggagcaataaaaaaaaaaaaaaaaaaaaaaaaaaaaaaa

SEQ ID NO: 28687 - DNA, 1451 bp, Triticum aestivum
  Clone ID: PAT_TA_28687
gcacgagggctttgcctattgctaccacatcacgcacgaactagctagagtgagagccatagcagtttcggccatggcgaggagcattgctctggtctgcttcctcgtcgtcggtctctgcctcgtcggcgccgtgtgcgcctcgacggtggtggctggcggcaagaacggagggcggctggtgaacgcggtgtacgtgttcggcgactcgctggtggacgtgggcaacaacgactacctgccggcgccggcgcccagggcgaaccggccctacggcatgggacctccccggcaagcccaccggccgcttcaccaatggctacaaccttgccgacgtcatctcacaacgtgtggggttcgagatgagccccaagccatacctctccatgctgccgcacgacaagattttactcggcctctgcaagattggcgccaactacgcttccggtggatccggcatcctcgacaccacgggaaaagggacgctcacgatgcgcacacaagtcgagtacttcaagaaggcggcggacaacatgatttgctacccaagcaaggaggagcacctggcgcggtccctcttcctcctcagcggtggcggaaacgacttctcggccttcgacccctccacggccagcccccaggcctatgtcgtcaagatggtcaccacctacatcgagcacatccaggcgctctacaacatgggagcgcgaatggtggggatcctcgatgtgccgccgatcgggtgcacgccggggcagagggtcagcatgcccaacggcgagtgcaacgagcaggccaactccctggcgcaagcattcaatggcctcctaagggctaagctcgccgaggcttccgcgactaccatgaaggagctcaagtactccatcgccgccaactacaacatcctcaacgacatgatggacaactcgctcgtagccgggctgaggcacgtgaagacggcgtgctgcgggtccgggaagctcaacgcggaggtaatgtgcagccaccagggcacgacggcgtgccccgccgcggagcacgatgactacatgttctgggacatgctccaccccactcacgccaccatccagcgcggtgtcgtcgccctcttctacggcaacggccccaagtacggcgagcccgtcaacttcggcacgctggtcacgggccagaacgtatctcccgcgatcaagatggtggtcgacagccagtaaacggcgacgttcgtcgtcggcatgcttgcctaattcgaaataatgatgatttaaaatttgcagcagctgctaactagctagctaggagctagcactcaataagaggatgattttcccgttaattattccatgcgtacgtgctgctagctccatcttgtgttgagttttgcgcttcaattattagtatgtggaactaataaagtggttaagtaaataaatcttgtcctaaaaaaaaaa

SEQ ID NO: 28688 - DNA, 597 bp, Triticum aestivum
  Clone ID: PAT_TA_28688
gcacgagggccgcaacaaccaccagcagcaacacacacacagcagcgaagatgtccggccgcggcaagggagggaaggggctgggcaagggcggcgccaagcgccaccggaaggtgctccgcgacaacatccagggcatcaccaagccggccatccggcggctggcgcgacggggcggcgtgaagcgcatctcggggctcatctacgaggagacccggggcgtgctcaagatcttcctggagaacgtcatccgcgacgccgtcacctacaccgagcacgcccgccgcaagaccgtcaccgccatggacgtcgtctacgcgctcaagcgccagggccgcactctctacggattcggcggctgacctgcgccctctgctccaatctccatcgactctgactctgctagctgctgctgctgttctggtgctgtggtttcgtttctgaattcagagtgcgtgcgttgttgttccgtcggtctgtgtagttagtggatggcgatggatctgaatgcagttagttcgtcagagtgcgtgtgttgtctgtggaaggagataaatatgaatgcaatgggattgttggtttcttctaaaaaaaaaa

SEQ ID NO: 28689 - DNA, 623 bp, Triticum aestivum
  Clone ID: PAT_TA_28689
gcacaaagacaggtcgacctcaccgaggagaagaaaggagaagcgagaaagatgtcggggcgcggcaagggaggcaaggggctcggcaagggcggcgccaagcgccaccggaaggtcctccgcgacaacatccagggcatcaccaagccggcgatccgtcgtctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccaccatcaccgccagattagagtgtctagggttcgtggtcgttgatgtaatcgcagtatctcgctgctgtttgctatcttctgtagaatggaattgaatggaaatcgaactagtttatcgttgaaatctgttagcgtctgtcagttccccaatctctgtctctcaaattttctgtctcaaatcggttgttggttttggtgcgcaaagggggggcccggtacccaattcgccctaaaagtgagtcgtattacgccgcgc

SEQ ID NO: 28690 - DNA, 690 bp, Triticum aestivum
  unsure (1)..(690): unsure at all n locations
  Clone ID: PAT_TA_28690
cgctcgagccctggggccttttngttntntttttttcttttttttttttttttttttttttttttttttttttttattcttactattattaatttattattgggatctctgaggggaacatgccatggcagattacattctacgacgatgatgatagtcactatatagctcagcatacaggcacgtacgcgcgcactttatttagttattctgccaatgatctcagtcttcttcaccggccttcctctcgcgcgatccccatgatcgaagctcctcacgcgtgcgcgggtggtggcactggtgctacggtgtaagttccgcatttgctcccgacggtgagtttgattttgcagtcgtgggcgaggtggacgagcttcacggggctgacggtacgctcgtcggaggcggtgaggacgcggcagatgcagggcatgtcgaccttcttcacctcgttgcggcaggcctggcttgggggcatgtagaagccctccttcttgatgctcttgatgcagatgctcatgatcctgtccctctcgtcgtagcagtccttctcccccgcggcgagatgcgccgcgaacccggcgaagagcgacgcgaacagcagggcacggacgaggctggctccggtgcggcggcccatctccgtgtctaggccgtagcgtgtgatgctggtatgcttgcgagtggtgt

SEQ ID NO: 28691 - DNA, 779 bp, Triticum aestivum
  unsure (1)..(779): unsure at all n locations
  Clone ID: PAT_TA_28691
gtgcggcgctcgaggcggccgttcgggaatcccagcagccaccaccgtccctccgattccacatccgctcgcagctcgagatcgtcagccatgtccgggcgcggcaagggaggcaaggggctcggcaagggcggcgccaagcgccaccggaaggtactgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggccgccaccagatcagtagctagactgtcgttgtttggtagtaccagcagtgctcgtggtcctcttgtgtaatggcagcatctcgctgctgttaacccttgttgtctggatgtactactaggatggaatggaaattgtagcagtttgcccttgaattcgttacctattctttcggcctgttgatgtttgttcgtgcgcgggtcagatattgccagtgcgttcttcagttgtcttgctctgtaaatttcggcccccaaatccgtttgtgctggcttcggtgtttggatcctattttgtgttgcctccagtgtgtggtggattcaaaccaaatcccactgtgtttggcttctgtgtttggngnatagaaatcaaatcct

SEQ ID NO: 28692 - DNA, 747 bp, Triticum aestivum
  Clone ID: PAT_TA_28692
ggaagatcaaaatccagttctctaagaactagaacaaacaaattatatgcgctgatgctgccaatgattattacagacgattcttcagcttgactgcaatgctggtaaaacttttccaaggacaagaatgcgaggattattcaggagccttaaacggtgtctcaacacccaaggaaatcgaggtgcctgccacttacctactcaggctaaagctcccggtatgcaacaaaattaggtgggagacaaataatcgagagaaagagcagctggtgctcagatatgatcgcaaactgcttttgtgtagtctgacgttgatgacttcccaccaagatcagcggttctgtacttcccctcggcaattgtctggaggatggcattgtggatccggtctgcttggtcattgaattgcaagtggcgcaacatcataacagcactcaacataagagcagttgggtttgcaaggttcttgccagagatatcaggtgcagaaccatgaacagcctctgccagacaaatgccaccttcaccaatgttgcagctgggagttaagcccaagcctccaatcaaaccagcacatagatcactaataatgtcaccatacagatttggcatcactaatacatcaaatgtaccaggattcttcacgagtgtcatgcagcaattgtcaataatgacttcctcatatgtgatttcagggtacttctcagctacttcacggcaacacttgaggaaaagtccatctgtttt

SEQ ID NO: 28693 - DNA, 720 bp, Triticum aestivum
  unsure (1)..(720): unsure at all n locations
  Clone ID: PAT_TA_28693
ggaaggcctttattcttatactattattattattgggatctcacggtaacatgccatggcagattacattctgacgatgggatagctcactagctcagcatacacgcacgcgcggactttatttatagttatagttattctgccatgatctctccatctccttcactggccttcctctcgcgcgatccccatgaccgaaactcctcacgcatgcgcggatggtggtggcacccgccccccgatggtgtaagttccgcgtttgctcccgacggggagttcgatgtggcactcgtgggcgaggaggacgagcttcacggggctgacggtctgctcgtcggagggggtgaggacgcggcagatgcagggcatgtcaaccttcttcacctcgtttttgcaggcctggctcgcgggcatgtagaagccatccttcttgatgctcttgatgcagatgtgcatgatcatgtccttctcgtcgtagcagtccttctcccccgcggcgagatgcgccgcgaacccggcgacgatcgaggccaacaacaggaagcggacgagggtggctccggcgctgcccatcttcctgtgctgctgctgagctgctggctactgtgccctcgtgccgaattcctgcagcccgggggatccactagttctagagcggccgccaccgcggtggagctccagcttttgttccctttagtgagggnttnaaagnngcgncat

SEQ ID NO: 28694 - DNA, 729 bp, Triticum aestivum
  Clone ID: PAT_TA_28694
gccggccgggctgcggaaaccactgcacacacttccaccaccaccaccaccgcggcacgtacgtttgcgatcaaaagaaagtcgagccatatggcgaaggccgcagcgatgctcgtgctggtggcgctggtggtggcggcgatggcaacgggcggagcggcgcagtgcaacgcggggagcctggcggtgtgcacctccccgatcatcagcgggaccccgccgtccaagacgtgctgcaacaacctaaagagtcagcgggggtgcttctgcaagttcgcgcgcaaccccgcgtactccagctacatcaacagccgcaacgccggcaagaccctcaccagctgcggcatcgccgtaccgaagtgctaggagccgggcctccgccgccggcgccggcgtgctaggcaccgccccgccgcctattgctactactactactacgtaacgtactacgtacgagctcctaccatggctactggtacgacgtccgtcgaacagttccgtgcgaaccgtgtgtttcatgtatcttttttttccctctcgaatacaatcgtgtgttcatgtatcgtgtgcaagaataaaatggtgtgtacgtgttgatccagcctctgcgtagtttgttactcctttgtcaatttttatcgatggatgtcgatcgatctcgtgtaattcctgtacctccgacaatatatatccgcaccttaacaaaaagttgctactaaaaaaaaaaaa

SEQ ID NO: 28695 - DNA, 797 bp, Triticum aestivum
  Clone ID: PAT_TA_28695
actctctctctctctctctctctctctctctctctctctctctctctctctctctctctctctctctctctctctctctccggaaacggtggcggtgggaatggtggcggcggaaacggtggcggtggcaatggtggcggcggcaacggtgggggcggaaacagcacccagtgccctctggacgcgctgaagctgggggtgtgcgcgaacgtgctcgggctgctgaaccttaccctggggagcccgccggtgcagccgtgctgctcgctgatccaggggctggcggacctcgaggcggcgctgtgcctctgcacgacgctgaacctcaaccttctgggcatcaacctgaccttgcccatcgccctcagcctcgtcctcaacaactgcggcaagaacgtcccctccggcttccagtgccccaactgagccggccggaccctgcatccgccatacctcatgcacgcacgcatgcatgcatgactggctatttgaagtaccactacgtacttgttgtgtgctttaatttcttaatcatctgctggtttttatgtgtggctggatttcgattgcggagaaactacgtactacttctccaggttctacgtacgtacaagcacgcactgttacctgcgtgcgtaaggatttcgttgtgtgtgtgtgcatgatgtgttgtcgtaatcgtcacatgtttgtgatgagttggttattgccagagtgctcatgatgtaccgctatctccgactaaataaaagatttgctattttccattattactatatactacatttgcaagtttt

SEQ ID NO: 28696 - DNA, 840 bp, Triticum aestivum
  Clone ID: PAT_TA_28696
gccggccgggtcgggcttttttcatcctctcaccactcgcgcctctcacgcccttcccgccgccgccgccgccgccactcccctcgccgccgcagcagccgcagccatggggcgcatgcacagccgcgggaagggcatctcatcgtcggcgctgccgtacaagaggactccaccgagctgggtcaagaccgccgtcgccgatgtggacgagttaatcaccaaggccgcgaagaagggccagatgccgtcgcagatcggcgtcctgctccgtgaccagcacggcatccccctcgtcaagagcgtcaccgggagcaagatcctccgcatcctcaaggcccatgggctggcaccagagatcccggaggacctctactttctgatcaagaaggcggtggcgataaggaagcacctggagaggaacaggaaggacaaggactctaagttcaggctcatccttgtggagagcaggatccaccgcctcgctcgctactacaagcgcaccaagaagctcccgcccacctggaagtacgagtctaccaccgccagcactctggtggcgtaagggagatccagatctggtgtgctcttagctgattaaagcttgattgttctggaaaccattcttatgtaatgctttatgagagtttggagccaagcagatgctgcaaattttctatgtttgcctggaggatgctgtaaaacctttatggtttcactgttctgtctgttaaacgactgttataatgtacccagattttgtccgttacagttagcagttaccgtatgttttttcagatagtacatgttgctcttccgctgaaaaaaaaaaaaaaaaaaaaa

SEQ ID NO: 28697 - DNA, 1139 bp, Triticum aestivum
  Clone ID: PAT_TA_28697
tctagctggtggctgcggaggcgaggcccggaggaagcggctgattgagtaagcgcgtctagcacaggaaccaagaggaggaaggaagaggaacccaatccaatcatggactcggagcactggatctcgcgcctcgccgccgccaagcgcgtctacgccgcgcagctcggccacatcgacgatatggcggggatggggatggaggaagaggacatggacatggaggacgacggggagatggacatggagatggagatgcagctggaggaggcaagatggccggaggtcgcctgcccctactgctacgaggactacgacctcggctccctctgcgtccacctcgaggaggaccacccctacgagccacaccccgcgccttgccccatctgctctgaaaagattacaagagatatgctaaatcatatcaccatgcatcatggttacttgttcaaggcgcttctaggaggcggtcatagtcataggtcaaggaacaccaccgccgccactacaaatatttatgctgatccactgctttcatcgtttggcctgggttttgcaacatcagatgccgaagaaccatcgaaatcatcagttccggttctcgatgatacttcaattcttaaggaggcacctcctcaaccttgggaatcaagtattgactcgtccctcacaagtgaggaaagggaacaaaagcggaaacaagccacaagcagggcgacctttgtgcaagacctggtcctctccactttatttggagacgactgagtgcttgaatggccctgcattttccttgttagatgggtgcttccttcacgctgattcggatagaactgcagcactccgccctgagttggttaatcttaacttgggcgaagtcaagtgcgtctggtgcacccgcagtcaagtgcggattttatttgggcttgacacatcacaccttaatttatggtagctgtcccatattgcccgttttttccaccgaattatcggccagcagttccttgccttggttgtaacttgttgtgccatcctcttcattgtcaaggaacattggtctgtaccaacgtcacacagctgttacatactatagaatgcaatgcaatgggaaattacagaagctccacctatgtggaagcaac

SEQ ID NO: 28698 - DNA, 3274 bp, Triticum aestivum
  Clone ID: PAT_TA_28698
gcacgaggcccgtcgtctcccacctctctcaatttgttctcttctatctattcctccacccgaattcctgttccgcccgccagccgtacacagcacaccactgctctctctctcgcgcgcgcggcggccatggcggacgcgccggtggagctgccgggccggctcgccatactgccgttccgcaacaaggtgctcctcccgggcgccatcgtgcggatccgatgcaccaaccccagcagtgtaaagctggtggagcaggagctctggcagagggaggacaagggtctgatcggagtgcttccggtgcgggactccgaggctgcggctgttggttccatcctgtcgcctggcgtgggcagtgattcaggtgaaggaggccgcaggtcgcctggtggttctgggggagagtcgaccaaacaggatgcaaagagtgggaaggagcccattcactggcacagccggggagttgctgctagagctctgcacctttcaagaggggtggagaaaccaagtggaagggttacatacattgttgttctcgaaggcttatgtaggttcagtgttgaagaactcaatgcaagagggtcgtatcatgttgcccgtgtttcacgacttgacatgacaaagactgagttggagcaggcagagcaagacccagatctaattgctctttcgaggcaatttaaagcaactgccatggaactaatttccgtcttagagcagaagcagaagacggttggtaggactaaggtgctacttgagacagttcctgtatacaggctagcctgatatttttgttgctagctttgaaataagctttgaggagcagcttgctatgctggattcagttgacttgaaagtgagactttccaaggcaacagaacttgtagacaggcacctgcagtcaattcttgtagcggagaaaataacacagaaggtggaggggcagctatcaaaatcccaaaaagaatttctgctgcgccagcagatgagggctatcaaagacgaacttggtgataatgatgatgatgaagatgacattgctgcattggaaaggaagatgcagaatgcaggaatgccagctaatatttggaagcatgcccaaagggagttgaggcgcttgaggaagatgcaacctcagcaacctggatatagtagctctcgagcttatttggaacttattgcggaccttccttggcaaaaagtaagtgaagaaagggaacttgaccttagagctgcaaaggagagtcttgatcgtgatcattacgggctgaccaaagttaagcaaaggattattgagtatttggctgtccgtaagctcaaaccggatgccagaggtccagtgctgtgttttgtggggccacctggtgttggaaagacatctttggctacatccatagcaaaggccctaaataggaagttcataagaatctctcttggtggtgtaaaggatgaggctgatattaggggccatcgaagaacatacattggaagcatgccagggcgcctcattgatggactaaagagggtatctgtcaacaacccagtgatgctccttgacgaaattgacaagactggttctgatgtacgtggggatccagcatcagcactgctagaagtacttgaccctgagcagaacaaaacattcaatgaccactatttgaatgttccatttgacctgtcaaaggttgtatttgttgcaactgccaacaggatgcaacctattccccctgccctgttagataggatggaagtcattgagttaccaggctacacgcctgaagaaaagctgaaaatagccatgaaacatctcctaccaagggtattggaacagcatggcttgagctccgcatatcttcagattcctgaggctgtagtcaaacttatcatcgagagatacacacgggaagctggtgtgcgtaatcttgaaagaaacctagctgcattggctcgtgcagctgctgtcaaggttgcagagctagatagtacgcttagacttggcaaggaaatgcagccaataactacaactctactggactcgagactcgccgatggtggtgaagttgaaatggaagttattcctatgggccaggacatatcaaatacatatgaaaattcatcacccatgattgttgatgaggctatgctagaaaaagtgcttgggcctcctagatttgatgacagagaggctgcggatcgggtgtcattcccaggagtgtcagttgggctcgtctggacttcttttggtggggaagttcagtttgtagaggctgcggccatggcgggtaagggtgacttgcatctgacaggacaacttggtgatgtaattaaggaatcagcacagttagctctgacatgggtgagagcaagatctgctgacctcaatctgtcacctacttctgatattaacatattggagagccgtgatattcacatacattttcctgctggtgctgtgccgaaggatggtccttctgcaggagtgacattggtaacatcactggtgtcattgtttagtaaccggaaagtcagagcagacactgcaatgacaggagagatgactcttaggggcctagtgttgccagttggtggtgttaaggataaggtgcttgctgcgcatcgatatggcatcaagagagtaatattaccagaaagaaacttgaaggacttggctgagattccagctccgatcctcgctggcattgagattctgctcgtgaagcgcattgaggaagtacttggccatgcttttgagaatggattccctttgaggctacactccagtctatagcacgggcaaataccaattggcgcctgatgtggcatttcctcggtggccatttactcgttttgaagattcgtcgctattcaccgcccagatatctacaaatgagcgttgagcgtaggcgagcaattgctccgttggagcgaaatctcatgacgccagcgttgctcgtccaactcagttaagctaatatgcggaatgtgtatatggatacttgctatccacaaaagcggcagggagatctgctctggtctttgtgattgtatttatagagggatgctcatctatctatgctcggtttgctatggtagcaaggaggtccacctgttgttgtcggtttgggtgtatatgtaacctatttcagccagggagaattgaatgttgcagtatcataaataaaaaagagatagcacaagtaatcatcgtaaaaaaaaaaaaaaaaaaaaaactcgaacctcggccgcgaccacgctaatcactagtgaattc

SEQ ID NO: 28699 - DNA, 608 bp, Triticum aestivum
  Clone ID: PAT_TA_28699
tagcgcggtatcgatcatatagggattggtaccggccccctttgcgccgccgcgccaccgccgtcagccatggcaccgaagaaggagaaggccccggcggcgtcgtcgaagccggccaagtcgggcggcggcaagcagaagaagaagaagtggagcaagggcaagcaaaaggagaaggtgaacaacgcggtgctcttcgaccaggccacctacgacaagctgctcaccgaggtgcccaagtacaagcagatcacgccctccgtcctctccgagcgcctcaggatcaacggctcgctcgctcgcagggccatcaaggacctgatggagagggggctcatcaggatggtgtcaatccactccagccagcagatcttcaccagggccacaaacacctgatttacctcatgtgttggctgcctgttttctagtccagtagactgagatgtcgctgttatattgacgttcattatgttcagcgaggcactttggcactcgtgccacaagtatgttgaattgcttttgagtttttggtacaatctaagacgcaatgaaatctaccttatattatcagactgtgtttgtaaaaaaaaaaaaaaaaaaggccccta

SEQ ID NO: 28700 - DNA, 1034 bp, Triticum aestivum
  Clone ID: PAT_TA_28700
ccccgcttcctcctcctcttcctcccgctcactcccgaagcgaagcctcgagaggtcccaatggcttccaccacattctcctccgccttctccatcctctctctcccctcctcctcaccatccccctccgcctcggcccccaggaccctacccgtcgccaaccgccgccgccgcgccgtcgccgtcgcctccactgccacggagtccccgaaggtccttgagctcggcgacgccattgcccgggctcacccttgaggaggctcgcaaccttgtcgaccatctccaaagaacgtcttggcgtctcctgccgcctcctttgctcccgctgccgcggtcgcggctcccgccgcaacggcggccgaggaggcaccgggtcgagaagacggagttcgatgtggtcatcgaggaggtgcccagcagcgcgcgtatcgcaaccatcaaggttgtgcgcgcactgaccaacctggcgctgaaggaggccaaggatcttatcgaggggctcccaaagaagctcaaggaggccgtgagcaaggacgaggccgaggaggccaagaagcagctcgagggagtcggcgccaaggtgtccatagcgtgagactagaacaatgtgagtattacattgggcatggcatgtgagtttgggtagttgaagaacatggactctccatatgaagatatatgtgtggtgctgaaactgggaagttctctgaaaatattgtgtgtttttgtctctagagtattttgttttcccccatgatttgaatctatcgaaggcgctgaaagttgttttacgcccactttgtatttctgaatctctacttctgctttccaaagtgtaattgggtgatgctgttggcacccttgatgttatccatccacaaggatcaagtaggccaacggaaagagttacactttcgcatctcgctttggtacgtgtatattggcagtcatcaccgcatcagccatatttggcaggagagaccttgcaaacaaagtacatcagccatatttggcaggagagaccttgcaaacaa

SEQ ID NO: 28701 - DNA, 595 bp, Triticum aestivum
  Clone ID: PAT_TA_28701
cggccgggctgcggcgagagaccgatagcgaacagtaccgcgagggaaagatccacctcatcgctctacacctcacaaagacaggtcaacctcaccgaggagaagaaaggagaagcgagaaggatgtcggggcgcggcaagggaggcaagggtctgggcaagggcggcgccaagcgccaccggaaggtcctccgcgacaacatccagggtatcaccaagccggcgatccgtcgtctggcgcgtcggggcggcgtgaagcgcatctcggggctcatctacgaagagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccaccaccgccgccagattagagtgtctagggttcgtggtctttgatgtaatcgcagtatctcgctgttgtttgctatcttctgtagaatggaattgaatggaaatcgaactagtttatccttgaaattctgcaaaaaaaaaaaaaaaaaaggccccta

SEQ ID NO: 28702 - DNA, 609 bp, Triticum aestivum
  Clone ID: PAT_TA_28702
gcaggaattcggcacgaggaaaaacacacacactcagaagccaatctcgccggagagggaagcgtcgaggatgtcgggccgcggcaagggagggaaggggctgggcaagggcggcgccaagcgccaccggaaggtgctgcgggacaacatccagggcatcaccaagccggccatccgccgtctggctcggcgtggcggcgtgaagcgcatctcggggctcatctacgaggagacccgtggcgtgctcaagatcttcctggagaacgtcatccgcgacgccgtcacctacacggagcacgcccgccgcaagaccgtcaccgccatggacgtcgtctacgccctcaagcgacagggccgcaccctctacggattcggcggctaggtcgcgccggtccagtcgagcccacctcgcgccgccatactcgtactactagctagccatggttgtcttcggtgtaatggaatggccgcatctcgctgctgtctgttgtttcgctgtattactagcacggaatggaaatctcagcattttatccctgaattcgtctgcaatctcttgctctgttgttaaatcttgtcagtgtgctttgttaaatcttaaaaaaaaaa

SEQ ID NO: 28703 - DNA, 682 bp, Triticum aestivum
  Clone ID: PAT_TA_28703
gaaaaaaaaaaaaaaaaaaaaaaaaaaatagcaacccatcaccacccctccccccaatcccactcgcgcagcagctccaagaggatcgtcggcgaccatgtccggccgcggcaagggaggcaaggggctcggcaagggcggcgcgaagcgccacaggaaggtgctgcgcgacaacatccagggcatcaccaagccggccatccggcgcctggcgaggaggggcggcgtgaagcgcatctccggcctcatctacgaggagacccgcggcgtgctcaagatcttcctcgagaacgtcatccgcgacgccgtcacctacaccgagcacgcacgccggaagaccgtcaccgccatggacgtcgtgtacgcgctcaagcgccagggccgcaccctctacggcttcggcggctaggccgctggcccccgccagacggtcgtcagtcttcgtcgccacctgcagattccgatgtgttagtccgcccgttcctagtagtgttgcgctcaagaaatctcagatggaaaccgccttgtttccccatttcctctgtatgtttagctgaatcatggaattatgtaatgaagatgtttgcatccagagttcgaactgaaacctgcatcccttgtcttgaattctgtgcaaatgctgcgttcctctccttttttgtgaaaaaaaaaaaaaaaaaaa

SEQ ID NO: 28704 - DNA, 800 bp, Triticum aestivum
  Clone ID: PAT_TA_28704
ctcttttctatcctctcaccactcgcgcctctctcgcccttcccgccgccaccgccgccgccgccactcccctcgccgccgcagcagccgcagccatggggcgcatgcacagccgcgggaagggcatctcgtcgtcagcgctgccgtacaagaggactccaccaagctgggtcaagaccgccgtcgccgatgtggacgagttaatcaccaaggccgcgaagaagggccagatgccgtcgcagatcggcgtcctgctccgtgaccagcacggcatccccctcgtcaagagcgtcaccgggagcaagatcctccgcatcctcaaggcccatgggctggcgccagagatcccggaggatctctactttctgatcaagaaggcggtggcgataaggaagcacctggagaggaacaggaaggacaaggactctaagttcaggctcatccttgtggagagcaggatccaccgcctcgctcgctactacaagcgcaccaagaagctcccgcccacctggaagtacgagtctaccaccgccagcactctggtggcttaagggagatccagatctggtgtgctcttagctgattaaagcttgattgttctggaaaccattcttatgtaatgctttatgagagtttggagccaagcagatgctgcaaattttctatgtttgcctggaggatgctgtaaaacctttatggtttcactgttctgtctgttaaacgactgttataatgtgcccagattttgtcagttacagttagcagttaccgtatgttttttccaaaaaaaaaaaaaaaaa

SEQ ID NO: 28705 - DNA, 627 bp, Triticum aestivum
  Clone ID: PAT_TA_28705
gccggccgggttcgggatctcttctcctcctccccgccgccgccgccgcctcctcctcttcgccgctcccgctcccgccgccgcgccaccgccgtcagccatggcaccgaagaaggagaaggccccggcggcgtcgtccaagccggccaagtccggcggcggcaagcagaagaagaagaagtggagcaagggcaagcaaaaggagaaggtgaacaacgcggtgctgttcgaccaggccacctacgacaagctgctcaccgaggtgcccaagtacaagcagatcacgccctccgtcctctccgagcgcctcaggatcaacgggtctctggcacgcagggctatcaaggacctgatggagaggggactcatcaggatggtgtcaatccactccagccagcagatcttcaccagggcgacaaacacctgatttatcattatcatgtgttctgggtctgtttttagtccagtagactgaggtgttgctgttacattcaagttcactatgtccaggggggcacactgtgccaccagtaatgttgaattgcttttgagttttggtacactttaagatcgttttgtcagcgcaatgaaatctacctcaaaaaaaaaaaaaaaaaaaggccccta

SEQ ID NO: 28706 - DNA, 988 bp, Triticum aestivum
  Clone ID: PAT_TA_28706
aaggcaagggctcgctcgagccatggtcgcacgcatacacctgggaggaggacttcaccgcctccgacgacgacgaggacgagggcgagtacgggcagattgaggagcgcaagccggagaagaagaagaaggaggacaagcccaagaagatcaaggaggatgacaagaagaagaagaagccggcgaggacgtgcgtccagatcgaggagatccccgaggacaacaccgccggctgcgacgccatccgcaaggcctttgccatggggaacggcaaggggaaggccaaggagctgtcgccgcaggacgccgcgctgctcatccagatgaactacagggcgcacctcgcccaccgctcccaggtgctccgctgcctgcgcgacctcgccgtcgccaaggccaagctcaaggagctcaggtccctcttctacaacctctcctacaggcgccgcctctcgcacgaccacgaggagcgccagaggttctccgagaagatcattgtcctgctcctcactgtcgatgcgctcgagggacctgacttcatggtgaggacggcgaagaaatctatgctggaggaactggagagcatgctggagattgtggacccgcagccaccagggaagcagaggtcgtttagccgccgcaagttcgatcttccagagggcggagcgattccgaacgagaaaactgcaggcgtgaacaatgctgtcagggtcatcaacactggcaagggcaagcagtaggcaccatgcgcctagtttagtggccggtaccatggccgatcgatggagcttgtagcgccgcttttgtctgtgagatagtccggttcatcttagaattccagtgtctctgagatttgagaaagattgaacttgttgtgcaccattgtttgtgatgtcgtagcgtgtatgatctgtatcgttttgttttggacttgttgtaatgtatggtgttgttgaactaccagtagaagagtttggtgctttaaaaa

SEQ ID NO: 28707 - DNA, 603 bp, Triticum aestivum
  Clone ID: PAT_TA_28707
cccacgcgtccgcccacgcgtccgcaccagcaacacacacacagcagccaagcgaagctcgccgcagatcgaagatgtcgggccgcggcaagggcgggaaggggctgggcaagggtggcgccaagcgccaccgaaaggttctccgcgacaacatccagggcatcaccaagccggccatccgtcggctggcgcggcggggcggcgtgaagcgcatctcggggctcatctacgaggagacccgcggtgtgctcaagatcttcctggagaacgtcatccgcgacgccgtcacctacaccgagcacgcccgccgcaagaccgtcaccgccatggacgttgtctacgccctcaagcgccagggccgcaccctctacggattcggcggctaggccgcgccggtccactcatatccacgtcgcgccgccagattagtagctagccatggttgttcagtgttcatggtcttgggtgtaatggtcgcatctcgccgctgtatgtcctggccatgattgttgtttggatgtagtcagatctgggatggaattgaagtggtttacccttgaattcttctgcaatctctcactctgttcatgctgaaaaaaaaaa

SEQ ID NO: 28708 - DNA, 1525 bp, Triticum aestivum
  unsure (1)..(1525): unsure at all n locations
  Clone ID: PAT_TA_28708
atccatggtggccatcgtcaccttcttgagagaagactagggcagcaccctcgccaaaagatcaccatttggaatttgaacatgatgtccaagttcaagtgggagctccatcgtgtgatctacctggattctgtctggggtagctctggttaccaggagctgcacataccttgccgtcttcctgagttcccaatcatcagtgcggatgacccggatgttgtatgctgccttttaagggaggaggaatttcacggtgaggcgtggatgatcatggttgacatgaaacaggcacatgttcagtcatgtactccatatatcaatcaacagtcctgctatgctaagtctgtgggtgtggatgtgcaagctcgcaaaagccgttttgctaatgtgcccctacttccagctgtcttctccagacaccttgaaaggccaacagggatgctatggaacaacgacaagcttgcacctcatccttcaaagaagagtaagtttgcaaggtaaagacttgggagtatggttcgctcaaatcgaagatgatgtttgtcaaaggtgcaacttttgggattctcaaaccgaagatgatgtttggtgcggtgcagacagaaatgtgggaaaatatcatatttatgtgatgaagatgatgtactaatgaatatccattagagtaaacgatacatattatggatcctgtaatcgtatgtttgaaagccagcctgttatatgtttgggattgaacattgctgggtgttaattatgtttgccgtcgtctaaacaaaaaaaaaaaataaacacacgactctcggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgcctgcctgggcgtcacgctcgtggccttgccggatgagatcatagcatgatgacttttcatctacatgaagcgagagagctggttactgtctgcagcaccgcaagcatgttgatgccctcttcagattcagagtgtggacaactcacccgtggaacgatagggttagtggtttcatggacagtaactccgcctcgtggaacatccagaagctgcaagaagtcgaggtgctcaggagtacctcgtccccatgggacaaggtgatttgtgggcatgctttttctacaaaaaaggcacgttcactattcattcagcgtacaatatgctggtgagtatcaaaaccaagctcggatactaggaagcaagtgaagaattgggcgaatatgtggcaatactttggaggcaacccaactcattggggcattcgcttgtggactgcaccatggcgaagtgcgtatgggtgctcgtagatgaagactagaacatcgatggtgtgcattgtcgtgccggtctattgtacagtanatatatnaataccagataccagaaacatattttaatttgcaaaaaaaaaaaaaaaaggcccctaggg

SEQ ID NO: 28709 - DNA, 837 bp, Triticum aestivum
  Clone ID: PAT_TA_28709
caatcgcgccgccgctcgagcccctctcgcccttcgcgccgccgccgctgcaggcaaccgtcgccgccgtcgccgccgtcgccggagctaaacccctcgcctgacgccatggggcgcatgcacagccgcggaaagggtatctcgtcgtcggcgctgccgtacaagaggactcccccgagctgggtcaagaccgccgtcgctgatgtcgacgagttgatcacgaaggctgcgaagaagggtcagatgccctcgcagatcggtgttctgctccgtgaccagcacggtatcccccttgtgaagagcgttaccggaagcaagatcctccgcatcctcaaggctcatggcctggcgccggaaatcccagaggatctgtactttttgattaagaaggctgtggccattaggaagcatcttgagaggaacaggaaggacaaggactccaaattcaggctcattcttgttgagagcaggatccaccgtcttgcccgttactacaagcgcaccaagaagctcccgcccacctggaagtacgagtctaccactgccagcactctggtggcttaggagggctcttcatctggtgtgctcttaccggcttcaggatggtcttgttctacatattatcaatttcatgtaacgcttttgagtttggagcgatttagatgaacaagagaccaaattttctatgtttacttggagaatcccataaaccatttttggttttgcaattctgtctggttctgtttagtgtctatctacaattaatcagttaaaattagacattgtgataaaaaaaaaaaaaaaaaaaaaaaaaaaaaaaaaaaaaaaaaaaaaaaa

SEQ ID NO: 28710 - DNA, 1513 bp, Triticum aestivum
  Clone ID: PAT_TA_28710
cccacgcgtccgctccctcaccctcccgcgccgcctcaacacggcgccatcctcatcacgaacccaccaaacaaacaaaaggcggacccaactccccctcctccaccttccccggagcacaaatctcccctcccaatccccacccccgtcggtagccaatcgcgtcgacgatgctgggcgccgcgaggagatccggatgcgtgctggggcaactgatgcagaccctccgcccggcggcaacggcggcgaggagctactccgcgaccccgaaggagatgactgtgcgtgaagcattgaattccgctcttgacgaggagatgtctgccgacccttctgttttcttaatgggagaagaggttggagagtaccaaggtgcgtacaagataacaaagggtttgctggacaagtatggtcccgacagggttctcgatacaccaatcacagaggctggttttactggcattggcgttggtgctgcctaccaaggtcttagacctgtagtagagttcatgacatttaacttctcgatgcaggcaattgatcacatcatcaattcagctgccaaatcaaactacatgtcagctggtcagatatccgttcctattgtttttcgaggaccaaatggggcagctgctggagttggtgctcaacactcgcagtgctatgcagcatggtatgcccatgttccaggattgaaggtcctaactccctattctgcagaagatgctcgaggcttgctaaaagcagcaatcagggatccagaccctgttgttttcctggaaaatgaactactctatggtgaatcgtttcctattaaggctgaagtacttgattctagcttcagtgctcccaattggcaaagctaagatagaacgggaaggaaaagatgttacaattactgcattctctaagatggttgggtatgctcttcaggctgcagagatactgtccaaggagggaatcagtgctgaggtgatcaaccttcggtcaattagaccattggatagagctgctatcaatgcatccgttaggaaaaccaacagattggttaccgttgaagaaggctttccacaacatggtgttggtgctgaaatatgcatgtccgtagtggaggacagctttgagtatcttgatgcaccagttgagaggattgccggagctgatgtaccgatgccctatgcggcaaaccttgaaagattggcagttccacaggttgaggacatcgtccgtgcagcaaagcgagcttgctacagatcatcatccatggcggcaaacgcctaaagcacaaatgcaagttttgtttctcggccttcttcttccttccttgtccagaaaagatgtaccgaatcgcataattgtatcccccaactcgtgtgagctaattttgtagatctgcatgcattgttgattcctatctgtcggcggcagtcggatgactgcatttagttcatggttcatccctatacatttgaatcatgcaacctctggaggtttacatccctgagggatgtat

SEQ ID NO: 28711 - DNA, 692 bp, Triticum aestivum
  unsure (1)..(692): unsure at all n locations
  Clone ID: PAT_TA_28711
cgtcccttccaggtcacaacgctacccccaatccccagcctccagatccacccgccgccgccggccaccccgtcgcttcccgccccccgcgcgccccagccagccaggatgacgctagaagaagcaccattttacccacgcgagaagctcgttcagaagcagcagtatttccagaagctgagcaagcatatccaccttaaaggccgttacgatgtggtcacctctgttgccattccccttgcgcttgctggcgccagcttgttcatgattggtcgtgggatctacaacatgtctaacgggatcgggaaaaaggagtgaatttctgtggcttttgctagtatctcaagtaagcggcatggaagcgatactgcccaagctatgatgtcatcttcgtatgcaaataatattgtcagagaaagactcgagtccatttccagttctcttttgtcggtatttgtggatatttgatgtcaagcaaattgatgctaaactggcaatgatgattctataacatcggcatcattatccttctcgtgccgaatttaacaaaatattaacgcttacaattaagtggactttcggggaaatgtcgcggaacccaattgttaatttcaataatcaatagtaccccatgagaatacccgataanctaatatatgaaaggaattatatanattcngcnctatcctttg

SEQ ID NO: 28712 - DNA, 538 bp, Triticum aestivum
  Clone ID: PAT_TA_28712
atttccacatcgctctacacctcaccaagacaggtctacctcaccggagagaaaagaagagaagcgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccaccagattagagtgtctggggttcgtggtcgttgatgtaattgcagcatctcgctgttgtttgctatcttctgtagaatggaatggaatggaaattgaactagtttatccttgaaattttgcaaaaaaaaaaaaaaaaaaggccccta

SEQ ID NO: 28713 - DNA, 1515 bp, Triticum aestivum
  Clone ID: PAT_TA_28713
gcgacatcacagatcaccaccacactcccccagcccagatcccgagcccatcgcccatggcgaccgccttcgactccccgacctcctccccggcggccgcgcccttccacgacgaccccttcctcagcttcgccgactcccccacccccgccgcggccgacgcccacgtctccggcgacgccttcccggcctcccccgacccctacgccttccgccacgactccgccgccgcgcaccccttcggcatgcccgactccaacggcaacggccacgccatgcaccacgacgccgacgacgacggcctcttcaccgaccccggccccgtcctccccgaccccgcccagatgggggccgacgagggcttcctcctccgcgagtggcgccgtcaaaatgcactccttctggaggaaaaggagaagcacgagaaggagctgaggagccaaatcatccttgaagctgaagagttcaagaagggtttcgtcgagaagcgcaagctgaaccttgagacaagcaaggatcacaaccgggaaagggagaagcttttcctgtccaaccaggagaagttccacaagggcgcagacaagcagtactggaaggcgatatccgagctcatcccacaggagattgcgcacatcgagaagaggacgggcaagaaggacaaggacaagaagcctgggatcatcgttgtccagggccccaagcccgggaaggccaccgacatggcgcggatgcgccagatcctctcaaagctgaagcacacaccgccgccacacatgaagccacctccaccacctgctgcagcacccgctgggaaggatggaactccggccgccgctggaaaggacggagctaaggcggtagcgacacctgctgccaaggatgcccctgccaacggcactgtccctgagaaggagaatgccgcacccgccgccgctgcccccgcagcagcagcccctgcaccaccagctgagcccatcggctgctgcctgaacgaaggtgacctcgttcagccgctaatcctttgcagtagggttatatttgggtgtcggtagagttgttccaaggagagatggggaaggagcgtgaaggccacatacgatgcgaggtggtgagatcgtctttgagttcaccacggggaatcatggcggagatacacgcagtgtactattattaatttgagtttgttattatgagcaggagggttgttacttatgggaccagcaaactttattcgttaatattgtcattgcattttgtagagagaaagaggggactggtaagaataaggtaaggctgctgctgtatgtgtttgtatatttatcatcaagtgttggatttttggtcagacctgtgattgatgttgcatatattatatcatttggtttttcatctcaagttcagtgctgtcttgtgtttatgcactgtgatgtagttggcattgctgtagcttgaatgctcttattgttgcatccttttttcggtgaaaattattgtacctcggccgcgaccacgcta

SEQ ID NO: 28714 - DNA, 743 bp, Triticum aestivum
  Clone ID: PAT_TA_28714
agctttagcttagctttgcacctgtgtacttgttgagccatggagttcaagcacctgtgcctggtaaggttcaaggagggcgtggtggtggaggacatcattgaggagctcaccaagctcgccgcggagctcgacaccgtcaaattcttcgggtggggaaaggacgtgctgaaccaggaggcgctgacgcagggcttcacccacgtcttctccatgagcttcgccagcgccgaggacctggcggcgtacatgggccacgagaagcactctgcattcgccgccaccttcatggccgtgctcgacaaggtggttgtcctggacttccccttcgtcgtcgccaagccggcgccatcgcctgaggccgcctgaatgatacacccccaccaccccctgtagcagtatctgtctgttactactgagcaagtataagcatctaccatcggcagccactgtaaggtgcctacatctatctgaaggctgcagctgtgatgtacctaaagcctcctttttttttgcttgcttgtcctgctactacggcgtttgttaaccgtctagcctgtaaagcctccggccggtgtaactctattccgtgcattccgtcgctcaaaagttgcttggttatcacccttgaataaacatcgctggttttgctttaaaaaaaaaaaaaaaaaaaaaaaaaaaaaaaaaaaaaaaaaaaactcgagggggggcccggtacccaattcgccctatagtgagtgtat

SEQ ID NO: 28715 - DNA, 708 bp, Triticum aestivum
  Clone ID: PAT_TA_28715
cgcagccgcaccccaccatgactggagctgctcttctccggcaccgccgtctgtgtgcacgtatggtggtggaggggagtaggaggccatggcgaggagcgaggaggagggaggggccgtgggaatgggccatggcgaggagcgagaaggagggaggggctgtggggatcgatagaagccaatctcgccggagaaagaagcgtcgacgatgtccggccgcggcaagggagggaaggggctgggcaagggcggcgccaagcgccaccggaaggtgctgcgcgacaacatccagggcatcaccaagccggccatccgtcgtctggctcggcgtggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggacgcaccctctacggattcggcggctaggccgcgccggtccagcagaacccacctcccgccgccagattcactagctagccatcggtcgtccgtgttcatggtctttgttgtaatggaacggccgcatctcgctgctgtctgttgtttcgatgtagtactactagcatggaatggaaatctcagcgtttttacccctgaattcgtctgcagtctct

SEQ ID NO: 28716 - DNA, 834 bp, Triticum aestivum
  unsure (1)..(834): unsure at all n locations
  Clone ID: PAT_TA_28716
gccggccgtgccgggttacttaaccaaccccaatcccccactctttccccaacccacgccctcccgtttccccgtctccccgtctccccgccgcctcctcctcctccgcgtcgcaaaccctcgtcctaatccgccgaatcccgcgacccacgaaccaaggcagatcgatggcgaagagctcgttcaagctggagcacccgctcgagaggaggcaggcggaggctaaccgcataagggagaagtactctgacagaattcctgtgatcgttgagaaggctgggaagagtgatattcctgacattgacaagaaaaagtacctcgtccccgccgaccttacggttggacagttcgtgtatgttgtccggaagcggatcaagctcagtgctgagaaggcgatcttcatctttgtgaagaacactcttccaccgacagctgccctgatgtctgccatttacgaggagaacaaggacgaggacggcttcctctacatgacctacagcggcgagaacaccttcggattgctctagatggcgctggctgccacggcaatcgctctgaatgcctcctgtaaataaggcgtgccaatcaactgtgtatatattccggtttgcctcgtcgtaggatctttaaattgcacaaccaagaaaacctattcttatcctgacttatcgtatttgaatgttctgacttatatatatcaagtaagactctgaaattctgtaatttctactgctcctgcgttcatgcatgccgctgtggttacgggttgttcactgctgctgatgtaagttcacaagtaattgcctgactaaggtcnccggtactnccaaaaaa

SEQ ID NO: 28717 - DNA, 1123 bp, Triticum aestivum
  Clone ID: PAT_TA_28717
cttcaagcaagcaagcaagcagaggagagggaccgggaccgggagtgagaggaagttgagctcttggcccctgactgctggttgagatgtcgaagatggcggacgagaaggtgatctcggcgccggcgaccggcggaggggaggacgggctgatcgcaggggacctgtcagccgcggaggcgcgggtccgtccgttggagacgctgctgcgcgccgcgcctctggggctctgcgtcgccgccatggccgtcatgctccgcgacacgcagaccaacgagtacggcaccgtctcctactccgacctcggcggattcaagtacctggtttatgccaacgggctgtgcgcggcctactccctggtctccgcgttctacactgccgtgccgcggccggcgacgctgtcccgctcctggatcgtcttcctcctagaccaggtgttcacgtacctgatcctggcggccggcgcggcgtcggcagagctgctctacctggcgtacaacggcgacaaggaggtgacgtggagcgaggcgtgcggcgtgttcggcggcttctgcaggcaggcccggacgtcggtggccatcaccttcggctccgtcgtgtgctacatcctcctctccctcatctcgtcctaccgcctcttcagcgcctacgacgcacccatgccctcgctcggcaacaagggcgtcgagatcgctgccttcccgcgctgagccgagaggatccctagctgctgtggcttggctactcgatgacgggtcaaaactcaaaacacgtacgtacgtagtagtatcgctgtgtgtgtaggcgaacgaaataatctgcaagggctcatagttaatttcaagctacatatagtgcatctgcctctcttctttttacttgattctatatacactgtactagctttgaatcttctgctgtgaggctgtggtggattcattgatgcgttccaaaaatgagaacctagttccgttgcaggcacccaggtgatctatgtaactacgatgagcttcctcatttaaggagttcagttgcttgtaaggtgcttgaagcaaagcaaaatcaataccctttccgttcacaaatacgtataagatataagatgttctaaccaaaaaaaaaa

SEQ ID NO: 28718 - DNA, 784 bp, Triticum aestivum
  Clone ID: PAT_TA_28718
cccccccaccccgacgccggtcgccccaccccccaagcacgagaaaccacatcacacacacttccaccaccaccaccgcggcacgtacgtttgcgatcaaaagaaagtcgagccatatggcgaaggccgcagcgatgctcgtgctggtggcgctggtggcggcggcgatggcaacgggcggagcggcgcagtgcaacgccgggaacctggcggtgtgcgcctccccgatcgtgagcgggaccccgccgtccaagacgtgctgcaacaacctaaagagtcagcgggggtgcttctgccagttcgcgcacaaccgcgcgtactccagctacatcaacagccccaacgcccgcaagaccctcgtcagctgcggcgtccccgtaccgaagtgctaggagccgggcctccgccgccgccgccggcggcgtgctaggcagcgccacgccgcctatgctactaatacgtaacgtactaccacgtacgagctcctaccatggctactggtacgacgtccgtcgagcagctccgtgcgaaccgtgtgtttcatgtatcttttttttttctcgagtacaatcgtgtgttcatgtatcgtgcgcaagaataaaatggtgtgtacgtgtttgatccagcctctgcgtagtttgttactcctttgtcaattttgatcgatggatgtgacggacaatacttgcttaaacctagcaccctgttgccttgcttttcatccagccgctcatgtaattgatgtaccttcgacacaaagttgctactgtaatgcttcgccatc

SEQ ID NO: 28719 - DNA, 767 bp, Triticum aestivum
  Clone ID: PAT_TA_28719
aattacaaaaaaaaaaaacccaagcagccgccgccgcaaccctagagctcctccatcccctcctctcccgggcgcctccaccccccgcctagcggcgcgaagcgaccatgacgttcaagcggaggaacggcgggcgcaacaagcacggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtgcatgatggatatgttcttcccaagctgtatgccaaggtgcaccactgcgtttcctgtgccatccatgctcacattgtccgtgtccgctcccgtgagaacaggaggaaccgggagcccccgcagcgtttcaggcgcagggacgacggcccgaggcctggacagggtggcccgccccgtgccggcggccctggtgctcctggtggtgcgcctgctggcgccggtgccgttcctggtgcccctgctccccgtgtctagttgggaatgctttgtccgtgatatgcgccagccctagttttactcgtatctggatattggactattctacctagtttttgctgcaatcggttgtactgaaagttggttggtcaagcacaatttgtgatcaggtctttaatgttttgacaatttcgctgctatctatatcggagagaaccttttggtttaaaaaaaaaaaaaaaaaagccccctagggaacgagcggccgca

SEQ ID NO: 28720 - DNA, 1240 bp, Triticum aestivum
  Clone ID: PAT_TA_28720
gccgaccagtcgactcgtcactgccctctgctcgcccatacggcactgccaccgcgccattaactcgcgcattcaagccaccccgctgcgctccaactaacctccccagctccacgccttaaatgcgcgcctcccctcgtcccgattccctttctttcaagcaagcaagcaagcaagcagaggagagggaccgggaccgggagtgagaggaagtcgagctcttttcttcgtcgacgctggtttttggcccctgactgctggtcgagatgtcgaagatggcggacgagaaggtgatttcggcgccggcgaccggcggaggagaggacgggctgatcgcaggggacctgtcagccacggaggcgcgtgtccgtccgttggagacgctgctgcgcgccgcgcctctggggctctgcgtcgccgccatggccgtcatgctccgcgacacgcagaccaacgagtacggcaccgtctcctactccgacctcggcggattcaagtacctggtttatgccaacgggctgtgcgcggcctactccctggtctccgcgttctacactgccgtgccgcggccggcgaccctgtcccgctcctggatcgtcttcctcctagatcaggtgttcacgtacctgatcctggcggccggcgcggcgtcggcagagctactctacctggcgtacaacggcgacaaggaggtgacgtggagcgaggcgtgcggcgtgttcggcggcttctgcaggcaggcccggacgtcggtggccatcaccttcggctccgtcgtctgctacatcctcctctccctcatctcgtcctaccgcctcttcagcgcctacgacgcacccatgccctcgctcggcaacaagggcgtcgagatcgctgccttcccgcgctgagccgagaggatccctagctgctgtgccttggctactcgatgacgggtcaaaactcaaaacacgtacgtacgtagtagtatcgctgtgtgtgtaggcgaacgaaataatctgtaagggctcatagttaatttcaagctacatatagtgcatctgcctctctttttactttattctatatataccgtactagctttgaatcttctgctgtgaggctgtggtggattcattgatgcgttccaaaaatgcgaacctagttccgttgcaggcacccaagtgatctatgtaactacgatgagcttcctaatttaaggagttcagttgcttgtaaggtgcttgaagcaaaaaaaaaa

SEQ ID NO: 28721 - DNA, 1343 bp, Triticum aestivum
  Clone ID: PAT_TA_28721
ggtcgcccggttgaagttgctcttatttatttctacatctacttgttgtactacatggggtcgcgatggctcatgtggacgtacaccacctggtacaagagtagaagtgatgtcatctaatccaacgcatcatgactcctcgatgggcatcttgattcccttgatctcgcgcgcgagggtccgcagctcctcgacctcgtcggcggtgaggctccacccaagtgcaccggcgaactccattgcctgcccggcgttcttggcccccgggatgggcaccacgttgccctggcaggtcagccagttgagagacacctgagttggtttcttgccatagcttactccaatctctttgatcctgttcatcagcggttggagcttggcgaggaactcgggagtgtaggtattcccccgaggacccgtgggtggattctccggagtgtatttccctgacagaacaccttgggcgatgggggaataggcgatgagcgtgacgccgagctcgtcgcaggcagccttgacgccgttctcctcgggcgtcctgtagatgaggctgtagttcacctggttcacggccagcgggacgcccctcttcttgagccgcgcgtgtgcgtcccggaggcgtttctcattgtagttggagactccgacggccttgacgagaccttgctcgtacgcgtccgccaggccatcaaggtacccttcgtttccccatagccctggccagtggagctggtagagctcgacggaggggaggcccaggcgctccagcgacttcttgagcgccgagaggacgctgccacgtccgaacctccagggcagcgccgcaaacttggtggccacggtcacctccaccgcccccttctgctgcctctccctgatgaaatctcccagtaggctttctgaattcactgctcccatgagcgctgtgccgtatacttcggcggtgtcaaagaaagtcattccgttgtcgatgctggcgtcgaatgctgctttagcctccttcagtctcctgtcgtcccactcggagtcgttccagtaggtggtgtcaccccacgaccatgcaccgatgccgagcttgctcaccgccacgctggactcgcccagcctcaccttgtcctcctccgccaccttcgcccccgcacccgccctcggcggtcgcagcgccgccatcgctctcctctcctgccgccggccgtccagcgggccgaagcagcaacccacgccgcggccggcgccgacctgcagcgaagccattcctagtcctagttgcgagctccaccagctagtactgtactttgctcgctcgctcgctcgctcggctcggccgctgaggcaccagccac

SEQ ID NO: 28722 - DNA, 755 bp, Triticum aestivum
  Clone ID: PAT_TA_28722
tattcccctgctcgaaattaaccctcactaaagggaacaaaagctggagctccaccgcggtggcggccgctctagaactagtggatcccccgggctgcaggaattcggcacgaggccgcaacaaccaccaccagcaacacacacacacagagaagcgaagatgtctggccgcggcaagggagggaagggtctcggcaagggcggcgccaagcgccaccggaaggtgctccgcgacaacatccagggcatcaccaagccggccatccgtcgtctcgctcggaggggcggcgtgaagcgcatctcggggctcatctacgaggagacccgcggagtgctcaagatcttcctggagaacgtcatccgcgacgccgtcacctacaccgagcacgcccgccgcaagaccgtcaccgccatggacgtcgtctacgcgctcaagcgccaggggcgaaccctctacggcttcggcggctaggcctgcgcccgctgctccagtctccgtcgactctgactctgctagctgctgttctggtgctatgcgtttcgtttctgaatgcgtgcgtgcgtgcgttgctgttccatcggtctgtgtagttagtggatggcgatggatctgaatgcagtaagttcgtcagagtgcgtgtgttgttctatcggtctctgtagtcagttcctctgtggaaggcgatggatatgaatgcaatgggattgttggtgaaaaaaaaaaaaaaaaaggcccctagggccgcgggcgctct

SEQ ID NO: 28723 - DNA, 938 bp, Triticum aestivum
  Clone ID: PAT_TA_28723
tcacactctgtatcagtcacctcaggctctggtcgatcacggtagcactagcttcagctagccactccaggcattttcttgcatccacgacggcaatggccaccgctgatgtgcaaaacccatcggccgcgctgacggaggaggcgcccgcggtggagacgcccgtcgccgctgaggaggtcgcgaagacggaggaggtccccgcgccggcggagaccgaggtcgaggcgcctgctgcccccgtcgaggtcgtggagaccaaggaggaggcaccggccgccgccgagacggaggatgccaaggaggccgagccagcagctgcggccgagccggaggccgaggcgcccaaagagacagaggcgccagccgtggtcgagacagagaccaaggaggccgtggctgaggcagagccggcggcggccggggaggtgaaggaagaggcggcgcctgctgccgaggccgagccggccgctcccgctgctgctgaggaagcaccggtggaggcagccgcggccggcggcagaggagccggccgccgcggtggccagcgtcagcgtgtgaggcgcccagcgcgcgcggaggaggagctggctgggtcagcgtcgacggcggcggccgtgtgctcctacgtggcacggcgtgatgctgagtcagcccagtggagtggagtgctactgctttttactaggtgtggagtgggagcgctatgcgcggggtcgcgcgtgacgtgggctaaataaaagtgttgtcggggccagtcgacgcccagtgtcgggtcaagcagcgagcgagcgagcgacgcagcgccactctcgccggcacccccgtgcctgcgtctgctcagctggagctttgttgcggtgtgtgtcacagtgtcagtttccacctatgatcgatcggtatcctcctatgcggtttgtgttaataaaaaaaaaaaa

SEQ ID NO: 28724 - DNA, 671 bp, Triticum aestivum
  Clone ID: PAT_TA_28724
ccgtctctcctcctcttcgccgctcccgctcccgctcccgccgccgcgccaccgccgtcagccatggcaccgaagaaggagaaggccccggcggcgtcgtccaagccggccaagtccggcggcggcaagcagaagaagaagaagtggagcaagggcaagcaaaaggagaaggtgaacaacgcggtgctgttcgaccaggccacctacgacaagctgctcaccgaggtgcccaagtacaagcagatcacgccctccgtcctctccgagcgcctcaggatcaacgggtctctggctcgcagggctatcaaggacctgatggagagggggctcatcaggatggtctcaatccactccagccagcagatcttcaccagggcgacaaacacctgatttatcatcatcatgtgttctgtgtctgtttttagtccagtagactgaggtgttgctgttatattcaagttcactatgtccaggggggcacactgtgccaccagtaatgttgaattgcttttgagttttggtacactttaagatcgttttgtcagcgcaatgaaatctaccttatatattgccgtattgggtctttttatttgttgctgtccacgctctacggctgttcctgggcgcaactattttgttgcggtgtaggttccaagggtaggagttatcat

SEQ ID NO: 28725 - DNA, 1678 bp, Triticum aestivum
  Clone ID: PAT_TA_28725
ctctctctctcgctctctccgtaggttgtgtcgagtttgttccacttgactcgctctcccgagaagagaagggatcaaatccgcctcgaattccccgatccagcagcgcggccacaatccccacccgcatccccgcccagcgccagatccctccgtctccccgggcgcaacccagcttccagacccagcggcaccccatcaccacccccgccttcctgccagtagtagatcccttatgagctggttggctgcggtttcacttcagtttgggggctactaagatgggtcagcagctggggcagagacaagattggatcaaacctaacagctgatgacatagcgagcgccttctacttctctctcctgctctcccctgttgtctccttctgggattgcatcttccgcaagataagatactccttcagacctgagtgggtgtagcagcatttgctccaaccgcttcagcactagtcggtccgggagtaaatcagcgggcccttagggaagaaagcatctagacaggagtccaataactatgaactttgcagattttggtttcccgtaattataactggtagaggagtttagctgagagatagtagtagtcaatagcaagaagtcacagtggtcatggagaaggctgcgggcaatcaggcagggaaagtcttgaagaagggaaagaagaagcaggcggcgaaggatgagctggaccgcccagaagcaggctgagaagaagaggcgccgggctggagaaagcgctcgcaaactctgctgccatcatctcgggagctggagaagaaagaagcagcagaagaaagaggagcaaggaaaggctggacgaagaaggcgcttcgatagcccgaagcggtcgcttcttcatgtccttcataggtgaggactcccgatgaatcccgccatctgggcgcttgaacaagcacagaagcatgcaacgactgggacccctcggccgggtctggatttcgctctggacagcgcaaggcgcagccgatatctactcccccggtgggctcatgtgcgccaatcaagcttatgccttccaaggggtcatcggtggatcgactgggggcaaccgcgcatccgcctgccaaccctggggggaagtgagggacctgaaagcgtcctaccaccaaggaacgttccaccagtcgacagtcgcctgcccgggcttcatggccgcccaggccgtctcgtcgctgcagatccgagaagactcgtcctctccgggccagggagtcgccgccgcgaccgtcgttaataggatgctcggcggcgccaacgggctcaacctttacagggagatgtgaaaaaggaagatatatatatacaaccgacctcgtcgtcatagtggtgttgtacataatagtcacccgaaggtgtgctgactattttgcctgcgtgctggaagctgttccggccatcagattagaatctgatggcgcaacttgtttcgcccttttgttttcgtcggtcggtgtgataggatatgttttgcgtctgttgttattgttggtattgtaatgaaacaaatatgattttcgtttctcttgctcctaactgggttttctcctgaaaatctatatatataattcttaattgtgtgtcctcgcgaaataaaaatgtgcttgtggaaaaaaaaaaaaaaaaaactcgagactag

SEQ ID NO: 28726 - DNA, 1179 bp, Triticum aestivum
  Clone ID: PAT_TA_28726
cggcacgaggccgcggcgacggcaggcagaaaaggcgttgccgaacagaagcgtcgcgttgggcgggcgagcgagcgagccaagcatccatggcggagcgcaaggaggagtcggtgatggacaagatcacggagaagttccacggggggtcctcctcctcgtcgtcgtccgacgacgagaggaggtcggggtcctcgtcgtccgtcaaggccaagatctaccgcctcttcggccgcgagaagcccgtccactccgtcctcggcggcggcaagcctgccgacctcttcctgtggaggaacaagaagatctctggcggggtgctcgccggcgccaccgccatctggctgctgtttgaggtcctggagtaccacctcctcaccctcctctgccacggcttcatcctcaccctgggcatcctcttcctctggtccaacgcctctgccttcgtcaacaagtgccctcccaacattccagaggtgaagatccctgaggacctggctgtcaatgttgcccgctcgctgcgatacgagatcaacaggggctttgctagcctgagggcgattggtcaaggccgtgaccttgaagaaattcttgattgtggttgcaggcctgtggatcctctcttttcttggcagctgctgcaatttcctgaccttgttctacatagtcttcatggtgctttacaccgtgcctgttctgtacgagaagtatgaggacaagatcgatgcttttggagagaaggccatggttgagctgaagaagtactacgccatcttcgatgagaagtgcctgtccaagattcccaagggcccgtccaaggataagaagcagcattagaacggtagagagtaccctgcgcagatttatcttcaaagttgatcactactcgtcggttttcaaggatggttgtgattccatgtccgtagttgatagtagataccactatcttgtcaaaaacctctggcacggtcagtagtcgtgacgtgcaacttctacgaacttaaaaagtcatgccagcttttgctgaatatcctctttccaatgctatggttaacgtagcatcctcacttgcaagttgtgttggtgtaatatggcagtgatgtttgtgaccttagtagacttgctacaatgaatgaagtggctctttttggtgttatgtcattcctggggttcataacc

SEQ ID NO: 28727 - DNA, 541 bp, Triticum aestivum
  Clone ID: PAT_TA_28727
cgtccgcaccgttcctccgattccaccacatccgctcgcagctcgagatcgtcagccatgtccgggcgcggcaagggaggcaaggggctcggcaagggcggtgccaagcgccacaggaaggttctgcgcgacaacatccagggcatcaccaagccggcgatccggcggctggcgcggcgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctatggcttcggcggctaggccaccaccggatagtcgttgtttggtacagtactagcagtgttcgtggtcctcgggtctgaaaaatcgccggcatctcgctgctgtttgccctggccctgtttgttgtctggatgtactaggatggaatggaaattgcagcagtttacccttgaattcgtcaaaaaaaaaa

SEQ ID NO: 28728 - DNA, 1032 bp, Triticum aestivum
  unsure (1)..(1032): unsure at all n locations
  Clone ID: PAT_TA_28728
cattgatactgtccccttcatttactctcggagctggagtcatcaagaacacctgctgaccccagtgtgtcccaccattctcatctggggctgtattcaattcaacttcctcaactgcagggttttgcttgctacctctaaagtgaacatcaaaccacccagccaatgcagctagccttgttctatcctggttgattggcaatgtaacttgtgctctaacttctcgttcctccgattctacatctgctcgcagctcgaagaggatcgtcagccatgtccggccgcggcaagggaggcaaggggctcggcaagggaggcgcgaagcgccaccggaaggtgctgcgggacaacatccagggcatcaccaagccggcgatccggcggctggcccgtaggggcggcgtgaagcgcatctcggggctcatctacgaggagacccgcggtgtgctcaagatcttcctcgagaacgtcatccgcgatgccgtcacctacaccgagcacgcccgacgcaagaccgtcaccgccatggacgtcgtctacgcgctcaagcgccagggccgcaccctctacggattcggcggctaggccaccaccagatcagtagcctgatagtcgggtgtagtcgcagcatctcgctgctgtttgtcctgccttgtttgttctctggatgtacttctgtactaggatggaatggaaattgcagcagtttacccttgaattcgtacctagtctgtgggtctgttgatgtttgttcgtgcgcgtggtcagatgttaccagtgcgttcttcagttgtcttgctctgtaaatttcagcccccaaatctgattgtgtaggctttggtgtttggatcctattttgtggtggattcaaaccaaaccatattgtgattgggttctgtgtttggtggatagaaatcaaatcctattttctgttggtttcagtgtttggattcaaaaccaaatcctactttttgttggcttcagtgtttggggatccaaaccaaatcctatttgtgtggnctcagcgtttgc

SEQ ID NO: 28729 - DNA, 1269 bp, Triticum aestivum
  Clone ID: PAT_TA_28729
cgtccgcccctacacatctcattcccccacctcccctcccgtcccgataaggcggacagcgaccgagagaagctcccggctcccctcctctcccctctcatcgcctgggagaatccgacaagctccatccatccagaggagagggcaggaggcggaggagggacgagcggccgtgcctacctatctatctacgccgccggaatggactcggagcactggatctcgcgcctggccgccgccaagcggttctacgccgcgcagctcggccacgccgatcgggcggggatggacgagctggacatggacggcgacgagaacgcgggcaggcccgacttcgcctgcccctactgctacgaggaccacgacgtcgcctccctcgtcgcccacctcgaggaggaccaccccttcgagccccacgccgcgccttgccctgtctgctccgaaaaggtttctaaagatatgcttaaccatatcaccatgcaacatgggtacttgttcaagaatcgccgcaggttgcgcagatttgctgttccaggcagccagtcgctctctctgctgagccgggatctacgtgaagcccatttgcaggtgcttctgggaggtggtggacataggtcgagcaacaataatgccacaaatatttcagctgatcctcttctgtcatcatttggccttagcttcccaacgttagatgctgaggaaacatcaaaattgtctactcctgctcagagtgatgtaccagtgctaaaagaggcagctgctcgaccatggcggtcaagtattgactcgtcgctcacaagggaagaaagggagcaagccagagtgagagcggcatttgtgcaagacctgctgctctccaccctattcagagaccaataactcagaggcgagccgatgttaccgctacccgggtgccgcctggaccctgatgcagactccgaaaggtcggtgcccccagaccaagttgccgaatgtgacatccatggaagatagatagggtttggctccccagcaaggaaggaggtgcattagagtcgatgtgggcatgaggtgtctgtcctaagttatttgtagccggtctttgtgttgagttccatcatctcagttatcgcgatctcgcaggtgatagatgtctgcgcaggtcgcggttgtgtctgtaccgtaccgctgcttctttgtttacaagcattggtttgttgtaccagttacataataataatgaatgttgctatgcaacagcagaaggctatgcagtttatttcaaaaaaa

SEQ ID NO: 28730 - DNA, 889 bp, Triticum aestivum
  unsure (1)..(889): unsure at all n locations
  Clone ID: PAT_TA_28730
ttttttttttttccaagcaattaagaaaactttatcttaacgtccagtctcatcattaacataagataaacatagcataatccctttaactaggcatgaagcaaaatgatattgcacgggcacctcagaatccatttcatcgaccaaaagatgggaaactactagcagaaaatgtagatagataagtagacaagcagtacgccaccaccgccatacccaagaggacttctcgcagagatcaacggtaagacttctggaaacgcgcgcgggcgccacgaccgccgaacttcttgggctcgcaacggcgcgggtcggcgacgaggagcgtccggtcgtagcgggcgaagatctccttcacctccttcttggccgcctcgtcgacgtacttctggtagtaggcgacgagggacttggcgatggcctggcggatggagtagatctggctcgtcttcccgccgccgcggacgcgaatcctcatgtcgatgtccttgaagcgcgacctaccggcgagcaggatcggctcgaaggccttgaggcggagcatctcggggcggatgagctcgatgggggcgccgttgaccttgatgaggccgcggccgggcttgcagtaggccacggcgacggcggtcttcttccggccgaagcactggacggtgcccggcgtcgggcgggtgagaacggctgccatggtggctgcggcggtgtcctgggattgctgtgagcgcggtggtgtgcttggttgcggctagcgcagcggcgcggcggggttttggcctcgtgccgaattcctgcagcccgggggatccactagttctagagcggccgccaccgcggtggagctccagcttttgttccctttagtagggttaatttcgagcaggggancaaa

SEQ ID NO: 28731 - DNA, 1007 bp, Triticum aestivum
  Clone ID: PAT_TA_28731
gggtaccgggccccccctttgctcaacatccaatccttgtttcaatttccaccggacaagtcagataaaaccattcagatccaggagcactagtagtatcttacagtagtagtagcagtgccattttaaccagccagcccatcttccaggcaaacacacacacacacgcgagcctcacactctctgatcacagtaggactagcttcagctagcctgcagcgtctgccactccgggcattttcttgcatcaaccacggcaatggccaccgctgatgtccagaacccgacggccgcgctgacggaggaggcgcccgcggtggagacgcccgtcgccgccgaggaggttgctaagacagaggaggtccccgcgccggtggaggccgaagtcgaggcgcctgcccccgtcgaggttgaggcgaccaaggaggacgcaccggccgccgccgagacgaaggagaccaaggagcccgagccagcagctgctgccgagccggaggccgaggcgccgaaagagccagccgtggtcgagacagagaccaaggaggcggtggcagagtggcagaggccgagccggcggtggcagaggaggtgaaggaggaggcggcgcctgctgccgagccggaggtggcgggccgtcgccgaggaagcacctgctgctgcggaggaggagccggccgccgcggtggccagcgtcagcgtgtgaggcgcgcggtggagggcaactggctgggtcagcgtccacgacggcggccgtgtgctcctacgtggcaacggcgtgatgctgagtcagccagtggagtggactggagtgctactttttactacgagtactaggtgtggagtggagtggagtgctatgcgcggggtcgcgtgacgtggcctaaataaaagtgttgtcggtcagcatcgagcgagcgacgcagtgccactctagataatgtatgctttttattttgtcgacaagacatgattcattatttctacggaaaaaaaaaaaaaaaggccct

SEQ ID NO: 28732 - DNA, 805 bp, Triticum aestivum
  Clone ID: PAT_TA_28732
cccacgcgtccgcggaaactgtggcggaaacggtggcggtgggaacggtggcggaggaaacggtggaggtgggaacggtggcggaggaaacggtggaggtgggaacggtggcggaggaaacggtggaggtgggaatggtggcggcggaaacggtggcggcggcaacggtgggggcggaaacagcacccagtgcccgctggacgcgctgaagctgggggtgtgcgcgaacgtgctggggctgctgaacattaccctggggagcccgccggtgcagccgtgctgctcgctgatccaggggctggcggacctggaggcggcgctgtgcctgtgcacgacgctgaacctcaacctcctgggcatcaacctgaccttgcccatcgccctcagcctcgtcctcaacaactgcggcaagaacgtcccctccggcttccagtgccccaactgagcccggccggaccttgcatgctgcatccgccatacctcatgcatgcatgcatgcatgattggctatttgaagtaccaccacgtacttaattgtgcgctttgattacgtaattatctgctggtttttatgtgtggctggatttcgattgcggagaaactacgtactacttctccaggttctacgtacaagcacgcactgttacctgcgtgcgtaaggatttcgttgtgtgtgtgcatgatgtcttgtcgtaatcgtcacatgtttgtgatgagttagttattgccagagtgctcatgatgtaccgctatctccggctaaataaaagatttgctattttccattaaaaaaaaaaaaaaaaaa

SEQ ID NO: 28733 - DNA, 653 bp, Triticum aestivum
  Clone ID: PAT_TA_28733
aaaaagccggccgggccgggaccaagctcaacagcgactcccattctcccctgttagactgcttccatctcatctccggcgatgtctgggcgtggcaagggcggcaaggggctcggcaagggcggcgccaagcgccaccggaaggtgctccgcgacaacatccagggcatcaccaagccggcgatccggaggctggcgaggaggggcggcgtgaagcgcatctcggggctcatctacgaggagacccgcggcgtcctcaagatcttcctcgagaacgtcatccgcgacgccgtcacctacaccgagcacgcccgtcgcaagaccgtcaccgccatggacgtcgtgtacgccctcaagcgccagggccgcaccctctacggctttggcggctgagcgccatcagctcgctggctgaccctgctgtttcctgcgttgctctgtagtcgtatcccccctgtcgtgaatctagtgcgctggctatgcttgtttctgtagtttgtctagtgaaatccaacttctagttgtaactcctatcgtttcctttcgttgcaatgacaagttaattccaatctcagaaaaaaaaaaaaaaaaaaaaaaaaaaaaaaaaaaaaaaaaaaaaaaaaaaaggaaaaaaaaaaaaaaaaaggccccta

SEQ ID NO: 28734 - DNA, 574 bp, Triticum aestivum
  Clone ID: PAT_TA_28734
ccgcagcaacacccacacttacagagaagccaatctcgccggagaggggagcgtcgacgatgtcgggccgtggcaagggagggaaggggctcggcaagggcggcgccaagcgccaccggaaggtgctccgggacaacatccagggcatcaccaagccggccatccgccgtctggctcggcgtggcggcgtgaagcgcatctcggggctcatctacgaggagacccggggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggattcggcggctaggccacgccggtccagcagaacccacctcgcgccgccagattcactagctagccatggttgttcagtgttcattgtcttgggtgtaatggaacggccgcatctcgctgctgtctgttgttcagtgtactgtgtttggatgtactaggatggaatggaaatcgcggcgttttacccctgaaaaaaaaaaaaaaaaaaggccccta

SEQ ID NO: 28735 - DNA, 1917 bp, Triticum aestivum
  Clone ID: PAT_TA_28735
aatacgtacatacgttgattattgtgtatatacaaacaatgcggtgcattacaaacaagtattacaacagacagcgggaccgtggctagtgactgtagatgaaatagggcacgcgatggcagctgctatccagcatgcagctccaatggtattctctatgtgccacttacatatgcatgtttgcaacaatgcccgtcagaggaagaagggaaagcccttctgtgattgtgccttggtgcactctgaatttgcccatccgatctgcctccgctcattgtcatgcacaactagtttgccgcgcagagaaacatctccgactattatggttgacccatgattgatctctgttccatttagcagccccagacaaacattgcccttttcactgatgatcaagtaatcatcgggaacaatggtgaatgttttcggcacgacaaaccatcttctcccaaaatgaaggttcaagggcttgaagaaggacctaacagaaaaatcagctttccagcataaaggtaatgtcgtatctgagctatcttggacaaaattgggagagtcatctttaatagcatcaataaggtttttatacatctcctctggaaggtatgtatacgagctcccactatcaaaaatcacttgaacagaatttcctgcgtgcccgtgcatactgagctcctgatctccataatttactttctgggcctctgtgtggtataagttatctggaccacctcgaataggagcccatgtcattccccatcttggtacataatcatcacccagaaaacatgtaccccccaccatttgtttctctagtgatacaatgaccgaaaatgttggaaataattcctttgctggccagctgactaggaaggcttattgctgcactgctaagaccaagaatcccatcggtctttgctggtgaggacaaaagctggccttgctgatcatatgcacacccaaatacaaagtctagcttttcctttccaccatttgtagcgattagatgcatatcatccttcgcaagaacacccatagacgagcttctatcggcatattcaatctcatagtcacattgcttgcaagtttcgcagtagttctgatcgccttgcaactcttgacatagcaaatccctgggagggactatcttttcttttgctggcttatataaaggatgaggtccttgggcacagtttgtgcatggtgcgtcacactgaatccatgttaaatcgcttccagtatcaacatcaaggaaataaggtcttggtggattgccaacaaagatagatgtgtaatactgcccatcagggaacacattgcccttgatcgggagcagaaccgtggagttagtcccagccgatgtcgcccccttgacatccagcttcttcgtgaccttcctgccgccgccgtcatcgaccctcttggcggcgagcttgatgttgccgaattcccgcagcgcgcggccctggtgcgccttggggtagagctggaagaggaacgacttggtctcgttccgctccttctgcgcctcctcctcctccatcccgaggaactgcacggccacgtccgagtagaagctgtagtaggccgcgagcgcgagcgcgcccagcacgagcaccatcgcccccgcgcgccgcgagaccgcccgcctcgatcgcctggcctccctccccgcggtagccatcggaggtccccggttcagcggcggggccggagcgccggcgcccggctcgtcggtgtaggtgaaggcggtgatggtcttgcccttggagggctggtcggggggcgggagggtgatgatgaacacgccgtggagctgcgggggagggggcggcggcggcggcatcggcatctccggtcgagatcccggcggcgctccggcggggcggggtcagaggcggcggggagggcaggccatcg

SEQ ID NO: 28736 - DNA, 953 bp, Triticum aestivum
  Clone ID: PAT_TA_28736
ttttgaccaataggcttggttttaggtactttgttcaacattttcaatctaaatagttgggggctgtccaaaatgaacacaattctttcccagccagcaaacccatcaaagcatccaaatggaaagccacacatatcatgacacgacagagattttacttaatggataacgaaacgtcaggtagaacagactacccagacccaacggacttgacatggcaagagtacattcatacgagttcaacaggggcacgacggcctcaaaagtccattcacttcgtcacggggtggggtgatactttggctggttatttaggtgataacggttcttgggctcggcgcatccatggtcaccagctggccgtccaggctctagcccatggcgtacttctgcgtccaggagcgcgccgtggactcgtacttggcccgatcagtcttgtacatgtgagcgatctcgggcaccagaggatcatcggggttcgggtccgtcagcaacgaacagattgacagcaggacctttgatatggtcaaagccgggctccactgttccttgagaatgtcaaggcaaatgctgccgttgctgttgatgtttgggtggaacaccttggtgcggaaagagaccttcgggggcttgaaggggtaatccggtgggaaatgaatgttcaccaaaaataggccaccggtgaacgggctgtccgagggtcccatgatagtggcctgccagtggaacatgtcctcacctacaggacctgcgctgcacgaggtgggagggtccttctgcaggtccttgagctccttgaggatcctcttggacgccatgggatcaaacccggccggcgggggcgcgggggcggcggcggcggcctctcccctctgcggcggcggcgggcggcggttggggaccacggggcaagaggagggggcgagaaggagtcggagcccgacccggccggc

SEQ ID NO: 28737 - DNA, 940 bp, Triticum aestivum
  Clone ID: PAT_TA_28737
gcaccaaagctcccagcttttttccccttcctccgccgccgcgactagagtttcctcgctagggtttcgtctcccggtccggatccagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgatggggctgccgccggagccggagccggagcctcggacgccgcccccgccgcccccgccgaggacctcaagaactgggacgccgagttcgtcaaggtcgaccaggccaccctcttcgacctcatcctggctgccaactacctgaacatcaaggggctgctggacctgacctgccagactgttgctgacatgatcaagggcaagaccccagaggagatccgcaagaccttcaacatcaagaacgactttacgcccgaggaggaggaggagatccgcagggagaaccagtgggcctttgagtagaggagcatctaggcaggcgatgccgccgccgcgttgaatgaacgaacaacgcttagtattcgtcatgtctgcatttcagcgctcttctttatgtctgtcgtaatgggttgtaattatcctggagtctatgaggtggtgtcggtgaacatgttcggtcagtggttatgtttgcgacaacaagaaaaacctatcgtggtcagtggtcatcacttgtcaaactgaatcttaatcgtcaagtggaatgctttgcttgtttatcaccaacaaaaaaaaaaaaaaactccaggggggggccccgggtacccaatt

SEQ ID NO: 28738 - DNA, 964 bp, Triticum aestivum
  Clone ID: PAT_TA_28738
ggtcaggcgggactacccgctgagtttaagcatataaataagcggaggagaagaaacttacaaggattcccctagtaacggcgagcgaaccgggagcagcccagcttgagaatcgggcggctgtgccgtccgaattgtagtctggagaggcgtcctcagcgacggaccgggcccaagtcccctggaaaggggcgcctgagaggggactagagccggagcggggaggaagaagacatggcggcggcggcggcgaggaagagcgtgtgtgttaccggcgcaggagggcttcgtcgccgccgcctcctctcttcgccgctcccgctccgccgccgcgccaccgccgtcagccatggcaccgaagaaggagaaggccccggcggcgtcgtcgaagccggccaagtcgggcggcgggaagcagaagaagaagaagtggagcaagggcaagcaaaaggagaaggtgaacaacgcggtgctcttcgaccaggccacctacgacaagctgctcaccgaggtgcccaagtacaagcagatcacgccctccgtcctctccgagcgcctcaggatcaacgggtcactggctcgcagggccatcaaggacctgatggagagggggctcatcaggatggtgtcaatccactccagccagcagatcttcaccagggccacaaacacctgatttctagtccagtagactgagatgtcgctgttatattgacgttcattatgttcagcgaggcactttgtgggtcttgtcttgcgctcgtgccactagtatgtttgaattgcttttgagtttttggtacaatctaaagacgcaatgaaatctaccttatattatcaggctctgtttgtatttgttgctgtctcggttttcatgtttcttcagctatatgaatgttccatccggtagtataattgaaccttgattatagctgcatagtggcccctagttgcgagggtaatg

SEQ ID NO: 28739 - DNA, 619 bp, Triticum aestivum
  Clone ID: PAT_TA_28739
ccggagggaagagagaaaagagaaagctagccgcctttgggccatggcggagttcaagcacctttgcatggccaagttcaaggaaggcgtcgtggtggacgacatcatccaggagctcaccaagctcgccgcggagctcgacaccgtcaaatacttcgggtggggcaaggacgtgctgaaccaggaggcgctcacgcagggcttcacccacgtcttcgtcatgaccttcgccagcgccgaggacctggcggcgtgcatgggccatgagaagcactctgcgttcgccgccaccttcatggccgcgctcgacaaggtcgtcgtcatggacttccccttggtcttcgtcaagccagcgccgcctgcctgatccgcctccagtatctctaccaagcatggatgtgccaactatctatctatctgctgcagctctggtgtagtgtaggagtacctgagcctcctttctctgcttcagtgtttagctggtgcagctgcctgcctgtaagactgtaatgccgcgtgttcccttgaaaagttgtttggttacccacccttgaataaacttgtgcgattttcatttgtttttcaaaaaaaaaaaaaactcgagactagttcacctcgg

SEQ ID NO: 28740 - DNA, 627 bp, Triticum aestivum
  unsure (1)..(627): unsure at all n locations
  Clone ID: PAT_TA_28740
gaccgctgcaacaacgcaccaccagcaacacacacacacacagcagccaagagaagctcgccggagagagaagagtcgacgatgtccggccgcggcaagggagggaagggcctcggcaagggcggcgccaagcgccaccggaaggtgctgcgcgacaacatccagggcatcaccaagccggcaatccggcgtctggctcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctgaagcgccagggacgcaccctctacggattcggaggctaggccgcgcctgcccactcgaatccacctcgcgccaccgcattagtatctagctatgaatgttcagtgttgatggtcttcggtgtaatggaatggccgcatctcgctgctgtctgttgtttcgatgtactgcttgtgtgtaatggaaatctcagcattttacccttgaattcgtctgcaatctcttgctctgctgttaaatcttagcagtgcgctttgttaanananaaaaanaaa

SEQ ID NO: 28741 - DNA, 885 bp, Triticum aestivum
  Clone ID: PAT_TA_28741
attttgtgcaatacttgctactagaaatgacggccatatcattcacagattctaaataaagctgcattttacctattcaactaaatatcaaatcgcaaacagttaagctcaaacagaacattcagtttcatcattaacataagattatgatagcaaaaccccttcgtcaactaggcaggatactgcagacaactcacagttcttagagatcatatccaattcattggttcaaaagaaaacaaactactagcggtaaaaggtagatagataggcaggcaaggagtaggccaccgccgccatacccaacaagagatctcgccggagctcaacggtacgacttctggaaacgcgcgcgggcaccgcgaccgccaaacttcttgggctcgcagcggcgcgggtcggcgacgaggagcgtccggtcgtagcggccgaagatctccttcacctccttcttggccgcctcgtcgacgtacttctggtagtaggcgacgagagacttcgcgatggcctggcggatggagtagatctggctcgtcttccctccgccgcggacgcggatacgcatgtcgatgtccttgaagcgggacctgccggcgagaaggatcggctcgaaggccttcaggcggagcatctcggggcggatgagctcgatgggggcgccgttgaccttgatgaggccgcgcccgggtttgcagtaggccacggcgacggcggtcttcttccggccgaagcactggacggtgcccggcgtcgggcgggtgagaacggctgccatggtggctgcggcggtgtgcttggttgctgtgagcgcggcggcgcaggttagggtttttggtggcggcgcgtagaggggatcacggcggcgagagaacctcgtccgaatcg

SEQ ID NO: 28742 - DNA, 802 bp, Triticum aestivum
  Clone ID: PAT_TA_28742
ctgtgcggcgctcaggcggcgggtccgaaaaaaaaaaaaaaaaaaaaaaatacaacgctacccccaatccccagcctccagatccacccgccgccgccggcctccccgtcgcttcccgtcccccgcgcgccccagccagccaggatgacgctagaagaagcaccattttacccacgcaagaagctcgttcagaagcagcagtatttccagaagctgagcaagcatatccaccttaaaggccgctatgatgtggtcacctcagttgccattccccttgcgcttgctggcaccagcttgttcatgattggtcgtgggatccacaacatgtctaacgggattgggaaaaaggagtgaaattctgtgggttttgctagtatctcagtacgcggcggcatggcagggataccgtccaagctatgacgtcttcttcgtatgcaaataatattgtcagagaaagactcagttcatttccagttcccttttgttggtatttgtggatatttgatgtcagcaaattgatgttaaactggcaatgatgattctataacatcggcatcattatcctttcagtccaataatatacaggaaactcttcgggcgggggcccggaccgcaatgcctcctatactgaggcggattacaactaactggacgatgtcttacaacgtggtgactcggaaaaccctggcggtacccaacttaacagacttgcaacacatacacctttcgtcagctggcaaaatagaggataggcccagaccgatcggcctttccaacagttgctcatcctgaatggcgaatg

SEQ ID NO: 28743 - DNA, 622 bp, Triticum aestivum
  Clone ID: PAT_TA_28743
gccggccggtttgggatctcttctcctcctccccgccgccgccgccgtctcctcctactcttcgccgctcccgctcccgccgccgcgccaccgccgtcagccatggcaccgaagaaggagaaggccccggcggcgtcgtccaagccggccaagtccggcggcggcaagcagaagaagaagaagtggagcaagggcaagcaaaaggagaaggtgaacaacgcggtgctgttcgaccaggccacctacgacaagctgctcaccgaggtgcccaagtacaagcagatcacgccctccgtcctctccgagcgcctcaggatcaatgggtctctggctcgcagggctatcaaggacctgatggagaggggactcatcaggatggtgtcaatccactcaagccagcagatcttcaccagggcgacaaacacctgatttatcattatcatgtgttccatgtctgtttttagtccagtagactgaggtgttgctgttatattcaagttcactatgtccaggggggcacactgtgccaccagtaatgttgaattgcttttgagttttggtacactttaagatcgttttgtcagcgcaatgaaatctaccttatatattgctctatttgctg

SEQ ID NO: 28744 - DNA, 694 bp, Triticum aestivum
  Clone ID: PAT_TA_28744
ctctccccaacccaccgccccgttcccccgtctccccgccgcctcctcctcctccgcgtcgcaaaccctcgcccaaatccgccgaatcccgcggcccaggaaccaaggtagatcgatggcgaagagctcgttcaagctggagcacccgctcgagaggaggcaggcggaggctacccgcataagggagaagtactctgacagaattcctgtgatcgttgagaaggctgggaagagtgacattcctgacatcgacaagaaaaagtacctggtccctgctgaccttacagttggacagttcgtgtacgttgtccgaaagcggatcaagctcagcgctgagaaggcgatcttcatatttgtgaagaacactcttccaccgacagctgccctgatgtctgccatttatgaggagaacaaggatgaggacggcttcctctacatgacctacagcggcgagaacaccttcggattgctctagatggcgctggctgccacggcaatcgctctgaatgcctcctgtaaataaggcgtgccaatcaactgtgtatatatctggtttgcctcgtcttaggatctttaaattgcacaaccaagaaaaacctattcgtatcctgacttatcctatttgaatgttctgacttatatatatatatatcaagtatcgactctagaaaaaaaaaaaaaaaaaaggccccta

SEQ ID NO: 28745 - DNA, 1014 bp, Triticum aestivum
  Clone ID: PAT_TA_28745
tcggacgaggctctgcctgtcccctacacatctcatctcattcccccacctcccgtcccgataaggcggacagcgaccgcgcgcgcgagagagaagctcccggctcgcctcctcctccctcccctgtctcctctcccggctccatccatccagcgggaggagagggcaggcggaggagggacgaccgccgcaggccagaggccgtacctacctacctatctatctatctatctatctaagccgccggaatggactcggagcactggatctcgcgcctggccgccgccaagcgattctacgcggcgcagctcggccacgccgatcgggcggggatggacgagctggacatggacggcgacgagaacgcgggcaggcccgacttcgcctgcccctactgctacgaggaccacgacgtcgcctccctcgtcgcgcacctcgaggaggaccaccccttcgagccccacgccgcgccttgccctatctgctccgaaaaggtttctaaagacatgcttaaccatatcaccatgcaacatgggtacttgttcaagaatcgccgcaggttgcgcagatttgctgttccaggcagccagtcgctctctctgctgagccgggatctacgtgaagcccatttgcaggtgcttctgggaggtggtggacataggtcgagcaacaataatgccacaaatatttcagctgatcctcttctgtcatcatttggccttagcttcccaacattagatgctgaggaaacatcaaaattgtctactcctgctcagagtgatgtaccagtgctaaaagagacagctgctcggccgtggcggtcaagtattgactcgtcgctcacaagggaagaaagggagcaagccagcgtgagagcgatgtttgtgcaagacctgctgctctccaccctattcagagaccaataactgagaggcgagccgatgttaccgctacccgggtgccccctgtacctaatgcagacttccgaaggtcggtgcccccaagacaagtggg

SEQ ID NO: 28746 - DNA, 1023 bp, Triticum aestivum
  Clone ID: PAT_TA_28746
gagaaaactttacctgaacgtccagtctcatcattaacataagataaacatagcataatccctttaactaggcatgaagcaaaatgatattgcacgggcacctcacaatccatttcattgaccaaaagataggaaactactagccgcaaaaggtagatagataagtagacaagcagtacgccaccaccgccatacccaagaggacttctcgcaggagatcaacggtaagacttctggaaacgcgcgcgggcgccgcgaccgccgaacttcttgggctcgcagcggcgcgggtcggcgacgaggagcgtccggtcgtagcgaccaaagatctccttcacctccttcttggccgcctcgtcgacgtacttctggtagtaggcgacgagcgacttggcgatggcctggcggatggagtagatctggctcgtcttcccgccgccgcggacgcgaatccgcatgtcgatgtccttgaagcgcgacctaccggcgagcaggatcggctcgaaggccttgaggcggagcatctcggggcggatgagctcgatgggcgcgccgttgaccttgatgaggccgcgcccgggcttgcagtaggccacggcgacggcggtcttcttccggccgaagcactggacagtgccaggcgtcgggcgagtgagaacggctgccatggtgtctgcggccgtgtgcttggttgctgtgagggcggtggtgtgcttggttgctgtgagggcggtggtgtgcttggttgcggcagtgcggcggcgaggaagatcttgagcacgccacgggtctcctcgtagatcagcccggagatgcgcttcacgccgccccgccgcgccagccgccggatcgccggcttcgtgatcccctggatgttgtcgcgcagcaccttcctgtgccgcttcgcgccgccctttcccaggcccttgcctcccttgcctcggcctgacatggctggcgacgcttgctggctgctgtcccgaaggtgggattggaggggattggggattcctcgtgccgaat

SEQ ID NO: 28747 - DNA, 983 bp, Triticum aestivum
  Clone ID: PAT_TA_28747
cgcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcagctgcggccgaaccggaggccgaggcgcccgccgtggtcgagacagagaccaaggaggccgtggctgaggcagagccggcggcggccgaggaggtgaaggaagaggcggcgcctgctgccgaggccgagccggccgctcccgctgctgctgaggaagcaccggtggaggcagccgcggccgcggtggccagcgtcagcgtgtgaggcgccagcggcgcgcggaggaggagctggctgggtcagcgtcgaccggcggcggccgtgtgctcctacgtggcacggcgtgatgctgagtcagccagtggagtggtgctactttttattaggtgtggagtgggagtgctatgcgcggggtcgcgtgacgtgggctaaataaaagtgttgtcggggccagtcgacgcccagtgtcgggtcagcagcgagcgagcgagcgacgcagcgccactcgccggcacccgtgtgcctgcgtctgctcagctggagctttgttgcggtgtgtgtcacagtgtcagttccacctatgatcgatcggtatcctatccggtttgtgcacgtctctggaggatgatctccagctaacttaccactttaccgatccatctagacgaataacgtaggcgtatatatagatccggcgatcgccggcgccggtggcttcttccttggtttattca

SEQ ID NO: 28748 - DNA, 1182 bp, Triticum aestivum
  Clone ID: PAT_TA_28748
ggcacgagctcagtgtcagtgtcggcccagcagagtgctttcgccgttggtgttctttccgatctcaatgcatttcaccgctccaccggaactcattcctcctaccacctcggcaccaccagcccaagcagagccatggcgcccaacggagacaacaccgtggccaacgtccacagcggcatcgacagcaccaacaagacgctgctcaagagcgacgccctctacacctacatcctcgacaccaccgtcttcccccgtgagcacgagtgcatgcgcgacctgcgcctcatcaccgacaagcacccatggggctacatgcagtcgtcgtcggacgaggcacagctgctggggatgctgatcaagatggcgggcgccaagaagacgatcgaggtgggcgtgttcacgggctactcgctgctggccaccgcgctggcgctcccggaggacggcaaggtggtggccatcgacaccgaccgcgagtgctacgaggtgggccgccccttcatcgagaaggccggcatggcgcacaaggtggacttccgcgagggcaccggcctggcgcgcctggacgagctgctcgtcgaggacgagggcgcggccagctacgacttcgcgttcgtggacgcggacaagcccaactacgtgcgctaccacgagcagctgctgaagctggtccgcgtcggcggcaccatcatctacgacaacacgctgtggggcggcacggtggcgctgccggcgggcacgcccatgtccgacctcgacacccgcttctccgccgccctcagggacctcaacgccaagctcgccgccgacccgcgcatcgaggtctgccagctcgccatcgccgacggcgtcaccatctgccgccgcctcgtctaggcgggcgggcgtccggcccggcccgtcccggcgtgatcgtgatccgccgcgcgcctgccggcctgcgtgcgtgcctggagtccatttccttaccagccgcttatcctaatcaattgtattatttttccctgccagcgctggtttagcgtgaagcatccgatggtttcgaattttcaataacttttttggcttttcaactttgagaggagtggctgtacttactgtactatatatggtgttccgatatgcgatgacgttgtcgtgcatgtgaaaaaaaaaaaaaaaaaaaaaaaaaaaaaaaac

SEQ ID NO: 28749 - DNA, 914 bp, Triticum aestivum
  Clone ID: PAT_TA_28749
aatcgcgccgccgctcgagcccctctcgcccttcgcgccgccgctgctgcaggcaaccgccgccgccgtcgccggagctaaacccctcgcctgacgccatggggcgcatgcacagccgcgggaagggtatctcgtcgtcggcgctgccgtacaagaggactcccccgagctgggtcaagaccgccgtcgctgatgtcgacgagttgatcacgaaggctgcgaagaagggtcagatgccctcgcagatcggcgttctcctccgtgaccagcacggtatccccctcgtgaagagcgttacgggaagcaagatcctccgcatcctcaaggctcatggcctggctccggaaatcccagaggatctgtactttttgattaagaaggctgtcgccattaggaagcatcttgagaggaacaggaaggacaaagactccaaattcaggctcattcttgttgagagcaggatccaccgtcttgcccgttactacaagcgcaccaagaagctcccgcccacctggaagtacgagtctaccactgccagcactctggtggcttaggagggctcttcatctggtgtgctcttaccggcttcaggatggtcttgttctacatattatcaatttcatgtaacgcttttgagtttggagcgatttagatgaacaagagaccaaattttctatgtttacttggagaatcccataaaccatttttggttttgcaattctgtctggttctgtttagcgtctatctacaattcatcagttaaaattagacattgtgatattcgtgttgtctgatctgagtgagtgtaatcgctgctttcagtgcactcaagcttggacagtttgactatatggttatcctgaaatctaaaaagtggctgcgcactttttggtcgaaccgagcggccggctctc

SEQ ID NO: 28750 - DNA, 1272 bp, Triticum aestivum
  unsure (1)..(1272): unsure at all n locations
  Clone ID: PAT_TA_28750
taccgcccacacgtgcgcccacgcgtccgacacaattcaacactagctagctgcacaggacacgagccgatccatccatccagaaaaaaaaagagtgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcggcgcgacgacgccggcggggctgatcgcggcggcgctggcgcacgcgttcgcgctcttcgtggccgtgtccgtgggcgccaacatctcgggcgggcacgtgaacccggccgtcacattcggcgccttcgtgggcggcaacatcagcctgctcaaggcggtggtgtactgggtggcgcagctgctcggctccgtcgtggcctgcctcctcctcaagatcgccaccggcggcgaggccgtgggcgccttctcgctctccgccggcgtcggcgtctggaacgccgtggtcttcgagatcgtcatgaccttcgggctcgtctacacggtgtacgccacggcggtcgaccccaagcgcggcgacctcggggtcatcgcgcccatcgccatcggcttcatcgtcggcgccaacatcctcgccggcggcgccttcgacggcgcctccatgaaccccgccgtctccttcggccccgctgtcgtcaccggcgtctgggagaaccactgggtgtactggctcggccccttcgccggcgccgccatcgccgccctcgtctacgacatctgcttcatcggccagcggccccacgagcagctccccaccgccgactactgaaaacctcactctcaatctcatccatccatcaccgccatgagagattgaaatcgattcaaaaaattccagcaagtgtacgtcgtcgtgtcatcatcagtaagccagtttagtttcattctctctccctctctctcacgtgtctttgagaaattcagggtaaacagtgtgagtcaagtcagtcaaggaataatctcttgtcttgggtgtatgtcctcaattatgaatgcttctattccatggtcaagattgatgtttgtacaaaggtattgtctgtcctggcaacttgatgtcttgccaatcttgtgtccatattttctgtagattttgtcctgtcccgacatgatatgtatggtaagcattggtgattgtgatggatgggaagaaattgacagttcaagaanaaaaa

SEQ ID NO: 28751 - DNA, 2254 bp, Triticum aestivum
  Clone ID: PAT_TA_28751
ggatccaccgcctcgctcgctactacaagcgcaccaagaagctcccgcccacctggagaggaacaggaaggacaaggactctaagttcaggctcatccttgtggagagcaggatccaccgcctcgctcgctactacaagcgcaccaagaagctcccgcccacctggaagtacgagtctaccaccgccagcactctggtggcttaagggagatccagatctggtgtgctcttagctgattaaagcttgattgttctggaaaccattcttatgtaatgctttatgatagtttggagccaagcagatgctgcaaattttctatgtttgcctggaggatgctgtaaaacctttatggtttcactgttctgtctgttaaacgactgttataatgtacccagattttgattttttttttttttttttttttcatcagaatttatttatcaaagcactattttaggaacagagacacaaaacggtgaaacaaataagctcaaacgctgataagatttttcatgacctaagaagaattacaaatgcaggatcaacttattccccagccccgacacgctttgataattttgagaacaatggtggcagctacacaatttgcatgagaaatagttacacggtgtctttggagagccagttaagcgagggcacccctcgggcattcgtcagctcatccaccgcatctccacgctcgaaaacggcggccgcacccatcccggaacctatgcacatagaaatcactccaaaccggcagtccttgcctcggcgtttcatctcgttgagaagagtgctgacacatcgcgcacctgtggcacccaatggatgtccaagagcaattgcacctccattaacattgacttttgcgggatcgagatccaacttttttgagcagtacacatactgagatgcaaaagcctcattaatctcaaagaggtcaacatcattaatttgaaggcccgcggccttcactgctgctgggatagcaacagcaggaccaacacccatcacagctggatcaactccaactgcagcaaagctcctgtagattccaagaattggaagacccttctgtgtagcaacatctcgcctcattagtaggacagctccagctccatcacttacttggctagcatttccagcagtagtggtcccgtccttggaaaatgctggtttaagttttgacaggactgccagtgtggtattcgaccggattccatcatctgctgagaccacaatctccttttcttcaccagtttttggatccacgatctttgtattaactggaactatttcttctttaaatttaccagcagcaactgccgccgctgccttcctgtgagactcaacagcagcttgatcttgctccatgcgtgttatgccaaaccgctgtgcaacattctcggaggtaaggcccattgggagaaggcaatcacgtgcttgagcaaatagctcaactttgggattcactttctcgacaagattaactttgttcactgtcatcgactctacgccagcagcaataccaatatcatacatccctgctttaatagcagcagcaacatctgcgactgcctgaagcccagaagagcactgtcggtttacagtcttcagaggaaccgtgtcagggaaacccgcatacaatgcggccatcctgcattctattgccctttgggacccaggagctaaaacagtaccaacaacaatgtcgccaacttcgctcggatttaactttgttttatccaccaaagccttgaataccggtaccaagagatcctcagggagtgtatccttgaaactacctctcttggccttgcagattgctgtcctataggcagcgacgatgacgacgtcgtcggcgaagcaggggccccggtggtacgcggcgctgtcccccgcggcgcacgcgctggcggagacggcggaggcggccgggctggcgccggccgcgggctccaggtgccgcagcaggatcctctgcctgtcgagcgccttctccattgctggctgctgtctcaaccttgcctccttccttccttcttcgctgcctctcggcgtcctccctgtcacgggaggaattggtggttaatggtgcgaatggttggttggtcggtagtctgctgcgcgcgctgggtggcgacggggcgtgtggtatttctagtcaggtaaaggagcccctgaaaaaaaagtagaggaagaggagggggaatttcggaggagctcactgcgactttggtggggtggaga

SEQ ID NO: 28752 - DNA, 892 bp, Triticum aestivum
  Clone ID: PAT_TA_28752
gccggccgggttcaaatacaatcgccagcaattattattttcctcacgaacccctctctccccacttaccaactccggctcccaacgcccaaagcctccgcatccagagctccaaaccctaggcgaggcgaggcgaggcgaggcgaggaggcggcgcggcgagggagaggccatggatcccgattcggtgtcgaaggcgttcgtgcagcactactaccagacgttcgactccaaccgcgccgcgctggtggggctgtaccaggacggctccatgctcaccttcgagggcgagaagttcggcggccccgccgccatcgccggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgctgccagctggagggagcttctacgtgcagaacgacatgttccgcctgaactatggttaaggaagggcgactctggcagcaaagaacttgttcagggatttatgttgaaacaatgaacatcaaatgatgatgctgcagactctttgtttgttcgccaacctgtgcaatttatcgcaaaaaattgccttgataggcatccaccagatcatcttttgttttgtgtttcccatgtattgtcgttgcttgggtggcactttctttggaatgttgatggaaaccgtccaggtattagttatgcgtggcatctctgggttttgtttgtgaccatttaagttcacttttgcatgtcccaaaagtttcttcccttgctcagttaatattcttaaagtgttttttcaaaaaaaaaaaaaa

SEQ ID NO: 28753 - DNA, 941 bp, Triticum aestivum
  Clone ID: PAT_TA_28753
cccaaattgtgagagcatctaatggcggagtacggtggagggtacgggcacccgtacccgcgcgtcgacgagtacggcaacccagtgccgccggtcgaccagtacggcaaccccatcccgagggaaccgggccaggttccggcgtacagctcggggggcgcctctccgtcctatggctctgccggcgcggtgacgtcggccgactatggcgcgggtgtcacgccgggctacggcctgagcggcgccgtgcacccacacgagagcgtggtaggcggtgccgtttccccgtccggcgcggcgcacacgcacgagggcgcgctaagcggcggcctcgcccctggcgagacaactgcatacgcttatgagggcatggtcggcaggggcatcagcacgggcgaccagatccagcccaccaaagaggggcacacgacactgggcgagactttgcggcgctcctccagctctagctccagctcgtcgtccgaggatgacgggcaaggcgggaggcagaggaagaagaagagcatgaaggagaagataaaggagaagctcccgggcaaccacaagcaggaggagcacaaggccgggcacacggtgccggcggctgggacagggacgcatgagaagaagggcatcatggagaagatcaaggagaagctccctggacaccactgagcaacgttaacgtgtgcactgcacgcctcagtttcgctttcttggaccatgtacgacttatgtacgacctaaatgatcactggctcgtgtataatgagctcgctagccttatgtataatgatcgagggtatttccttctgccttcttcgtgtatgatcggtgttgataggttgtacgagctagatttggggtcgtttgagttggtgtatggctaatgtctgtgctactggacaagtcgagttctttccttcctcacaaaaaaaaaa

SEQ ID NO: 28754 - DNA, 757 bp, Triticum aestivum
  unsure (1)..(757): unsure at all n locations
  Clone ID: PAT_TA_28754
gccacccccaacccaccggngcataccaaggcggcgccgcggcgacctcacctcctgccaagggaaatgactaccgttccggggtctctggtctgggagctggtgaagaagaacaactgcttcttgatcaagcagttcggcaacagcaacgccaaggtgcagttcagcaaggagcccaacaacctctacaatgtccactcctacaagttctccggcttggcgaacagcaagaccgtggcggtccagccctctgcaggagaggacaaggctgtcgtcctgtccacgaccaagaccaagaagcagaacacccctgccaagctccagcacaagactctgatgcgcaaggagttccgcaagatggccaagtccgtcaagaaccaggtctgcgacaactactacaggcctgatctgaccaagccggcccttgcaaggctgagcgccgtgtaccgcagcctccaggtttccaagtctggaatcaagaagaagaacaggcagccaactaagctgtaaactcattgagattgcctttcagtgcacatgttaccatgtctgttccgacagttttgagtcataagtgagacccttggaggaaccatgttacaaacccgccctagtttgtaccctgacagtgttagaaggatggtttgtgtcgatctataattattgtttgatttgcactggtgatcgctgcttgttaaaaaattgtggtgccctgctgttggatttgcacatgctgcatcttctattaaaaaaaaaa

SEQ ID NO: 28755 - DNA, 1079 bp, Triticum aestivum
  Clone ID: PAT_TA_28755
actaaagggaacaaaagctggagctccaccgcggtggcggccgctctagaactagtggatcccccgggctgcaggaattcggcaccagaagctcccagctttttccccttccgtccttcgtcgccgccgctctagggtttcctcttcccgatccccgatccagcagcagcagcagcgagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgcggccgccgccggagcctcggacgccgccgcccccgccgctcccgcggaggacctcaagaactgggacgccgagttcgtcaaggtcgaccaggccaccctcttcgacctcatcctggctgccaactacctgaacatcaaggggcttttggacctaacctgtcagactgttaccgacatgatcaagggcaagaccccggaggagatccgcaagaccttcaacatcaagaacgactttacgcccgaggaggaggaggagatccgcagggagaaccagtgggcctttgagtagaggagcatctaggcgatgccaccgccgcgctgaaagaactacgcgtagtattcgtcatgtctgtatttcagcgctcttctttatgtctgtcgtaatgggttgtaattatcctcgagtctatgaggtggtgtcggtgaacatcttcggtcagtggttatgtttgcgagaacaagaaaaacctatcgtggtctgtggtcatcgcttgtcaaactgaatcttaatcgtcaagtggatgctttgcttggttatcatcttcctgttctgattgttgctgtgttatttgagcttctttgttgaagcttaatgtgttggatgctggttctttaagattggaaacatttgcagatttctgttgagctaaaaaaaaaa

SEQ ID NO: 28756 - DNA, 1037 bp, Triticum aestivum
  Clone ID: PAT_TA_28756
ttcggcacgaggcagtagtcatatgcttgtctcaaagattaagccatgcatgtgcaagtatgaaccatttgaactgtgaaactgcgaatggctcattaaatagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattccagcatttgccttgacattctcaaggaacagtggagcccggctttgaccatatcaaaggtcctgctgtcaatctgttcgttgctgacggacccgaaccccgatgatcctctggtgcccgagatcgctcacatgtacaagactgatagggccaagtatgagtccacggcgcgctcctggacacagaagtacgccatgggctagagcttgacggccagctggtgaccatggatgcgccgagccagaaccgttatcacctaaataaccagccaaaagtatcaccccaccccgtgacgaagtgaatggacttttgaggccgtcgtgcccctgttgaactcgtatgaatgtactcttgccatgtcaagtccgttgggtctgggtagtctgttctacctgacgtttcgttatccgttaagttaaatctctgtcgtatctatatatgtgggctatccattgca

SEQ ID NO: 28757 - DNA, 791 bp, Triticum aestivum
  Clone ID: PAT_TA_28757
tctctctctctctctctctctctctctctctctctctctctctctctctctctctctctctctctctctctctctctctctctctctccacgaaccccgggacgaagcagatcggcggcgcgtcactccaatcaccggttaggataaatggcgacggtttcggattctctggtctgggagcttgtcaggaagaacaactgcttcctgatcaagcagttcggcaacagcaatgccaaggtccagttcagcaaggagcccaacaacctctacaatgtccactcctacaagtactctggcctggcaaacaagaagactgtgacggtgcagccagctgctgagaaggagatgactgtggtcctctccacaaccaagtcaaagaagcagaacaagcctgctgcgttcacccacaagactgtcatgcgcaaggagttccgcaagatggccaaggctgtcaagaaccaggtcagtgacaactactacaggcctgacttgaccaagcctgctcttgcaagactgagcgcagtttaccgcagcctccaggttgccaagtccggtgtcaagaagaagaacaggcagtaagcactgaggggccaatgagcttgttttgtggatccgttggtttatgtttccagctttttagatttgttctaagagtatggaggttgaatatgatgaatggtgtgctctgcatactggcccaagttttctcagtaggttctatatctgtacccatgactatgttgtgaagcctcttgaaatcatttccacaattattggccttccaaaaaacc

SEQ ID NO: 28758 - DNA, 664 bp, Triticum aestivum
  Clone ID: PAT_TA_28758
ccctactaaagggaacaaaagctggagctccaccgcggtggcggccgctctagaactagtggatcccccgggctgcaggaattcggcacgaggcaaatctctcgtggtagacagcttccatctcatctccggcgatgtctgggcgtggcaagggcggcaaggggctcggcaagggcggcgccaagcgccaccggaaggtgctccgggacaacatccagggcatcaccaagccggcgatccggaggctggccaggaggggcggtgtgaagcgcatctcggggctcatctacgaggagacccgcggcgtcctcaagatcttcctcgagaacgtcatccgcgacgccgtcacctacaccgagcacgcccgccgcaagaccgtcaccgccatggacgtcgtgtacgccctcaagcgccagggccgcaccctctacggcttcggcggctgagcgccatcagcgcgctgccgctggctgacactgctgtttcctgctttgctctgtagtcttactcccccccgtcgtgaatccagtgcgctggctatgcttgtttctgtagtttgtctagtgagatccaacttctagttgtaactcctatcgtttcgtttcgctgcaatgaaaagttaattccaatctgagaaaaacatcatgtctgcttatgtttgttt

SEQ ID NO: 28759 - DNA, 1086 bp, Triticum aestivum
  Clone ID: PAT_TA_28759
tcaccacagtctcggtctatcacggtagcactagcttcagctagccaccctcttcctctccgggcatcttcttgcatcaaccacggcaatggccaccgctgacgtacgtatagcttgtctagatcgactttcctttttcgcatgctcgcatcgatgatcgtttcgatcggttctttaccttttgatctgcttatgtgtgtgatctgacgaacggccgggtgagcatgatattcattgagctcgagctagattggtttgtgtacgtgttgacatgtgcgtggtgctaatgaacgtaactgtgcgtcgtgcaggtccagaacccatcggccgcgctgacggaggaggcgcccgcggcggagacgccagtggccgccgaggaggccgcgaagacggaggaggtccccgcgccggcggaggccgaagtcgaggcgcctgcccccgtcgaggttgaggagaccaaggaggaggcaccggcagccgctgagacggaggagaccaaggagcccgagccagcagctgccgccgagccggaggccgaagcgcccaaagagccagaggcgccagccgtggtcgagaccaaggaggctgtggcagaggcagagccggctgtggtcgaggaggtgaaggaggaggcggcgcctgctgccgagccagaagtggcggccgtcgccgaggaaacaccggctgcagcggaggaggccccagcggccgcggcagaggagccggccgccgccgtggccagcgtcagcgtgtgaggcgccggcgcgcgcggaggaggagctggctgggtcagcgtccacggcggcggtcatgtgctcctacgtggcacggcgtgatgcttagtcagccagtggagtggactggagtgctactgctttttactacgtacaaggtgtggggtgctttgcgcggggtggcgcgtggcgtgggctaaataaaagtgttgtcgggtcgacgcccagtgtcggccagcatccagcgagcgagcgactcgacaagatatgcttcattatgttttgttttcgcatggcaaacataaacaaggttatcctaatttagattcctaaaaaaaaaaaaaaaaaaaaa

SEQ ID NO: 28760 - DNA, 1151 bp, Triticum aestivum
  Clone ID: PAT_TA_28760
attctaagcgacaacattctacctctcatcctcccagttctgttcctcggccattctagctaccatgccgggctccatcgccttcggtcgcttcgatgactccttcagcttggcctctttcaaggcctacatcgctgagttcatctccaccctcatcttcgtcttcgccggcgtcggctctgccatcgcctacactaaggtgagcggcggcgcgccccttgacccatccgggctgattgccgtggcgatatgccacgggttcgggctgttcgtcgcggtcgccatcggcgccaacatctccggcggccacgtgaaccctgccgtcaccttcggcctcgccctcggcggccagatcaccatcctcaccggcatcttctattgggttgcccagctcctcggtgccatcgtcggcgccttcctcgtccagttctgcaccggcgtggcgacccctacacacgggctttccggcgtgggcgcctttgagggcgtcgtgatggagatcatcgtcaccttcgggctcgtctacaccgtgtacgccaccgccgccgaccccaagaagggttccctcggcaccatcgcccccatcgccatcggcttcatcgtcggcgccaacatcctcgttgccggccccttctccggcgggtccatgaaccctgcacgctccttcggccccgccgttgccagcggcgacttcaccaacatctggatctactgggccggcccgctcatcggcggtggcctcgccggcgtcgtctaccggtacgtgtacatgtgcgacgaccacagctccgtcgccggcaacgactactaagccagccatgggaagagtcgtcgggtccataatgccttcggcaacataaaagtgcgtacgtggtgggcagtctcacgaatgtctcgatgatgtgaagaacatcctgttgtttggttcagatcgaagctgtagcacctggatgatgcatgttcctttatctgtaaaatgtgatgttgtgaagttggtggggtttgagaattcttcagttgagtttccttatgcgattcaataagaacatcattgtttagtgcatccaagacctcgctgtgatccttctctgtttgtgctttttttctccttaaaaaaaaaaaaaaataaaagaaaaaaaagcggccgctct

SEQ ID NO: 28761 - DNA, 709 bp, Triticum aestivum
  Clone ID: PAT_TA_28761
actcccatcccacctccaccaccgcggtacgtaccgtttgcgatcaaaagaaagtcgagccatatggcgaaggccgcagcgatgctcgtgctggtggcgctagtggtggcggcgatggcaacgggcggagcggcgcagtgcaacgcggggagcctggcggtgtgcgcctccccgatcatcagcggggccaagccgtcgacgacgtgctgcaacaacctaaagagtcagcgggggtgcttctgccagtacgcgcgcaaccccgcgtactccagctacatcaacagccccaacgcccgcaagaccctcaccagctgcggcgtcgccgtaccgaagtgctagtagccgggcctccaccgccgccggcgtgctaggcagcgccacgctgcctattgctactagtactacgtaatgtactactactacgtacgagctcctaccatggctgctggtacgacgtcggtcgaacagctccgtccgaaccgtgtgttcatgtatctttttttctctccaatacaatccgtgtgttcatgtatcgtatgcaagaataaaatgggtggtgtacgtgttgatccagcctctgcgtagtttgttactcatttctcaattctgatcgatagatgtcgatcgatctcgtgtaatttctgtacctccgacaatatatatccgcatcttaacaaaaagttgctactatattgctaaaaaaaaaaaa

SEQ ID NO: 28762 - DNA, 937 bp, Triticum aestivum
  Clone ID: PAT_TA_28762
tttttttttttttttttttttttttttttttttttttttttttttgcgaaacgaaacagagaccgtctttcattgtgcatagacagagtgacccatggcagctacttgatccgaagccgttttttttcttggattcaacgattcaaatgtcgcttattacattacaaaccagagcagcaaaaatgcacgcagttggatttgaacaaaaaacataaagttcaatcacaatagtgagggtgaggactggctcgccgcatcaaggacacatgccggtaactcagctgctgcccctgtgacctggcggcggacgggccgggcgggcggcgactacttgttcttgtgcgcctggacgaatttggagttcttgaggtcctcctcggtgaagccggcggtcatcttggtgatgagggcgcccgtgacggcgaagccggcgaggaagggccaggtgcggccccactcccggcggaagaacaccggccacgggtcgaacgccgagaagaacttcatctccggtggctttgatctcgacctccgccttgggttggattggattggattcgtgtccgccaagatctggttctctctctctctctggttgcgttgcggcgtggacgggctcgagagatgccaccaggaaccctcccatctgtacactggaataatctttgaggtggacaaaatgcccgactgctggttcttcttctgtctcgcatatcaagttgctgcgtttttctgtttcctcttattatggctgtgattgattaatggacaagtaatgttcagttgtcacagagtactagcttatacgggagcaacgtttgccctagttttgtaataatggtatatatcaactcttgacgttctgtcgttgattgctcttgttctgcaaaaatttagtaaatgccatgtttacctgttgcaaaaaaaaaaaaaaaaa

SEQ ID NO: 28763 - DNA, 1204 bp, Triticum aestivum
  Clone ID: PAT_TA_28763
ctagtggatatatacaggcacgtcgaggctgtgggtggacgtacactcgatcgaaccaactcattccttcctaccacccccggcaccaccagcccaagcagagccatggcgcccagcggagacaacaccgtggccaacgtccacagcggcatcgacagcaccaacaagacgctgctcaagagcgacgccctctacacctacatcctcgacaccaccgtgttcccccgcgagcacgagtgcatgcgcgacctgcgcctcatcacggacaagcacccatggggctacatgcagtcgtcctcggacgaggcgcagctgctggggatgctgatcaagatggcgggcgccaagaagacgatcgaggtgggcgtgttcacgggctactcgctgctggccaccgcgctggcgctcccggaggacggcaaggtggtggccatcgacaccgaccgcgagtgctacgaggtgggccgccccttcatcgagaaggccggcatggcgcacaaggtggacttccgcgagggcaccggcctggagcgcctggacgagctcctcgtcgaggacgacggcgcggcgagctacgacttcgcgttcgtggacgcggacaagcccaactacgtgcgctaccacgagcagctgctgaagctggtccgcgtcggcggcaccatcatctacgacaacacgctgtggggcggcacggtggccctgccggcgggcacgcccatgtccgacctcgacacccgcttctccgccgccctcagggacctcaacgccaagctcgccgccgacccgcgcatcgaggtctgccagctcgccatcgccgacggcgtcaccatctgccgccgcatcgtctagacgggcgtccggcccggcccggcgtgatcgtgatccgccgtgcgcctgccggcctgcgtgcgtgcgtggagtccatttccttaccagccgcttatcttaatcaattgtattatttttttccctgccagcgctggcgccgtgaagcatctgatggtttgaaagtttcaataatatttttggcttttcaactttgagaggagagggaggagtggctgtacttatgtactgtaactatactatatatggtgttccgatgtccgatgacgaggtcgtgcatgtggatgccgttgtcacccgcctaattgttaagtttatctcaactggaaaaaaaaaaaaaaaaaaaaaaaaaaaaaaa

SEQ ID NO: 28764 - DNA, 601 bp, Triticum aestivum
  Clone ID: PAT_TA_28764
ttttttttttgcgaaacgaaacagagagcgtcttcattgtgcatagacagagtgacccatggcagctactttatccgaagccgttttttttcttggattcgacgattcaaatgtcgcttattacattacaaaccagagcggcaaaaatgcacgcagttggattcgaacaaaaaacagaaagttcaatcacaatagtgagggtggggattggctcgccgcatcaaggacacatgccggtaactcagctgctgcccctgtgacctggcggcggacgggccgggcgggcggcgactacttgttcttgtgcgcctggacgaacttggagttcttgaggtcctcctcggtgaagccggcggtcatcttggtgatgagggtccccgtgacggcgaagccggcgaggaagggccaggtgcggccccactcccggcggaagaacaccggccacgggtcgaacgccgagaagaacttcatctccggtggctttgatctcgacctccgccttggattggattggattggattcgagtccgccaagatctgattctctctctctcttgttgcgttgcggcgtggacggggggaggtgcccggcccggccggc

SEQ ID NO: 28765 - DNA, 740 bp, Triticum aestivum
  Clone ID: PAT_TA_28765
ctcctccctttacttaaccaacccccaatcccccactctttccccaacccacgccctcccgtcccgtctccccgccgcctcctcctcctccgcgtcgcaaaccctcgcccaaatccgccgaatcccgcgacccaggaaccaaggtagatcgatggcgaagagctcgttcaagctggagcacccgctcgagaggaggcaggccgaggctaaccgcataagggagaagtactctgacagaattcctgtgatcgttgagaaggctgggaagagtgatattcctgacattgacaagaaaaagtaccttgtccctgccgaccttacagttggacagttcgtgtacgttgtccggaagcggatcaagctcagtgctgagaaggcgatcttcatctttgtgaagaacactcttccaccgacagctgccctgatgtctgccatttacgaggagaacaaggacgaggatggcttcctctacatgacctacagcggtgagaacaccttcggattgctctagatggcgctggctgccacggcaatcgctctgaatgcctcctgtaaataaggcgtgccaatcaactgtgtatatattccggtttgcctcgtcgtaggatctttaaattgcacaaccaagaaaaacctattcgtatcctgacttatcctatttgaatgttctgacttatatatatatatcaagtaatcgactctgaaatttggtaaaaaaaaaaaaaaaaaaaaaaaaaaaa

SEQ ID NO: 28766 - DNA, 718 bp, Triticum aestivum
  Clone ID: PAT_TA_28766
gatctctctctctctctctctctctctctctctctctctctctctctctctctctctctctctctctctccgctccctcaatcccactcgcgcagcagctccaagaggatcgtcagccatgtctgggcgcggcaagggaggcaaggggctcggcaagggcggcgccaagcgccaccggaaggttcttcgcgacaacatccagggcatcaccaagccggccatccggcgcctggcgaggaggggcggcgtgaagcgcatctccggcctcatctacgaggagacccgcggcgtgctcaagatcttcctcgagaacgtcatccgtgacgccgtcacctacacggagcacgcccgccgcaagaccgtcaccgccatggacgtcgtctacgcgctcaagcgccagggccgcaccctctacggcttcggcggctaggccgcgccagatggtcgtcagtcctcgtcgccgcctgcagattccgctgtgttagtccgcccgttcctagtagtgttgcgctcaagaaatctcagatggaaaccgccttgtttcccatttcctctgtctgtttagctggatcatgaaattatgtactgtaatgaagatgtttgcatccagagttcgaactgaaacccgcatcccttgtcgtgaattatgtgcaaatgctgtgttcccctcttctattttcttgtgaaagttcgtgtgagattgatctcaaaaaaaaaa

SEQ ID NO: 28767 - DNA, 1149 bp, Triticum aestivum
  Clone ID: PAT_TA_28767
ctgaacgtccagtctcatcattaacataagataaacatagcataatccctttaactaggcatgaagcaaaatgatattgcacgggcacctcacaatccatttcattgaccaaaagataggaaactactagccgcaaaaggtagatagataagtagacaagcagtacgccaccaccgccatcccaagaggacttctcgcaggagatcaacggtaagacttctggaaacgcgggcgggactacccgctgagtttaagcatataaataagcggaggagaagaaacttacaaggattcccctagtaacggcgagcgaaccgggagcagcccagcttgagaatcgggcggctgtgccgtccgaattgtagtctggagaggcgtcctcagcgacggaccgggcccaagtcccctggaaaggggcgcctgggagggtgagagccccgtccggcccggaccctgtcgccccacgaggcgccgtcaacgagtcgggttgtttgggaactctcaaccgccgtcgcgtctccactttcctctccatctcactcactctctccctccgccgccggcgcagcgtcctccccgcgactccgatggccagcaagtgggtcaggcccgaggtgtacccgctgttcgcggcgacgggcgtggccatcggcatctgcgcctttagcctccttcgcaacatcaccggcaacccagaagtcagggtcaacaagatggggagggcagcgggagtgcttgagaaccatgaggagggcaggcgctacgccgagcacggcctcagagcctatgtgcaggacaagacccccgagatcatgccaggaatcaacaagttcttcaccagcccaaaatgaagcactttagtctgtctgtgactcgcaattagtaactgttgtggtcaagtgcaaacctatttcaagcattcagtaatgttgttgcgtccataattcagaggacatcgtcaattacctcttattgaaagaaccatgtgatgtttgatggcttgctatatatgtgatggttgatggcttctaaaaaaaaaaagaaaaaaaaaacctcgtgccgaattcggcaccagcctagagcttttctcgccgctgctcccacgttccccttcgcgaccgcggcatctcgaccaccgccgccgccgcc

SEQ ID NO: 28768 - DNA, 1129 bp, Triticum aestivum
  Clone ID: PAT_TA_28768
gtattctaagcgacaacattctacctctcatcctcccacttccttttctcggccattctaagccaccatgccgggctccatcgccttcggtcgcttcgatgactccttcagcttggcctctttcagggcctacatcgccgagttcatctccaccctcatcttcgtcttcgccggcgtcggctctgtcatcgcctacaccaaggtgagcggcggcgcgccgcttgacccatccgggctgatcgccgtggcgatttgccacgggtttgggctgttcgtcgcggtcgccatcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttctgcaccggcgtggccacccctacacacgggctttccggcgtgggcgcctttgagggcgtcgtgatggagatcatcgtcaccttcgggctcgtctacaccgtgtacgccaccgccgccgaccccaagaagggatccctcggcaccatcgcccccatcgccatcggcttcatcgtcggcgccaacatcctcgtggccggccccttctccggcgggtccatgaaccctgcacgctccttcggccccgccgttgccagcggcgacttcaccaacatctgggtctactgggccggcccgctcatcggcggtggcctcgccggcgtcgtctaccgatacctatacatgtgcgacgaccacagccccgtcgccggcaacgactactaagccagccatgggaagagtcgttcggtccataatgccttcggcaacataaaaagtgcgtacgtggtgggcagtctcacgaatgtctcgatgatgtgaagaacatcctgttgtttggttcagatcgaagctgtagctggatgatgcatgttcctttatctgtaaaatgtgatgttgtgaagttggtggggtttgagaattcttcagttgagtttccttatgcgattcaataagaacatcattgtttagtgcaaaaaaaaaaaaaactcgagactagacctgccccgggcggcccgctccgaaatcactagtgaattc

SEQ ID NO: 28769 - DNA, 780 bp, Triticum aestivum
  Clone ID: PAT_TA_28769
attcggcacgaggcaacgcccaaagccttcgcatccagagctccaaaccctaggcgaggcgaggcgcggcgcagcggagggagaggccatggatcccgattcggtctcgaaggcgttcgtgcagcactactaccagacgttcgactccaaccgcgccgcgctggtggggctgtaccaggacggctccatgctcaccttcgagggcgagaagttcggcggccccgccgccatcgccggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgctgccagctggagggagcttctacgtgcagaatgacatgttccgcctgaactatggttaaggaagggcgaccgctctggcagcaaagaacttgttcagggatttatgttgaaacaatgaacatcaaatgatgatgctgcagactctttgtttgttcgccaacttgtgcaatttatcgcaaaaaattgccagacttgataggcatccaccagatcatcttttgttttgtgtttcccatgtattgtcgttgcttgggtggcactttctttggaatgttgatggaaaccgtccaggtactagttatgcgtggcatctctgggttttgtttgtgaccatttaagttcacttttgcatgtcccaaaagtttcttccctgctcagttaa

SEQ ID NO: 28770 - DNA, 2209 bp, Triticum aestivum
  Clone ID: PAT_TA_28770
tctgcttctgccctcgacccggcagctccacctcgcccgcggcgatggattccgccgccgcccaggcccagccgacgcacgcgccggccgacgaggaggaggcgcgccgccgccggggcaccgactgcgtctactacctcgcctccccgttgacctgcaacaaggggagcgagtgcgagtatcgtcacagcgacgctgccagggtgaatcccagggactgctggtattggttcaacggcaactgcgcgaatgctaaatgtgcatttaggcacccgccgctgggatgacttgctcggagcatcggcgactccgcgggcacctcaacaacctgcgccgcaggttcccgtgccagctcaagcccttccacccaatggcaccgcaaagccagttgtcccgtgttactattaccagaaaggcatgtgtgcgaaaggaaacctgtgcacattctcgcatgggccacagtttgctggaaaccctgctttgcagcctcatctccagctgaagaactccaactcgtggacgaaaccaagcaattcaccccaacagagaaccactcccgccatacatggcgagcttaaagtcggtgctcagaatggcagaccagctcagaagcaaaatccgacaagcagggcttatcactcaccaggaatttaccagaatcagaataataacccttatgtgctttctggcgcggcaaagagttaccagcctcagcgctcggttcaagctgagtctgccgagaatgttatggagacgggtgagtttgtcagggaaccttctgctggttccagtgtggtcgccggcagtgccgaggatgacgccgaacggtcgttcaaggaaggccacgctagtagttaccggcgtgccagtggggagcagaacagtgggatacgaaggcaagcacatggtggctatgaactagaaaggtcatcacacagaagctcatccgacaggttggtgtcagagagaaggcttatgcagagagagtcgatgcctgtgactgcagaaagttcagacttgcgccacaggctactgaagcaaagaaggctgaatgattcgagatcgacgcaggtccccgataggcgggatagaaggtatcctgaggatgagcgcggcagccatcatcatcgtcgaggggaagagcgagctgcccatgacggcctctcacgctctcggttgcaaggtcggataaaacttccaggggaggcatcactggacagacttggcccacacacacacacgcctcacactctctcatcagatcagccacagagtcacacaagcactagcttcagctagccagcctcagccactccgggcattttcttgcatccacgacggcaatggccaccgctgatgtccagaacccgacggccgcgctgacggaggaggcgcccgcggtggagacgccggtggccgccgaggaggccccgaagacggaggaggtccccgcgccggcggaggccgaggtcgaggcgtctgcccccgtcgaggttgaggcgaccaaggaggaggcgccgggcgccgctgagacggaggaggccaaggagaccgagccagcagctgcggccgagccggaggccgaggcgcccaaagagccagaggcgccagccgtggtcgagacagagaccaaggaggccgtggcagaggccgagccggcggtggtcgaggaggtgaaggaggaggccgcgcctgctgccgagccagaagcaccggccgtcgccgaggaagcaccggctgcagcggaggaggcccccgcggccgtggcagaggagccggccgccgcggtggccagcgtcagcgtgtgaggcgcgcacagagacagaggaggggctggctgggtcagcgtccacggcggcggccgtgtgctcctacgtggcacggccagtcagccagtggagtggagttctactttttactaggtgtggagtgggagtgctatgcgcggggtcgcgtgacgcgggctaaataaaagtgttgtcggggccagtcgacgcccagtgtcggtcagcggcagcgagcgagcgagcgacgcagtgcggtgccactctcgccggcccccgtggctggctgcgtctgcttagctgcagctttgtagtggtgtgtgtcacagtgtcagttccacctatgatcgatcggtatcctatccggtttgtgttatccctggctcctgcttgcttgagattttctaaaaaaaaaaaaaaaaaaa

SEQ ID NO: 28771 - DNA, 961 bp, Triticum aestivum
  Clone ID: PAT_TA_28771
gcccaaagccttcgcatccagagctccaaaccctaggcgaggcgaggcgcggcgcagcggagggagaggccatggatcccgattcggtctcgaaggcgttcgtgcagcactactaccagacgttcgactccaaccgcgccgcgctggtggggctgtaccaaggacggctccatgctcaccttcgagggcgagaagttcggcggccccgcggagggagaggccatggatcccgattcggtctcgaaggcgttcgtgcagcactactaccacacgttcgactccaaccgcgccgcgctggtggggctgtaccaggacggctccatgctcaccttcgagggcgagaagttcggcggccccgccgccatcgccggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgctgccagctggagggagcttctacgtgcagaacgacatgttccgcctgaactatggttaaggaagggcgaccgctctggcggcaaagaacttgttcagggatttatgttgaaacaatgaacatcaaatgatgatgctgcagactctttgtttgttcgccagcttgtgcaatttatcgcaaaaaattgccagacttgataggcatccaccagatcttcttttgttttgtgtttcccatgtattgtcgttgcttgggtggcactttctttggaatgttgatggaaaccgtccaggtattagttatgtgtggcatctctgggttttgtttgtgaccatttaagttcacttttgcatgtcccaaaagtttcttcccttgctcagttaatatttttaaagtgttttttttccaaaaaaaaaaaaaaaaaaactcg

SEQ ID NO: 28772 - DNA, 608 bp, Triticum aestivum
  Clone ID: PAT_TA_28772
ccgggctgaggaattcggcacgaggccctcctcccccaatcaactcgcgcagcagctccaagaggatcgtcagcgaccatgtccgggcgcggcaagggcggcaaggggctcggcaagggcggcgccaagcgccaccggaaggtgctgcgcgacaacatccagggcatcaccaagccggccatccggaggctcgctcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggccgctggcccccgccagatggtcgtcagtcttcgtcgccgcctgcagattccgatgtgttagtccgcccgttcctagtagtgttgcgctcaagaaatctcagatggaaaccgccttgtttccccatttcctctgtatggttaactgaatcatgaaattatgtaatgaagatgttggcatccgttcgaaccgaaaaaaaaaaaaaaaaaaggccccta

SEQ ID NO: 28773 - DNA, 761 bp, Triticum aestivum
  Clone ID: PAT_TA_28773
ttcggcacgaggcaagaccgtggcggtccagccaccaccaccccaacccaccggagcagacgaaggcggcgccgcggcgacctcatctccggccaagggaaatgactaccgttccggggtctctggtgtgggagctcgtgaagaaaaacaactgcttcttgatcaagcagttcggcaacagcaacgccaaggtgcagttcagcaaggagccaaacaacctctacaatgtccactcctacaagttctctggcttggcgaacagcaagaccgtggcggtccagccatcagcgggagaggacaaggctgtcgtcctgtccacgaccaagaccaagaagcagaacacccctgccaagctccagcacaagactctgatgcgcaaggagttccgcaagatggccaagtccgtcaagaaccaggtctgcgacaactactacaggcctgatctgaccaagccggcccttgcaaggctgagtgccgtgtaccgcagcctccaggtttccaagtctggaatcaagaagaagaacaggcagccaactaagctgtaaactcattgagattgcctttcagcgctcatgttaccatgtctgttccgacagttttgagtcataagtgagacccttggaggaaccatgttacaaacccgccctagtttgtaccctgacagtgttagaagaattgtttgtgtcgatctataattattgtttgatttgcactagggatcgctgcttgttaaaatttgcggtgcctgctgttggattttc

SEQ ID NO: 28774 - DNA, 814 bp, Triticum aestivum
  Clone ID: PAT_TA_28774
ggccgctcccgaggccggcccgggttctgccaaaaaaaaaaacctaagcgagctccacccccccagcgccgccgccgccgcctcctcaaccctagctcgccctcccccgcccgccaccggcagccatggcgacggagctggcctacgcgccgccgatgaagtcggggaagctcgggttcgagggcacccaggaggtgcagcaccgcatccgcatcaccctctcctccaagtccgtcaagaacctcgagaaggtgtgctcggatctggtgaagggcgccaaggagaagcagctcaaggtcaagggccccgtccggatgcccaccaaggtgctcaacatcaccaccaggaagtccccctgcggagaaggtaccaacacctgggatcggtttgagatgcgggtgcacaagagggtgatcgacctcgtcagctccccggacgtagtcaagcagatcacctccatcaccatcgagcccggcgtcgaggtcgaggtgaccatcagcgaccagtagttatgctgccccattatatgtgtctttaaatcttttttacaagggtggagagacaccagcgtaccaagatgtttttgaaactttctctagtatgagaactgggttttgtatgactaggttctttgcttcgtgattctaagtgcctaagttatcttttgtcaattttccttcgttgccctgctgtgtgtgctgggttgaatgttcatacatggttcgctattcatctatgatttggtagcgttatctatgctcccttaccgttgatgtgcggtgccaaatccctaaaaaaaaaaataaaaaaaaaa

SEQ ID NO: 28775 - DNA, 843 bp, Triticum aestivum
  Clone ID: PAT_TA_28775
cccacgcgtccggctcgagcccctctcgcccttcgcgccgccgctgctgcaggcaaccgccgccgccgtcgccggagctaaacccctcgcctgacgccatggggcgtatgcacagccgcgggaagggtatctcgtcgtcggcgctgccgtacaagaggactcccccgagctgggtcaagaccgccgtcgctgatgtcgacgagttgatcacgaaggctgcgaagaagggtcagatgccctcgcagatcggtgttctgctccgtgaccagcacggtatccccctcgtcaagagcgttaccggaagcaagatcctccgcatcctcaaggctcatggcctggcgccggaaatcccagaggatctgtactttttgattaagaaggctgtggccattaggaagcatcttgagaggaacaggaaggacaaggactccaaattcaggctcattcttgttgagagcaggatccaccgtcttgcccgttactacaagcgcaccaagaagctcccgcccacctggaagtacgagtctaccactgccagcactctggtggcttaggagggctcttcatctggtgtgctcttaccggcttcaggatggtcttgttctacatattatcaatttcatgtaacgcttttgagtttggagcgatttagatgaacaagagaccaaattttctatgtttacttggagaatcccataaaccatttttggttttgcaattctgtctggttctgtttagcgtctatctacaattcatcagttaaaattagacattgtgatattcgtgttgtctgatctgagcgagtgtaatcgctgctttcagtgcactcaagctcggacagtt

SEQ ID NO: 28776 - DNA, 889 bp, Triticum aestivum
  Clone ID: PAT_TA_28776
gagcgccgcactactataaaagctcgctcccaaaactcgccccgctaccgcagccgccacacacgacgaacaccggaacgaagcagatcggcggcgcgtcactccaatcaccggttcataaaatggcgacggtttcggattctctggtctgggagctcgtcaggaagaacaactgcttcctgatcaagcagttcggcaacagcaatgccaaggtccagttcagcaaggagcccaacaacctctacaatgtccactcctacaagtactctggcctggcaaacaagaagactgtgacagtgcagccagctgctgagaaggagatgactgtggtcctctccacaaccaagtcaaagaagcagaacaagcctgccgcgttcacccacaagactgtcatgcgcaaggagttccgcaagatggccaaggctgtcaagaaccaggtcagtgataactactataggcctgacttgaccaagcctgctcttgcaagactgagtgcagtttaccgcagcctccaggttgccaagtccggtgtcaagaagaagaacaggcagtaagcactgaggggccaatgagcttgttttgtggatccgttggtttatgtttccagctttttagatttgttctaaaagtatggaggttgaatatgatgaatggtgtgtgctgcatactggcacaagttttctcagtaggttctatatctgtacccatgactatgttgtgaagcctcttgaaatcatttccacaattattggctttccacattaattgtctttgctgagttgcttggagttggagtgctcctgatgcgtgtttttctattacacatgtgctcggtgaggtgctaacttatatcaactgggtattgtgcgtggaactcaagtatgcaact

SEQ ID NO: 28777 - DNA, 2221 bp, Triticum aestivum
  Clone ID: PAT_TA_28777
ttttttttttacaccagcacgtgcagtccagcacagtttattgccccatctttattcatacacaaaagtagatacaaccagcgtgttcgagcatcttggcctagaatgctcttgctaacagttccggtaagtgaaaccaaaaaagagctcatgtgcgttggttcaacattcaacaatacaggagatgatattacacaagacaataatattacagaagacgccgtgacccaagaaatctacagataacatatgctcgctgactcaaagaatgggatctgactatataattactacagcaaaaaggccagaagtttgaactgctcaatttattcaatctgcactcgagaaaacattggatctcccaacaaagatgagatcagtgggcagcatctctgctgtagaacgcatccaaggtcttcgcggggatacgatggagaagctcgcgagggaagatgcggagcaatgtccatgctaggtcaagtgactggaagatgttccgagtatcgtatgctccctgtgctacaaatttcctctcaaatttgtcaaggaattctagataaagcagatcttcagaagagagagcctcctctcccacgactgctttcatggcctggacatcctttccaatagcatagttggcataaagctggttagacacatctgaatggtcacgacgggtcataccctcaccaatagcactcttcatcaaccgagagagagatggaaggacattgatgggtgggtatatctgtctgttatggagctgtctgtcaatgtatatctgtccttcagtaatgtaccccgtgagatcaggagttggatgtgtgatatcatcattaggcatagttagaatgggtatttgggtaatggagcctgttcttccctcaatacgcccagcacgctcataaatggttgccagatcagtatacatatatccaggataaccacgcctacctggcacctcttctcgggctgctgatacctcacgaagtgcatctgcatatgaactcatatctgtcaagatgaccagaacgtgcttcccacattcatatgccaaatattctgctgttgttagcgcaatacgaggggtgatgatgcgttcgatcgtggggtcatttgccaagttcaggaaaagggtgaccctctccattgaaccattctcttcaaaatcacgtttgaagaattgggctgtctccatgttcactcccatagcagcaaacacaatagcaaaattgtcatcttcaccaccaccctctgcatgctttcctttctccagcctcttgacaagaccagcctgacgacaaatctgagcagcgatttcattatgaggaagaccagcagcagaaaagagaggaatcttttgccctcgagcaatggagttcatgacatcaattgtagatatccctgtttgaatcatctcctctgggtaggttctctcacttgggttgatagaacttccggagatatccaagtaggcctcaggcaatatcggggggccattatcaataggttttccagaaccgttaaaaatgcgtccaagcatatcaagtgagacgggagttttcaaaacctcgcctgtgaactgcacagttgtgtatttgttgtctattcctgaagtaccttcaaagacctgcacaacagctttttcaccatcaacttccagaacttgaccacgccgggtggtgccatctcccaatcggatgtttacaatctcctggtattttgggccctttactttgtccaagataaccagaggtcctgccacaccagaaactgtcctgtactctatgccgatctccagggttccctcctccatgtcggcgccctccttcaccagacccatgctgaacccaacgaagagcaacctgcggagagcatcaccaaccgcgccgtcagaatcaacacacaaaacgatccgcgtcgcttgttcaagcaacgcggatcgccccgatcccgccgacaaaaagaaatacacagcgagctgtctgccaatcgcgcccgccgctccaaattcaggagcaacgcggggcctccgcccgacccctagacccagatctaggcattgggggcagatctcgatcccgatctcggattcgacgcccgtaacggcgtggcgggacgaacctagcctccccgcgcggagtggggggagattggctgcccgcggcgcggcgcgaggcgagcgagcttcgccgcgcccacgagtccgcccacgcgtccg

SEQ ID NO: 28778 - DNA, 1145 bp, Triticum aestivum
  Clone ID: PAT_TA_28778
cggacgcgtggggcgtcaaacaaatatcctctggccgacaagagaaggccaccaccgtcgtcgtcgtccttaattgttcctgcgtctcccaacttttccttccaaacagcggtgacctccaccaccacccaagagccgagcgaggagaagagaagagatcggccatggctgcggacggcgagaggtgggtgggcctggcggtggacttctcggaggggagccgcgcggcgctgcagtgggcggcggacaacctgctccgctccggcgacaacctgctcctcctgcacgtcctcaaggaccccgactacgagcagggcgagaccctcctctgggaggcctccggctcgcctttgatccccctctcggagttctctcacccttcaattgcaaagaaatatggggtgaagcctgatgctgaaacgctggacatgctcaacactatagcgaagcagaaggaggtctccgtggtttcaaaagtcctgtttggagatccccgcgagaagctgtgccaagccatccatgacatgcccatcagctccctggtcattgggagcaggggccttggcaagctcaagagggtgctcttgggcagcgtcagcgattacgtcgtgaacaatgccgcctgccctgtcaccgttgtcaagccagcgagtaaccatgcctgatctcatcatcgcaaatgtccacatgtgttttagtttgccagagtcctatatatccagttggccgcaacttattgaaccatccagtgttatttgtaataataattgacaattagcctgtggatgattcccaggtgtgtgtaatctgtgcatgtgtcctgtacatcctgtacatttgtgtgcttatcttcagcctagcttttgctccatgagtcagtccgtgctgctgtttgttgcatacagtttgtagagtctgaataaaatggattctgctgtcaaaaaaaaaaaaaaaaaaaaaaaaaaaaaaaaaaaaaaaaaaataaaaaaaaaaaaaaaaaaaaaaaaaaaaaaaaatagaagacaccaaaactaaaaaagaaaaataactaaaaaaatacaacatcataaatagggggggggccgttttaaaggaccaaattttccttcccggggattgcaccttataatttttttttttagggc

SEQ ID NO: 28779 - DNA, 840 bp, Triticum aestivum
  Clone ID: PAT_TA_28779
ccttagctcgaacttaaccctactaaagggaacaaaagctggagctccaccgcggtggcggccgctctagaactagtggatcccccgggctgcaggaattcggcacgaggctccaccccccagcgccgccgccgccgcctcctcaaccctagctcgcccgcagcgccgcggcctcctccctcccatcctccccaccggcagccatggcgacggagctggcctacgcgccgcccatgaagtcgggcaagctcgggttcgagggcacgcaggaggtgcagcaccgcatccgcatcaccctctcctccaagtccgtcaagaacctcgagaaggtgtgctcggatctggtgaagggcgccaaggagaagcagctcaaggtcaagggccccgtcaggatgcccaccaaggtgctcaacatcaccaccaggaagtccccctgcggagaagggaccaacacctgggatcggtttgagatgcgggtgcacaagagggtgatcgaccttgtcagctccccagacgttgtcaagcagatcacctctatcaccatcgagcctggcgtcgaggtcgaagtgaccatcagcgaccagtagttatgctaccccaagatatgtgtctttaaatctttttacaagggtggagagacacctccaacgtaccaagatatttttgaaactttctgtagtatgagaactgggttttgtatgactaggttctttgcttcgtgattctaagtgcctatcgtcctaagttatcttccgtcaattttcgttgccctgttgtgtgtgctggaatggatgtttatacatggatcgctgttggcccaaaaaaaaaaaaaaaaaaaaa

SEQ ID NO: 28780 - DNA, 735 bp, Triticum aestivum
  Clone ID: PAT_TA_28780
gcacacgacgaacaccgggacgaagcagatcggcggcgcgtcactccaatcaccgttttctaggttaggataaatggcgacggtttcggattctctggtctgggagctcgtcaggaagaacaactgcttcctgatcaagcagttcggcaacagcaatgccaaggtccagttcagcaaggagcccaacaacctctacaatgtccactcctacaagtactctggcctggcaaacaagaagactgtgactgtgcagccagctgctgataaggagatgaccgtggtcctctccacaacgaagtcaaagaagcagaacaagcctgctgccttcacccacaagactgtcatgcgcaaggagttccgcaagatggccaaggctatcaagaaccaggtcagtgacaactactacaggcctgacttgaccaagcctgctcttgcaagactgagcgctgtttaccgcagcctccaggttgccaagtccggtgtcaagaagaagaacaggcagtaagcactgaggggccaatgagcttgttttgtggatctgttggtttatgtttccagctttttagatttgttctaagagtatggagattgaatatgatgaatggtgtgctccgcatactggcacaagttttctcagtaggttctatatctgtacccatgactatgttgtgaagcctcttgaaatcattttcacaattattggctttccacattaattgtttttgctgaattgct

SEQ ID NO: 28781 - DNA, 856 bp, Triticum aestivum
  Clone ID: PAT_TA_28781
gttgcgtcgtggaataaataacgaaaggaatgtcagtctgttgatcaaaaaaaaaaaaaaaaaaaaaaaaaaaaaaaaaaaaaaaaaaaaaaaaaaaaaaaaaaaaaaaaaaaaaaaacccccagggccgccgccgcctcctctgcgccccaaaccctagctcgcccgcagcgccgcggcctcctccctcccatcctccaccggcagccatggcgacggagctggcctacgcgccgcccatgaagtcgggcaagctcgggttcgagggaacccaggaggtgcagcaccgcatccgcatcaccctctcctccaagtccgtcaagaacctcgagaaggtgtgctcggatctggtgaagggcgccaaggagaagcagctcaaggtcaagggccccgtcaggatgcccaccaaggtgctcaacatcaccaccaggaagtccccctgtggagaaggtaccaacacctgggatcggtttgagatgcgggtgcacaagagggtgatcgacctcgtcagctcccccgacgtcgtcaagcagatcacctcgatcaccattgagcccggcgtcgaggtcgaagtgaccatcagcgaccagtagttatgctaccccatgatatgtgcctttaaatctttttacaagggtggagagacaccagcgtaccaagatattttgaaactttctgtagtatgagaactgggttttgtatgactaggttctttgcttcgtgattctaagtgcctactgtcctaaattatctgtcaattttcgttcgttgccctgttgtgtgtgccgggttgaatgtttatacatggatcgctatttatctatgagatttggtaacgtttccttgaaaaaaaaaa

SEQ ID NO: 28782 - DNA, 936 bp, Triticum aestivum
  Clone ID: PAT_TA_28782
acacagacacatacgcctcacactctctgatcagatcagccacagagtcacagtagcactagcttgagctagccaccttctgccactccgggcattttcttgcatccacgaaggcaatggccactgctgatgtccagaacccggcggtcgcgctgacggaggaggcgcccgcggtggagacacccctggtcgccgaggaggtcgcgaagacggaggaggcccccacgccggcggtggccgaagtcgaagcgcctgctgcccccgtcgaggttgaggagactaaggaggaggcgccggccgccgctgagacggaggagaccaaggagcccgagcccgcagctgcggccgagccggaggccgaggcgccagccgtggtcgagacagagaccaaggaggccgtggctgaggcagagccggcggtggtcgaggaggtgaaggaggaggcggcgcctgctgccgagccggaggttgcggccgtcgccgaggaagcaccggctgctgcggaggaggcacccgcggccgcggcagaggagccggccgccgcggtggccagcgtcagcgtgtgaggcgccggcgcgcgcggacgaggagctggctgtgtcagcgtccacggcggcagccgtgtgctcctacgtggcacggcgtgatgctcagtcagccagtggagtggactggagtggagtgctactttttactactaggtgtggggtgctttgcgcggggtccgcgtgacgtgggctaaataaaagtgttgtcgggtcgacgcccagtcccaagtgtcggtcagcagagagcgagagacgcagtgccagtgtgccactctagataatgtatgcttcttttctcgacaagacatgcttcattatttctaaaaaaaaaaaaaaaataaaaaaaaataaaaaaaaaaaaaaaaaaaaaaaaaaaaaaaaaaataaa

SEQ ID NO: 28783 - DNA, 1083 bp, Triticum aestivum
  Clone ID: PAT_TA_28783
ttttttttcacaacatcagtatcaatgatgataggctgatagcaacatgcagggtcttcaacaattacaacagctgaaggaggcttaatcttggaagtggaagtacacatagataagataaggaaccatattctaagaatctattacaacatcaggcgtgaggccatgcatgttttgttcacctccaacatgagaaacatttcgtgcaatacttgctactagaaatgatgggcaatacttactagaaacatttcattcacagattctaaataaagctgcattttacctattcaactaaatatcaaatcgcaaacagttaagctcaaacagaacattcagtttcatcattaacataagtttatgataacaaaaccccttcttcaactaggcaggatactgcagacaactcacagttcttagagatcatatccaattcattggtccaaaagaaaacaaactactagcggtaaaaggtagatagataggcaggcaagcagtaggccaccgccgccatacccaacaagagatctcgccggagctcaacggtacgacttctggaaacgcgctcgggcaccgcgaccgccaaactttttgggttcgcaacggcgcgggtcggcgacgaggagcgtccggtcgtagcggccgaagatctccttcacctccttcttggccgcctcgtcgacgtacttctggtagtaggcgacgagagacttggcgatggcctggcggatggagtagatctggctcgtcttcccgccgccgcgaacgcggatgcgcatgtcgatgtccttgaagcgggacctgccggcgagcaggatcggctcgaaggccttcaggcggagcatctcggggcggatgagctcgatcggcgcgccgttgaccttgatgaggccgcgcccgggcttgcagtaggcaacggcgacggcggtcttcttccggccgaagcactggacggtgcccggcgtcgggcgggtgagaacggctgccatggtggctgcggcggtgtgcttggttgctgtgagcgcggcggcacaggttagggttttgggtggcggcgcgttttttttcgaaggcccggccggc

SEQ ID NO: 28784 - DNA, 1378 bp, Triticum aestivum
  Clone ID: PAT_TA_28784
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagtataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcagccgcgcaaattacccaatcctgacacggggaggtagtgacaataaataacaataccgggcgcattagtgtctggtaattggaatgagtacaatctaaatcccttaacgaggaccaccccttcgagccccacgccgcgccttgccctgtctactccgaaaaggtttctaaagacatgcttaaccatatcaccatgcaacatgggtacttgttcaagaatcgccgcaggttgcgcagatttgctgttccaggcagccagtcgctctctctgctgagccgggatctacgtgaagcccatttgcaggtgcttctgggaggtggtggacataggtcgagcaacaataatgccacaaatatttcagctgatcctcttctgtcatcatttggccttagcttcccaacattagatgctgaggaaacatcaaaattgtctactcctgctcagagtgatgtaccagtgctaaaagagacagctgctcggccgtggcggtcaagtattgactcgtcgctcacaagggaagaaagggagcaagccagcgtgagagcgatgtttgtgcaagacctgctgctctccaccctattcagagaccaataactgagaggcgagccgatgttaccgctacccgggtgccccctggaccctaatgcagactccgaaaggtcggtgcccccagaccaagttgccgaatgtgacatccatggaagatagatagggtttggcaccccagcgaggaaggaggtgcatcagagtcgatgtgggcatgaggtgtcctaagttatttgtagccggtctttgtgttgagttccatctcagttatcgcgatctcgcaggtgacagatgtctgcgcaggtcgcggttgtgtctgtaccgtaccgtaccgctgcttctttgtttgaaagcattggtttgttgtaccagtcacataataatgaatgttgctatgcaacagcagaaggctttgcagtttatttc

SEQ ID NO: 28785 - DNA, 1337 bp, Triticum aestivum
  Clone ID: PAT_TA_28785
gccggccggtttgggcacgactctcggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgcctgcctgggcgtcacgcattcttagcgacaacattccgtctcatcctccccagctcggtttttgggccattctaagccaccatgcctgcctccatcgccttcggtcggttcgatgactccttcagcttggcctctttcaaggcctacatcgccgagttcatctccaccctcatcttcgtcttcgccggcgtcggctctgccatcgcctactccaaggtgagcggcggcgcgccgcttgacccatccgggctgatcgccgtggcgatctgccacgggttcgggctgttcgtcgcggtcgccgtcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttctgcaccggcgtggcgacccctacacacgggctttccggcgtgggcgccttcgagggcgtcgtgatggagatcatcgtcaccttcgggctcgtctacaccgtgtacgccaccgccgccgacccccaagaaggggtccctcggcaccatcgctccaatcgccatcggcttcatcgtcggcgccaacatcctcgtcgccggccccttctccggcgggtccatgaaccctgcacgctccttcggccccgccgttgccagcggcgacttcaccaacatctggatctactgggccggcccgctcatcggcggtggcctcgccggcgtcgtctaccggtacctgtacatgtgcgacgaccacaccgccgtcgccggcaacgactactaagccagccatgggaagatcattcggtctttggtttccataatgtcttcggcaacataagaagtgcgtacgtggtggtcactctcaggattgtctggatgatgtgaggaacgtcatgttgtttggttccgatcgaaagcccgcgaggctgtggcacttggatgatgcatgtttctgtatctgtactgtgatggatgttgtgaagttgttggggtttcaagattcttcagttgagtttccttatgcgattcaataagagcatcattgtttagtgcattcccaaaaaaaaaaaaaaaaaaaactcgagaatagttcacctcggccgcgaccacgctaatcactagtgaattc

SEQ ID NO: 28786 - DNA, 871 bp, Triticum aestivum
  Clone ID: PAT_TA_28786
gcacgaggggctgttccaaccttccgcagccaccaccaccccaacccaacccaccggagcagaccaaggcggcgccgcggcgacctcatctccggccaagggaaatgactaccgttccggggtctctggtgtgggagctggtgaagaagaacaactgcttcttgatcaagcagttcggcaacagcaacgccaaggtgcagttcagcaaggagcccaacaacctctacaatgtccactcctacaagttctcgggcttggcgaacagcaagaccgtggcggtccagccatcagcaggagaggacaaggctgtcatcctttccacgaccaagaccaagaagcagaacacccctgccaagctccagcacaagactctgatgcgcaaggagttccgcaagatggccaagtctgtcaagaaccaggtctgcgacaactactacaggcctgatctgaccaagccggcccttgcaaggctgagcgccgtgtacaagcagatcacgccctccgtcctctccgagcgactcaggatcaacgggtcgctggctcgcagggccatcaaggacctgatggagagggggctcatcaggatggtgtcgatccactccagccagcagatcttcaccagggccacaaacacctgatttacctacctcatgtgttagctgcctgttttctagtccagtagactgagatgtcgctgttatattgacgttcattatgttcagcgaggcactttgtgggtcttgtcttgcgctcgtgccacaagtatgtttgaattgcttttgagtttttggtacaatctaagacgcaatgaaatctaccttatattatcagactctgtttgtactaaaaaaaaaaaaaaaaaaggccccta

SEQ ID NO: 28787 - DNA, 491 bp, Triticum aestivum
  Clone ID: PAT_TA_28787
ttggcggcccgcggggaattgggatttcgagcggccgccccgggcagggcgggcgacttcacccaacatctgggtctacttgggcccggccccgctcatcgggcgggtggccctcgcccgggcgtcgtctaccgatacctatacatgtgcgacgaccacaagccccgtcgcccgggcaacgactactaagcccagccatgggaagagtcgttcggtccataatgccttcggcaacataaaaagtgcgtacgtggtgggcaagtctcacgaatgtctcgatgatgtgaaagaacatcctgttgtttgggttcaagatcgaagctgtagctggatgatgcatgttcctttatctgtaaaatgtgatgttgtgaaagttgggtgggggtttgagaaattcttcaaaaaaaaaaaaaaaaaaaaaaaaaaaaaaaaaaaaaaactcgagacttagttcacctcggccgcgaccacgctaatcacttagtgaattc

SEQ ID NO: 28788 - DNA, 1651 bp, Triticum aestivum
  Clone ID: PAT_TA_28788
gcacgaggagcatcaagttttagttaattttttaatctaaagttaagatcgcttaagttatgttaactgaccttgttgagcacaacgaggacggtaataccatgacaaaaagcaaaagaaagaagatcaaaatccagttctctaagaactagaacaaacgaattatatgcgctgatgctgccaatgattattacagacgattcttcagcttgactgcaatgctggtaaaacttttccaaggacaagaatgcgaggattattcaggagccttaaacggtgtcttaacacccaagggaaatcgaggtgcctgccacttcacctactcaggctaaagctcctggtatgcaacaaaattaggtgggagacaaataatcgacagaaagagcagctggtgctcagatatgatcgcaaactgcttttgtgtagtctgatgttgatgacttcccaccaagatcagcggttctgtacttcccctcggcaattgtctggaggatggcattgtggatccggtctgcttggtcattgaattgcaagtggcgcaacatcataacagcactcaacataagagcagttgggtttgcaaggttcttgccagagatatcaggtgcagaaccatgaacagcctctgccagacaaatgccaccttcaccaatgttgcagctgggagttaagcccaagcctccgatcaaaccagcacatagatcactaataatgtcaccatacagatttggcatcactaatacatcaaatgtaccaggattcttcacgagtgtcatgcagcaattgtcaatgatgacttcctcatatgtgatttcagggtacttctcagctacttcacggcaacacttgaggaaaagtccgtctgttttcctcatgatattagctttatgtatcgcagagaccctctccctgccattggctttggcataatggaaagcatactctgccactctcaaacttgcttggcgggtaataattttcaaactttccacaacacccctcacaacctgatgctcaaggccactatactctccttcagtattttcacggattgtcacaaggttcacatcatcatatctagtcttgtagcctgggaggctgttgcaaggcctgacattggcgtagagtccgagttctttccttaatgtaagattcaaagaacggtggccttttccaataggtgtagccataggacctttcaagccaactttgtttctacgcaccgactccaggctctcccatgtcaaaaagctctctgttctgggatcaacttccgtaccaacataatgttcttcccattctatcggtacacctgcaacattgaatacctgcttgaccgactcggcgatctcaggcccgatgccatcaccaggaaacagggttgcgcggatagtctccccagcctccgtggaaaacgatgccccaacatgccggcccgtcgtccgcggtaggacaatcccctgaagcagcctccggagtgccatgtctcctctccaccactcggaagaaggagattcgcgggtagtgtcaacggcggcggcggcggcggcggggggcggatggggtccgcggcgagaggggggaggggtggacgaaagatggggatgggaaagggagcaaaaagggtgccaacttgcacagactcttggcc

SEQ ID NO: 28789 - DNA, 761 bp, Triticum aestivum
  Clone ID: PAT_TA_28789
ctcgtgccgaattcggcacgaggccgccgcaaccctagagcctcgcctccctcctctcctctcccgggcgcctccaccccccgcccagcggcgcgaagcgaccatgacgttcaagcggaggaacggcgggcgcaacaagcatggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtccatgatggatatgtccttcccaagctgtacgccaaggtgcaccactgtgtttcttgtgccatccatgctcacattgtccgtgtccgctcccgtgagaacaggaggaaccgtgagcccccgcagcgtttcaggcgcagggacgacggccccgaggcctggacagggtggcccgccccgtgctggtggccctggaggccctggtggtgctcctgccggcgctggtgctgtccctggagctcctgctccccgtgtggcgctttgatctagttctggcatgattgggcggtggcgccatccctagttttacccgtgtctggatattgaactattctacctagtttttgctgcaatcggttgtactgaaagttggttggtcaaaagcacaatttgtgatcaggtctttaatgttttggcaatttcgctgctatctataatcagagagaactttttggttaaaaaaaaaaaaaaaagtcgacgcggccgc

SEQ ID NO: 28790 - DNA, 2061 bp, Triticum aestivum
  Clone ID: PAT_TA_28790
ttttttttttttttttttttttttttttttttttttttttttttttttttttttttttcccagccagcaaacccaatcaaagcatgcaatggaaagccatacatatcatgatacggacagagatttaacttaatggataacgaaacgtcaggtagaacagactacccagacccaacggacttgacatggcaaagagtacattcatacgagttcaacaggggcacgacggcctcaaaagtccattcacttcgtcacggggtggggtgatactttggctggttatttaggtgataacggttctggggctcggcgcatccatggtcaccagctggccgtccaggctctagcccatggcgtacttctgcgtccaggagcgcgccgtggactcatacttggcccgatcagtcttgtacatgtgagcgatctcgggcaccagaggatcatcggggttcgggtccgtcagcaacgaacagattgacagcaggacctttgatatggtcaaagccgggctccactgttccttgagaatgtcaaggcaaatgctgccgttgctgttgatgtttgggtggaacaccttggtgcggaaagagaccttcgggggcttgaaggggtaatccggtgggaaatgaatgttcaccaaaaatagaccaccggtgaacgggctgtccgagggtcccatgatagtggcctgccagtggaacatgtcctcacctacaggacctgcgctgcacgaggtgggagggtccttctgcaggtccttgagctccttgaggatcctcttggacgccatgggatcaaacccggccggcgggggcgcgggggcggcggcgggcggcggcggcctctcccctctgcggcggcggcgggcggcggttggggaccacggggcaagaggagggggcgagcccacgcgtccgcggacgcgtgggcggacgcgtgggcaacccattcctcctactacctcggcacaaccagcccaaacagaactagcgagcagagccatggcgcccaacggagacaacaccgtggccaacgtccacagcggcatcgacagcaccaacaagacgctgctcaagagcgacgccctctacacttacatcctcgacaccaccgtgttcccccgcgagcacgagtgcatgcgcgacctgcgcctcatcaccgacaagcacccatggggttacatgcagtcgtcctcggacgaggcgcagctgctggggatgctgatcaagatggcgggcgccaagaagacgatcgaggtgggcgtgttcacgggctactcgctgctggccaccgcgctggcgctcccggaggacggcaaggtggtggccatcgacaccgaccgcgagtgctacgaggtgggtcgccccttcatcgagaaggccggcatggcgcacaaggtggacttccgcgagggcaccggcctggcgcgcctggacgagctcctcgtcgaggacgacggcgcggcgagctacgacttcgcgttcgtggacgcggacaagcccaactacgtgcgctaccacgagcagctgctgaagctggtccgcgtcggcggcactatcatctacgacaacacgctctggggcggcacggtggcgctgccggcgggcacccccatgtccgacctcgacacccgcttctccgccgccctcagggacctcaacgccaagctcgccgccgacccgcgcatcgaggtctgccagctcgccatcgccgacggagtcaccatctgccgccgcatcgtctaggcgggcgggcgtccggcccggcccggcgtgatcgtgatccgccgcgcgcctgccggcctgcgtgcgtgcgtggagtccatttccttaccagccgcttatcttaatcaattgtattattatttttccctgccagcgctggctagcgccgtgaagcatctgatggtttcaaattttcaataatatttttggcttttcaactttgagaggagagggaggagtggctgtacttatctactgtgactatactactatatatggtgttccgatgtgcgatgacgaggtcgtgcatgtggatgccgttgtcacccgcctaaaa

SEQ ID NO: 28791 - DNA, 881 bp, Triticum aestivum
  Clone ID: PAT_TA_28791
cctcttttagtagggaagaagcgaaagtgacggtacctgcagaaaaagcaccggcaccaagccgccgccgcaaccctagagcctcgcctccctcctcccctctcccgggcgcctccaccccccgcctagcggcgcgaagcgaccatgacgttcaagcggaggaacggcgggcgcaacaagcatggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtgcatgatggatatgtgcttcccaagctgtacgccaaggtgcaccactgtgtgtcttgtgccatccatgcccacattgtccgtgtccgctcgcgtgagaacaggaggaaccgtgagcccccgcagcgtttcaggcgcagggatgatggcccgaggcctggacagggtggcccgccccgtgctggtggacctggtggcgcgcctgctggcgctggtgccgttcctggtgctcctgctccccgtgtctagtttgggaatgcttccgtgatatggagccagccctagttttactcgtccctggatattgaactattctacctagtttttgctgcaatcggttgtactgaaagttggttggtcaagcacaatttgtgatcaggtctttatgttttgacaatttcgctgctatctatatcagagagaaccttttggtttgtctggggatgccccttgttgttttgcattgcatgcatcatatcatcttttagttctctcaagactgatttgaatcctgtcagtacttaagtcctcttagtattgaactgtgctgagtgaaaaaaaaaaaa

SEQ ID NO: 28792 - DNA, 1754 bp, Triticum aestivum
  Clone ID: PAT_TA_28792
cgtacgcacacgcgcgcgcaccacgcgtgggtccacgggtccggctagctacacagcacacgaaccgatccatccatccagaaaaaaaagaaagagtgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcggcgtctggaacgccgtggtgttcgagatcgtcatgaccttcgggctcgtctacacggtgtacgccaccgcggtcgaccccaagcgcggcgacctcggggtgatcgcgcccatcgccatcggcttcatcgtgggcggcaacatcctcgacggggagagcctaagaaagcatgttaaagagattgaaaagaaagtcactttggcccaagaatttggaagaggtgattgaaaagcttgtagacatcgtccacttcttagatctggaaatttatgatgcctttggtcatgctgagagtgaagaaccacaagaacccgtgaaacgccataatagattgggaccagcaggccttgcgctccattatgcaaatatcatcagtcagattgatacacttgtttcccggtcaagttctatctcttcaaacacgagggataatctataccaaggtctgccgcctaccgacaaatctgctctccggcctaagctacaaacttttgagataaaagaagagcttacggtttctcaaatcaaagctgaaatggagaaaactttgcgatggcttgtccctattgcccataatacgactaaggcacaccacggctttggttgggttggagagtgggcaaatacaggatctgagctgagctgcaagctatcaggacagatggacttgacccggatcgagacactgtatcatgctgagaaggacaagactgaagcacatatccttgagcttgttgtgtggcttcatcatctcatcagtaaatgcagagcagccaatggagatataaggtctcctatcaaatctcctgtccgttcaccgacacaaaagggtcatacaattaggttgcagctggacccagcgaacaattcatcgccgattctcacaccagaggatcaggatatgctaaggtgtgtcaagtacaggaaattcgtccctgggataagcaaaagtcaagaattcgacacaaagtcgaggcacgacaaacatagcagattgtgcaagagcaatagccattctccaaccagtggcaacaggaaagatctgctatcatttaggaggttctccatgctccctgtcatagactttgagattgataggacaaaggctttggatttaattgacaggcttgatggtctggaaattcagtcaggaatcaactgaaagcaatgtgaatgaacctggatactgtgtagtcatcttctattgtgaaatccatagctctggcaaggatgtaaaaagtcggtgtagaccacccgtccgaggtgaagaccgagcagtatgtcaatttgagagtaactggtgtagcaaacattgtattatataccatgttctgaacagaagagcggagttattgtaaaaactatctaatgtttagttgcttgtataaaacacaagttttgaagaaaataggatatctgtgttgtgaatatacatggcctgcaaattccagtgcttgatgaattgtttaacatcataaaaaaaaaaaaaaaaaaac

SEQ ID NO: 28793 - DNA, 1032 bp, Triticum aestivum
  unsure (1)..(1032): unsure at all n locations
  Clone ID: PAT_TA_28793
attcggcacgagggctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacatacaactccttctgttcagcgtgtgaaaaaaaaaaaaaaaactcgagggggggcccggtacccaattcgccctatagtgagtcgtattacaattcactggccgtcgttttccaacgtcntgactgggaaaaccctggcgttacccaacttaatcgccttgcagcacatncccctttcgccagctggcgtaatagcgaanaggcccgnaccgatngcccttcccaacagttgcgcagcctgaatggcnaatggcaaattgnaagcnttaatattttgttaaaaattcncgttaaattttnttaaatnanctcattttttaaccnattangccnaaatngggnnaaattccttatnnntcnnangaatt

SEQ ID NO: 28794 - DNA, 1190 bp, Triticum aestivum
  Clone ID: PAT_TA_28794
tgtttgcattgctctgtttctatgacatgatcattcagaaaaattacagaccaaacaggcttggattttaggtacttggatttttctaagggattttaggtactttgcttcgacattttcaacttcaaaatagttaggggctctctaaacccacgattctttcccagccagaaaatccaatcaaagcatgcaatggatagccacacatatcatagatacgacacagatttaacttaatggataacgaaacgtcaggtagaacagactacccagacccaacggacttgacatggcaagagtacattcatacgagttcaacaggggcacgacggcctcaaaagtccattcacttcgtcacggggtggggtgatacttttggctggttatttaggtgataacggttctgggctcggcgcatccatggtcaccagctggccgtccaggctctagcccatggcgtacttctgtgtccaggagcgtgccgtggactcatacttggccctatcagtcttgtacatgtgagcgatctcgggcaccagaggatcatcggggttcgggtccgtcagcaacgaacagattgacaggaggacctttgatatggtcaaagccgggctccactgttccttgagaatgtcaaggcaaatgctgccgttgctgttgatgtttgggtggaacaccttggtgcggaaagagaccttcgggggcttgaaggggtaatccggtgggaaatgaatgttcaccaaaaataggccaccggtgaacggactgtcagagggtcccatgatagttgcctgccagtggaacatgtcctcacctacaggacctgcgctgcatgaggtgggagggtccttctgcaggtccttgagctccttgaggatcctcttggacgccatgggatcaaaccctaatcacggaaatccgaccggcggggtgcgcgggggcgacggggccggcggtgctgcggcggtgggcggcggccgcctctcccctctgcggcggcggacggcggttggggaccacggggcaagagggggcgagaaggagtcggagccagcagctgcggccgaaccggaggccgaggcgcccgccgtggtcgagacagagaccaaggaggccgtggctgaggcagagccggcggcggccgaggaggtgaaggaagaggcggcgcctgctgccgagaccgagccggc

SEQ ID NO: 28795 - DNA, 1288 bp, Triticum aestivum
  Clone ID: PAT_TA_28795
cgccgaaggcgtcaaggaacactgtgcctaacccgggggcatgtctagcttgctagccgtccctcgtgttgcaaagctatttaatccacacgactctcggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgcctgcctgggcgtcacgcacacagacacatacgcctcacactctctatcagtcacgtcaggctcggtggatcacggtagcactagcttcagctagccagcctctgccactccgggcattttcttgcatccacgacggcaatggccaccgctgatgtccagaacccgacggccgcgctgacggaggaggcgcccacggtggagacgcccgtcgccgccgaggaggtcgcgaagacggaggaggcccccgcgccggccgaggccgaggtcaaggcgcctgctgcccccgtcgaggtcgaggagaccaaggaggtggcacctgccgccgctgagacggaggaggccaaggagcccgagccagcagctgcggccgagccggaggccgaggcccccaaagagacagaggcgccagccgtggtcgagacagagaccaaggaggccgtggctgaggcagagccagcggcgcccgaggaggtgaaggaggaggccgcgcctcctgccgagccagaagcaccggccgtcgccgaggaggcaccggctgcaccggaggaggcgcccgcggccgcggcagaggagccggccgccgcggtggccagcgtcagcgtgtgaggcgccggcgcgcgcggaggaggagctggccgggtcagcttccacggcggcggccgtgtgctcctacgtggcacggcgtgatgctgagtcagccagtggagtggagtggaatgatactttttactaggtgtggagtgggagtgctatgcgcggggtcgcgtgacgtgggctaaataaaagtgttgtcgggtcgggtcgacgcccagtgtcggtcagcagcgagcgacgcagtgccactctcgccggcctgcgtctgcgtctgcttagctggagccttgttacggtgtgtgtcacagtgtcagttccacctatgatcgatcggtatcctaaccggtttgcgttaaaaaaaaaaaaaaaaaaaaaaaaaaaaaaaaaaaaaaaaaaaaaaaaaaaaaaaaaaaaggggcggccggttctaaaaggaacccaagtcttacgtcaccgcgtgc

SEQ ID NO: 28796 - DNA, 895 bp, Triticum aestivum
  Clone ID: PAT_TA_28796
gggggcttgaaggggtaatccggtgggaaatgaatgttcaccaaaaataggccaccggtgaacgggctgtccgagggtcccatgatagtggcctgccagtggaacatgtcctcacctacaggacctgcgctgcacgagttgctcatctctccacccaatcatcactagctaatacggtgcactgttagctacagaccaagaagtgatcatggcccgcgctcaggtaatgctcatggccgtcgccttggtgctgatgctcgcggcggtcccgcgcgctgccgtggccatcgactgcggccacgttgacagcttggtgagaccctgcctgagctacgttcagggcggccccagcccgtctgggcagtgctgcggcggcgtccagagcctccataaccaggcgcaatccaagagcgatcgccaagccgcttgcaactgcctcaaggggatcgctcgtggcatccacaatctcaacgaggacaacgcccgcagcctcgcccccaagtgcggtgtcaacctcccataccacatcagtctcgacatcgactgcaacagtgtgtaatgagcgacgatccgtcaagctggtgctcagctcatccatccacgtggagttgaagcgcgcagcctctatccctatgtagtatgggcactagttatgcgagtttatactgaatatgaataagaactctctcctgctggcttgctggtactcctctggaggagatcagtatctgtgtatctgagagttgagagtttgtaccatgggcactcccagtgtttatggacttttatacatacagctcgttctgttcagtgtgtgacttatctctgtttcctcacgttcgcctgtcatatactccttccatccggtattagttgacgctcaaacggatatatc

SEQ ID NO: 28797 - DNA, 648 bp, Triticum aestivum
  Clone ID: PAT_TA_28797
aaaaatgtcttcaagccagcccgaacaagatccaaaaaccaaggccttaaatggctatagaagaagacttttggaacatcgtgaattagatgccaagcttaaagaaatgcgtcttggattgagaacgcttgataaagaatatgataaatcagaagacgacattaaagctttacaaagtgtaggtcaagtcattggcgaagtattaaaacaattggacgatgaacgatttattgtcaaaaacacaagtggacctcgttatgttgtgggatgccgtaatattatagataaagagaaattaaaacaaggagcccgtgttgctcttgatatgactactttaactattatgcgaattttacctcgtgaagttgatcctcttgtatacaacatgtctatggaagatcctggcgatgtcagttttgcaggtattggtgggctttctgaacagattcgtgaacttcgagaggtgattgaattacctttaatgaaccctgaattatttttacgtgttggagttaaacctccaaagggtgtattgctatatggaccacctggtacaggcaagactttattagctaaagcagttgctagtactcttcaagtgaatttcttaaaggttgtttccagtgctattgttgataagtatattga

SEQ ID NO: 28798 - DNA, 460 bp, Triticum aestivum
  Clone ID: PAT_TA_28798
tgggcggcttcgccatgaaagacgtcgcctccgatggtcagttccccgtagacaacctcggcgattcgcaaggccagctctcgctgagctcgcggggagaagctttcttcactcaggaagccagggttgatcgatgaatcacctacgtcgtgggcatctgcatggtctctagctgctccaagaaggtgcttataaattaataatccataatgctctgaggagcagtattttactgtctttataggtaagttatgctgtgatttaagaatacttgagtggggattatttgggagtattgggtgtgatgatcaagttaaggtttttgcagccactgtgcaatgcaattcgttgctttttttactacaagaagtaatcgttcatgtattgactggctttgtgtaataacgatctgggattttgcttgggagtctctgcttaataagttcatttttctcttgtg

SEQ ID NO: 28799 - DNA, 712 bp, Triticum aestivum
  unsure (1)..(712): unsure at all n locations
  Clone ID: PAT_TA_28799
gacagccgcactttgtttagataacttttcgtcacaagtagcttgaaagacacaacacgcctgagatagaatcaggaaagtcaaaagaagtattgatgaaccctttggtcatcagtcgtaatgaaaatgaaaaagtattgattgaaccatctgtcaactctgtacgagtgagtatcaagattaaacaagcagatgacttggaacgtattttatgtcataaattctctcgttttttgatgatgagagcagaaaattttgttattttgcgtagaaaacctgttgagggttatgatatttcctttttgattaccaatagccatacagaacaaatgtataaacataaattagttgattttattgttcattttatggaagaggtagacaaggaaatatcagaaatgaaacttagtgtcaatacgcgtgcaagaacagtcgcagaaagttatttgattcaatttgcttaaatgcgatgatgaatattatttagtttgattaaagcacatggttaaagtaaacaaaagttttgtaatcacctattttgcttctttttattttgttacatgtctgttattacatcaaaaaataagaaaatggataaatagtttttttaaaaaatcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28800 - DNA, 1340 bp, Triticum aestivum
  Clone ID: PAT_TA_28800
tcgtcttccgtgcctttttttttttttttttttttttttttttttttttttttttttttttttttttttttgatggcctaatttttgccgcctttctcatggattcgagacaaatcctggtacttactgatcacactcatgatgcgtgacgtgagggggccatgaattgcgaatcttttgacaactctatatgcgatgaagaatttctttgtactgcgatcaatggtgctcaatctatgcagcgaaatctcacttaggggtgcaggggcgaactgtagggggaccaaattgaatcaacaatgatcgtggaccccctttccgggggacggatgctttcaaaaaagacatgcttggataccttttggcacaccgccatgaacctcgagtcgcagagattcgtcacctcaatgagcccagtcccacaacacccacgggtcgtctccgtgaacccccaccgctccccgccctcggcgagctcttggatgatgtcatagatccccaagtagacaatgcgggtgttgaacccagcctccgcattcaacccgttgatgagcacctgcaccctcgagttgtagagttgtgccgcgtagttgcgtttgggctcgcagcgacggtggaacccgccaccgaccgtccgttgcgacggcacgcacccgataggtggaaggcccacgaagccgataagctttgctccacgagcgctcacgcttcggaggaacttgtccacgccgacgaggaggaggtccacgtaggacgggatgtcgtactccaggattcggaacggagtggtgaagtaggtgttggccacgtcatccgtgccagcgcacacaaaaaagaaggcgccgtcgatgatcctctcggcctcttcctcgccggcgatggccaccaacttgccgcggtactcatcgaagtactccagttgctgctccagcgtgatcacactcacgatttttggagtgagtgggtcatatccggtggcgccggaggcgaagctgactccggtgaggaggtcctccggagtgtggtcgacgttgagccacggagcaaccagcttcttcacgtgaagtttctgggcgaggaggtcggagggcacgaggccgttggagaagcggccggtggcgaggtggccgtcgaagtccttgccgtagggcgcgtggttggccttgatctgggtgtgcaggttgttgttgatgttctccccgctcttcttcgcgcccttggtgggagccatcgcgtccctcgcactccgcgtctcctcccctgccacctccaacgtaccgttgttctgctggtcccggcacacagccggacgcaccaccgccactaacgccagtaccgcc

SEQ ID NO: 28801 - DNA, 765 bp, Triticum aestivum
  unsure (1)..(765): unsure at all n locations
  Clone ID: PAT_TA_28801
cggacgcgtggggtttggtgtacagaacacggtctataacgaaggaacacactttgtgattccttggtttgaatcacccatcatttatgatgttcgtgccaaacctcgcaatgtggcttccttgacgggcacngaaagatttacaaatggtcaacatcacctgccgtgtgctttcaaagcctcgggtcgatcaactggcgacggtgtaccgtacgctgggtcaagactatgacgaacgcatcctgccctcgattgtgaacgaggtcctgaagtctgtcgtggctcaattcaccgcctcccaactgatcacacaacgtgaacgggtctcacgtcttgtccgtgagaacttggtccgtcgtgcgcttcgattcaacatcatcctggacgatgtgtccatcacccacgtcggattctcacccgtctttgaaagcgcggtcgaagccaaacagatcgctcagcaagacgcgcagcgggcggcctttatcgtcgacaaggcccgacaggaaaagcaatcgatcattgtgcgtgcccaaggtgaagccaaatcggctgagctgatcggggaggccctcaagaacaagcctgggttcctttagctgaaacggatcgaggcggctcgttaagtggcttcgatgatctctcgatcccccaaaaaggtcatgctttattttgaaacgttgctgcccaaaacccattccaacaaggaaaaggtggctgatgaataagtcgtgtataaaataaaattttgtatttgtatatctcgtg

SEQ ID NO: 28802 - DNA, 617 bp, Triticum aestivum
  Clone ID: PAT_TA_28802
ttagctagaaaaccacaccataaatttcattccatgcaacaaagatacacgaaatggaagtcacatggcacaaagcgtgcgagctcacaaccacatagcagtacaacctgaagctcagccaccggttacacgggaacacgggatcgaggccgatccggtatcctatgcgcacatcatcagcttaaccttcaggttttcgcacgacaacagaagagacgtagacacacacacacacgtacagacttttattggcacgggttactagtacgggtagacgcgtacgtgacgagaggcccagcggggagggcttcttcagtggccgcaggtgcagttggtgcaggtgcagctggtgccgcagctgcacttgccgtcgttctccgcggtctcctgcacctcgaagtggctcttctcggtgtcaaccatgacgatgccgtaggtgttgcccttcttcacgcactgggtcttgtcggcgcagtcgcagttgccgcacttgtcagccatggtggtcttgggttgtgatcggagagtgcttcgcaaatcgacttgtggttgattggttatgccggacgcgtgggcggagcagtgggcgctgcttgcggtggtatcggacgcgtggg

SEQ ID NO: 28803 - DNA, 806 bp, Triticum aestivum
  Clone ID: PAT_TA_28803
ggcgctcagcggcccacgcgtccgcgctaagaagcagcaagcaagcaaagcaagcagccactcacacactagccaggagcaagagcaccagttcaggggcaggctagcgatggagaagtcgaccaagatggtggcggtgctcgtcctcgccgtgctggccgcggcgaccagcgccgaggcgaggaacatcaagacgacggacgcggcagccgccagcaaggacgcggtcctgcagccgacgaccttcccgcccttcgaccgcctcggcggcctccccggcggcagcagcatgccgggattcagcctccccggcagcagcggcgccaccccgggcatcagcggcatcggcagcatgcccttcctcggcggcagctcccccggcctcggcggctccaccggtctcggcggcttcggcggcatgccggggtcccccgctgcagctgccgtcgacgagcacgccaagaagccgtgaaaagctgagggcggccgttgatagctagatccgctggtgtgtggcaagcactgacggggcggatggttgatggttcggtagtgctactcgtagcgtgcatgcatggttctgtgggcgctatacgccgcgcgtacgtacgtttggagaactcgatttgtttgttgtgtttgtcgcttaattacgtcgttaggtcaatctctatcgctcgttcgtgttaagttcttggttatctgtagtagtggtgcatgttcttgaggcatatgaataatgctagatgtacgtgtcgcttgtgctgtggtaagtgatgatgaaatgaatggaatattattgtagt

SEQ ID NO: 28804 - DNA, 689 bp, Triticum aestivum
  Clone ID: PAT_TA_28804
tagggggccttttttttttttttactagttaaccacacgacaaatttcattccgtgcaacacgcatacgcgaaatgaagtcacatgccacaacacgtacgagctcacaaccacatagtagtagtacctgaagctcagccactggttacaggggaggaacacgggaccgatcggctgatccaagatcctatcctatgcacgcatcagccaaccttcaggttcttgcacgacgacaacacaacatacgtagacacacacgtacagatcgacctttattgacacgggttactagtacgggtagaggcgtacgcgatgaccgagaggcccagcggggcgggcctgttcagtggccgcaggtgcagttggtgcaggtgcagctggcgccgcacttgcacttgccgtcgttctccgcggcctcctgcacctcgaagtggctcttctcggtgtcgaccatgacgatgccgtagccgtcgcccttcttcacgcactgggtcttgtcggcgcagtcgcagttgccgcacttgtcagccatggcggtcttgggttgtgatcggagggtacttcgcgaatcgatcgacctgtggttgattggttttgctcttgcttggtgaggagcaatggacgctgcttgcggtggtatatatagccgcgcgccgggccggagggagggaatcccgaggccctgccggc

SEQ ID NO: 28805 - DNA, 845 bp, Triticum aestivum
  Clone ID: PAT_TA_28805
gagcgccggccggcaagcaagcaaggcaagcagccactcacacactagccaggagcaagagcaccagttcacgagcaagctagcgatggagaagtctaccaagatggtggcggtgctcgtcctcgccgtgctggccgcggcgaccagcgccgaggcgaggaacatcaagacgacggaggcggcgtccgccagcaaggacgcggtcctgcagccgacgaccttcccgcccttcgatcgcctcggcagcgggtcgccggggttcggcgggctccccggcagcagcggcatgccgggattcagcctccccggcagcagcggcgccaccccgggcttcggcagcatcggcagcatgcccttccttggcggcagctcccccggcctcggcggcttcggcggcatgccgggctcccccgctgcagctgccgtcgacgagcacgccaagaagccgtgaaaagctgagggcggccgttgatagctagatccgctggtgtgtggcaagcactgacggggcgcatggttgatggttcggtagtgctactcgtagcgtgcatgcatggttctgtgggcgctatacgccgcgcgtacgtacgtttggagaactcgatttgtttgttgtgtttgtcgcttaattacgtcgttaggtcaatctctatcgctcgttcgtgttaagttcttggttatctgtagtagtggtgcatgttcttgaggcatatgaataatgctagatgtacgtgtcgcttgtgctgtggtaagtgatgatgaaatgaatggaatattattgtagtataagcttttgttggtttactacttgttaattaaaattaaaaaaaaaaaaaaagggccct

SEQ ID NO: 28806 - DNA, 1022 bp, Triticum aestivum
  unsure (1)..(1022): unsure at all n locations
  Clone ID: PAT_TA_28806
tcgggtcnttatatcggccgctcgagccggccgcgctggggaccatcccaccgagctagaagcagcaagcaaacaaagcaagcagccactcacacattagccaggagcaagagcaccagttcaggagcaggctagcgatggagaagtcgaccaagatggcggcgatgctcgtcctcgccgtgctggccgcggcgaccagcgccgaggcgaggaacatcaagacgacggaggcggcagccgccagcaaggacgcggtcctgcagccgacgactcttcccgcccttcgaccgcctcggcagcgggccaccggcattcagcggcggcagccagcatgccgggattcagcctccccggcagcacacggcgccacctgcgggtcttcggcggcatcggcaaaccagtgcccttcctcggccagggcaagctcgccctggacctcggcggtttctcccggaccgggtagactcctggcgggcagttgccggggctcccccagctggcgcgtgccggaccgaccgacgccaactgccattgatgctggtgaagatggtgacggacgtccgttggtagctcgatctgctggggtctgggaagcactagatggggcgcattggttgatggttcaggaggtgccactaggtgtcgtgcttgcatgctggtgcggcgtgcgctatccgccgcgcgtacctgcatttggtggactcgacgtgttggttttttttctcgctcgattacgtcactagctcgaatgtcggtcagtccggcttgctatgttctttgttacctcttcatggtggtgcatgttgtctggaggcttatgaattacgctacatgtaagtgttggtggtcttggggtggtgttggaggagtgcttcgcaaatctattattgtatgaagtaattattgaaaaaaaaaaaaaaaaaaaaaatacccgctaacagtaataaaaaaaatcagacaaataagtttatagacagacagaaaaaaaaaaacaggccgcataaaaaaaagcgggcccccca

SEQ ID NO: 28807 - DNA, 589 bp, Triticum aestivum
  Clone ID: PAT_TA_28807
gcggaagcggaagcggaagcaggtctcgactcgaagaagtcctccgggatggcgacggcgctccccatcctttccagaaagctcgccggccgcgccctccgcccatcgctggccgcggcggcggcgacgcagcaccagccggcgaccgctcgcctgctccactcgacgacgaagatgcagaagggcctcatctcatcccatgcccagcctaagcgcgagaaccctgtctggcgcttctatcgtagggcaaagtggtaccatttgctcatgatgtatggcccagcatttgtgttcggctatgcgtccatgtgggatcggcctgatggcaagaaggagccggcgccagatcagtagttagtttcttatgattattatcatcagggttgcgctgttagactaaattatctgtcatgttcactgaggtggtatgttatggtaaggctgaactagctgtgattaggtggtatcttttggtaaggctgaactagctgtgattaggtggtatcttttggtaagcttgaactagctgtgatgaggctgtatgttaagctaaggccgaactagctgttatgagctggtatgttaagct

SEQ ID NO: 28808 - DNA, 893 bp, Triticum aestivum
  Clone ID: PAT_TA_28808
ctacattttataaacatgacacgactttcaggaaaggtagctattgtaacaggtgcagccagtggtattggttttgaaactgctgttttatttgctaaagaaggcgcaaaggttgtctgtgctgatttaaatgaagaaggtgctaaaaaaactgttgtcaaaatctctgaattggttggcaaacaggatgtagctattgcttttaaggttgatgtatctaaagaatctgaagtgaaagcattagttgataaagcggttgaagtttacggtaaattgaatattatgtttaataatgctggtattatgcatcctcaagatgacaacgcgttaaatactgaagaacgtatctgggacttgacgatggatattaatgtaaagggtgtttggtacggctgtaaatatgccattatcgctatgcgtaaaagtggtggcggatcgattattaacacggctagttttgttgctctcatgggtgcagcgacaccttaattagcttatacggcatctaaaggtgctgttttggctatgactcgagaattggctatggttcatgctcgtgaaaacattcgtttcaactctctttgtcctggtcctattcggacccctttattaatgggctttttaaaaacccaggaaaaaaagcagagacgccttgttcccgttcctcaaggaagattcggtgaggctatcgaacaagcttatggggctctctttttagcttcggatgaaagttcatttgtgacgggtgttgcctttaaagtcgccggtggattagcctctgcttatgtaacccccgaaggtgaacctacggggactggaccaaagaactttgcggaaatttaattttttttttctttccttacaaataaaaaaaatggttgttccttgtccag

SEQ ID NO: 28809 - DNA, 640 bp, Triticum aestivum
  Clone ID: PAT_TA_28809
cccacgcgtccgaaacatgtcacttgctaagcaaaatttcgctaaccaatctgaagaagccttgaatcaacaagtcaatactgaacttcaagcctcgcaagtttatctttccatgtctgcctgggctcagcatacttcggttgctttaccaggtcttgaaaagtattttcgtgaagctgctcacgaggaaagagaacatgctcaaaaattgattgattatatcaataccagaggtggtcgagttgtgttgagagcattacaagctcctgaaacagattggaaatcagccaaaaatgcagttgaaagtgctcttcaacttgaaaaagatgtcaacaagtcactcttgaacttgcacaagattgctgatagtaacggtgacccacaaatgtgtgattttattgaagctgaatatttgggtgaacaagtggaagctatcaagaaattggccgatatggttactcaactgaaccgtgttggagaaggtcttggtgtttacttgtgggatcaacagctttacagagatggaacaggtgctggtagccgtgctaccggtaacgttaaacatggttaaaaacttatacaagctgttgtttttatataaaaaagtattgctgaaataaacttgcttctttttgaattt

SEQ ID NO: 28810 - DNA, 340 bp, Triticum aestivum
  Clone ID: PAT_TA_28810
cccacgcgtccgctgcagttcccggcggagtgaacggccaggatcaaacttgcggcagagagatgcttacacaccaaacttgcggcagagagatagagatgcttggtagagggatatgatgtatcttgccatggatttttttgaagattcttgcaacaagctgtatgccaagaatgcagctctcccaagtcccaatgttgactaggaggcattgtgtaaactaaatataggtaaaagaagtggcaaatgagaatattgtgatcattgaacttttgtttaaattccgtgaaggttgttgcaaatcatcaagtgtctacacttgatgtgagttggtatttgc

SEQ ID NO: 28811 - DNA, 514 bp, Triticum aestivum
  Clone ID: PAT_TA_28811
gctctgggccacggtcatgggcgcgctcgttcagctgctctccgcgcgcctcggggtcgtcaccgggaagcacctcgccgagctctgccgcgaggagtacccgccctgggccacgcgcgcgctctgggtcatgacggagctcgcgctcgtcggcgccgacatacaggaggtcatcggcagcgcgattgccatcaagatcctctccgggggcatcgtgccgctctggggcggcgtcgtcatcaccgccttcgactggtcagtttgcttccctgctccagctcctgctcctgctcgcgaccagaattaattcacggtccccatctctgttcttttcctcttggcacccaactcaaactgcataagattttggcggcctctagtttgttgttggttgcaaatcgagccgctctgttcttatctttttggagttgtcgagactagagctcgcgaataagttggttcaggtgttcctttctctggtaggtagtaaaaatctgcgcagcgatggcatctg

SEQ ID NO: 28812 - DNA, 303 bp, Triticum aestivum
  Clone ID: PAT_TA_28812
cggtccgtcgtggcgcgtgccgacggggaggagggacggcacggtgtcgaccatgcaggaggcggtccgcgagctgccgtcgccgtcgatgaccttcccgcagctcgtcgccctgttcgccggcaagggcctcgacgtgcgcgacctcgtctggctgtcaggtgcgcacaccatcggcatcgcccactgctcctccttcgccgaccgcctctacagctaccccagcgccggcaacggcaccgggaccgtcccgcccctcgacgccgcctacgccgccaacctgcggcagcgcaagtgcaggat

SEQ ID NO: 28813 - DNA, 1090 bp, Triticum aestivum
  Clone ID: PAT_TA_28813
ctcgtctacctgaagggctacaatgctataagagaggcctatccagacattcagatgatctcaaactgggatggtgcatctggaccacttgaccatcctgctgatctatatgatctccatgtctataccggttccagggcactattttccatgaagaatacatttgacaatacctctcgtagtgggcccaaggcttttgttagcgagtatgctgttacaggaaacgatgccggcagaggaagtcttcttgcttcattggcagaggccgctttccttactgggctggagaagaatagtgatgttgttcatatggcaagctatgcaccgctcttcataaatgataacgaccgcacgtggaacccagacgctatcgtcttcaactcctggcagcaatatgggactcccagttactggatgcagaagtttttccgtgaatcaagcggcgctacaatccatcccatcacaatcagttcaagctactctggttcgctggcagcatccgctgatcacgtggcatgatgacgagaacagcttcctgagagttaagattgtgaactttgggccagatgccgtgagccttacattctcggcaactgggctccagggcagcatcaatgcgctcggatccaccgccactgttctcacatctggcagtgtaatggacgagaactccttcgctaacccaaacaaggttgtgccggtgacgatcgagttgcgtaacgcctcggaggagatggaggtcacgctgcctccccactctctcagtgcattcgacctggcgctggcgcagtccaggcttgtagcggagatgtgaagcgaatgacacggcgttggtgaataagagaacgatgggcagggcaaagcaccggcaacagcaagcggagaggggtcagtgcgcgcgcttgtgtcctgataaagcactgtatcatgtgtgtacggtggtgtggcatgaaggaaatactggagtaaataaaaatcacgtcaggcttcatttcttttcttttctgaaagcacattttcagtttttctttgtgaaggtaaaaggaaaggtttgtctcttgggtttattgggatgtactattaaaccaaa

SEQ ID NO: 28814 - DNA, 671 bp, Triticum aestivum
  unsure (1)..(671): unsure at all n locations
  Clone ID: PAT_TA_28814
cgacacattccttgcggcctcttttccacacccacccccaaccccgtgcggcggcgctcccacgctgncggnaccagccactgcctcccccctccccgtcctccacctggatcgcgcccgcgagcgtctcctccgcggagacatggccggcgacgacggcaacggcaacagcagcgccgtccgcggcggcggcggcgggagcggccaggaggaggtccagatagaaatcgcaggatcctccaaacccgcggtttccttggcccatgaagcacccccacaaagcgctccggttaagcactggcaatggtggttgatggtggtactgaacatgttcttccttgtggctggtcagacgtcggcaacactcttagggagattctactacaatgaaggtggcaatagcaaatggttgtccacgtttgtccagactgctggttttccggtgttgtttgttgcccaatttcttttccgtccaaagtcaccttccacacaagcaactaccagtggccctgaagcttctatcaccaaaatcactctgatatacattgccttgggactcatcattgctgcagacgacttgatgtattcctacggtctattgtatcttcctgtctcaacttactccctcgtttgtgctagtcagctggccttcaacgccgtcttctcatatt

SEQ ID NO: 28815 - DNA, 1181 bp, Triticum aestivum
  unsure (1)..(1181): unsure at all n locations
  Clone ID: PAT_TA_28815
ccacgcccccccccctccccgtcccctgccgcctccgcgccccccccccccccctccccgggcgccggcccgcccacgccggcggcaccagccccctccccccccccgcccccgccgcgacctgcctcgcgcccgcccgcgtcgcctccgcggggtcctccccgcctgcggcggcctcggcccctgcagcgccccccccggccgcgccggcggggccttcccggtggtggtccagggtggtaccgcacgtgccccccctcccgccgggtccgtcgcccgcgacgctccccggcagagccctccgctttggcgctggcaatggcggttggtggtcctcctgtgcccggtctgccgggtggccggtctggcgtcggccccactctcttttccatgcaaagtcaccccacatactcacttattctgtctctcatgcaagttacgtttgaaaaggttattaagagggagaccttctcagtcgtgctgaacatgcagatttatacggcatttgtggctacattggcttctcttgttgggttgtttgcaagtggtgaatggaagactttggagggagagatgcacatgttcagcccagggaaggtgtcctatgtaatgacagtgctatggacagctatatcatggcagatagcttctgttggagttgtggggttgatctttgtggtttcatcactcttttcaaatgtgataagcactctagctctacccatcattcctgttttcgcagtgattttctttcacgacaaaatggatggaataaagattatagctatgctgatagccatctggggttttatttcatacggctaccagttgtatgttgatgacaagaagtctaggaagacttcatccagtgtggaggagaattcctaatgctttggtgcattgttttccagacttaatttcttggtactcaatgaggtactagttattactaggcttactagtaagttcatcaaaagaaatatcatttctatatgtatagaatgtttttagtttcttcccttttcctatgtaagcgatgtatcatcatgggaattgggaaataagaaggcaaaagtatttctgagaaaactccggttgagttgtgggggttgatcttgggggtttaacaactctttcaaatgtgataagcacccanctcngccancaatccggtttcgang

SEQ ID NO: 28816 - DNA, 708 bp, Triticum aestivum
  Clone ID: PAT_TA_28816
cttcgaactataaaagtgtcattcaagacttgttttcttataacgtaataaaaagaaagcaaatattaaatcattatttctttaaagatactatatatatctcgtccagcatgacaactaaaggagttgataatatacagaacatttacaatgtttggcaaaacttgaatagaacagaaccaacaataacaaacatcgtatttagtggacaaacagcagtcgtccatttgattcataatttatcgcccatcattttacctaaattcatgagtctcggagttcctgcgatttccacactttattttcgtgaaacagaacctaatagtggactattaaagatatataaacaagaagatagtttgacattagaaggtttgattcaatgtatgccaatcatgtcattttggtataatcatgtattgcgtgttattgcgggtaaaatattggtttcaactggtgatatttttgaatctgctttagtatacgcacaaagcataactcttcaaagtcaaaagattcaaatgctgacaagtgggtcagagatcaaacgctcggattcagattcaagtgatacttacaaaggtgaacctttgcaagaacatatttatttggaagaagaataaaaaagcaatgttttgtaaataaaagaacatgatgctatttgtttattttgtaacggtagcagtacaagtatgctgacgaacattt

SEQ ID NO: 28817 - DNA, 1320 bp, Triticum aestivum
  Clone ID: PAT_TA_28817
actccatacacttcgcctccaacccccgcggcagaaccttatcccctgcgagtcttatccccctctgcaatggcggccaccctcttctccaccgcgctctcgcaccacttcatcccgctcccctccgccgccaggcccgccgccgcctcggccgcctccttcgcctgcggcccgctgcgcgccgtgtcggcgctgctggcgccgcggaggcggctcctgctgcccgtggccgtggccgtgtcgtccgagttcgggacggaggacgccgaggaggagcagagcgagggcgagggcggtggcgactccgaggccgagtactccgaggacctcaaggtcttcgtcggcaacctccccttcaccgtcgacagcgcgcagctcgccgggctcttcgagcaggctggctccgtcgagcatggtcgaggttgtatacgatagaatgaccggacggagccgtggatttggattcgtcacaatgggttcagctgaggaagttgctgccgccgtcgagcaattcaatggctatacgttccaaggaagacctctcagggttaactctggaccaccaccaccccagagatgaattcgcacccagaacaccgaggaccatgggtggtggcggcggcggcggcagctttgattcagccaacaagctctacgtcggaaacctatcctggggcgtcgacaactcaacgctcgagaacctgttcagcgaacaaggaaaggtgcttgatgccaaggtcatctatgaccgtgacagcggcaggtcgaggggtttcggtttcgtcacctatggctctgctgacgaggtcaacaatgcgatctcaaagcctcgacggcgtggacctcgatggcaggcacatccgggttaccgtcgcagcggcgaagccgagggagcaaaggcggttttaagatgtcctgacgctggttagagatcaatcatgtgttgcgtaagtgttagtttgtagtttcttctactattttatcgcggttgatgagattgactgggaagtgaatgttgtataccgggagaattgtatcagctgtgccactgcggtgcgtctcttgagccaaaaaagtagaaattttttcaaagttagtcaaagtacttattagcagagatgatgtccgtaagcatagaagcagagatgatgtacgataccattaaaaacccttctgaatgtttgttgatgctgtgtatggctctcactcaaaaaaaaaagggtgcagaggaagaaccatccaaatccagtttggccatcaggtttttgttaaaagttgttattaaaactgtgatgttgtacctcggccgcgaccacgcta

SEQ ID NO: 28818 - DNA, 1579 bp, Triticum aestivum
  Clone ID: PAT_TA_28818
cgagcgccgtggggcgcgggcgcaagctcacgctggctgcctgctcccgcccggcgcagaacgaccggctccccctccggacggtggtccacgtgcttttcttcgagcagctccagctgcgccgggccatcgcccggacgatcgtggcgaatgaaggcggtgcggcgggccaaggagaggaagacggcgagagcgacggcggccggacgtggcgcgtggcgacgagggggaaccaagtgctgaggctggacatggacagcatgcgcaaccgggtgcaggagctggagcgcgagtgcaccaccatgaggaaagccatccagaagatagaccgccgaggcggcggcgccgctggggataagggagcggcggcaccggccgcggagggcaggtggggctcaatggtgaccaagaggttcggatgcaagttcccggcgcaggtgtgccagtcacagccgcggtccgtggtggcgcggcctcgccgggcacggattgagcagagcccctgatacctcctccctccccgctgcacatgatagctttcaccagcttccttgttttgttctcttgattctttgcttcgctttgtgaaaatacgaggggttttcctaggaggaattgtgagcttcatcatgtttgatcaatcagatttcgttgtagcagtgcacaatcgctcgatgtgtcatctatagctggctaatgcatcatgtcatatgttggctaaacaaattgcttcattgttctctccacttacacaagaccaaaaccctttgccaaaatttacaggcatgctcgagacactgaactaggctaagataggaatggatgccaatggcagttgtggtggaggcgtctcaccagtaatccccgcaggagcagccgccgtccttgaaatggtggaaccgcttgttgtccctgacgatgatctcgcggccggtcaccttggcgatgagcttgacggcgctgtggcagtccccgcagatgcggaggttcttcatgacccgcagcggcgtgccgggcggcgtgctcaccagcccgaaggcgatggccaggcgctcgctgtggtacatgagcgcgcgctccttggcggcctcgtcgatgtcgtgcagcacgaagcgggtgtccggcacgtaccccgccgcgcgtatttcctcgtgcagctcgcgaaccttctcgtaggcctccttccgcttggcctgcgccgcgtccgcgggcttccccggcgccggcctcgacgctccctcgaggacgcggcgcgcgtcggcgggggcgccgagcttgcagtacagcgtggcgatcctgtgcacgatgggcgcggcgatcccggagtaccgggacgtggacttggagagcaggcggtggcctcgtctgagggaggccagcgagagcgcgtcgacgtagcactggaggaccgctgcctgctcttccggcgcgagttggcccgacgagccgttgcctcccctccggcgaagcatttcgtcgagcaggttgactgctccctcgaggtcgggctcttggcagaccccgcggagctcgtcgcggtccaggccgcactgagtgtcactggtcgatacgctgcccg

SEQ ID NO: 28819 - DNA, 700 bp, Triticum aestivum
  unsure (1)..(700): unsure at all n locations
  Clone ID: PAT_TA_28819
ctccacgatggcacgcaagctcatgtacccacggatcctcgcagtgctcgcactcgtcatggcgacggcgtggacgccgtgctccgcggacacgacggtgccaacgatgtccccagcagcggcaaggggagacaacgcacccgtccgagctgctgcaagtgcgccggtaagttcaacagtcgccgtacctgcagccggtgcagcgacaacgcaagccacggccatgacgtccaacaagatcccgttggcgccaccagacgtggtcgagccggcagcggaggtggtgtcggcgctgccggtgccggtccccgagactcttcccagcgcagaaggccttggcttcggcagcagcgggttcaacggtggccagggcggcttcggatgctgcggaggtttcgggtacaacggtgggctcggctacaataacggaccgttgttcttcaactcggcgccggcgagaagattgagcctgacgagcatggcgaccggaaatggcctcgcggctctgctggttgctggtgctgcggcgatgttttatgtgtgatttgtactgtactagtttttattattttttggggaaggggcatgcatcaactgacatgtatcacaggcagttaatactccaaatttaaagtaagatcataataatataccatacgacgtataaaaaaaaanatgntcaaaaaaaaatnncctttat

SEQ ID NO: 28820 - DNA, 1068 bp, Triticum aestivum
  Clone ID: PAT_TA_28820
cttcatatcgtagattgttgttgcattgctctcgaggagacgaggtcattagttgattaccatgctgccgatcggttgcggattaattgggccgaaggcagtcggtgatctcttgattgatttggacgccatgaaatttggaaagtggctcaagaggcagatcgagcagagcctcccggcgtggaaggacgagttcctgagctacaacgagctcaagcccgtcatcggcgccgtctcgccggccgacttcgtcgcccgcctcgacgttcagatcgagaagatcaacgccttcttcatcgagcaggaggagttcttcatcatcacgcacagggagctgcagggggcgatcaggagcgcgctggagaggaagccggcggtgccggcggcggcgcacgaggcggagatcgcggcgatccggagggagatcgtcaacttccacggcgagatggtgctgctgctcaactacagcagcgtcaactacatcggcctggccaagattctcaagaagtatgacaagcgcacgggcgccgggatccggctcgccgtgatcgagaccgtgctagtgcagcccttcttcacggcggaggcggtgtccctgatggtgagggagtgcgaggccatgatggaggcggtgttccccacggcgcccggcgaggggcaggcggcggcgcggcgggaccgcgaggccctggtcgccgcggagcagaggatcttccgcaacaccgtgtcggcgctcctggccatgcaggacgtgcgcagcggcagctccacgcgcggccgccactcgctgccgccgctcaacctgcctgactcggactggctccgctccttctagccgccgggcccccattccccgtccaatgccccccgccggcctcttcttggtggtctccccagccaccacagccacagcccacagatatgtaattggcttatctgtagtttctaacttcttttttgtctccttttcattttaccacatgctggtgtaagatggtaacaagatgtgagcatacaaattcatactcctgtgcattatgctcctaaaaaaaaaaaaaaaaaaaaaaa

SEQ ID NO: 28821 - DNA, 436 bp, Triticum aestivum
  Clone ID: PAT_TA_28821
cgtcgcgcgaaggacccggaggcctgtctgaggcaactgagggagcgggcggcggagttcttgggaggtggatccaagtcctttaaggatgctgagaaagagattaaggagagtccatcggtggaagagccgctgattccgttggctcccaatgctctcccaccaaatctggagattaatggagtaaaacagaaaggaattcttacgggtgagtcaattcgaaagttcaatgggaggtttctcaccgatgattatgcctgcattacatccgatttgggaattattcgtgtggattatgaggcggaatttggggggcggggggagtttttgagtggccagactagaagccatgttcttcgtctctgttcgacttcgcctctttcgtctgtctgggtgttttcccctctaacaaaaatctagaattccatgtcgagcc

SEQ ID NO: 28822 - DNA, 841 bp, Triticum aestivum
  Clone ID: PAT_TA_28822
gcttcttcttggagagaatatacaactgctgaaggcaaaagtattatagtaatatcaagacaaaagaaacggtatgggaggtacctccagagataaaagagcaattagaaaaagcaagaaagatagcaaacgaaatgaaaaatataccaacaccacctattgttcctgctaaaccaagcacaccatctgttgtccaattggaacagccaattccagaatttgatacaaaagaagaagctgaaaaggccttttttagcttacttaaagaaacaggtgttaaatcagactggacttgggatcaggccatgcgcgcaatcattacaaaaccgctttatcgtgctctcaaaactattgtcgaacgcaaagcagccttccaagcctatgttgatgccgaatctaaacgagagcgtgaggaaaaagaagaatttgagcgacaacaaaagcaaagctttatggcacttatcgatcgccataaagaaatggtcaaaccctacacgcgctacagtacttttgcccatctagcaagccatgatcctgcctttaacacaattaagagcgacaaacaacgagaagcttattttgaagaatatgtgcaaaatatgcaacgcgcggaaaaggacaaattacgcgacttgcgcaaaaatagcatggagcgctttggtcagcttctccgttcgattcctgacattacctaccgaacacagtggaaagaggcactatcgctttatatggagcctaatcatgatttgaaacaagagtttcaaggtatggatatgttggatttcttatctgtttttgaggaatacaatagagctttatgggaggaaccattgaatgagtt

SEQ ID NO: 28823 - DNA, 560 bp, Triticum aestivum
  unsure (1)..(560): unsure at all n locations
  Clone ID: PAT_TA_28823
ggctcgtactaagcaaacagctcgtaagtctactggtggtaaggcccctcgtaagcaattggctaccaaggccgctcgtaaatctgccccctctactggtggtgtcaagaagcctcaccgttacagacccggtactgtcgctcttcgtgaaatccgtcgttaccaaaagtctactgaactcttgatccgtaagcttcctttccaacgtctcgttcgtgaaattgctcaagacttcaagaccgacttgcgtttccaatcctctgctattggtgctctccaagaagcttctgaggcttacttggtctctctctttgaagataccaacttggctgctattcacgccaagcgtgtcactattcaacccaaggatattcaattggctcgtcgtcttcgtggtgaacgttcttaaataatacccacattcagtacatcacagcaccgtataatggactaagataacactttacagtgattacactgccaatttgaggattttttttttttttttttgtaaataaatagttcattttatttataaaatataaaanaaaaaaaaaana

SEQ ID NO: 28824 - DNA, 794 bp, Triticum aestivum
  Clone ID: PAT_TA_28824
cccacgcgtccgaaataattatagagggcagtttatacctcatgtttaaatgattatttgttaatggctattataatagtaagatagactagatttatttttacttatataatagctatataatagttatgaaaagggtaaagaataattttaaatgttatatatagttaatgaaatgacatttagtggttatagtgtagttaatttagatttattgtacattattgctatcttattaggtatattagttattattagtaaaaatcctatagtatcggttttatttttaataggtttatttttatgtatatctgcttatttaattctaacaggattaaactttataggattatcatacttattagtatatgttggggcagtatctatcttatttttatttatattaatgttaataaatgttagaatatctgaactattaatagatagtattaatagtatacctttagctatattagtaggtagtttctttaattattttgtaaataatgttttaccatatatggttatgactaataatttactttatcattttagcattaaaaaaaatttaacgaatgttacatctgtgtcatgagatggatatttagcagaaacttctcatataacaagtataggaaatatactgtatggtaattattcaatatgattaataattacatccattatattattactagcgatggttggggcaatagttataactctaaagccacaaacgaatgcaaaataataaaaaaataataatgatagtacgtctttcctttttgtttctt

SEQ ID NO: 28825 - DNA, 1271 bp, Triticum aestivum
  Clone ID: PAT_TA_28825
agtccagctggagctcgactactccagcctccggcgagtacataccctacaagtctaagaaggttcatagaagacctgtagtgccaatatggctggcgtctccagcaatgccattgcccttgtggcactcctctccatgctcttcacgtccgtccgttctgcggtcaactacgacaccgccgtcgctagatcctacacctccggctggctcccagccaaggccacctggtacggagcgcccaacggcgccggccccgacgacaacggtggtgcttgcggcttcaagaacgtgaaccagtacccaatctcctccatgggggcatgcggtaacgagcctattttcgccggcggcgagggctgtggcatgtgctacgagattaagtgcgagtactccaacaacccttcttgctcaggccagccgaggaggatcgtcatcaccgacatgaactattaccccgtggccaggtaccacctcgacctcagtggcaccgcgttcggctccatggccaagtacggcctcaacgaccggctccgccacgccggcatcattgacatgcagttcaggagggtgccctgcaacttcccgggtatgaaggtgaccttccacgtccagcgtggctccaaccccaactatctcgcggtgctcgtggagtacgtgaatgtggacgggaccgtggtgcgtatggagctcatgcagactatgaacggccgcccgacgggctactggcaggatatgcgccgctcgtggggctccgtctggcggatggacaccaaccgcccggtgcaggggccattctccatccgcatcaccagcgataccggaaagacgctggtcgccaacaatgccatcccggcttattggcagcaggaccatgcctattggtccaacctccagttctactgatttgcttacgtgcgtacttctccgatcgatgctgggttaatcattttggtgtcatcaggatgatccctatttacgatgatcgaatgattttaagttattagtaggcactatgtactttcaagcgtgttaactgtcctcgattgtgtgtcctgaatatgtgtggctgtctctctgtgtgtgtgtgtgtgtgtgtgtgtgtgtgtgtgtgtgtgaaatgtaaggagctaggcaagtggagtatcatccatgtgctaccccggccactatcgcagttccatgcctgataaagtgtgatccaattaagcttataaattaattcaaatggatgtagtccatggccgtgcggacatatatcatcatggccatt

SEQ ID NO: 28826 - DNA, 1273 bp, Triticum aestivum
  Clone ID: PAT_TA_28826
cctccgcctccaggtcgcgagtcgctgccgcaccacgtctcgcctccgcctcctccctcctccctccctccccacaaacacccccggctcccgccgctgccgcgtcttctacccgtccagtcgccctccccgctgccgacttgtcgccgcagccgaagcacagcacagcacagcgcggaggcggagagaggtcgatccgagggcggagagagaggacgtagcgcgcggaggggagtgaggagggagggcgggatggagggcggacgatgactgcgcgcgccgcggcgggatgaggacgatctgcgatgtgtgcgagagcgcggtggcggtgctcttctgcgcggccgacgaggccgccctctgccgtccctgcgacgagaaggtacatatgtgtaacaagcttgctagtcggcatgtaagggttgggcttgcggaccctaataaattagtacgctgtgatatatgtgaaagttctcctgctttcttctactgtgacatagatggtacatcactttgcctgagttgtgatatggctgttcatgttggtgggaaacgaacccatggaagatacttgctgctaagacaacgagtcgaatttccaggagataaaccagggcatatggacgatgtagccatgcaacagatggagtctgaaaacccaagggaccaaaataatgctcattcggtagcaaaggagcagatggtgaaccaccaccacaatgcctatgatccggcctcagatggcaattgcaacggccagggtgccattgactcaaaaatgtttgatcttaatatgaggccagctcgtaataatgggcaaggttcaagttcccagactcatggagtggatcatagccacaacaataaccatgactcttcaggagtggtgccaacatgcaattacgatggagccaccgacaaataaatgtcagaaactcggaatgtaaattgcttcggttgctgttataaacatttcttctgcaccgggagctcaaattagctttagccttagtggccaggctaaatgtatcgttgcagggaccttagaatgtgtgttgttttcgaatagagacgaagctaacgactgtatctggattcagcacggcatgcactagacgctgtgttgcggatttctgttgtacgctatcaggaactgtacaaagaaataatagatctctcattctgtgtactggaactgctgtatatgccaactgttgtgaatgtcagaactaagatgttgcaaggagtaaaaaaaaaaaaaaaaaaaaaaaaa

SEQ ID NO: 28827 - DNA, 902 bp, Triticum aestivum
  Clone ID: PAT_TA_28827
aaaagaaaaattaaacatgactaacaagtggtccatccaaattcctgaaacaccttccccaaactatattcttgtcaagaatatttcctctaaatcaactgaacaaacagtaagagaatttttcttgttttgtggtaaaatcaaagagtttgagctgaaatctgatgacgaagataacaaataccaaattgctttaatacactttgagcgcgaatctgctgctaaaacggcatcccttttaagtaacgccttgcttgatgatagccatataatggcttttccttatttcgatatatcttcaagcgatgatgaaaacggtattgattccgagcaccttgaaactcaagaatcgaaaccaaaatctcgtattgcagctgagatattggctaatggttatatacttcaagatcatgttgttgctaaaggtattgaatacgacaacaaatataacctttcttctcgcttgactagttttttgaatgcattacaaaccaatgttaagcattttgaagaaaaatatcgtatttgggataacgtgattaacattgaccgaaagtataaactcagtgaaaaagcccaaacggctgctcaaacagctcagaatagagcacaagtagctcttcagaccccaacaggtcaaaaggttcatgaatttgctagtcaaacactggctcaaattgccgctgttcattatgaagcaaagaaaattcagagcgaaagattaaacaataacaacaatggagcctctaatgacacctctgagaatcctattgctacccctgcttagtaaacgccattcgctctatatctgtatggtcaatggctacttgtacttttttataagaaaaagaaaaaaaataaagctgcaaatgcttttggttaataaacatttattgtacttg

SEQ ID NO: 28828 - DNA, 667 bp, Triticum aestivum
  Clone ID: PAT_TA_28828
ccgaaggaattcggcacgaggtaaaggttggactgtacctctttcggctgcaaaagggaaatcctggcaagctgctcgtctggttcatccttaaatctgatatagaagacagcatcacggatgaagatgaagccccgggatctccaaccaaaaggccctcatcggacacaagcggcatatctaagctaagcaatcggagcgacaccattctggcgtccacggagaagttggggccgacacacgaatcatcagaccccagtcgacggggtacccgcaattccagtaagcgacagatatctcctgccactgtcaaaggagctgctatggcagaaccgatcggcccctctaatgtaaacggttcccgccgccggtacccctttcgggtccggaggaacgcagcagggcaacagagaataagctggtaatgctgcgcactaaatcaacccccctatggggttgacgggcattacggatacttagtgatagatcacatagcttctagatacatcgaagaaatggtcgatcgctgtctttgcggaatcggccacataggcacgtgacatttctgatgagagtatctggggtgtgatccattgactgattgttacttggtaaaagttgcaaacttaaggctggttgttacttggtaaaagttgcaaaaaaaaaa

SEQ ID NO: 28829 - DNA, 589 bp, Triticum aestivum
  Clone ID: PAT_TA_28829
gcaacaggctcggcgtcatcggcctcctctacgccggcatggagagcggcatggtcacagccagggacggccaggacgactggatcaacagcgtcgtcgccggcctcggcaccggcgcgctcttccgggccgcccagggccccaggtccgccgcggtcgccggcgccgtcggtggggtcctcgccgccgccgccatggccgccaagcaggcagccaagagatacgcgcccgccttctgattgattgattgattcatgccctcctcctgccggccggtattattaatcttaatcaatcgctcgctcgctcgctgctcctgtctgtcatcaatcgaatcaattggccaaggatgtagtactagtttcttcgtttattgctgtcagagttaattatttgagaagggtcatcttctcgacattattatgatatgttataagtgttatgctatatgaaaacaacgatgccatcggtatcatctgatcagcaaatttttgacatgccttgttgcaatgtaacatcatcttctttcttcatcactacttagttagcgacctagattgtcgtgggtgtcagactcaataatatgtgt

SEQ ID NO: 28830 - DNA, 1384 bp, Triticum aestivum
  Clone ID: PAT_TA_28830
cggccgcgtgggcaagcactcccacttccggcaagggacctcgtattgcattgccgacgcgtgtataaatacgggcaggcctagatgtccaaattcattcattcattctctcacaggcatcgatccatctaaactaggtggagcagtacatacacagcaaagcaaggcataatggcctcgggagtgttcggtacccccatttcagagaagacggtgctggccactggagagtataaggaacccatcactcaaaaggatgttgcagactataccatgaagatgatcaacgccggtggtaaggatattaacgcacaaaccttcgtcgacaacctcaaggagaggtatggtaacggaatatctgtaaaatgcctcatctacaatgccaccggtgccactttgaacttggctaactacaaagactggcacggccatatctacgatacaccctacccatcagatattcagaatgggcaatggggggcatttctccacgtccacccaagtggcgctgcggttggttcagctggtgccgttgtgtatcgtaccaaggtcccatccagcagcagctcctccggttggttgttctcctcccccgtcccccacattggtgtgggtgtgacctgcagcgcattctcaaaggcaatgccccaagtgtgggtaggtggccttaagtatatctatgggatgtggctgatgaaaatctatatcctcactactaaaaacaaagattaggttgctgcgccaactaccgtcgaaggtggccccacaaccatcggtggtcgtgcaatttttcattaccggaacgttatctcgtcacctcaggtggaggctgacctcgcaatgaattgttgttcgtgtgaagggggttggttttgttcattttcgcgtatggtgttggtttggctccggctagtttgttctgatcaatcagaatccaagaaaaataaggaaagaaacctgttacctctggttaagaaccagtcagcaggctcccatttaccagcaatagatcaaaaaaaaaaatgatggcgacccccgtaccagttcccccctcgattgagttccacacaaaatccaatatttgcgggcgccccggccccccttcccccggtgctggggccccagataaatttaaccgtagaagctcccttcccatggtgctgtgatctgtgcactcgtctgttgcacatgggcaaaatagaatgcgaagataatggagcaaatatagaacagtcgggaccgtagcatgacgccgttgtggagaaaaaatccccgatttggcggtaatattcagagttcagggatgcaggctccttgtgatggcagagccaatcccttgaacgccacgcccaccctgacggcgcctcatcctcgccggcgccgc

SEQ ID NO: 28831 - DNA, 434 bp, Triticum aestivum
  Clone ID: PAT_TA_28831
ttccgggtcaacggggccagagatcatcaccaccccgtatgactggcgcatccacgtcggcgatggcgagtcggcgccgcgagaccgcagtgagcgcatctgccaccctgccgctcctcctgtagccggcgtgatgacgacgaagatgaccaccgtcgggaggaccaagaccgagatcgtcggggccgtgacggctccaggaacggcaggggctggggggagagggtgcgtcgcagcctctcccgcgccccccgggacgacaaccgcgaccgtggtcgagagcagcaaggaggtcgtgatggcggtcggcgatgccatgaggaagtggccccttcgctgctgctacgtggctccggctcctccagcgtggtggccgcacacgatgcggagatggtgccagttgctcctccgccgcctgcccgtacaatctcccc

SEQ ID NO: 28832 - DNA, 360 bp, Triticum aestivum
  unsure (1)..(360): unsure at all n locations
  Clone ID: PAT_TA_28832
cccacgcgtccgcaagggccgtgttttgggttacgaacgtgccaagcgcaaccaaaaccccaatgtttctttgatccaagttgaaggtgttcaaactaccaaggacgctcaattctacctcggtaagcgtgttgcctacgtctaccgtgctcaacgtgagatcaatggttccaagatccgtgtcatctggggccgtatcgctcgtactcacggtactaacggtgttgtcaaggctcgtttccgcaagaacttgcctcctaaggtctttggtgcttctgttcgcgttatgctttatccctccaacatttaaagtgtaaaataaaccgaaaaagaaaacattgcgtgcgaatgaatacanna

SEQ ID NO: 28833 - DNA, 681 bp, Triticum aestivum
  unsure (1)..(681): unsure at all n locations
  Clone ID: PAT_TA_28833
cccgtgtttcccgttggaaccccgacggcgnggcgttcaccttggcagntcgccgcgttccngatgtacgacggcaangatttcggttgggcagagcgntcgccgtgcggagcgcccgggcgaacagttggacggcaagtgtcgggttccccgggcccaggcgggggacggcagcttggcgtggggatgtgcctcgccccggacaccatgggccgcctcctctgcgacgacgagttcctgcagttcgtgtcccatgcaccttcaccttgatgcagtgcaccgcatctggagtaccagcgcataagatgtgacatggccacctatgatcgatgtggtcactggacatgtcacatgatgcatgtatgtaacacatgttgcgcagcagatacgtaatggatttgtatggttgcaagatatcaagaaatatcatggactggttggctactctgtatatccaggagtggccagctagataggatatgtagcggtgctactggcgctcaagtcgtgccgaagagggccaaaaccactgtatttttctccttttcttgtggaaacactgttatcattttaaaaaaaaaattaaaaatgatttgatctaaataaaaaaaaaaaaaaactcgaaaagggtagaaaaggaaaaaaaaaaaaaaaaaaaaaaagggggggggcggttttaag

SEQ ID NO: 28834 - DNA, 466 bp, Triticum aestivum
  Clone ID: PAT_TA_28834
cggacgcgtgggcggacgcgtgggctttaaacatgggactctttgacaaatttagcgaacaacacggtgaagttcaaaatactcctcacgaacataagggtcatcttagtcatgaactcattgccggtgctgcctcttttgaagccatcaaggcctataacaaacactgtgaagaaaatggtaagccagttgatcacggtactgccaaggctcttcttgctggttttgctggtatggctttggacaaattggttgaaaccaagggtcttgatttcattgataagcaaaaggccaagagacatgctgaagatgaagtaaagcaatactatgaagaagaacactaaagtcgctcctatgcaaatataggcatacccattttctttgtaacataaactttcaaaaaatacctttttaaaataaacaaatgcccaaagctatttgttatttgttattaaataacatcatt

SEQ ID NO: 28835 - DNA, 829 bp, Triticum aestivum
  Clone ID: PAT_TA_28835
cttatgccttcagtagattcgtcttcaaaaccacttaccttatcacgcgtctatggcactttgactattgttcaatctgtttctgctgctgtatactccgtttatgtactcattcacggtgtgcaattggtgtctgctaatttcggtggtgtcgaattagccaatcgtacacttccactgacaagacctctctaccaagaaaagggaactgaaatagttcttgttgtcggctcagcgttggtacacttgttctctggtattgcaaagtttggcatacgagcttactggaaaagatttggtcaagataccagtcatcctgctttactaccttatcatcgattcgtaggacatatgcaagtcccagcacttttgcttcactattatctcgttcgtctcttacccattcaaaaatacggtgattcttcctttatcgattttagttatatcggttggggtcttcaaaatagaccaaaattcacttatgctttgcatactacgttgatcgtcggcagtatgtaccatgctgtgagtggcatgagcttcatttacgcaagatatctaaagaaaggcaaatctacagagaaagcagcccaggtagctcaacacagcaaatctgttgaacaacatgttttgatcgaaaaatataagcgcaaccaacgaatcaagaaaggattggttgcagctctcagcattacattaatatccagtttagtgatcattggtaaagacacaacaaagatcccattaagacttgatttcgaaagcatgtattccaaaatcattggactttaaataaatttacaattgtttcttttttttattcattgtt

SEQ ID NO: 28836 - DNA, 596 bp, Triticum aestivum
  unsure (1)..(596): unsure at all n locations
  Clone ID: PAT_TA_28836
cccnccgngttccgtcgcgccagcaggagcagcaggagcagcagcagcaggcccgcccgcgcgggctcgaccccgaggtggtcgcctcgttccccgccatgacctacgccgaggcgagggcgctccgggacaagggcggcgacgacgcggccgtgctcgagtgcgccgtctgcctcagcgagttcgaggacggggaccagctccggctcctccccaagtgcagccatgcgttccacccggactgcatcggggagtggctcgccggccacgtcacctgccccgtctgccgctgcagcctcgcccccgaggagccggccccggccgcggctgaagagaacggcgccggtgcggaggagcagcgggcgccggaggtggccatcgacatggaccgcgagggcgacggcgaggcgcaggaggagaggatgagagaggcggcggagctggagcggatcggcagcctgcgccgggccgtgcggtcgcggtcggggcggccgttctcgcgcgcgcactcgacgggccactccctctccgcccggtttgacggcgacctggagcggttcacgctgcgcctcccggagcacgtgcgcagggacatg

SEQ ID NO: 28837 - DNA, 1647 bp, Triticum aestivum
  Clone ID: PAT_TA_28837
ttttggctggtagtaataaactgatatacggcaatgctcgacagttccattgaacggtaaaatacactttaacctcccagtaaaatcccacactgatgatcgtcgcatcagttgcatacaacaacgctacccagtgaagcacttgctcgtagctttgctgagcagaacaatggaccgcacacacttccgctagcgtggagcggcggccggcagcggctggccccggaggaagtggtagagcatggcgagcgagcggtcgggcgcgaagagcggcacctggtgccccgcgccgcgcaccgtcaccagtgtcagcccctcctcgtactccaccgcccacccggccacctgctgccggtagaaccacgccctccacccgctcctcgcccgcgcccgcagcttcatcgcgttgacgctgtaccgcgtcgacgtcaccggcaccctcccgtccgtgtcgccgctgtagacccagacgcgcagcccggcggccatgagcttcttcaggatggggagtacggtcgccggcgagtcgttccatttacttatcaccgcgctgcccgccgagtatcggtacttgaggcccgtccggttggcgtgcagcgcccgctgcacgtcctggcggttaaaatacctggtcacgtacgcctccgtgcacgggtcgtaccccgccggcgcacgcctcatcatgtgccatgcctcgtgctgggagaagaggcgcggcgcggcgacgagcctggacgggcgcggcgccgtggagccggggccggcggagggagagaggcacgtcggcgtgtagatgctgtagatgtcgatgtcgtcgaaggcgcccatgaaggcgcggacggccgacgagcagcccttgccgggcttgccgccgtcggcctcctccctgaagtagtcgcactcccgcgtcaccgccgagtggagctcgtcggagatgatggcgtggctccacgcgtactccaccatgcccagctggtccgtctcgtcgttcagcaccgcgttgccaattatgaaacctttgaggttgatgattctgcctctgcccgccgctttgttcccctcgtagatgagatctgcgagctgtgggacgtagtgcccggcatagctctctccggcgatgtagaagtcgcggcccttgaactccgggaacttggcgagccagttgaggaggaaggtgtgcgagtcctgcgccgtcacgcggtcgccgaggcggcccaggtccgccgtcttgttggtgtaggagaaccccacgcccaccggcgcctccaggaacagcaggttcacggctttgttccacgcgtaggcgttgcgggtgaggttcgcgccgtagcccctgaccaggaacgggcccagctcctgcgcggcgccgtaggcgatggacgagctcccggccctccgttgagccgcagcgcgaggggcttcttctccggctccttctcggcctcgaagaaccagtagaagagcgccctgtcgccgcccgttccgacgtcgacgtagccggcgtagtgcttgaacccgacctctggttgcccggggagaccggtgacgaggtcgccctctggccgcgggctccaggaggctccggcggccgccgccgacgccgccgtggcaaggaggagcagtgccatggccatggccacggctgct

SEQ ID NO: 28838 - DNA, 948 bp, Triticum aestivum
  Clone ID: PAT_TA_28838
cataatctggtgatgtacacggtaatgtatattgtagaagcgatctagggtataacaaccagcgcatgcgttcatgctcctctttcctgtctcctcctcttccttttccccggcatgatgtagccgcgactatgcagcgcctgacgcttttgccttttcctgggcttcgagctttctccgtgctgccagaatcatctcctctcgccgtctttgcaaattcgcttgcctctcactcttgtctgcactccatgatttcgccttcggctgctcctcctgtgccggctgcgagacttggctaagcttcgaggacagattgtatcgtgttatcagatcgggatgtgcgggtctcgctggggctggggatgctcgcgccggtgtagctgcgactcgcggtgccggtgttggtatttggaaagacgctggtgccgtgtctaaccctcgcccgctcagggcccgctccgttgtcgccgcaacgtttccgccattcctctgcagatcccatgcgatgtcgcgtctgctcaactgcggcagcatctcagcgacttggtctatttgcgcagggctcacgcggagtgcagcgcgattcgccgcagctcgcgtgcctggggccgccgccgtcggctttctcaagtaccatcgtacagcaaggaacgtgacgacgatgaaaacgatgacttggggaatgttgatgctctgttccgccatgactctatctgcggtatgagtcggaggctcgtgagtcgatgcgctgtaattgtgtatgtaccgaggtgcggcgtaaagtgcgttggtagcagccgagactcgcaaacgggtaccaaagttgtagttatctgagcaaacgtgatttcagatcaccgattgctttaagatgtcaaacgagagcgcgatagcggtatgagcgagtttacggacagtgtattgaacagtgttctgtcaagttcaagt

SEQ ID NO: 28839 - DNA, 1008 bp, Triticum aestivum
  unsure (1)..(1008): unsure at all n locations
  Clone ID: PAT_TA_28839
aaaaaaaagcaaaaaccgcgcaagcacgcggacgaaaaccaggaaccccaaaaacggccgccccctttttttttttttaaaaaaaaaaaaaaaaaaaaaaaaaaaaaaaaaaaaaannanaannnnnnnnannnnnnnnnnntcnnttaaaaatttcaataagagagttcccttattgtttatttatttattttttaaaaagaaattcaaattacaacgttgtctttagctccctctttactttgattcctcggcttcttcagccttaggttcgggcttatcagattcatcctgtaaatcagatgtccacaatgtcaaattgtctctcaacaattgcataataagtgtagagtccttgtatgattcttctgagagggtatcaagctctgcaatagcatcgtcgcccgcttgcttagccaaatgacaagcgcgatcaggtgagttgagaatttcataatagaaaacagaaaagttcaaggccaaacccaaacgaatagggtgagtgggtgctaattcggtttgagcaacatcagtagcactcttgtaggcttcatgtgcttcagtggcagattccttgcgagcttcaccagtcaaaaattcagcaaggtaacggtgatagtcacccttcatcttgtaataaaagaccttggattcgccaccttcagcaacagggatcaagtcttcactcaaaacagataagatatccttacagacttcctgaagttcggtttcaatcttttgacggtaggttctgatcttttcaacctgagcactattacccttgctttcttccttttgctcaattgaagaaacaattctccaagatgcacgacgagaaccaataacatttttgtaagcaacagacaaaagattgcgttcttcgacacttaattcagcacccatcttggcgacttccttggtaaattgaaccatttcatcataacgctcagcttgctcggcaagcttggccatgtagacattatttcgcgttcagtagcggacgcgggg

SEQ ID NO: 28840 - DNA, 1019 bp, Triticum aestivum
  Clone ID: PAT_TA_28840
cttgcgctctgaattggtgggagtgcgtttggtcgcggtaggggagttttttttttttttttttttttttttttaatctctccttttcttatatattatatccttttacaaactacatgaatcatgcatttagatacctataatgagataaattgatgaatcttataaataactaccttatcgaagcatgaatgaacatacttttaaaagtctgattaatcaaccatgcatatagtcccgaatacgtgaaaaagattacatatccttttgatcaaaaatatgtaaatcatgcaaataagtaacataaacagggataccatgaaaattagatcgaatcataagtttatccaagcatgaattgcgatcggtgggggagggagcctgaataggggagatcgagttgaacgtatatgtgtttgaacatgtaacaggagaaaagcagatcggtatggtgcagctgccgttagcggcaagcgttactccggtagcggtggtagaaggcattatggatgtgtagaagattcgaccccatgggagtggaatggactcaagatcggggccacggtagaagtggggcacggggtacttcattgcggcactgggctggacggcagcagggttctaggtcgatggggcacgttgaggctggcgatgccggaggatgttggccctggatggcggctgcaggaggcacacagcggcgtcggaggtcggcggaggccgccccaggagcggggacggcactgctgcgtgtggccggcacaccgatcgtgagcttcagtaggttcaggcacgttggcgcacacgcccagcttcagcgtgttgatcgggcagctgcccccgccggtcgatggcacgacaggcggtgggcggatcggcggggtaggaacgacaggcgggcagttgggcccgcagccctgtacggcggcgaggaggaccaggttcagggcgaggaagagggcgagcttggagggcgccattgctcttactggtctgtgggtaagcttggcaggccttgc

SEQ ID NO: 28841 - DNA, 709 bp, Triticum aestivum
  Clone ID: PAT_TA_28841
gtttttttttttttttttttttgggtcgacagacaaattccatttatttataatcaatgtagcaatggcacattttctgaacagggagtgcgacatggtgcggtataccacagtgagaaatccatgttctgttattccgggttgttacggtgtctctgaaattgctggtacctcatctctgctcggatgaacggtcgcccttataaatcccgaccgcacctatcgcagacgggtgtttttgcctccgattctggcttcttgatctgcttctgcaactgcggcaagtcatgctcgagcacatcgctgagtgccttcgatgcttctgtgagctcctcgggactgattgaaatgggaggggctaatcggattatggtgtcatgcgtgggctttgcaagaatgcccctctcctttagcttgatgcaaatatcatatgcagaagcagggtatagagctttgctgcttaggtctactgcattaagcaaacctctcccacgtatttccctaataatatcaggaaatttctgttgaacctttcgtaactggtctctgaactcctgacctaactccgcggctctttcaacaagaccttcatccttgaccactttcagagatgcgattgccacagcacttgccaacgggtttccaccaaaggtacctcggccgcgaccacgctagatacacagcatgatatccttatccgcggcacgag

SEQ ID NO: 28842 - DNA, 1120 bp, Triticum aestivum
  Clone ID: PAT_TA_28842
aaacaaaataaggtttttattttatggtttgtctggaagctaataccgattcttacagactcatggagcataaataatacggagagtattagtgtttccgagtccacctctccatccttgaacagcaacaacaggttgaccacgactaagaagaccgtacttcatagcttgttccattccccatcgaattctatgatcaacgtcttcttgccaaggtgcattctcaactgggcttaaatggccttgagaagaagaatttaagagagaagtaatagcagatgaggcctttggataaaggaaagggaaacaacctctgtacaagtgaatttgtcgtgcggtttgagggttacgagtgacgacaacaataggtgcattaggcttatacttggatatcaaacgagcagaattgccagaagtagtcaacacaataatacatccagcattctgttcatgtgcagccgcgacagcagcacaagcaactgtctcggtagtttcagttggtaattcagtaaggtttctcagctcattgaatatggcaggatagcaaagtacggattcagctagtttacagatgtcgtgcattgttttcacagcatctactggatagttaccctttgctgtttcaccagaaagcatgacgcaatcagcaccatctaaaactgcgtttgccacatcagatacttcagcacgtgtaggtcttgggttgtaagtcatggattccagcatttgggttgcgcagataacaggtttaccggccagattacattttgtaatcatcattttttgagcaataaagacgcgttcaagagggatttcgatacccatgtcaccacgggcaaccatgacaccatctgtttctgcaagaatatcatcaaaattttcaacgccttggtgattttcaatttttgaaataatcttgatattctttccgtctggacccaagacctttcgaatatcacgaacatcttgaccacgacgaacaaaagaagcaaaaataaagtcaactttttgttcgacaccaaatcttaagtctgccttgtccttttctgatagagcaggcaaatctactggtgtatttggcaaattgacgcccttgtgagcggaaagtcggacgcgtggg

SEQ ID NO: 28843 - DNA, 777 bp, Triticum aestivum
  Clone ID: PAT_TA_28843
aaacagttgcatatgaccttttattgtgttgtatcgtacatttatctttacatggttacataaaaaaggatcccttccagctcccgttgaaaggtaacataaggttcccttctagcacctggtttgctgtatgtaatgggctcttggtttactttactaactactatgggatttattctaccatttttgaaattaaacttattgaaagtacacatatgctggatggagctagctagtcgttgatggcctctcattgtcctcgatgagcactgagcgagagggaggagcatgggagatcaattgttgtgccacaccacgtgatgtcgttgctgcctttttggtgtactctgctttgatcttcttcaacctcacaaccacgttgcttatcgttgttctctcgtcaggcgagtcactgcaacagagcaaacctagctcaaatactggcacaagaaatccattggccaagtcgtagctagaaaagcagccttgtagtatctggtcatccacaacacccataagctctgtgggaaatgcatggtgaacccactgcctaagggttaattcacctccaaacatagcatcagtgggtcttcttctagtgaagacttctaggagcatgatcccgtagctgaacacatcgctcttccgtgatgcttttccaagagatccgtactctacacaagaaacaaaaaacaaaaaaatatatatatatatatatagtatatatatgcatatatatgtcgaacttgtctgcccacgcgtccgcccacgcgtccg

SEQ ID NO: 28844 - DNA, 793 bp, Triticum aestivum
  Clone ID: PAT_TA_28844
gagaaagaaaaaggacaaactgatatatgtctttgacccctttttattgattaacaagatggtattgtgtaacctgtcgattatggatagattatgttacacattcatgaaattaattaagcaaaagtaaaataaagagttgctaaagtaatcgaaaccaagatctttccaacactagccattctttgagaaccatcggatgaagctaatgtacttgatgtagtactactgcttggagagccacttggcttagccaaaacttgactagacattgtaggactagaagatacgatggctgaagtagaccaagcaccactactggccgtactcatactagcagatgatgttgatgatgcttcagagatggaggcactggatgctgttacggatcctgaagacgatacgtcagatgataaagtagcagaagaagcagcaattaaagtagttgagctatcaacaatagtactttcagctgaatctaaagtggtggtagcacgagtagtttcagtaggcatgacagatgtcgtggtagtgatggtggtagcagctaaaatctcctctgtcgggttagcttcttgctttgtagtctctgtcaaatagtttgaaatttgatcttggcccacgattgatttccaccaaaaaatatcagtattaagaggaggtaaagtaggttcagcaacttcagcagcggtcatagtggcgccattgtcattttcttcaagaccaaaaacaacaagttgttgaatactaagaagagtaactaaggataaagcacttgtaacccacgcgtccg

SEQ ID NO: 28845 - DNA, 913 bp, Triticum aestivum
  Clone ID: PAT_TA_28845
gaggacgagccaacgaggggagggtggcgagatgacggcggggcctaagagcggcgggggcggcgcggcagccgcgcgagcggcggctgcggggccgaggacggtgctcatcacgggggtcagccgggggctgggccgagctttagctctggagctcgcgcgccgggggcacgccgtcgtcggctgcggccgctccgccgatcccatccgctccctcgaggccgagatgggttccccgtctcgccactttctcaccgtcgccgacgtcaggtctgacagcagcatgggtgaactggcaaaggctgttgtggaaaggaagcaaattcctgatatcatagtaaacaatgctggtacaataaacaagaataacaaaacgtggaatgttccagcagaagaatttgatacggtggttgatacaaatattaaaggaacagcaaatgtacttcgccattttgtaccacttatgatacagaagaaacatgggatgataatcaatttatcctctggttggggaaggtctgctgctgcagaggttgctccatattgtgcttcaaagtgggctattgaaggtttaacacgctcattagcaaaggagttgcctcctggattggcagcaattgctcttagccctggtgttgtgaataccgatatgcttacttcatgctttggaagttcagctgcgttataccaatctactgagcaatgggcacccaaggcagccacaatgattctaagcctttcactggaagataatggtgcctcactaactgtatgatgctgtagcaatgttgtattaatcacagatcggttctcaagtaattatgacatttaacttgctgctgttgcatcaattatgttgtagtaataagataaaaaggttcaggtaaaaaaaaaaaaaaaaaaaaaaaaaaaa

SEQ ID NO: 28846 - DNA, 652 bp, Triticum aestivum
  Clone ID: PAT_TA_28846
gattgggctgaaactgtcttttccttttcatttatttatatatgctgaagcatccaaatggcgcaatcgcctcttatacctcttcatatcctcaataattatttactacattcgtgtgagccattcgtagagctcatcaattttgggtacaagtatacataagttaaaccacaacaatatctgcgtgtgtgtagcagaatggacaatgtagatcagatcatctccggtcagtggagacttcagctccgctgcagtgtcgccgcggccccgggcttctcccagacggcgtagtcgttgccgtgtgccgaggtcacgaaccctgccgggatcaccgccccgacgtcgtacctggacccgatcttcaccaccaccttgccgtcgatctcggcgacgtaggcgtccccttcgtgcatgaggatcttgagtgcactcgtcgccgtgatgccgttgcgcttcctgatcgccaccagcgccgcgatctcgtccttgaacccccaggtgaagaaatggtcgtagaagatgcatgggatgccggggtgggtgaggatgtacgcgtagccctgcatgaccttgtcggaggggaatggccacatggcctgcgtggagcccgtgtcgtggttgtcgacgaaggtgacggccttggccggccgcc

SEQ ID NO: 28847 - DNA, 1671 bp, Triticum aestivum
  Clone ID: PAT_TA_28847
tttttttttttttttttttttttttggggacaaactcgaatttattaaatctcttcgtatcctcagtactttatttagtacagtcgtgtgagcaattcgtatggctcatcaattttgggtacaagtatacagagttaatcatagtatctgcgtgaatccagcagaagtcgactcatagactcctatcttcagaaaagttcatagctcgagtcgaatggtggactcatgtggagacttcatgctcctgctgccgtggttcgccggcggcgcctgggcttcctacccagacggtcgtagtcgttgccgtgagctgaggtcacgaacccggccgggatcaccgccccgacgtcgtacctggacccgatcttcaccagcaccttgctgtcgatctcggcgacgtaggcgtccccttcgtgcatgaggatcttgagtgcgcttgtcgccgtgatgccgttgcgcttcctgatcgccaccagcgccgcgatctggtccttgaacccccaggtgaagaaatggtcgtagaagatgcatgggatgccggggtgggtgaggatgtatgcgtagccctgcatgaccttgtcggaggggaatggccacatggccctgcgtggaagccggtgcgtgggttgtcgacgaaggtgacggccttggccggccaccaccccatccaccccgggggccttcccctgcgggtcgatcagccgccacagctcgccctccacggccgcgttcagtatccccttggtcgtgaaatcgaacaccatgcctgccgacgccgcgccgcccaccttgtccacccagttcaccagattctgccggtgcgcgtcctggtcgtagttgggcttgccgtcgccgccggtggccatgttgtcccacacctccgccacggcgaggctcggggacgtgccgtcgatgtacaccttggccatctccggcgagtagcccttggcgaagtcaaagcgccacgcgtcgaagccgaggtcgctcttgagccagaggagccactccttgagctcgcgctggacgcggtcgttgaggtggtcgatgtcgggcgcggcggcgaagtcggcgccggtgtcgaggttggcggtgccgtcggagtaggtggtgtcgtcgcggcagatcatgtgggggccccagtcgaggcggccgtcggaggtgccgccctcgaagatgcagtagatgccgcggctgtccttgtagtcggcgcagcggtggttgatgacgatgtcggcgatcgcctgcacgcccttgccgtggagcgcggcgatgagcgacttgaggtccgccgcgttgccgtacttggacgcgtcgatgtcgtagagccgaccaggcatgtaaccttgggtggagacggagtgcgacggcggcggcagccagacgtgcgtgactccggcggcggcgatgtcgtccaccttgcccgtcatcatgttgtaccacccgccgctctgcttccacgactcccagttgaagccctgaaagaggacttggtggccggacgcgaatccggcgagaagcagcagcagcagagagaagcagcacaggttgccgttcctccccatcgcgcgcgctactgtcgatctctcacccttcttcagtggactcttcttctactgggggagtggcggggcgcgtgggactggctgatcgactgatcggaacccggccggc

SEQ ID NO: 28848 - DNA, 1301 bp, Triticum aestivum
  unsure (1)..(1301): unsure at all n locations
  Clone ID: PAT_TA_28848
taaggtaggnataaattgagtggttagttggtagtttcgctaatcgcggaaagggaaatctttttcagggctttgaaaccacgccgtgatccggacttggtattgatttatacaggcacctcaccttttaggttagccttccgatcaggcacttaaaacaaacggcttcttagatcgacccctctggtgagtagtgatgtcatgattccttccaaatactactggccggaatccggccagacgatgatgatagtaagaaggttggggagctcgagctgtgctctgaccgtgccgtgctcagctcaccggtggagctctgcgagacgaccacggttcacggcgggctgaggaacagcgccggatcggtgtcggcgaacacgccggccacccagtaggaccccaggtcgcagcccgacggccactcgaacgggctcgggtccgccagctccttcccgccggcgtcgtccgccacgccgagcccgagcgccaccgacgggtgatcggtgaaagcgaggcccccgtttccctccgccgcgggtggcacgtcgggctcgccggccgtgaaagcgaagcacccgtctccgtccgccgcgggtggcgcgtcaggctcgccggccgtgagagtgaagcacccttccttcgcgggtggcgcgtcgggctcgccggctgtgaaagcgaaacacccgtccgccgtaggggctgcggcgggatcctcagctgctgtgacgtcctcggtggccgcggcctccttcgtcgtcgcggcgacggcggctgaggcgtcggcgccgggctcagcctcgggcgccgggggcgcggccggcgcgacgcggcggcgcttggagttcttggcgcgcttggggctggaggacgaggacgacgacgaggaggagctcttgcgcgagccgccgccgacggggacgttgcggagggtgccgcccttggtccagtagcggcggcaggacttgcagtagtggcgcggctgggaggtgttgtagttgttgtagtagcagaacttggtgtccctggactcgcagcgcgggcaggggtcgccgtgcgcctccccctcctccgccgccgccgcccccacctccgcctgcgcggtcgccgacggcgccgggtagcccttgggccggcgcaggtcgacggcgccggcgaacggccgccgcccgggctcctgcatgccacctaccaacgagagcaaagctggctccgatcggtcggcggtggagggaaggaaaggaacggacggacgaggcgtttggtttgtgtagctagcgagcgcgaatcccgacccggccggc

SEQ ID NO: 28849 - DNA, 829 bp, Triticum aestivum
  unsure (1)..(829): unsure at all n locations
  Clone ID: PAT_TA_28849
gttggcatgctcccggcccccccattggcggngaattcactaagtgattagcgtggtcgcggccgaggttttttttttttttcaaaattttggatgttacttattacgttgtaaacacaggaaataatacataaacacacttatagtacaacggataaaaagcccccaactgcgctttctttctgggattacttaatttcatttaatataagatttttccttgcagatctcatgaaagatagaattaccaaactacaggatgaaatgagccgctaggagaatacaagtcatatttccttgggtatggctgtaaggggggtgactagagataacaccaccccacacttctctacctggcctatcccagcctccttgacctccgcaggaagctcccactcgaaccgatggagcagcgtgccaagaatcaggggtatgagcttctgtgcgagcggcatcccggggcagatgcgtcggccaagaccgaatgggatcatgtcaaagtcctgccccagctggaagttcttggtctcgccgccgatgaacctctccgggacgaacttgtccggatccgaccatgcgtcggcgctccggttgatcgcccacgcgttcaggatcacgttggtgcctttagggatcctgtagccattcacctcgatgtcagcctccgctttgcgaggtactagcggcacctcggccgcgaccacgctaatcacttgtgaattcccttggaggtatgggagccgggcaatgtcagattcttccatgagcggtttgtcgccaagaaccccactgagctcctccttgaccttgcgcatcacctctgggttct

SEQ ID NO: 28850 - DNA, 1153 bp, Triticum aestivum
  unsure (1)..(1153): unsure at all n locations
  Clone ID: PAT_TA_28850
ttttttttttttccgattaagatccgaaggaagatccttttctttggagaaanatcctttgtggtccccatgtttttaaattctnacttacaatgcggatccatccaaagggattatgatcccaaaagattatgaattcgttgatagtagtactctcaaaaagtcaaatttacaccccgatatatatacgatacaatatgtgcgtcgtagacgcagcaagatgattatcctgtgtcctgtgttcttgcatgacccagccagtgtttccagtctcgtcacagacatcgtgttgtcctgtcttggtctacgcgtgtgcggtggcgccggcgaactgcagcctgagccgaccgccctcgcgcgacgcccgcaggagctccttcccggggatgacaacctccaccagcacgaacctgccctccgcacggaacgaccggaagcacacgctcggcttcccgccgcgcacgctgatcgaccgtatcgggggcgggaacgacggcggaggccgctggttctccttctcctcctggttcgcgtcgaccacgtccgcgtcgtcgcgtgtctccacctggcggcggaacgcggcggctagctcgtcgtcgtcatccctcagcacgtccacggtgctctcggacccgagcccctctgtgcagagcagcagggacgacgcggacgggctcttcttcatggagaagctcgcgctcctcttcaccgtcggcgtgggcttcggcgactctgaggagcgcgtcgagagacgagtcgtccttgctcttctcggcggcgtcgatccacgacgaggacgacaccgtggtcgcgcgaacaagaggaggtgaaggtggcggacgcggcgccggcaggacgttgccccgggcgacgtggtccggctgctgctgcttctcgtggaagtggagctcgccgaatatctcggtgaaggatgtcgggtcgaccggcctcttggggtggacgcggttccacgccgacagcgcctccagcagcgtcgggttctccggcagaggcttctcgaacagcctcctcagcccgccgtccgccgccatgtctatctcccctgaccttgaaatgaaatctgagtgaacacctgcacggaccgtcaatccggacaaggtttttgaagaatttgcagaagagatttctttnc

SEQ ID NO: 28851 - DNA, 266 bp, Triticum aestivum
  Clone ID: PAT_TA_28851
gcagttcagaagcttatattcagaaatttttgtcttgtacaaattcccatattacagcaatggaggaccacccatctaactatctaagttcagtcataacacctcacaacatcaaaattgcattcagaaattttggcttgagatgacaagctcgcacacgaaattggataaatcaggtagaatgaggcattgcagaatcaagctttgaaggagcaacagcccattccgcggccggcgtccccggtgcgcccgtccggacgcgtggg

SEQ ID NO: 28852 - DNA, 820 bp, Triticum aestivum
  Clone ID: PAT_TA_28852
aattatgcaaaatcaaatgcttatttattcaacatttaatttattgagcggcagcagcagctctgcggcgatcacgttcttcagtgatagtgagcttgacacccttacccttaggaagagagacccagggcttgttaccttgaccaatggtgaagacgttggagatacgagtggcaaagacgtgatcaagagcatccttgatgtgaacaatttcgaaaccaccaatgtgacgttcacggtgaaccaattgaccgacacgaccaatgttacgaccaccagtaaccatgacaacgttaccaacatcgaacttgacaaagtcttcgatcttgccggtttcaaggttgaaacgaatggtgtcgttggtcttgatcaaaggatcggggtagcggatagtacgaccatcgtgagtagtgatgtaaggaacacccttggaaccgatcatgaccttcttgaccttacagagcttgtacttggcttcttcgtcagtgatacggtggacggcgaaacgacccttgacatcatagaccaaacggaagttttcaccagtcttttcaacgctgatgacatccatgaaaccagcagggaaggtagagtcggtacggaccttaccgtcaaccttgaccaaacgttgcatcaagatagattggacttcacgaccgttaagagcgtacttgagacggttacggatgaagacaatcaaaggcaaacattcacgggtcttgtgaggaccggaggaaggcttaggggcataagaacccaaaagcttgtcaagcatccaatgcttgggagctgccaaacgcttcatgtgcttcttaggacc

SEQ ID NO: 28853 - DNA, 1537 bp, Triticum aestivum
  Clone ID: PAT_TA_28853
gtattcactacgtggtttcgtgcggccacccgggaaatagcttattattgaattactttattattgtgtctggggcttctttacaactgacccactcttttattgccttgctcacacttttgtggagcgctgacacttttgtccacgttccttgacactttagttgagaaagcgtgtactttcccttatttggaaaatgcttaaatttaaacttgaaaactaaattataaagaaacggaaattgcccgcttcattgaaaatcccctccaacggtcagggtgtggcactaccccggtcccaacccctactgcaccggggcgagcgacccatcgagggcctctgggtattagacgttacgcatgaacactatagcggggacgctcctgtagatcggggggttgcgtccatcggtgactggggcacatagaacctcgtcgatctctcaatgttggtgttgaagaaggacgccacaagagaccctacgcggtgtctgtttgctcttgttccccacggactcggtgctccacgctcctgaactggtcattgctgacgagctgaagaaggtcgccgatgttgatgatgaaagcgccgggcacgggagggacatccacccaggtcttgccgtcgacgagcacctggaggccgcccatgccgtcttgcaggaggacggtgaggaagcccgggtcggtgtgcctcgtgccgccccgtgccccatgcggcgcccggctccgggcacggtgggtagtattggcacagggcgtttgaggttcgccgcgcagtccatgtcgcgcaggtggtcgctgctcaggccaagggactccgacagcagctccagcacggacagccccaccttggtcaccgcgtggccgtactccgtgaccacatccctgacagcctcgggcagctcttctgaaggtgccgggtccggagcgaggtggaagaagagggtgtcgcgccagttggccgccgccgacgagaagaggtcgaagttggaggcgaaacgcaccttgcgagcttggtccctgctgtagatggcctgcttcgcctcggcgggtccctcgttgaaccggcgcaccccctcgagcatgccggccatgagctcggccggcacgccatggttgaccacctgaaagaagcccaccgtcccggccgcgtgccgcaccagggcgaccgcgtcctcgcgtcgcggggccgctaggtcgacggtcgggatggcccccgcgacatggtttgaggacgtgatgccctccagggactccggcgagtggcggaagatgggcgggagggccgtgacgccggcgtcgacgaggcccttgacgcccgccttggtgtcgtcgaacgcctgcagctcacgccggcggtcccaggccacgccggcggccgattctgtggaaggcatcgacgatctcaattatattcgatctatgcccgctgcagccgcacgcattaacaatgcaaggccagtgttggagtatagatgctgctccagcagcaaatatatagtcgcgcttgaggttgagggaggccttcgctcatc

SEQ ID NO: 28854 - DNA, 337 bp, Triticum aestivum
  Clone ID: PAT_TA_28854
aaaaactatataaaagatgtagagctttattaagcaatagtaacttaaccattcagcttcttccattgagaattcattgctagtaaagaggtggtcataccagctaaaccaacaattccttcatcggccttaagcaagcctaatcctgcaagaggaataattgcatccacagcatcttggacaaactgatatttggcattatgtttatctttagctaatgccttttcttgagcctttaattcagttacttgcgcttcaggcttttcttcagagttgacgagtgctgtacgtgatttttcaagcatatgctcacgaatactcaactgtctaaatttat

SEQ ID NO: 28855 - DNA, 1147 bp, Triticum aestivum
  unsure (1)..(1147): unsure at all n locations
  Clone ID: PAT_TA_28855
gggggtccttgccattagctngnacttttgaaggcatcgtnggctntngtattccccacttgcgaaagggttcctatcgcggttcgtctttccctaggtttcccccttctgcagcatataccgtcgtcgttcctcccgctctgccacctccatcgacgactgcttaccagggacgggcccttgcaggatatttgccattttattggtgtcgtcttggataaactggtgtctggatgtacatttaggccacggaccagcaatatatagtcacttatacacatacatacataatggtagtttctacatacagcaatatataccagcttgctgctctcctgcaccaacctcagtaatttacagttgctttaatagcatccaggatcttgttctttgtgggcatgtagaatggttcataaacaagagggaaaggggtgtcgaggccgcagaccctcgcgacaggcgcttctaacctctggaagcagcgctcagcaatggatgcagcgatttccgcaccaaaccctccggttatcggggcctcgtgactaataagaagctttccggtcttgctgacagaggcctcaacagtttccttgtcccatggaattagtgttcttagatctatgagctcgcaagaaattccatcctttgaagcatcttcacacgcttgttccagcactgcaagttgagctccccaaccaataagtgttatatcacttcctttgcggatcacttctgcctgggataaaggcagcatatagtccccctcaggaacttcttcaacagacaaacggtaaagccactttggctcgaaaaagatgactgggtttgggtcacgaatgctggccagtaacagtcccttggcctcacgtggactccgaggtatgacaaccttcaggccaggaacatggcagaaaaaagcctctggtgactgtgaatggtagtgaccaccatgtccaacagcaccatatggagatcgaattgttaaaccgccacagttaaattcatttccacttcggtatctgaatttggctgcttcattgacgatctgatcaaatgctggaaagatataatctgcaaactggatttcggcaatagctctattacccatcgctgctaagccaatagcaaatccggcaataccctgttc

SEQ ID NO: 28856 - DNA, 258 bp, Triticum aestivum
  Clone ID: PAT_TA_28856
aacaataccaatgcaggttagccaaaaacatcaaattatcaatacatcagccagttaatcacgctctccaagtcgatcagaaaaaacaaagacatactaaacttcctcgcaagatacgtcgacggcatgggcgagcagcttctctgacttgacgccgatggcaaccggagagcagaggtactcggtgggctggccgccgtgcgtgtagttgagcccagagatctgcgtctggagcgtgcctttcaggtgcaccttggc

SEQ ID NO: 28857 - DNA, 440 bp, Triticum aestivum
  unsure (1)..(440): unsure at all n locations
  Clone ID: PAT_TA_28857
ctanctttatatatcatnagtatatttctttgtcanttttntacgtagcttcataagcttttttttttatttatttatttattatgttacatagagtgaaaggtatgttttgaatattcacatgaaaaaggtttagcgttcttcatcgtagtattgcttgacttgatcttcagcgtgtctcttggccttttgcttgtcaatgaagtcgagaccctttgtttcaatcaacttgtccaaagcagcaccggcaaaaccagcgaggagagccttggcagtgctgtggtcaacgggttcacccttttcttcacagtgcttttggtaggccttgacagcttcataagaggcggcaccagcaatgagttcatgagaaaggtgacccttgtgctcgtgagaagtttcgtggacttcaccatgttgttcgctaaacatatcaaagagac

SEQ ID NO: 28858 - DNA, 1051 bp, Triticum aestivum
  Clone ID: PAT_TA_28858
atagtaacacctcaaattgagtttttatttttcttccttttgcttgatttctattccactgttagtggcaataatacgcataacatccgtaagagacacaacacctatcgctctttctctttcatctactacccatacacgatgtgatttagtagccaacaatttggcgacagtaaagcctaatgttgtgtccagacggacatcaaaaactggtattctatcctggccatcttcaatgccttgctgagtacgaacgagactgacaaattgaaaacaagtcttccacaagagttgatgtcgataacttttcataacaaacttaacatctgtcatgctaatatttccaacaatcacacccatatggcttaatacggcaacagaggatatatcatgcttactcataagtgaaagtgcatcaagaacaggtgaatctgcattaacagagattacatcagatataccaagacctaattggcgcaaagtcttattcatgatgcactcaacatcaggaaaatgatgctgacttgtataaaagtactttgctacagttgattgagatagtatacccttaatagacccatcaggatttaacacacatactctgtgaataccataggaaaactcttctacagcagataataaagtagcctcaggtagaattgaatagaatgggtttttttgtgataaatcacttgccaactttactggaatctcttttccttcagatgctcttttaataatatcttttatttccaagttgatatcttcttttgtatcatcatttggttttatctttcgaagtactaataaaatataggcaataacatcaccataatcaaacatgccaacataagatcttggatgaataatagcagtctcaggagctatatgcttcactttggtatcataaacaggtgcagaacttatgttgctctttataagtatatcacaagcttcctcaactggtaaagagccttcaattgttatcaccttttgatctttaattaatgaagatgcttttataagtgtccaatcgtgattatcagttgtt

SEQ ID NO: 28859 - DNA, 1937 bp, Triticum aestivum
  Clone ID: PAT_TA_28859
agcataggtttgggacagaaacacagccaacagagaagtctacgtcgccttctgcctccgcgacggccaagcaaccggtcagccgctagcaaatcctcaacaccatcaaacgagacgacaaaacgtttcgattggatgtttgcgaaacctgttgatgaagtgaaagatcattgggttccagatgaggctgctaagaaatgccagtcttgtgctgctgatttcagtcacttcaaccggaggcattcatcgtaggaactgtcgcgagctcttctgtgataaatgcagccaacgaagaactgctctgacaactgaagataatgctccacttgtccgagtttgcgatagatgcatggcacaggtttctcagaggcttagtatggcacaggaagctgcaaacagatctaccccagggcaaagtcatgaggatcttgcaagaaaactgaaggaggaactggagaggaatcgcaagtcttcagggacggcgtctggagctgcatctggagcaaggatgcgggacggagcgtggccgccctgcccaactccatcgacgcggtgaactcgcaatctggtggcccgggaaccggtcgagtgtggagagtgccagcgtgcttttatgggtcaggcgggaatatatgcacatggagaggtggggtgacccgtcaaattattctgttggataacactatttgttggaccattgggatgatcacaaataagcttccgtattcaactagtcaagatgatgctggttgtgttgggcagagatgtagggtgaagttgtttctcgagggcatgagtgggtcttaaacatggcaagtcgtggccaaaaatgatggaatccgcatgcttgatcccagcacaagcaggaccctaaggatttatccccttgatacactgacgaaatgggaggttttggattcaactgtatttgcgatttgggcaaagacttcagtagattttgaagcaaagcgaataaggctgaagtcaaacagctatacttctaatactttgctcgacactgtgacagcagcaacagtccagtttaaagagatcggtgaagatgcaagagccaaaggaacagtagatgctggtaaatcctcaatacaatcaaatgagaagaaaaaaggttttgattggatgtttgcgaaacctgttgatgaagtgaaagatcattgggttccagatgaggctgctaagaaatgccagtcttgtgctggtgatttcagtcatttcaaccgcaggcatcattgtaggaactgtggcgagatcttctgtgataaatgcagccaaggaagaattgctctgacagctgaagataatgctccacttgtccgagtttgcgatagatgcatggcagaggtttctcagagacttagtatggcacaggaagctgccaacagatctaccacagtgcaaagtcatggagatcttgcaaaaaaactgaaggaggaactggagaggaatcgcaagtcttcagggacggcgtctggaggtgcatctggaacaagaatgcgagaagttgcgtgccctacctgcacagtccatcttcaggttgaagtcccaatctctggctctgaaacagtcgagtgtggagtgtgccagcatgcttttctcgtcagcgccaattgatagggagacagagcgtgacctgtcaaattattctgttgataactctatttgtttccccagttctataccagaaataagcgtgtgtgttcaacttgtagatgtttgtgtggctgtgttggtaatcgaggtaggatgtatttatttttcttgtacatgtgtgttctgaacatgggaagttgttgccaaaaatgctggttgttcgtgaagaattccaacagaatactcgttggtccaaacagcgtgtacttctaatctgacagtttcttaagtcacgtactgaccgaagttctaactcgagggggggccgt

SEQ ID NO: 28860 - DNA, 447 bp, Triticum aestivum
  Clone ID: PAT_TA_28860
gaacataaagccttttttttatttctcgaacttgatatgtgacaaaatttgattgggctaaacaagtaatagtacgatgacatgaggagctagcgcatagatagatacatgttgtgcatgtaatgtagtaactcagagactcgatatcacaaatgttcaaacgaccttttattttatctttccctctcctatccctcgatggctacggcaagcaaactctccccctcaggcttggccggcgaggctgtcggttcgacgatggccaagggtcggacgtagaagccgatggcgtggaggaagtctccagcgcggcagaacatgccgacgaggctgccaccgtcgagcaccggcaggctgtggtgcgcgccgtcccctcggccgaaggggccataggtggccccctggttggtcacaaacttgagtgaggtgacgcagtcatcgatctcc

SEQ ID NO: 28861 - DNA, 410 bp, Triticum aestivum
  Clone ID: PAT_TA_28861
atcctgccgcacggtcgagtttcccgggtcgacggggagtgcgacgaaggtgccatggccgccatagcccagtctgcgccggattctgtgctgatgacattggcggagtttgagacggcaagagaggcgtggaatgcactcaaagagatgaggattgaataaaatcgtgtcacgaaggctcgggcacaagtgctgaagcgccaatttcacaagttgcagatggagaaaactgaatcggtgaacgactatgccatgcgtctgactactttggtgggagagatccacgcgcttggtgcaaagctcgacgagaccgagattgtggagaagtttttcagttcggtgactgataaattcacgtacatcatcggcacgctcgagcagctttacgacatcgacgacatgaccataac

SEQ ID NO: 28862 - DNA, 438 bp, Triticum aestivum
  Clone ID: PAT_TA_28862
gagtgcgacaaaggtgccatggccgccatagcccagtctgcgccggattctgtgctgatgacattggcggagtttgagacgacaagagaggcgtggaatgcactcaaagagatgaggattgaataaaatcgtgtcacgaaggctcgggcacaagtgctgaagcgccaatttcacaagttgcagatggagaaaagtgaatcggtgaacgactatgccatgcagatggataaagctcgacgagaccgagattgtggagaagtttttcagttcggtcactgataaattcacgtacatcatcgggacgctcgagcaactttacgatatcgacgacatgaccataacggaagcgatcggatgcttgcggacgtgggaagagaatgctcgtggatgtcggaaacgcaaaggaggaggtgatgaccaactcatgtactcacgcgc

SEQ ID NO: 28863 - DNA, 941 bp, Triticum aestivum
  unsure (1)..(941): unsure at all n locations
  Clone ID: PAT_TA_28863
ggttttctcttctgttcgtcctgttgctttcaaacgaagaaaaggggagagggcctttggtgcctccttctgttcgggtcggccggcccaccggcgccggtcgtcgggagcggcccccgcctagactagcatcatctggaacaagaggtcgtgccagatgtctatggggccgggcaggcaccaatggatgcagtcgttgtaagatggaacaattcattatcaaaattgccttggagcatatcctttgatcagatctgtgtgccgatggacgggaacgggactgggctagacgagcatcatctggaacaagaggtcgttccagatgtcgatggggccggggaggcaccaatggatgcagtcgttgtagagctgcaccttctcgttgggccagtggccgtaccggctggggtggccgtcgggccgcatcagcatggcggccgtggcgtccatgagcatcagccgcagccccttggcccgcgcggccttctccgccgcgcggtactcctccatctgcgccgtgtagaactgcaggtcgcgcccctccatcaccgtctggttgctccggaccggctccgtccgcttgcagttgccgccctggtcccacgtcccgttctcgaagtgcgacatgggcgacagcatccgcaccatcacccgccccttcaccttgccctccagggcgttgatcgcccgcagcgccacccgccacgccttgcgctgcgagtagtagagcgtcaggtccggcacgccgtactgccggctgcagaagctgcacccgatcagccgccgcttctcgtagaagagcgaggggcgggagaaccagctccccgccctcgcccgcccggtgccccgccggggccccggcgtcccccacctgccgtcccgctcgtccccgtagaggctgtagtgccccgtgtgcgccgggtcgtcgtggtcgggctncc

SEQ ID NO: 28864 - DNA, 629 bp, Triticum aestivum
  Clone ID: PAT_TA_28864
agttttttttttttttttcttggtaattctattgatactgatttggtactgtaaatatctttctttgtatacactcatttaaataaaaaaaaaacatttgactcaaacaaaaaaccatattccttgcaagcccgaacggagcagtagttaacccatgtagtcttgatgtaaaatgaaaaggagaaacggtgagaagagaacacaaacaagagcaatccttccgaacgcagcataggatattacgcatcgacgcaggtggatgggtgaagcatcctcctataatttgctcgaaatgctcttatcctcctctagctctagggccttgacattgacggcggacgggcctttttggccgtcttgaatttcgaattcgacacgctggccctcggcgagggtcttgaagccgttgccagcgattgcggtgaagtggacgaagacgtccttgctgccgtcgtcgggggtgatgaagccgaaccccttggattcgttgaaccacttcaccttaccagtaatctgcattttctctcagtatgtatccgttgtctttaccacttcacctgaccagtaagcgctggcattttctctcagtatgtatctgtagtctcctctccctcccgagctcaacctgt

SEQ ID NO: 28865 - DNA, 492 bp, Triticum aestivum
  unsure (1)..(492): unsure at all n locations
  Clone ID: PAT_TA_28865
ggcagcaaaatatatcaagcctttgcacatatattatactttttctcatctcatctcatctcatatgcagtctcctgcatctctgggcactcagccaaacatagcacatatactactatagcatgatttataatggtaaaaaggaaagaaaaagaaagaagaagagaaaaaaactatctcaggctctgcttttgcagggtggatatgatctccgagaactgagggcgtttgagagggcaattgtcccagcaccggctcatcagcgacctcaggaacggcgggcagtccctcggtatctccggcctcagcccgcacgccgcgatccccaccgccgcttgcactggcgagtacgtcgagtaggcctcctcaccggtcaccatctcccagagaaccattccgtanctgtagacattgctcatgcaggtctccgatacgctttctggatctccatcaatgatctccggagctagccagcgatacccatatgtctca

SEQ ID NO: 28866 - DNA, 756 bp, Triticum aestivum
  Clone ID: PAT_TA_28866
aaaagtatatgtttattttattatttgttttttcttcttttatacacgcatttatttggaaggagccaaaccaactctgttatttccaaggtcatagacactatagaatttacgtaaaaagacatcacctacaatccaaagaggaccagcaggttcagggatatccatgcccatgaatccagagatacattgtccttgaacttccaatatataatccttgccttccaaacaaaagtccttgccattaaacacaaagcaaaattcgggcatgctaggaaccttgttacagtcgacagtgtattgaccagcccagttcttttcagcacctaattccttattgatcaaggcagcaaccgttgtgggggcaaccaagagtgaagaaccagtgtcgatagcagcaccaacagggtcaatatcaacataatcatcaccaaacttgatgttttccatagtgatttcccaatatcctttacgacgtacatcggaccagtgaatgtcaccttcaaagtgatcctcatccacaccaccaaagattaattcaccgccattctcttgatctttgttggcatcattcaaccagaatgaaaagagaggttcgtcgacaaggtcacggttgaccatgtgatagaagggaggaatggtatgtttaacagaaatggtatcgtaacccaagccaaagataccatcaaatttggcaaaggcaaaggttaatccaggttccttggtagattcggcaaatcttggtcttgcacttca

SEQ ID NO: 28867 - DNA, 517 bp, Triticum aestivum
  Clone ID: PAT_TA_28867
attatcatgcacaaataacaaaattcattttatttaacgagaagtagcagcagccttaggagcgaaacccttggcttgttgcttgctgaccttaggttgagaggcagcagggttagccttcttagcagcagcagcagtcttcttggcttccttgctcttggcaatagcagcttgacgagcagcagcacgggcatcaggcttttggttacgcttggcacggatggcatcccaagaggcaccaacaacagcacgttcgtgcttgacagtacgacgagaacgcttcttttgaacttcttcggtcatacccttcttgttcaaacgacggtaaatagcggtccatctgatcttacgagggttcaaacgttggagaaagtaagattcggtcttaccgttgatgaaacggaaggttctagaatcaatacgaacgtaggtcttacccttggcaggatagatcttttgaccagagaaggaacaaatctcaagcttcattgcggacgcgtgggcggacgcgtgggtc

SEQ ID NO: 28868 - DNA, 769 bp, Triticum aestivum
  Clone ID: PAT_TA_28868
attaaaaattcaattcacccaaaacagttaaaatatatttcgatatttttggcctttgcatagctaaaaggattaattcactttgatatggcaaataataagtatgatattgtttgtgtcttgctaaatttcttaataatagtgctgaagtcaatggtatacctgatacttctgattcatctacaggtatttttgtgatcgcaaatgttttaggctttgacgcatgttgtttgcttatctttcctgcaaagtgtgtgcgcatatgttgaatagcattcgcttttcctccaaatgtctttctggaacacttcatccatttacaatcattttctacttctaagtgatcctttacaatatgcttatggagttcagttttatcatcaaaagattgttcgcatccttcccatcggcaaatagagccgtcttttcttcttgtaggagagtatttgatattgcaaagaacagtctctagagggttctccccgttggcaaatgattcttctactgatgaaggctgagggaatgcaatttttaatactgtataaaattcctttaaacccaaaggtttctcggtcccaaaaagtttctgatagctaccaaacacttcctttagtacaatcttttcattttcgtcgccattgataagttgatccttcaaccatccaaggcatcggtatggctcatcgagattcgtataatttgtcagatctggaattgaaggctgttgctgtactgtttctacacgaatcatttgagcagctggaattcc

SEQ ID NO: 28869 - DNA, 623 bp, Triticum aestivum
  Clone ID: PAT_TA_28869
catactaaatgaaggattttattcactggccttcttttcatccggaataaattcttgacctgcgacaaagacaggttgttctttagtgatgaaggctgtaggataaggtgcaacaatgatttgctcttctacgttattcatctcagattcttgttgtacacgatgagtgtaagagtgaatggcaaatgcaaagtgaagcttcaataacatgttaatagccatagctagtgttacaatccaagcactttgaatataaatggattcacaagtattcatgtccaattcatcatctttcacttcgctcacaacttccttgcaaatttctttatccaaactgaaaagcaatacggcactggcgaccgagaaaaaagtgtgtaacgccaagtctgcccaataataaatgttgaagaatttaagtttcttagcgttatttttaagtacaccaatagcacctgccaagcaagcaaaaccggaaagataagaataagcggttaaaccaaagacggcaccgatatccgcatcatcaaattcatcagagagtgcagttaaagtaagagcaccatacaagtgactaatggtacccaatactgccaagattaaagtagcagattttagattaatac

SEQ ID NO: 28870 - DNA, 1455 bp, Triticum aestivum
  unsure (1)..(1455): unsure at all n locations
  Clone ID: PAT_TA_28870
ccacggttctcggcgcgcgcccccatgtataacatgatccccgccctgctagttctcgccggagtcatcaccggggtgcgtgcggcagcacctcctccggtgccggtgccggtgccgccgaaggttcccgcagctcccccggctgctgccgggccgcttaagtaccccgcactccttgctttcggtgactcgattatagacacaggtaacaacaactatatcaggacaatcgtcagggccaacttcccgccctacggcagggacttccccgggcacaaggccaccggccggttcacggacggtaggatcagtgttgacttcctagcggcggcacttggtgtgaaggagaatgtcccgccgtacctgaagaaggacctcaccctcgacgacctcaagaccggtgtcagcttcgcatcggccgggagcggctacgacaacgccacctgcaggaccatgtcggcgctgtcgatggagcagcagctgaagatgttcctggagtacaaggccaaggtggggactatcccggaccaggccctctacctcctcgtgtggggcagcaacgacgtcgtggagcacttcaccttcggagaccccatgtcggtggagcagtacagcgacttgatgtcccagcgtgccatcaccttcatccagacactcatcagcctcggcgccaagaggatcgccctgacgggggcgccgccagtcggctgcgtgccgtcgcagcgcattctctctggcgggatccggcggcagtgctccccggatcgtaaccagctagcgagcatgttcaacaacaagatcaagggcaagatggccacgctcggcgccaagctccctggcgtcacgctcacattcatcgacctctacgccatctttgaggacgtgatccaccggcacgaggcgctcgggttcaagaatgccagggactcgtgctgcggtttccttgggctggcggtggccgtgctctgcaacttcgccagcccggtctgcgccgaacccgccaaatacgtcttctgggacagctaccaccccagctccagtgcctacaaggtcatcatcgacttggtcgtcgaaaaatacttcagatagaatgaactagcagctaactatgagtggtagaggaccaagggggaaaggaggaaaaataaaaggaagaacgcaggattttgaccaacaatcagtaaggggttgacacgtgtcgcaaaaataaaaggaggaaaaatctgggactgaccaacaatcagtccacagattttgttttcagtttaggtcgaattttttgcccaataaggggttgacacgtgtcgctgatatttgagctgctgtatgcaacaaattcgacggattcgttcgaaagttgcctgggacgggccgtttccaacgtccacttncccattnggaaaanngnaatttcctnnaaggncccgtgggaaaaaancaganngccttttnact

SEQ ID NO: 28871 - DNA, 623 bp, Triticum aestivum
  Clone ID: PAT_TA_28871
ttttttttttcttttccgccgtggcggccctattttataatcaaactacacatacatttgtatccgactggggatttttagttgaacaagtaccatgatgacagagaatgaagtaattaaatagttggttaagccactgataaatgatagctggaaataaagggaggaacatattaggactcttgcaacgcacaacgccaataaccaaggaacaatagttgacactgatgaggcgagttgctcgtgtagttgtgcatgcatcccaaaaggagctgcactgctatttatgcctcagtatctcttgtccttgcagaacccaaacgcccaagtgttgcagaatgcaacagggctatagatgatgcagacttgaaaaacttggtagaagcatacaatattgcatgtggcgtatccgcgacattgcgtctcatcatacttctccaaaaggttgtgccggttacctagtccttctgccatcgccagcgtagccatcagcgcctggccagcgaatagggccagcatgaaaacggcagccatcttaggcacggagctggaagccatcgcaagagcggaaggcggatgttgcggctcaaagctctatctagaaaaatggaagtgttttctcg

SEQ ID NO: 28872 - DNA, 878 bp, Triticum aestivum
  Clone ID: PAT_TA_28872
aacaaataaataaaaacataaattcaagactgcatcaagcataacttctgcagttcggcagaagttaagtaacaacagcagcatgtccatagtccattacatgcatcacaaagtcttcagaattcatttgtcaaaagcacacaggaaaggatagaatcatgagcgccaaaacgaacttcataaagaaaccgacaagctcacatgtcagaaccagaactcatgttggtgtcctcgtcgtcgtcactttctgaagcagaggaagcagagagcagatcttcttgaggagtaacagggatcatcatcttcttcttcttaccatagacacccctcttccttttaaggggattaatagcagaagttcctggtccagcatgcgagcttgcatatggaatttcttgatcttgatcttcaccttcaacttgttcttcatcaccattaggcaccacaccagtgatccattcattctcatcatcttctaaaacatctaccacctgcttctcaatggggtccttgagtttgtttagtttcttgtccttcagtttggagttgaacttgatgaaaacaaggtcactcatcttgtcatgcaccagcctgctgcgtctctttgtgtgaacctcctggcgatgtgcttgccccggctgctggaaccgtttgagactgagactgagatgtcatcgtggtcgtagaggcgacgtcgtgcagaggcccctcgtcgccggtcgcctttccacctcctcgccgaacgaatctggcttccaacaggccaacagtcggcactgccggaagaacagcgcatccgccgcaatccggcttccaagcaagcagcgatcggcagtgttggcaacaacagcgcaaccgccgcaaacttttagtgggag

SEQ ID NO: 28873 - DNA, 1298 bp, Triticum aestivum
  Clone ID: PAT_TA_28873
cccgcgcagaggaattcgggacgatggttcggtcgatatggccttctcccccggcgcatggccggcgatcacctgcaatcttgctggtgcgcggcctgttcgccgccctcccggcggcgtcggtcgacatgggcgacatgctgatgatggacaggttccgtcagtggcaggccacgcacaaccggtcgtacctgagcgcggaggagaggctgcgtcgcttccgggtgtaccgcgacaacgtggagtacatcgacgccaccaaccggcgcggcgacctcacctacgagctcggcgagaatgagttcgccgacctcacccaggaggagttcctagccaggtacgcgtcgtcctacgatggggccggtgatgatactggcatcacgttgcctgtgggcggcggcgacgccgagctgtggtcgtccggcggcgacaatgatagctccttggaggctccgcctcccagctgggactggagatccaagggcgccgtcacaccggtcaagtcccaaggcgcaggatgcgctagctgctgggcgttcgtgacggttgcgacgatcgagactctgaactggatcaggacggggcagttggtgcccctctcggagcagcagctggtggactgtgaccagtacgacggcgggtgtaaccgcgggtcctatcacagggcttacaattggattgtggagaatggcggcctcaccacggcagcggattacccgtacacggcggtgaggggcgcctgcaaccgcgccaagtccgcccatcacaccgtcaagatcctcggcggcggcgtgatcccgcccaggaacgagcccgaaatgcagcttgccgtctccgggcagcccatcggcgtggccatcgaggtcggcagcggcatgcagttctacaggagcggcgtctactcgggcccttgcgggacaaatcttgctcacgccgttaccatcgtcggctatggcatcgacgccgctactggggccaagtactggctcgtcaagaactcgtgggggcagacgtggggtgagagcggctacatccgcatgcgccgcgacgtcggtggcccagggctctgcggcatcgcgctcgacgttgtctaccccaaaatggcgagagcgtgaatgtgaatgtacctatgtcatgcatctgcatgcgtaccttcccgattaagtaagctcgcctactgggaatgtttcaggaccaccgttattgtatgctgaacttgcattccttcaatactatccatctaatgaaggcactttaacaatcaaataatgaaggcactttgacattcaaaaaaaaaa

SEQ ID NO: 28874 - DNA, 696 bp, Triticum aestivum
  Clone ID: PAT_TA_28874
atatgacaacaatgaatgagccaaacaaataaatgtttctgcgactttattaagcaacaatttaacggtagcggcggagagaaagagtgttgcggcgcttccaggtagcacgacgaccagaacccttggtgttgttgaagcggtgacccttttggtgaccacgagacttcttaccgacagcagtcaaaccacgagcttcacgacgcttgtgaacagggttggcgatccagttgatacgggcatcgttacggatggccttgtgagagggatcgacgaggataacttcaaagtacttgtaggtggcgtcttggttgatccagtaggagttcaagacacgcaagttacggcacttgcgaccaacacgctcttcagcagtggagcggagggaacgttggtacttgagttggctgacaccttcattgacgggcttaccataggtggcacccttaggaacaggtctcttacggccaccacgacgaacacggatacggtagataacgtaaccttgcttagccttgtaacccaaacgacgggccttgtcggggcgagaaggacgagaggcacggtgaatgacattcaattgtctgtattcccaacaacgaacacgaagcaagaagcgagagacatcagattgcttctttctggcaagctcttccaaatacttgtaggcacccaggttaaactcggacgcgtggg

SEQ ID NO: 28875 - DNA, 971 bp, Triticum aestivum
  Clone ID: PAT_TA_28875
caaaaatgagaggagatattcttatcaactgtttattcgtatattgagctgtattgatgctttttttctttgcataattataaatttcttaaaacattaggataaaatgcttttgtatattataatttttgtactgaaatacggtttacataaagatggatgtctgtatgggttaaacaatgtctgagttcattcaagaacttcgaaacctcctcttcactgcttattcccatgagtggctttatccccgagattgtgcctttggctaactcaataaagtcccaagcaaacttctttgcagtagctgtattggaattcatgttgcaatgtcgagtatcatgttcagtaactttgatcaacctggtttccaaaagtagcttttccagttgataagtaatgtgaagatcctgtcctttggaagtgcatacagaatcgagtgcttttatgaatttattgtaggctgaagaatcatcctctgatagtctaaagtctggttccattaattgaatcatccctccaggctttgtcagacgtatgatctccttcagggctataggccattcttctttacgaagagcagcagtaaaaagtctcatttggacgaagtcaaatgtattatcctcataaggaagaccctggattacatttccaaaattgaaagtaaactgatctatctttaggttcttgttggttacatctacgatatcacaaccatgatatgtgcagttgggatagtcttgagtcatgtccatgatccacgctcctggcccacagccaacatccaggacagagatgcctttttcaaaatctaaatttctttggacactgcatgaaagattcccttcaaataactccttaagagcaaaatgttgccctgtcaatctttgttgctcttcctcgtcttttggtagccaataagtgcacgtttcctcgttatggaattctctctctctattgatccggacgcgggg

SEQ ID NO: 28876 - DNA, 602 bp, Triticum aestivum
  Clone ID: PAT_TA_28876
gtgcgtaccggaagccaaagccgtcccacggcgacgacgacgaccggcccagctacggccgcaagaagaatgacgacgacgacgacgacgagaggcggtcgcggtacaaaaagcgcgacgacgacgacgatgatgagaggaagccgcggtacaagaagcacgacgacgacgatgatgaccacgagaggaggccgcggtacaagaaacgtgacgacgacgacgatgatgacgatgacagaaagccacgttacaagaagcgctacgacgacgacgacgatgatgataggaagccacgttacaagaagcacgatgatgatgatgacgacgacgatgataggaagcagcgtcgcgggaacaaccgccgccgccacgatgacgatgactgattatgacatgagtttaagctgacgctaataagcatagttgcggcggctttgcatcgatgaattacgacatttcactttttttccaagcatttttcatttcgctgttcactgggcaccatgcctccaatcgtatgcccaagcttctgctcgattttctcttggaataaaatgtgcagtttgcccaaaaaaaaaaaaaaaaaaaaaaaaaaaaaaaaa

SEQ ID NO: 28877 - DNA, 606 bp, Triticum aestivum
  Clone ID: PAT_TA_28877
cagacgcaaaagcccgttatcttttcattttccttttctttttccgtgcagtcacagctcgcaagatgctactgaaacagtaatgagatatttacagggcgcccggttgctcttgctgaaagaatggaaaagaaaaaccaacgtcgccgggctgacagaatccccatggatttcttttgacgatgctcatgctgtcatacattttctttcttccaacctcctccccatcatcgtgtatggacatctcacgcatcaccacgaatctcatcaaaaactcccgcacgatacacaaaagaagaagggaggaggaactctatcgtggctggatcatggtgatggacacgtcgttgacggagtgcgtcttggacgtcgtctcggacctcatcgccagcgaggactggtctgacgccggggacttcttcggactcgcgaacagcgggggctgctcgggcgccgggagctgcgcctggtcgccgatgagcatcagcacgacgctggacatggtcggccggagctccgggctctcctgcacgcacagcaggcccgcgtggtagcaccgccacgcctcctccttggcgtacgacccggccagcgacgcgtccatga

SEQ ID NO: 28878 - DNA, 1309 bp, Triticum aestivum
  Clone ID: PAT_TA_28878
tttttttttttttttacggggaacggaggttgagttttttattcttattgattgattaaaataaccaccaacaacaccaccacaaccacaacaaaatgttgatacacaggaggacaggattttatggaatattaagtggttctaactctcctcctctttctccttgggctgggtggtaacgtgttggcacgagcatgagtgaggtcttcttccggtaagtgagcaccccttcctcctccatgttccacccccccccgccccccccctgttgggcagcgcccagttgaagctgtagagcaagttggcaaggatgtactcggcgtttcccacccccatgcccagcccggggcagatccggcggcccgcgccgaagggggtgaactcgaagtggctgccgttgaagtccacgtccgtgtcctggaaccgctccgggttaaactcctcgggctccttccacgcggaggggtccctgctgagtggcccacgcgttgacaatgacctgggtcttggctgggatgtcgtacccagccacctggacccgccgcagcgtctctctcgggacgagcagtgttgctgggggatgcagccgtagggtctcggacagcaccatcctcaggtagctcattttgggcatgtcagcttggtgcactctggttgcctcctccagcggcagtcctaatctcaagttgtgccctttgcagaacccttggtttccggatcagctctgccattgcccaggttatggtcactgtggtggtgtcaatgctacccaatgaatgtgttcatgagaatggccttgacatgatctctggtgaaggttcctgcagcggaggcggcgggccttttcatgatgtccagcagctcctgcaccaggtccgatccgccgccgccggtggcctttctcccatcgcactgctcgatgatatgctcaaagaagcggtcgagctgacgaaagaccctctggcggtgggctttgacgccggtgatgcggtcgatgaggcggccaacggcgttggggaagaagtcttgggcagagaagctacccaacatgtccatggttgcgttgagtaagggcacaaactgccccttgaactgctcccccgcgtagctctcgccgaacgcgaacaagcccacaatccggtccatggtggcgaagatgtgggcctccaggggtaccgggttcggccccaccacggtgagggtctcaatcagcttgtcgatctgtgcatccctcgcgtagtaggcagactgcacgcgccgcctgctgagcagctcgatgatgaacaacttgcgcatctcgcggacgtag

SEQ ID NO: 28879 - DNA, 521 bp, Triticum aestivum
  Clone ID: PAT_TA_28879
ttttttttttttttttaattaaaaaatggcaccgatgaataaaagacgtcaaaactcgaatgtgtttgccatgtttgacaaggcacaggtgatggaatttaaagatgcatttagtattatggatacaaatagtgatggattggtggatataaatgatttaaagattacatttgaaagattaggtcaacctgccacggaagaagaaattaaagaaatgatgggtgacgcgactggacccatcaatttcaccgtctttttgacattaatggcagataaactggcagacacagacagtgaaaatgtgattttaaaagcattttcagcatttgatgatcatcacagtggaaaaataaatgcaaactatttaagggaatgtatgatgacaatgggtgatagattcacagatgaagaagtggacattatgtttaaaggttctgtggtagacgaagaaggaaactttaattataaagattttgtaagaattttaaaacatggagaataaaaaaaaaaaaaaaaagggc

SEQ ID NO: 28880 - DNA, 568 bp, Triticum aestivum
  unsure (1)..(568): unsure at all n locations
  Clone ID: PAT_TA_28880
gngcgccaanatggnanaagttgtctgattggtcctgatgtggccattggacctgggtgtgttgtggaggacggcgtgaggctttcccgctgcactgtcatgcgcggcgtgcgtatcaagaagcatgcttgcatctcaaacagcattatcggttggcactcaactgttggtcaatgggcacggatagagaatatgactatcctgggggaggatgttcatgtgtgtgatgaggtgtacagcaatggcggtgttgttctcccacataaagagatcaagtcaagcattctgaagcctgagatcgtcatgtgagctctccagttttagctacagtacattcttaacttctttgacgaagggaggcttgcagatccccttttataaacgatattgcttggtatcttcgatttaatgcaaacagcttcatacttggtctcttgttaaactattgacaatgtatcttgttttttgttgaaaagtttagtacttgagtgtcaatcatacgtgttcgcttgctaaactattgacaatgtatcttgttctttgttgaaaagtttagtacttgagtgtc

SEQ ID NO: 28881 - DNA, 691 bp, Triticum aestivum
  Clone ID: PAT_TA_28881
acctagaatcacttaggaagaaatcagctgccaagctggccgctggagcacatgttgttgggaacgtccttggtgcacgagagcgccaagattggggagggttgcctgattggtcctgatgttgctattggacctggatgcgtcgtggaagatggtgtgaggctctcccgatgcacggtgatgcgtggtgtacgcattaagaagcatgcgtgcatctcaaacagcattattggctggcattcaacggtcggacaatgggcacgcatagagaacatgactatcctgggagaagacgtacatgtaggtgacgaggtctacagcaacggcggtgttgttctcccacacaaggagatcaagtcaagcatcctgaagcctgagatcgtcatgtgagctcaccgctcacaaatgcttttaggaacgatgttgtgtggcgtctttgttctagtgcatactgtaaacagcttaatatatgtggaacttgcgagacttgttaaactgatgagagtgtatgtgcattagtcatttccagtgttgtttcccattaagatccacttccagctttagtatagcgttgtggggatgtcggcctgtttactttattttctctgttcgcagaaagtgtaatgacacagaaaggataaataagaacaatgcctttgaaggtgaattttaaaagagaagagagaggagg

SEQ ID NO: 28882 - DNA, 1581 bp, Triticum aestivum
  Clone ID: PAT_TA_28882
accgaggcggccccctccgcagtgccgttcacgttggcagtctggtacccggggtaccactggcatattctcttcccggtcttggcgagggggcaagaaacaggcgaccgaccggccaaaacaaggtcgctcggcgctgcttccgaatctgaccccgtcggctcctcctcatccagggatcaggaggggaggaagaagggggacgcctcgccatgaaggcgctcatcctcgtcgggggcttcgggacccgcctccggcctctcacgctcagcttccccaagcccctcgtcgatttcgccaacaagcccatgattctgcaccagattgaagccttgaaagatgttggtgttacagaacgttattttagccatcaactaccgcccagaggtctatgattaatgttcttggaaaggattttgaggataagcttggcatcacaatcacatgctcccaagagactgaacccttgggaactgctggccctcttgccctggcaagggacaagcttgtggatggatctggtgagccgttctttgtcctcaacagtgatgtcataagtgaatacccatttgccgagctcatacagtttcacaagagccatggcggtgaggcaacaattatggtcactaaggtggatgaaccttcgaaatatggagttgtggttatggaggacacaactggagttgtggaaagatttgtagagaagccaaaaatatttgtaggcaacaagatcaatgctggaatttacctgttaaatccgtctgtcctggaccgcatcgagttaaagccaacttcaatcgagaaagaggtctttccgcgaattgctgctgatcagaagctctacgccatggttcttccaggtttttggatggatattggccagccaagggactacattactggcttgcgtctttatctagattcactcaggaagaagtcagctgccaagctggccgccggagcacatattgtggggaatgtcctggtgcacgacagcgccaagattggggagggttgcctgattggtcctgatgtcgctattggacctggatgcgtcgtggaggatggtgtgaggctctcccgatgcacggtgatgcgtggtgtgcgcattaagaagcatgcgtgcatctcaaacagcattatcggctggcattcgacggtcggacaatgggcacgcatagagaatatgacgatcctgggagaagatgtacatgtaggtgacgaggtctacagcaatggcggtgttgttctcccgcacaaagagatcaagtcaagcatcctgaagcctgagatcgtcatgtgagctcaccgctcacaagtgcttttaggaacgatgttgtgcgttctagtgcatactgtaaacagcttaatatatgtggaacttgcgagacttgttcccagtgttgtttcccattaagatcgacttccagcttgagtatagcgttctggggatgtcagcctgtttacttgattttctctgttcgcagaatgtgtaatgtcacagaaaggctccgtcacagcaaggcctttgaaggtcaatgccttaaaaaaaaaaaaaaaaaaaaaaaaaaaaacccccgg

SEQ ID NO: 28883 - DNA, 574 bp, Triticum aestivum
  unsure (1)..(574): unsure at all n locations
  Clone ID: PAT_TA_28883
aaaaaaatgtatttatttctttaatattaaataaaggtaaagtactttagcagataccttgagcagtcttggagtcttcagttgattctgattcagttcctgttgttttggacttggggttcacatcgttgctgtagattgaactgtgagagtgctcttcgatatgttcacgtcttttggcaacggcttctttatctgatgtgtcaagagcacgcagggcagcaatgatatccttgaccaagatttcacagcgagatctagaaaagtcttcacgaacaacaacacgcagcatcttgatgtgttctacattgggtgccatagtataagcagggactatccatccgccttctcttaatttagaagaaatatcaaactcattgtagtgatgttcatcctttaatctgaaagcaaccagaggtaaaccacgaccttgaccctcgctcatgatctcaaaacgaccggtggccttcaatcgatcagccaagtgatcagcagtagcagtcaagttggacatgatctttttgaaaccactcctacccaaacgaatcaagacataatattgtngcgatcacat

SEQ ID NO: 28884 - DNA, 672 bp, Triticum aestivum
  Clone ID: PAT_TA_28884
ggggcaaaaggtattcactaaatttcacgttttacggtagagaaagtgcattacagaaggtagaaatacatacacagggtaggtatacgtgctcagttattggtacaggctatttgcacgtggtgtattagccagccctgattctattgatgctgtggcggcggcggctgggtcagcggcagcccgaggcgagctcgcctcatcaggttgtactcgagcagcctctgcgcatccggcatcacctccttgacgccgtcgagcgcgcgaaaccgctccgcccaggccgccagcagcggcgtcgcggcggcgtcgagcagcctcacgccgcacatggcctcggacgtctgcagccacccgacgaagccgccgagcacgacgtccacgagccccaccgtgtccccgccgaagaagcccttccccttggagcactccccgaacgctcgctccagcgtctccagggcggcgccgacccgccccgccgcctctgccctctcctcgccggtgcgtccgccgtagacgggcagccacgcgctgagcagctcgccgtcgacgtaggaggcccagaagcgagcgacggcgcgctcgtgcgggtcgggagggaggaagcgcggggagctggccgggaaagcctcttcgacgtactgcacgatgagctgcgactcggggacgggc

SEQ ID NO: 28885 - DNA, 948 bp, Triticum aestivum
  Clone ID: PAT_TA_28885
atatcttttattcacaaaaaattcacagaaggtagaaatacatacacagtgtaagcatacatgctcagttattggtacaggctatttgcacgtggtgtattagccagccctgattctagcattattttatagtataaatctatctattggtgctgtagcggcggcggcggcgaggtcggcggcagcccgaggcgagctcgcctcatcaggttgtactcgagcagcctctgcgcatccggcatcacctccttgacgccgtcgagcgcgcgaaaccgctccgcccaggccgccagcagcggcgtcgcggcggcgtcgagcagcctcacgccgcacatggcctcggacgtctgcagccacccgacgaagccgccgagcacgacgtccacgagccccaccgtgtccccgccgaagaagcccttccccttggagcactccccgaacgctcgctccagcgtctccagggcggcgccgacccgccccgccgcctctgccctctcctcgccggtgcgtccgccgtagacgggcagccacgcgctgagcagctcgccgtcgacgtaggaggcccagaagcgagcgacggcgcgctcgtgcgggtcgggagggaggaagcgcggggagctggccgggaaagcctcttcgacgtactgcacgatgagctgcgactcggggacgggcttgccgttgtggatgagcaccggcaccctcttgtgcacggggttggaggcgaggaggagcgggctcttgccgtcgaagaggcccacctcctccacgtacgcgtaggggaggcccttgaggttgagggcgaagcgcgcgcgcagcgcgaacgggctcgaccagtatcccaccagcgtcagctcctcctccatgccgactggtgtagtactccaaccagcgagtagtggtgaccactgataaatggcagcttcgcccgcggcctcgagcgggcgg

SEQ ID NO: 28886 - DNA, 577 bp, Triticum aestivum
  Clone ID: PAT_TA_28886
atgataaaaattagtatgtatatattaaacatatacatcaccaaacagatgcaatttccttgtcacaacagcaaggcagcatgaccacaatattcacacttgtgacaaaaacgtgtacagaaaccagaagtacttaaaaatccacataaaagtccactatcacattgtaggtagcttaacagtcgaaaattcatgcagcataatattccaaggttcgcattacattaaagggcacagaccacaattcatagagagataggaaattaagcataagttgcagctgcggcatcaatgttcaattgttgatgatcaatcatccatccatcacatgctgctagcatctaccaaaactccaaaaggtcttccactcccacatgtccagcatcccatatacatttattttgagtacctactagcaagaaatagattaggcagcaaacttgtcattcaagagcttgccacctcactcttaggaaatggtatgaattcaacatcctccttctcatccactattattggtggttgattgtcctggtgtgaacctcgtatgaagctagaggcacatactaatgcctcg

SEQ ID NO: 28887 - DNA, 699 bp, Triticum aestivum
  Clone ID: PAT_TA_28887
attcatatcgtgccgccctccacccactctccggcttacatactgccgtgagccacgatattaaaggaaacaactagtactaagtactcccttcgtaaacttttataagattgtttagatcacgaaagtaagaatcttataaaagtttacagagggagtactaactgacatgacataatagctaaactgacattccagcacatctggcctcttgacttgtaatttgattacttcatatgacgcctcctcaacttcttgtagcgtcccctgctcgacaccccaaggtgctccgacattgacataaaaaagaagagaaaagaggttattcatatggtctagaaagaaaggactctgcaatagatggacacaacgggagcagaaacattgaacctttttcagacatttgcacaagcaggcctggcgattttggatggttggattgttggattagagtactgtccagcagaccagctcctcaacagaggaagccttgctctcaggtgcagctagctgggcgccttcgaccgcctacaaagaatactctgcaatccaatagacacaaacaggctgaccttcttcagagacttgggcaagcaggcctcaggatttagcatcgatggactagaagatggtgaagtaaaccagctcctcgacagacaaagcctcgcgctccagaatgccttgtctctcgtgccgaat

SEQ ID NO: 28888 - DNA, 979 bp, Triticum aestivum
  Clone ID: PAT_TA_28888
agatcaaaacaaagaatttttttttattaaaaaaaaaaaaggactgttttcaaataaaagaggttaaatggttcataaaagaaacttaatcccaaccagaagtagcgggggccgtgttgacatcatcagcccaatcaccgacagcatcagcagagggagcttcagcagaccaatcagccgcattaccagcaaaactagcaggaccttcagcttcgatcgtccaatcttgttcttcagtcgtagcaccccattcgacattacgaccggcctcttccaattcagcagcttcgttttccttttcaatttcctcagggtcacggtaaaagaacatgtcgaccatgacatcccaaggagtagcataatccaaggtaccacgaagacgaaggacagcacgggccaagagccagtagatcaaaccgatcgcatgcttacccttgttgttggtagggatgacgacatcaacatattgaagcgaggcatccgtatcagcaagagagatcacagggatattgacatacgaagcttccaagatggcttggaaatcagaacgagggtcggtacagacgacgagacgaggttcacggaaggaacgggtgatgtaattggtaaaagtacctggcgtgaagcgacccacgaccgcttcggctccaatgtagcgagcaaacttcaaggcggcacggtggccgtagggacgagcagagacaacaacaatgtccgcagggttctcgatcgctgcaatcacacgggcagcaaagatgagcttttcccaagtcttgccaaggttaatcaagtgaacaccatcagctcgacgcttaaagacatagggagacatgcgggtgttgaggttcttggcgccaaggtgggcttgagcagccaacaagagttgaaggtcttcttcagtagggttcaaaatagtaggaactttagacatttttttttagagtaggacggctatcgtttgtttctgacaagagttaag

SEQ ID NO: 28889 - DNA, 1256 bp, Triticum aestivum
  Clone ID: PAT_TA_28889
caacagtgaaacatttcatcacatttcagcccaaactttctcgccggttcaatataacaagagaagaagaaaaggagcagcaaaactgaacatttaacaaaagaaagaagagaagcagcagccaccaagaactactagtagtaacctatccaaatccatgcacaacatgcacgcacgcagctagtctccatcgatctgtcggtctcatgaacaaccatgatcctccgagctccatttttcttcatcttacaagaggcacgcggcggtggcggcggccaccacggcgaccaggctcctccagccggcgccgacggcggcggcggctccggcgggcggggcctcctcctcgtcctcgtcgtcgcccgagggcgccttggctgcccccttggccgacgagggcttcttgccgtgggccggcggcgcggaggcgggcggcttggggccgaagaggtccatgggcagcagcaccttgtcgacggagtagacggcgagcggcctggtggcgcgcagcgcggcgccgacggtggtgtggacgatccccgtggagacgttgacggcgctgttgctggtggcggtgacgttgacggtgcagggcccgtcggtgccggaggcctgggtgcggacggggttgctggcggtctcgaaggactccatggagtagaaggtggggacgatgtgggcctgcaccagcgtcacctggtcctgctgcgagagcgagttgagggtgcccggcttgaggctgttgaaggcgctgtcggtgggggcgaacaccgtgaagcccgtgtccgagtcgttggcctgcgcgttcagctgcgtgtcctgctgcgtcgacgccatcagccggatgaacttggtgtactgcccggccttctccagcaccgccgtcacgttcggcgcggcggccgccttgggcgtcgtccccgccgccggcgcgtctggcgtctcgggcgcctcgggcgccggggccgtcgtcttctggctcagcgccgccggcaccgccgccagcaccaccgccagcaggatgagcgctctcctggacgacgccattgctggagtggtgctagatcgaggtgctggcttgcttagcttagctcaagagtgtcgcgcagatccgcagccgggggatcctgatgtgatatataactggggatgggaatggagctgggggttttggagctgtgtgaggaggcgagatgggaagggaagatggtaacagactggctggtctgggttagtgttaaccatgatcctcgtgc

SEQ ID NO: 28890 - DNA, 992 bp, Triticum aestivum
  Clone ID: PAT_TA_28890
aaaaacgaaaacgttcaataaacattactttttattctacactgggccttagtccaattctttgaagaacataagtaggcatacagtaaacaggatcaaccgattttaaaccgggataaccgagcaaagaaaggccagtgaggccaaatagcgtatgaaatacatcaaccatgtctcccggtctatctgatatgcctcccttttcaggatcttgtgctgacaagataaatcgaatcagtttatctttatcgatccagtgagtattacccaatgtcgatagggcagacaagacccaccaagaataacacacatcttctaatttttgaggtcttccatttaacccaccatttttcaattgtctttcacatagccaccaactaagcaaatccgtatccacatgatgcaatgcatccgcaatagccaacgcactcacgcagcagaatatttggcccgaatgagattctgaaccaggtcgactgccaaatcctccatcataattcttacattttaagatccactcgaccgtcttttctacatcaatcgcatccagacgtttaagtagtgaacagcagcagagtgcaatataagcaaatcgagaatcgacttctccccaagcgtcacctcgaaatgaaccatcttgattttgtaaagactgaatgtaatttatgactttgtctacatcaatcacttccaaggcatccaatgtaattaaaacctgaacagctgataaggtgcaagtaatatgggtatcatgacccgtatgagcactaaagcctccattgctttgttgaaggctttttacataactaatcacttcttctcttggtaaagcgtcaatgtgattcatcaagtcaagtgctgttaatccccaataaatgccgttcaaacgcaagtgttctgtaagccaatattcaagctcatcttgtcttttatctaaacattggatatatttcacatgaagtggtatcaataactcttcttccatcggacgg

SEQ ID NO: 28891 - DNA, 1633 bp, Triticum aestivum
  Clone ID: PAT_TA_28891
gaattccgcgttgattgcagattggggaattgagctgtctctgttgtttgatcctaagtgccccaaattggagtcccttgtggagaaaatcaaggagattgtggagagcaatgaagtgggaagattgcctaaaattcccaagggaacacgtgactttgggagagagcaaatggccataagggagcgtgcgttttcaataattacaagtgtgtcgcggacaggcgacggatccccacagcatcgccgagtaggctaagaggagaaaggcttgaggaaaggataaggtgcctacaggaattggtccccaatacgaacaagtcagatagggcagctttgttagttgcgctatgatctgatttgtacatttgcacgctatgattccatgtgttacacaagtgcaaattaggtgttgcagatggtgatgctcagctggtgtgataacttctaaattcaatgaagggggaaacaagcgatggtgggagcaaacagcagatatgggaaaagtggtcaacggatggcacggaaaaagaggatgcgaagatgatggaagtggataacggtgatatagtgcactttgacataaagaaagctctcaggcaggatgctgagtctatgttgccattgctatctatgacagacaacatactcagaacggtcagcccagtgaaggacgaacccaacaacattacctagtatgagaacagcagcggcaacatggatgagcgcggctgctagtaggcatgcatgaacctgttatcaaagtgttaagataaaaactgctggttctgatccactaactacaaggaggcaggaaaagaccgtaaatgatccgctcacactgggagctgtatcgacgttatatgatgtgacgttcttatccaatgctctagaaaaagcaaatgcccttgacaggataagttttgatttaagccttgctagaggccttgattactacacaggtgtgatatatgaagctgtgttcaagggcgtcacacaggttggctctattgctgctggtggcaggtacgacaaacttgtgggcatgttcagcaacaagcaagtccctgctgttggcgtcagccttggaatagaaagagtctttgcaatcatggagcaacaggaaaaggaaaagaaccaggtgatccgggcgaccgagacggaggttttggtgtcgattctgggcaaggacctcatattggccgccgagcttgtgaacgagctgtggagtgctgggataaaggcagagttcaagctcaccaccagggtgcagaaccacataaagtatgcgacgcagacaggcatcccgtggatggtgctggtcggcgagtccgagttgagggacgggaaggtgaaactgaaggacattagggctaaccaggaagaggaggttccaaggaaagatttcgttgaggtgctgaagcagagattatctaacccttagagatgaaatctttgaaagatgtagaacgtgtgtgactgggcgatacatcgttgttggttttcctgtgcatccattttgctgatgctgagatgtgtacacaggacggtgcggctccttgatttaatactgatgatcacaaattgtttgaactgttgccttatatgttgagtgcttggtggaatgaaatccctg

SEQ ID NO: 28892 - DNA, 593 bp, Triticum aestivum
  Clone ID: PAT_TA_28892
agcgacggggagaggccccagggcacgggccgggcctgcagcgcctcccagaaggacggcgccgcctcgtgctcgtgctcctcgcgcggccgcttcccgaggagggagacggcggcggcggagggcgccgaggagcaggagaagacggccggggtggtgccggagccggtggcggccaggatggacggctcggcctgccggagcagccactccacggtctgcccgtccgacttgagccccagctcgcgggtgagctggaacacgcgcgccgcgcacacgatcggcatgcgcacgcgccgcccgcgcccgtttaccttgctgtgccggtccttggcgcccttggccgcgccggcctttctcggcgccggcaccggcaccgccaccacggcgtcgtccgcggcctcggccgacgagaagccgggcattgccatcgtctgggacatgggcgtcgccgtcggcattgccatgggccggtagagctggaaggtggcggcgtcgcgagatgccatggctgctggtggctgagctttggttcgggtggcgcacagatgtgtgtggggaggtgatggcggacgcgtgggcggacgcggggg

SEQ ID NO: 28893 - DNA, 803 bp, Triticum aestivum
  Clone ID: PAT_TA_28893
tcgcgatctagaaccgcccttttttttttttttttttttatcaggaaggaataaataaagaatctttattaacagtttaatttttccattgagtattcatagctaatatagaggtagtcataccagctaaacccacaattccttcatctgctttaagataacccaacccagcaagtggaataattgcatccacagcatcttgaatcatctgatatttagtgttgtatttatccttggcaagagtcttttcttgagccttcaattctaaaatttgtacttcagaatctttttcagaattgacaatcattttacgcgtcttctcaagtatcttctcacgagcaactaattgtttagatttatacaaacctgaaagcaaagaggcaacaagggcagttaaccaacacttttgaccaaactcagtgatcttcttgatattggagggcttgtaaaagttgatggcgttagacaaaacaaatgcttcactgagataataaaagaacataccagcttgtttggcaacagcagtataacgtaagacttgatcattcatagataagctcttgacaccaacctgagcaaactcaactggtttcaaaagacgaaagaactttctaccgttaccaaggtgtgtcttcaggtcaacccaacgttgaacggtatcttttgatgcaccggtgcggaataaataaaatgcataaaagcgagcaaaatattggacaagacgacagagcttttctctaccaaccgtggttcccaagtaacgattgaaagcatccacttttcgtgagttagaaccttttttg

SEQ ID NO: 28894 - DNA, 930 bp, Triticum aestivum
  Clone ID: PAT_TA_28894
gattgataaaaaaaacttgtgatttactttattacaatacaacaaaaaagtcaactgtatttttttttttcttagtttgagatcttgaaggtgtttgattcaaaggtacatgatgtatcagatttctttgaggtgacttcaagcttgtagtgataatcagcgctggtatccacattattcaatttaagatgatccttgagagtgaaggagttttgaagagcttcactaccagaccaagcgacttcaaccaattcatctcccttgtacaactcaaccttggtcaaggagtcggtttgagaggtgctgtcacgatcgacttggatatgaatgtgatcgtcgacattgaatgtactaccagctttaggataatcaacagacaaaccgaaacaaccgttatagtgttcattggagaaaatgttggcgtcatcaaggtgttcagcatattcagttacaccagcagcattggtgtgagatccagaagtgaccttgaaagtgtgagatgtttctaaacagtcaggaccatgttggccattaactaagtttgtaacccaaacacgataatagtaaagaccagcagcagcactcttggggattgtgtcagtaatagaagcagaggattgcaaagcatattttcctttccaaacattctgaacatatttagcttttcctttagagtcaacagaatataaatctaggccagtaacagtctttgtgcgtttatcagcttttctagtaacagtaaccttggttttactaccagcaactacaacagttgaagcagtagggaaggtgacatcaaggccactacaccaagacttcatggcatcactgtaagaatcagctgtagtgaaagaaacggctgtggacaaaacgagtgcagaaatggcggcaacagagaacttcatgatttaaaaatttggtatatgcctt

SEQ ID NO: 28895 - DNA, 725 bp, Triticum aestivum
  Clone ID: PAT_TA_28895
aaaaaagaattcaaacaaaaaaatttttttattcctcaaatacagtttgaaaaagagttgcagattattttattaataattcacgaatccctcttttcctttctttagttcatggcttgaaccaagttgttgatgaattgttcacggttaccagcatcaccaccttcgatgaagtgacggaacttacgttgcttccacatgttgttggggttggagagcttgaagggccagaggaagttgttggcttccttgaagtggggaccaacagtggcaatttcgtggatgagatcttcaatacagatgataccatacttgccgagagcttgttcaatgacagcgttatcgtggatggggatacgttgcttgctgaccttggcatatccacgcttgtagatcaattcacggatggtcttcaagttgggagtaccgtaagtaacatagggttgaaccaattggagcatttcagaggtagccttgttcaagcggacaaagacaccgttgttgatttgcaaaagacgcaagagttggagaaccttacggggcttgggagcaatgttgttgataccacggatacggacaacaaagaccaacttttcttgagcgggaacatagtagttaccgttggacttggcttgacgacggagagtgatttccttacgttcggcagccttgtattcagcatggtacttggcagcacgcttgaagagatcacgtctcttggcgag

SEQ ID NO: 28896 - DNA, 910 bp, Triticum aestivum
  unsure (1)..(910): unsure at all n locations
  Clone ID: PAT_TA_28896
atattttggattcgagcagacaaaatttgtgctaaaccagccctctactctttccttcaaaccgcaacactgcattctgcgtcacatactgtatctagcttctacagttaatacaattcatatagattagacggttgcgcttggcgctcattgcctcagccgtttacacagaaaaagaagccacaaaattaaattatcacaaggagcatgatgttacacaactgaacttccagggggaaacagcctattacactgaagagagcagccccgtccaaccctacatacaggcaaaaggaagaactgcaatggttgtggcaacatcatttgggcttcaacaagaccccacattatcttcatataaataatggtaacacacgagtagtccaccgtgccttgtgttcttttaagatgttgacttccgccgtacgaccaaatcatcagctgagtagtactccgaaataagccggtacatatatgatggactgtgcccgccagtatcagtgatgaaaaggctgacaagcttcggtggcacatagtcaaacgttggattggcaacgtttagaagaggagtaccatcctgagtactgaagttcatgcaatttgagaactcgccaaagtcaagcaaatcagatggtgatttaagctcgttcagtaaaacctccgggttgtgcggatacaaaggacacaacttatgactgccagcaaccacgacaaagggtacagcatgcctttgagcagcaagagcaaccatattcatccctactggtgcaatgactccaccgtttgccattattgcatggactccaacttttaaccatgttaacntcgggagatcatagcaaaaactgctgaatctgttataacagtagtctgtacacctttctcggaccagctccttcgcaagagcatg

SEQ ID NO: 28897 - DNA, 338 bp, Triticum aestivum
  Clone ID: PAT_TA_28897
aaagaaaaacaaaattatttttatttaatcattgtgagatacattaatgatataatatggtaaagcaggctgaattttcttatttctatcacactgcactaaccaatcaggttttacgataggtatagaatgctgaacagcacgatcataatttgttccaccaggtaattgagccaacaaatgggttgtttctacactcacttcatcagaccaagaagcacccatttttgtcaataaatcttttaattcagtgatggctggttctgattgctcaaaagtaccaaatgcaacccgaatacccgtcaaattctccatcttgtgtgtacgtgcagttacct

SEQ ID NO: 28898 - DNA, 390 bp, Triticum aestivum
  Clone ID: PAT_TA_28898
aagcaacagccctcgcatcttaatggatgaaagtgattctgaaaccattcagagaagtatttaggcagctgcagattaccaaaaaattaaagaggacggaacataacggtattttggccatttgctaggtgaaatacacaccttctacgtttgactagctgctgtcctccatgattttaccaagtaacagtttacttgagtggcacaaaaggaagctttttatatcgaacagttgcagtgctgcacaaaaactgggaggatcactcaaaaatattaaagcttggatcaagatgttttatgtagaacactaccaaaaggtatgtatcctgttcctactgaccattttcagttcaccggacgcgtgggcggacgcgtgggcggacgcgtggg

SEQ ID NO: 28899 - DNA, 439 bp, Triticum aestivum
  Clone ID: PAT_TA_28899
gtcgaccgggagattcacttaatgacgagctgaggaaaaaggagaataatcgtttgattttggccaaacatacctctcttttgaagaacatgaagagaaaactcattttggcgaaaacaaaggttgcaaaagcagagatggctttggcgaaagttcaggaatatctctctccagcagagcttccaacggatctggaaactgttacagacgaggagcgtttcctattccgcagaattggcctgaaaatgaaggcctttttgatgcttggcaggcgggaagtttttgatggtactgtgcaaaacatgcacttccattggaagcatcgagaattggtcaaaattgttgtgaaggggaagacctttgaacaagttaaacatattgctatctctctagaagctgagagtggaggcgtgctcattgcactcgacaagacaacaaa

SEQ ID NO: 28900 - DNA, 579 bp, Triticum aestivum
  Clone ID: PAT_TA_28900
acaatataaaaagtgaataaaatatatttattataaaggaaagggggagtaaaaatagaatagtacaatgaatggaactgggaatataatacaaaagtatggtttacaagatttgatattcaaatctctcaagagcgagcagcttgaatagtgaatttctttgaaatatttccagagtcaccaaagagaatgatgatataggatgtctttgtttcaagttcactaggtagagttacggtttgagcaccagaatccaaagggaaatcatcagccaagtcccaagtgatatgttcgttgtcaggatcgtccttttcgagataacccaacttgatataacctcgttgaccggaaggaataggagcttgcttttcaccatcaaagtaagtcgtttcccatttgactacataggtaccaccagctctccactttgtaccagtagtaggagtgagaactgtaggattgactaccatagcatgagtcatggcgaagaaggcaaaaaaagcaaaaaataagcaggcgaatttgatatttaacattttttttcccccgcgtccgcccacgcgtccgcccacgcgtccg

SEQ ID NO: 28901 - DNA, 1059 bp, Triticum aestivum
  Clone ID: PAT_TA_28901
aatgcagaaacatagcttagcaggctagaaggtatttattctgtattttgtaatgaatattgtaccaaactaagtgatatcgtggttttttattgagcgactatgcactgtattataacttttgcgccgaaacacagcttgcataaacataacaatttgtatgagacaagcaatgttcaagttcatctagaaatctggaaatttcctctttgctatttaatcctaaatttggacctatgaaacgcaagaggctttttgcaatttcaacaaagtcccatatgaatttttttgcagtagctgtattggaactcatgttgcaatgtcgaatatcatgctgaataatttttaccatgtttgtctcagtaagcaatttttctaattgataagcaatgtacgaatcttgccctttagaatgggctacagagcgaactgcttttatgaatttgtagtaggccgaagaattatcatctggtaatcgcatccctggctctgttaactggattcttcctcctggcttgacgacgcgcactgcttctttcaaagctattggccattcttccttacggagagcaagtgcgaaaaatcgcatatggacaaagtcaaacgtattatcttcatagggaagtcctactagtacgtttccataattgtaggtaaactgatccacctttaagattttgtttgtagtatctacgatatcgcaaccatgatatgtacagttgggataatcattgatcatatccatgatccatacacctgacccacagcctacatcaagcacagatatacccttttcaaaatcaagagcttcccgtacactgcgagatatatttccttcaaagaactctttaaaaagaaaatgttgtcctgtcaatctcttttgttcttcatcatcttttggtaaccaatacgtggatgattcttcgttgtgaagctctctgtctgtattgattgcagtatattccacgttcacagccgtatcgaccactgttgcttcttgagtaggggtcattgttttgcttcttttatctttaacagttatatatcactagatgttct

SEQ ID NO: 28902 - DNA, 444 bp, Triticum aestivum
  Clone ID: PAT_TA_28902
cgggggacggacggggcggcaactgttgcagccacaatgttcccaccatttgctagccagacacagctaaatgccagagctagctagcgcataatagtgcactagtagtagtacacttgtatcatcttcagcaaactactccctattcccaagaaattgcacgtatagggagagttgaggcaaaaaacctgcttcagcagtctccctaaacccaaaaaattatctcctcaaatagtggagagttgcaaccctccccataaattttcaatgcttgccatgtcagtgcgccgcctccattgaccgccgcgccactggaccactgccgcctgctggaacaccaccgctgccgccggacttctgtgctgccgttgctggacatccgcgccgccgccacctgccaccgcagccttgacgaaaagatgcaaatgagagagaggggaaaaa

SEQ ID NO: 28903 - DNA, 1059 bp, Triticum aestivum
  unsure (1)..(1059): unsure at all n locations
  Clone ID: PAT_TA_28903
gtcacggcggnagctcgnagcagnnctgaatatgtgaanaagcaccttttcagcaatttaaatcaagcatccgaaattcatgacagatacaaaggctgctattgctgaaacattcaatcataccgattcagagtttctgaaagctgatagtagccacaccagagatgctggctcaactgcctcaacagctattcttgtcggtggtcgcttggtggttgcaaatgttggtgattctagagctgttgtttctaaaggagggaaggctattgcggtttccagggatcacaaacctgaccagacagatgagagacagagaattgaggaagctggaggctttgtgatgtgggctgggacatggcgtgttggtggtgttcttgctgtttctcgcgcatttggtgataaacttctaaagcagtatgttgtcgctgatccagagatcaaggaggaggtagttgacagctcacttgaattccttatccttgctagtgatgggctatgggatgttgtaactaacgatgaagctgttgccatggtcaagccaatagaagatcctgagcaagcggcgaagggactacttcaaaaagcttctcaaaggggcagtgctgacaacatcactgtcgtcattgttcgcttcttggacggaacgacgacgtctgccggagatggaccaagtgaggaggtcgccaaggaccaaagtgaggaggccgccaaggaccaatcttcatagttcttgttcctccacggcgttgtatccgctgttgtatctgatgctcgaagtagatgtcatgtggcggcgccctcccgtgctgcgaaaccaaactgacttggcctgagtttcgtcgttgttccatgctcccggctatcctagatggtaggtaatgtcggaacacagggggatggtgaggcagtgttgttaccatatgatccaaggggtactttttctttcttcatgctgaaccttgtactgtgtagcttctatgctggtgtttcatgctagtgatttttagcagtaaatgcatgtaacctgactatttgaatgatttgaacaaagttgtgctc

SEQ ID NO: 28904 - DNA, 1735 bp, Triticum aestivum
  Clone ID: PAT_TA_28904
cccacgcgtccgccccgcgtccctaccgcctctctccgcccccaatcccgatctccctccccccctctcgcccctctcatgcatgagaggtcgccggggccatcgctagccgccacgcgcctcccctcccccgcctccctgctcctgctcctgctcctctcgctgtccctgctcgccgggcggtcgcacggctggtggtgccgcgaggacgacgaggggtgctccctgatggggttcaggggcgacgacttgccggtcaccggtggcggtatcagtgaaaaaggcaggttcagttatgggtttgcaagctgtgctgggaaaagggcatctatggaggatttctacgagacaagagtggatgatgttgatggagagactgttgggttgtttggcgtatttgatggtcacggcggagctcgagcagctgaatatgtgaagaagcaccttttcagcaatttaatcaagcatccgaaattcatgacagatacaaaggctgctactgcagaaatattcaatcataccgattcagagttcctgaaagctgatagtagccacaccagagatgctggctcaactgcctcaacagctattcttgtcgctggtcgcttagtgtttgcaaaggttggtgattctagatctgatatttcgaaaggagggaaggctagtttcgaaaggagggatggctattgcgattacccagaatcgagacagagacatgacggatgggaggtggtcatgctgggaatcgggactttgggggctgacggttgaggccgtgggttgttggtggtgtggttgctaattctggcgcatttggtggttcacttcaaaaccagtaccttggtagtggtggccgaggggatgtggaagctgatgatagagcacttgcattgctcaatccttgctagtgatgggctatggggtcgtgtggcttaacgctagaagtttttccatgggcaagtccttagaagatccttggcaagcggcgaagggactacttcaaagaagcttctccagacgggggtgcacgtgctgacaacatcactgacgtcctaattcgcgtcgttggacggaacgacgatgtctgcttggtagatggaccgggggtgatgaggttgcctatagaccaaagtgaggaggtagcccaaggaccaatcctccatagggctctgtagttctccacggcgttctttactctcgtgtttgttgatgcctcaagtagatctcagatggcggctcctcccggagcgcgaaaggaaaatgggcttggccgagtttcgtaggtgtccagggccggctatccttgattcaaggtaatgccggaacactgtggcatctttggtgcagtttgttaccagttgatctaaggggtacctgctctttcttcatgctgaaccttgtactgtgtagcttcatgctggttgttgcatgctacgtgatttttacgcaataaatgcatgtaacctgacaaattgagtgagtggggcagtgttgttaccatatgatcccaaggggtactttttctttcttcatgctgaaccttgtactgtgtagcttctatgctggtgtttcatgctagtgatttttagcagtaaatgcatgtaacctgactatttgaatgatttgaacaaagttgtgctcatggtgtcacactacagagttcggagctcgattttatttaagctttccttgcggagccaaaaacaaactcttttatccctctaaaaaaaaaaaa

SEQ ID NO: 28905 - DNA, 693 bp, Triticum aestivum
  unsure (1)..(693): unsure at all n locations
  Clone ID: PAT_TA_28905
gagaaatacaagaaatcaaagcaagttcattctattttacgtcacgtangctgaaaagaacgacattgctcttaaaactctatatgaaactatcggttggcccttatacaagaaatatggccatgcttatgatgcattcaagatggccattcttgatactgatgccattttcagtggcattgatatttctaaagaactccttgatgaattattgtctattattaagcgtagaatgacacctcagcctgtcaaaatccgtgctcaattggatattagatgcacaggtatcgacggcgtaaatgctatcaaaaacgccttaaaagcgggtgaacaagttggagacgaggatgttcctgtaaagattacatatttagctgcacctttctatgttgttactgtagattctttagataaagagcaaggtttccaaataattgaaaaggcgattgaggcaataaagactacattggatcaacacagttggactcgattcaaggtcgaaaaggaagccaaggtcgtatctgattctgatgatcgtgactttgctgctttattagcacaagcagaaaaggaaaatgaactagtgagcggtgatgaagatgaaggagatggtgtagctgctagtgaggatgatatataatttctatataataaacacacacacacacacatctcgtgtatatacagtccctt

SEQ ID NO: 28906 - DNA, 710 bp, Triticum aestivum
  Clone ID: PAT_TA_28906
tctctcacgcgtccgacagaacatgttgaacttatgaaaaaaccagaatggtattctgatgctcaaaagtattggaatgcagtaccggctactgttgacggtatgctcggcggatttgaaacaatcgatcctatagacgtcaaaggctctatatgttttattaaagaatttgttgatcaaaacataatcagtactgaatatgcttgtgattgtggagcaggcatcggtcgcgtcacaaagaactttttgttacaagtgccattcaaaagagtcgatctggttgaacaagctgaatcttttgtccagcaagccaaatcagattatctggctcaggaaattgagcaaggaaaagtaggaaatgtgttttgtcaaggattacaaggttttacgccagaagaaggaaaatatgacttgatttggtgtcagtgggtacttggacatttaacagacgagcattttatcaacttctttaagcgctgtataaaaggtttaaagccaaatgggttcattggagtaaaagagaacaatgcttcaaaagaagcactatttgatgatgaagatagcagtgtgactagacccaaccaagagttaaaaagattatttgcagaagcaggcttaaacattgttaaagaggaagtccaaaaaggatttcctgctggtttatttgcagttcgaatgtatctgctaaaacctcaataaattacatattt

SEQ ID NO: 28907 - DNA, 1129 bp, Triticum aestivum
  Clone ID: PAT_TA_28907
ctcctctgaaagatgatttggtgtcaaggaaatcagtttggctcttgctgaggtgatgcgtgtctatgatgacaatgatgatgaagagacagatctgagtgaagactctgacgaaaatggggattcactttctgtagaatcagattcggctgatgatttggttgttattgacactgaaatggtcacatcgtcagccttcactgccgggaatgcgtctgaatcatcaactggaaattcagagaatggaaatttctcaaccaatgggactcaactgttggtttctgctatgaaaggaagccgtgcaaagcggggaattgtgacaaagttgattgtttcatgggcccctgacgtatatgatcctcctgttacttctgactcacacacagtgaagccgcaccagagaagttcaaggaagagccactacaaatacaagcccccaaagggcagcagcagcagcagcagcagccgcactagcagtggcagcaaaaaggacaagaagcattctcaccacagcagcagcagcagcaaaagagataagaaaccttcccatcgcagtagcaatggtggcagcagcagaattgacactagtgatcctcaacatcggaaggcatatggcagcatcactagcagcagaactgacactagtgttcctgaatatcataagttatcaccgtggcagccaccggctagtgccgcagtggaagaagccatacctaccgtacctgtactgaaggccatggaacagatcaaacgtagttccagctgctgcaaggagccgccgataagcatgaaggccatggaacagatcaagcgtagctccagctgctgcaaggagccgccgataagcatgctatcacgccaattcgtggctgccaagtacaaagggatgttttctttcttgagtcagaaccaccttgcttcttgagcatatcgcagagactcctgcgctattcacaggcgttcctctggttatcagcaaggctttcatgttggatggcgtttgatctatgaacttttgtttggacatcagtggacacggttttgaaaattctttggttgacgtatgcatgcccttgagattattaactgtcttttcttattattaaaataaaaactgttttgctcaaaa

SEQ ID NO: 28908 - DNA, 2108 bp, Triticum aestivum
  Clone ID: PAT_TA_28908
gccggccggtcctggggccaatccacgcacacccgctcccgtcccgcaagctcgcctcgcctcgccctgatccgatccccaaatccctcgccgtcgacgccccgaatctcagctccggtgactcccgtcccgcaagcctcgctcgcctcgccccgccctgtaccgatccccaaatccctcgccggcgacgccccgaatctcagctccggtgcggccgacccattagcagggcgtgacctcggcgcgcccccctccctgccgcccgccgctccctcctctccgcccgccgtcgccccggtcgccggaacccgacaagttggatatctaggaggcaccgcagcgttgcggcgcccaccgcgcggacaccatgtctgcggcgccagccgcgtaccccacccccagcctccgcgccgtcgcgtccgggaactccttcttcccctgctcgcaccgcctcaagctctcctcctcgcatcgttttagtagatagtagtattggtaatcgtagtaattgcctctgacgtttgcctccccctcgtcgccccgaagggcatgatcatcctctgcctcctgcgcgctcgcagtggtggcaacaagcaagagaaggattcgcaccacagccccgtcatctgcgtacgagagtggtaacggtcccagcgcactagcagtggttgcggctccacaagagttactagtgtttgtcagcatcggaacgcctatggcagcatcaagagctcctgaattgacactagtgttcctgtgtatcacaaggtatcgccgtggcagccaccggctagtgccgcaggtgctgtaccgaagcccatcgtacctatactgcagggctccagctgctgcaacgagccgccgtcagctgcaaggccatggaaaaaatcaagcgtggctccagccctgtaaggagccgccgaaaagcatgctagcacccgaattcgtggctgccaagtacaaagtgcttgtctcccaattaagtcggaatcttcttgcttcttgagcatatcgaggatgctcctgcggcatatcctacagagctctgcgctatccacaaggctttcgtggtggaagctgctggagcttcaaattcggctgtggatttcgttggtactgatattgaaaattcttcggattcagtcttcacaattgttaagacgactgaatcttcaacttgaatttcagagaaaaaaaattcctcaacaactgggactcaactgttggtttccgcaatgaaaggaagccgtgcaaagcggggaattgtgacaaagttgagtgtttcatgggcccctgacgtatatgatcctcctgttacttctgactcacacacagtgaagccgcaccagagaagttcaaggaagagccactacaaatacaagcccccaaagggcagcagcagcagcagcagccgcagcagcagtggcagcaaaaaggacaagaagcattctcaccacagcagcagcagcagcagcaaaagagataagaaaccttcccaccgcagtagcaatggcggcagcagcagaactgacactagtgatcctcaacatcggaaggcatatggcagcagcattaccagcagaactgacactagtgttcctgaatatcacaagttatcgccgtggcagccactggctagtgccgccgtggaagaagccatgccccccgtacctgtactgaaggccatggaacagatcaaacgcagttccagctgctgcaaggagccgccgataagcatgaaggccatggaacagatcaagcgtagctccagctacgaccttcggttcgatctgctccttgtgctcgtcctgaggattgtctggttgtgagggctaggtgctacatctctgccttttgcgtttgcgcgggtttggtgtctgtgtctgtgttcgatcaccaggtccgatcgaaagcgatttggcctgttggaggtggtgattgctgtctctccgaggaaagaggaagttctcttctgaacttcggatttagcttgtggatggccggacctttggtagactgcagtgccggaggtgtgagcagcagctcatgtctcaggcgcagcacctgtggtaaagcaggttttgagcacaaatcttgtgctctacctg

SEQ ID NO: 28909 - DNA, 618 bp, Triticum aestivum
  Clone ID: PAT_TA_28909
gctagctaatgccggtgtggagccccacgatcagtaccagcgggggctccgatggctgaagtcatacgccccgaaaacatctcatccgcaataggagtagctgagaatcgtgtgctcactttgcagcatctctgtctcggatacttgtaggagatgccttcgtccccgacggccgacaccggcttgcagcaacggcacgacaaagttttccagcgccgcatggtcggtttgaggcagctggcgatggccatcaagcaccgcgccccgtcttgctgtctctgggaggtcttgcagcatttaccgtccgcccccgcacccctttcaaacggctcgtgatagacatggggagcacaagcccaccggatggatgcagaatagcatgcacgcggatgcatgcatgtccttttttttttggagttgagatgcatacatatctttttcattttttgcgagagagatgcatacatgtcgtccacaagaaagatgcatatatatgtgcacgctctttttttcatattttagcaattggtatctggctgatggtcctgtgcaaattaagatgtatggatgtattgctacaggatttcggtacattatatatattttttacgcttttgg

SEQ ID NO: 28910 - DNA, 585 bp, Triticum aestivum
  unsure (1)..(585): unsure at all n locations
  Clone ID: PAT_TA_28910
gccggccgggttccggagaggaccggaggcaggggaggagaaggacacgtacgtacgccggcaacgacgatgaggacgagcgtgcgcatcgccatggtggcggcggttgtcctgctgctcgccgcgacggcgacggcgcatttccggatggacttgatggacggctaccggccgaagcatggacggagccgcttccgcgccggattagtaccatggacgcaggacgagcacaaggacgtgcaaaaacaagggtggtcgaaggaaccacaatagtattccaagcactatcctttggcactatcatcctgtacataagcaaggcaaccccagtccccaatctatacctaactttgtaaggggagaaggtttcttactgctgaattttcatccgttaatttcgtttgtccatcacggtaattttcgttggtctctgaagaagttctttcgctactgtcagttgtacgccttttttttttgagaaaagtcgcatgtcctaacgtctaggacacgtctacagagtggccgactgctccgtagcgtttcggagtcggccggcccagatttgtttttnaaaaaacttccata

SEQ ID NO: 28911 - DNA, 781 bp, Triticum aestivum
  Clone ID: PAT_TA_28911
tgcctgatttaaaggaatatgatcaagaacaagttagacttatggaagaaatgtgcattgtgattgacgagaatgacaagcgtattggtgctgattccaaaaagacctgtcatctcatgtctaacattaacgatggtttattacatcgtgcctttagtgtctttttatttgattctcaaaatagacttttacttcagcaaagagcaagcgaaaaaattacttttcctgatatgtggacaaatacctgctgctctcatccattaaatactccttcagaacttgtagaagaaaaccagctaggtgtacgtactgctgctcaacgtaaattagaacatgaacttggtatcccacctgaacaagtgccacttgaaaagttcaaatatttaacaagaattcactatgtcgcaccaagtgatggacagtggggagaacatgagattgattatattctttttatgaaggcagatgttactttaagcttaaatcctaatgagatcagagatatcaaatatgtcactccccaagaattacaagagatgtttagagatcctaatattccaatgacaccttggtttaaacttatttgtaatacattcttatttaaatggtggaatcaaattgaaacaatcgagacaactgaacaagatgacactattcaccgcttaggattctaataataaaaacgttttttgatactattttaaataattgcgatctgtgctgctcctccttgcacgtgtaatctaacacaaaataaaaaaataaaaaacaaatttatttt

SEQ ID NO: 28912 - DNA, 403 bp, Triticum aestivum
  Clone ID: PAT_TA_28912
attccaggtcgacgggtgctaatctcatggtaggtaatgacattacataagaaagattgtaagcagtaaaatttattgaaagttgacgaacatagcattggtcaatgatgcatttcatgaaagaaattaataagggaagacaagattcacatgcaaatataccgtcttggacttcttttatgattgtgagccccattaagtattttatgtcaaattattgacgttggacaaggaagacaacataatgatttatgtttgttcatattcacacagaagttactagcaaaagagcccgtgcgttgcaacgggagagaaaacataacacacactcttaacccgaaaaccatcacccaagactacaatatgtccatcccctttaatttttcgagatatcatatttgtg

SEQ ID NO: 28913 - DNA, 1363 bp, Triticum aestivum
  Clone ID: PAT_TA_28913
cgacgctgccgacccccgccatgccgcgctaaagcgcgtcatgatcagcctcgccgccgcgcggatgcaccacgtcgcgccggtcttccgcatcgccttcggcgccgtgttcgacgccgccgacgccggcctcggcgacggccccgttcagttcaacaagctcaacgagcaccacatgttcgacttcacctgctccgcgctgttcggcggcacgccgccgagcaaggccatgggcgacggcgccgtgaccaaggccatcaagtggctcggcgtgcagctgcacccgctcgcgagtaagatcatcaagccgtggctgctcgaggatctccttctccacaccttccgcctgccaccgttgctggttcgccgtgactacgccgacctgacagcgtacttcgccgaagctgccgccggcttcctcaacgacgctgacaaggcgcagtccggcatctcacgcgacgagctcctccacaacctagtcttcaccgccatcttcaacgcctacggaggcttcaagatcttcctgccgcacgtcatcaagtggctagcccgcgccggcccggctctgcacgccaggctcgccagcgaggtccgcgccgccgtgcccaacggcagcgacatcaccgtgcccgccgtcgacaagatgccgctggtgaagtcggtggtgtgggaggcgctgcgcatgaacccgccggtggagtttcagtacggccgcgcgcgccaggacctggtggtcgagagccacgccgccgcctaccaggtgcgcaagggcgagatgctcttcgggtaccagcctctggcgacccgcgacgagcgcgtattcaagcaggccggcgagttcgtccctgaccggttcgtgggcggcgaagggcggctgctcgggaacgtggtttggtcgaacgggccggagaacagcgagccggcggaggggaacaagcagtgccccgggaaggacatggtggtggcggtcgggaggctgatggtggcggagctgttccggcggtacgacacattcaccgccgacgtgaaggagatgccgctggagccggtggtgacgttcacttcgctgaccagggccaaggcggagtgacctatagcagagcagtactgtcctactatagtgcagccggtgccaagtggcggcagcgctgccccaatccacaataattgctagtgctactggccggatgtctgttgcatctctggtcaaatctgcatgatttggcttttagtttggaattgcatgtgatgtgcgtgtgttggcgattatgtaaagttctttgggggtgtgatcgtttgaactgtctaccaataaaaaagctctatttacattcaaaaaaaaaaaaaaaaaacccgggggggg

SEQ ID NO: 28914 - DNA, 354 bp, Triticum aestivum
  Clone ID: PAT_TA_28914
ttcacgggtccacgggtctggccgcgatggcgctcttcagcgaccccggcatgtacgtccaccccatcaacgtggaggcgctggcggagtcgtagtgtggaggaccgccagcgatctggccgtgtgtgcttaggacagtttttatcgaaccaaaaacttaatttccaaatagccgcctcaaagcatatcttccaacaaattctgagttttttttacgttgcatttctatcctaaaactttccttttgttatttctcccatcctgttgcgtatgtaaatctcacttccgcgtacattttaaaaacatttcaattgtgaatgcacgaaatcaatttcataaaaaagataaccatgg

SEQ ID NO: 28915 - DNA, 657 bp, Triticum aestivum
  Clone ID: PAT_TA_28915
ccggtgccggcccgcgtgttcccccccctctccgccccggcctcctcgcccgagatgatcttcaaacccggcggcggagctggcttcgacctgacggtgctagacacggcgtgctgcggcggcgcgggcaagcgcaactcctccgccaagctctgccacggccccgacaactgtatcttctgggacacctaccatccgacgaaagccgcgtcgggtctggccgcggtggcgcgcttcagcgaccccggcaggtacgtccaccccatcaacgtggaggcgctggcggagttgtagggtggaggaccgtgagcgatctggccgtgtgtgcttagacagtttttatcgaacccaaaacttaagttccaaatagccgcctcagagcatatcttccaaacaccttatgagtttctttagggtgcagttcttatcgtgccccagaacttattttccttaaactttcctttttgtatctctctcgtcctgaggacgtgggcatagcccagtggttgggggcgcatgattgtaaacccaacgaccagagttcgatccacgtcggggacgaatttctggaattctcatgagggatgcttcttctatatcaataaaaccgtgggtgctagtgcccatggagcttctgtcttaaaaaaaaaaaaaaaa

SEQ ID NO: 28916 - DNA, 502 bp, Triticum aestivum
  Clone ID: PAT_TA_28916
tccgcccacgcgtccgggctcaggaaggctttggttgacagagatatgtaggtcaatcagaagaagaagaagaggaagaagtgctgatggaggatgaatatgtgtcggtgatggatcccatcctgctttccatcattcaacatccagcacgatgcatcttttgtacacattcaacttgttttgatgccaacgtcttttttaaatttcaagtgacttcaatgaactggcagtgtcctatttgctgtgtcaagataagaggtattcaggacctttatattgactatcaaaccaaagtggcattaaacaaatatccaaaccaagatagactattaaaacaaaaagacaatacctacacaaccaccagttggattgaatcaaacaatggaaccaaacgtatgcatgagataatcaccattcaagacgaagggtcaaaaaggttgaaacaaatctaaaaatagcatgtgattgtataaaaaattccaatttttcttttttctttaaa

SEQ ID NO: 28917 - DNA, 480 bp, Triticum aestivum
  Clone ID: PAT_TA_28917
tctattctactcgatcattgtttgacaccctaagagagcaacaaaggcaggcaaacgatgggtgcactgttatcgaagcatggaaacaacacggtgctccatatcgttggttatttggctattcagatgaaaatgactatttctcgttgatctcaaagcaattagcaaacaaagtagaagagtataaacaatgcatttgggagattgaaagaatagtggattcatggatcaagaacaaggttcaatcgcctcaagatattgcacgcattatacatgctcagaatctaactttacttaacttgggcaacaaagtagcatatttacatgaatatgtccaacaagagaaagaacattatcaacgttcagtttttccactaatgacagaagcttaaataatcaaatatcatttatgaaatctatagtaaaataaacattgtacacgtatgcataaacttatcagagctgcgattttattccatt

SEQ ID NO: 28918 - DNA, 1225 bp, Triticum aestivum
  unsure (1)..(1225): unsure at all n locations
  Clone ID: PAT_TA_28918
gcaggnaattcggcacgaggcgatcgcgccccttgctccgcactgcacgatcgcgtccccttctcggcggcggaaggcgaacgagcgaggaaccctaaccctaaccacttccgatccgcaaggcctgcgacgatggcggcttccctccgcgcagcagcgacgaggaccctgcgtccggcggtgcttccaggcggggggcttcgccggctcctccacacccaccagcgttacgaacccccccggggatacctttcgtcgcaaatccagcagaagaaagaggagctgtacgatctcattgccctcgccaaagccaattctgcggcttcccgggtggacaaacttctgttcaggtctctctgtaaccaagtcgagccgagaccacatgaccctcaatggcgccacataaaaagggttgataagatctgcagttggattatgccgacatttgtttttgttaatattggggccactctctgtgccattgctggccgtgctggaacagacggaaatctttataccactgagggtgtgcgcaggccagtcgagctcagcagcctgcgtgacggtgtgcgcaggccagtcgtgctccggcgtgagggtgtgcagaagccaaaggactaaggcgggaaacctgacttgagggtgtggtcaagcaagtggagcagcccagaaggaaaaagaaaaagtgcatcttgtttgacggagggagtataagttggtggatatatggtctatgatctgccacctagaacttgagcagtaggattactagatgatgattcgtaacagcatcgtgatatatttgtgatgttgctgcatgaaaatgagtatgcaacttgagagtagttttattactggatgatctgtgattccgctgtaacatatttctggtatgttattccttccgtttgagcgagcgagcacgcacgcacgcaccaattagcatattattagaagacacaagcaggttagctttagaataaagcatttgtttattctgtactccctccgttccaagtcatctattttggaatggagggagtacaactttggatcctgtgatataccccatccgtctgaaaaaacttgtccctcaaatgggtgtatttagcactaatttgatgttagataccttcatttgagggacaagcttttgcggaaggagggagtttataaggaactagcatgtgttgaataaaaatcacaagattggtttgtgtgtatc

SEQ ID NO: 28919 - DNA, 431 bp, Triticum aestivum
  Clone ID: PAT_TA_28919
gtcgactgcccggatgccgaagccttagcggccttcaagcacagtgtctgagatgaatggctcgccaaacacctcggccaggaaaagccgaggacaatggcagccttaacaagcctcatgacccgcttttgcgcgggcgaggatagttggctagcccatagcggcaccagtgacccaggaacatccgaagtcagagatggcaacggaaatccgtgacgcaataaaaacaagcgtcgaaacaatgaaaacagcccagataacacgacagtcagtgccggattcaggggctctcgacccggtcaacggaagaagccatttaaaggcagtagagatggaccgtccagcctgaataagattctagacaagttatgtcagattcatggcaccccccgaaaaacctgcaaatcacacccatagtgagtgctgggttt

SEQ ID NO: 28920 - DNA, 404 bp, Triticum aestivum
  Clone ID: PAT_TA_28920
acggcacggagtgctatgtccggatcactggtgatagtgataattctgttgtgcccgggcattttgagcttcatataccgtaatggggtacggcttggaagcatgtgaatgtgtctcaccccagcaaaccatgataccctctgttgagtgatgacacatggaagagaaactcttcggacctatagttctccggcgtgctgaataccacgtcgagtttgatttttcccgagcatctggcttcccgactagggataatactgtgaaaggttgtgttactttggtcaatgcgactcatgtccatttgcattctattgagtgtgtcctcatagatgaggttcagtccgctatgctaccgccgtccgtgacaactttagtgagccaaaacccgtctttgggtttaggac

SEQ ID NO: 28921 - DNA, 766 bp, Triticum aestivum
  Clone ID: PAT_TA_28921
gccctaatgtcgtcatagcagcaggaaagattgtgcgtttcatgaacgacattgcagcatatgaggtatgtagtatttgaaaatgtaactaattaagactcacatgtacaacgaaatcaaagtttcactcgcatttaaacaagtaaaattcagtaatattagagaaaaagtcatactaccatattgttgtacaaaattgtattttcgttatgacaattttgtgtccatgcagttatttttatcggttcaattatcagtcaaatttacttaatatgtgttgtggatggcatgtaattctgtataaaagaacttaaatagctcttctactaccaattggaatgcctactctaaacattctttatatatatatatatagaaccgaaagtgcaagggggatgcggcaagctccgtggagtgttacatccatgagtatggcgtcacaggcgaggttgccatcgcaaggatatatgaactgattgaagatgaatggagaactctaaacaaagctcgctttgaaaaccatgcattgctccccgcgctgaagcgtattatcggcttggcccttagcacatcattgttctatgataacaggaacgatgtgtacacagacagcaagcatcttcacaaaactattaagagcctcttcgtaaagcctgttttgtctggctagctagccacaacagatgaataataaattttcttatatattttgggtgtattttatacttcatacatatataagtttaatcgaaagaaaactttcaac

SEQ ID NO: 28922 - DNA, 545 bp, Triticum aestivum
  Clone ID: PAT_TA_28922
agccgcggcggcgaccccactgtggttcaggatcccgagactcccgatgacctggacaaccaatactatgacaacgtgcagaaacgcaaggtgctgttcaagtcagacgccacgctcctgtcatctcagaccacattgagattggtggacaaccacgccaaggacccgcaggagtggttgaaacaatttaaggcggctatggtgaaaatgggcagcatcgaggtgaagaccgaggccaacgggcagatcagaaagcactgccggtttgtcaattaaccagctcacgaacggctgatcagaatatggcgtgcctcgtcttgagttctggactcctcacaacggagagtaatcagaataagctcgtgcttttgtgtgtgctagctaagtcaccggtgctgttttttccctacgaaagtgtgtttcattggttcattctttgcactacatctgtattgaattttttggtgtactttattacgaaaagatgagattgtcaaagtatcctcagtttgcttaaatgggaattttagcactatggtgcaggg

SEQ ID NO: 28923 - DNA, 369 bp, Triticum aestivum
  Clone ID: PAT_TA_28923
cggacgcgtgggtgcattcaattcggatagtactattcttgtctctggaagtgcagatagaacaatgcgtacatgggatgtcaataagaatacacctaatgaatttagagaggagtcatcatcagattttaagaggacaaaattaaatggaaaaggaaaagacaagaaagaaaagatgaaaccattgttaatggacttgaagagaaataaaaagaattcattagaaagtgatgatcatttgtctgtatttccaaccaaaaacacgcctatttacactgtacaatttacccagcgtaatttgtgtttagcagcaggtgcgaaatcatctgtttcactgagtttataaatcaataaattaatagtacaatt

SEQ ID NO: 28924 - DNA, 877 bp, Triticum aestivum
  Clone ID: PAT_TA_28924
atgcccttcatcctcagccccctcgcttccgccgccgccaccacgcctcgccggacacctccgccttcgccccaacttgaactggccgcagtaacccacctctggcaccccatcgctacccccccccccccccctctctccagaaagaaagatcacatccatcacatctgtttcccagctcgatcccctttgcctggtcaacgttcgatgctggagctggcgatgaagcatggaggagcagaggagcaccggcgttgatgcactgctccatcgtctcgccggggccgtcgtattccctgctgcctccctgactcaccgttcgcgagcaccccgcggccttcggcgcgcttaggccgtcatctccctgcgtgtgtggcgtcgtccatgccgacatctcccttcggcgcatggcgtcccgggggccggcgtctacctccctcgtgtggctcaccgtggctgcatcaatctatatctacgcaaggcagccatcttcaatctgacgtgcgtgacggcgtcctggtcgccatcgatctcctgctcgttggctaggcatcggagcctgcaagctgtggcaacctcccagtgcatggatgcatcgaccttgagtagtggctgtcgctgccatcccgttcatggcagactctttttcctctcgtgtgtgtgtgtgtttctttctctcatggtgtgtgtggattgacgtttactagttggctcatgtcaggtggatggatctgagtgctagcttcgtgtgtgtcgtgtgcatatggatctgaatgctagtcacatagtgttgaattcatgtcccttgctgtgtgtatgtatggagatcaaatcgatatatacaaaattgattctagttggaaaaaaaaaggggggg

SEQ ID NO: 28925 - DNA, 740 bp, Triticum aestivum
  Clone ID: PAT_TA_28925
acaagatccttttttaatagttaaaagtcaagtggaagataatctgtcgaatgcaaccaacttgtttgagtcttggaaaagaattcaacaaacagtgtcttcacccaagaaccaggaacttttatggacagctgatgaactcaattcaactttggaagccatagaacaagatttggacgatcttcatgaagccctgcacatttcacaagccaatccttctcagtttaacttgaccagtaacgatttgaattcaagaagacagtttttagataaatctcgcaatttgattcaatccatacgttataccttggctaatccgccagcaaaaagcaaattatctaataatcaatctatagagacagtgagacaaaatgagaatagtcggtttattgaaagtgaacaaatgcaacaatcgttcgtcatacaagaacaagaccaacacttggacgcgatgggtggcacattgattaatttgaaagaaatagctggtacaatgaatagagaaatagacgatcatgtcattatattggatgatctgggtgaaagggtagatagatctgaaggaagattaaatactgctatgagaagagtgacagatatattaagaaaggaagaagaatcaaaatcaggttattgtatttgttgtcttattatcattttaattatattattggtacttgtaatcattatgtgatctgacttacaagtctcttttcgaaataaatataggttgatttaat

SEQ ID NO: 28926 - DNA, 907 bp, Triticum aestivum
  Clone ID: PAT_TA_28926
ttttaatgaaggcagaatattgtgtagattatttatcttataaatggaagacagatgatttgatagaaacatatcgagaaactcgtaaacattcaattgttaacaaattaaaacaagataaacatgaagaatacaagttaaaaagattacaaaatgctctttggagagaaatggcaaggaattgtacatcaaatctaagtcaatcaaacctcttgatcgatccttctttgatgagttggcaaaaagagtctgatatcacatggctttacggtccaatttatacaaatacaaaaacacaagtttatgtacccacttctcatctcgaaggtgtaaagcctgttttaaaaagacagaatacatccatcgtacaacattcaccactaccgacttattccgatgatctattcatggttgattatcattcaagtaataacacaacactcgtctcatcaagaaataatagctttagtagcatgagtacaacaacaacaacaacaacaacaacaacaaatcaaaaagcggtttattttaatccagagattattgaaattgaatatcaacccgaatatcctgttaccccaacttcatttcctttaatggaagaacatgaagacattgtatggttacctttattagaatacgtaaagaataacatttcaactcttcaattatttattttattatttaaatcattcatctcattcactactgattatatcgttgggtcatcaaaaaaaaaaaagaaaatagtgtaaagtgtaacagatcatgaaacaagtttgttttataaacaagttgataacaaacatcattttattcaatgtattctatacaaataaatcactctaaatcctatctaaagtcgcaggatggcgaaaaagataaagtttataacgtgctatgctac

SEQ ID NO: 28927 - DNA, 943 bp, Triticum aestivum
  unsure (1)..(943): unsure at all n locations
  Clone ID: PAT_TA_28927
cggacgcgtgggtttatgagattccttttttattttttacttttcttgtcgacattgcaacaatgctttggaacaattacaatacttgaaaccaacgataccctagtagatcgtttagcagcatttggtcctagaatcgatcaaattattactggctatttatcagcaccatcaaatgatatgtatgggtgctctgctgtgaaaaatattactcaaaaaaattggatcgcagtcttagaaagaggtcagtgctcatttttacaaaaggtacaagcgatgcaagaaagtggggcgattgctgttgttgtaggagataggcattttaatggatgggtgacaatgtatgcaccaggtgatacttanaatattcatattccaagtgtattcgtagcacaatatcaatacaagtcattattaaatttattagtgcaaaagaataattctcttttaattgaaatcacaggtgatgatctattggcttggccgctgttagacatgttactaattgtcgtcttatcacctgctgttatgatgctctttatttacttaacttggcaattacgacaacgtcagcacaaacagaatgatatggcacccagtcaattcgttgccaagttacctacttacatttttagaagagagaaggtgatcgatacagatcatatggattgtgctatttgtctagaggactattcagacggtgaacagctaagggttttaccttgtaaacatgaattccatgctaaatgtgttgatgcatggctcacatcacacaaaaaatactgccctatttgtaaatttgatacttgtcaaaaaccaaatgataaatcaagacctaatgagcgtacaccacttttgagtgcgtaacgaacgatacccccatctctctttctttttctctgtcacgcacatactttatcacaaataaatgatattgaggtgt

SEQ ID NO: 28928 - DNA, 104 bp, Triticum aestivum
  Clone ID: PAT_TA_28928
ttccatgatacatcagatcatttacagtcagaagtagtgctaattatatggcaaattctggttcaaattcaagtgagccaaaggcttctaccattttgtgtgtg

SEQ ID NO: 28929 - DNA, 694 bp, Triticum aestivum
  Clone ID: PAT_TA_28929
gaagattcatgctcaaaagctccgcccctgctaccaaaggaacagccggcgtgctcttcaggccgtcaggcggaggcgttgtcatccacgctatgaacgttagcgttgcagctgtacctagcttcagcagagagaacctccatagcttcttcaacaatcaacgccagctaacaaccatagccaccagctacagctccaggcaacgagagagacgaagggaagttcaaaaaaaaaaagagagagacgaagggtagcaacttaacaagcacctgccagttcggttcatggcagccccggagggtacgtagttccatcaggcgatgcacaggctgatgcatacttctaccctgtgcgagctgccaagaaggtgtctcacacttctgctataaccatagatattagtagcaagaacaagagtggcccttggaaatctcccccgccttcaccaattgacattaagatgtgatgaaggggattgtgaacatatgtaaatatattatactaaaatgtgacttgagctctgtcggttttaagggccggttttttgaccataatttattgtaaccccttagactaagacgtgtcttgagatctgtcggttttgggggaaaccatacttaacatactttatcataaataaatgtggggccccgttaattcccagtttttttttcattgggtataatattgtaac

SEQ ID NO: 28930 - DNA, 708 bp, Triticum aestivum
  Clone ID: PAT_TA_28930
atcatcgaagaacaactccaatctcttcaacaagaggccagtgaagttattggaaaaagtacaagtttatcagcgtaaagtaatgactcctgtttgggaaaagcgtcgcgaaatgattaaaaaaattcctggattttggggtactgctatcggtaaccacagtgtatttggtgctgctccttctgaagaggatgttgaggctttggaaaatttaactgatttccatgttgaattcgatgaagcaaaccctaattatcgcaaagtgattgcctcttttaagaagaataatgttttcaagaatgaaactttaactaaagaatacgtttgcaatgctgacgatgaaagttctgttatctcaaaatctactattgattatattgaaaagaagaacaataagcgtaaggctgaagataatgaaaatgacgaacctacaacttactccttccttgattggtttggtgatgatagcatcgatgcaggtgtcgtactcactgatcatattttccctgatgccgttgatttctacaagggaattgatgaagatgattctgatgatgaggatttagaacgtgaaattgaacttgtttcagaagatgaagaggatgatgaagaggacgaagaggaagaaaagcccaaggctaagaagtccagaaaataagcaatcttttgtaattataaataaacttcttttctaatatatttccaatc

SEQ ID NO: 28931 - DNA, 2029 bp, Triticum aestivum
  Clone ID: PAT_TA_28931
ccctccctaacaaacaaacctccgttcctgttctaagacacgagcccccgttcccccttccagatccctcctctcctcctcaccacccctccccgcgctctcgctaaatcctggccacccctcgtccgcccccagctcaagcccccccaccgatggcccgcccaggcctcgcggacccaacgccggcggaaccccgcggtatgcaggacgcccgccaagaagctgccgacgtccgcctgcgcgccccccctgaggttcaggcgcacgcggcagctctccgcctccggacctccatctccggggccgcctgcgcagggaagtcccgcgcatcaccctcgccggccaggacgccacggtcccgttcatgcactaccagccgcggcccgggcggccgctcctccgccgcttcttcgccgtccgactcagcgaccacactgtcgccccccgcctcccccgactgccgccgcctgttcgggcagctctcctcccgctggcctcttcgagcggcgtcggccacacctccaagttcctgctcgtcgcatcgtcggtgctcttctgcatcgccctctactgcgtcctcgcctgctccagcaccggggccaacatgtttgccgggggcctcattggcttcatctggatccagtcgggctggattggccatgactccggccaccagcaaacccccaggcatcctgcccacaacggcctgctgcaggtggttttgcgtgaccgccgcacggaaccctgcgctgcctgatggtaccgccacatcatcagaggcaaatttaatgacatcgaacacgccaagggctgcagcattgcaggctaggcaagccactactggacctcctccaaagaatccggtctggggagctttgaccactagcgcatgacggggttcgaggactggaccaagatcttcttcaacgcgtcgagccttgcgtgcaagcagttattggattttgtctcgatagcgtagatattttgatccttctagctcttgaaatcgtattggatgttgcgtgttgccaggttacaatttttggagttcactcgtgtgttcatgcttcagctgtggacggtgacaccacatttggattggtgggttcgcgttgccatggtaactgcatgattcgtcctggtggtccctcaccagctgcattgctgggcgatacatccttttctgcttgcttgctttgtgatcacacggtatactgaatgggttgttcggcctgaaccactcctcctccgccgcgagtgttccccgtggatggggtagttccaggttggactgcaaaaccaggtggaacattatttgtttcctcgcctgcctcgctgccactatagaatggtcgcaccaattgtgcgtgacctttgcaagaagcacgggctgtcttatggtgctgccacattctgggaggcaaatgtaatgacatggaagacgctacgggctgcagcattgcaggccagggaagccactactggggctgctccgaagaatttggtctgggaagctttgaacactcatggatgactggggatcaggactggagtatgagacaattgctagcgtcgagccttgcgtgcatgcagttatctgattgcttctcgattgcgtagagatattgatccttttagctgttggaatcgtgttggatttttcgtgttgccaggtgactatctttgcagttcaattgtggattcatgcttcagttgtgtacttgtacaccatatttagattgttgggttctccctatcatggtaactacatcaatagtacttgatttatatcattgaatcccgtggcttatctttacatccatttcattttgcttgcaagttcatgaaactgtaaactcaattgatggtttgtagcgtgtatatcccctgctgctatggcagcttgaactgcattttgggaacatgacgattccaataataaacgtttagacattttctgctgcatgtgtatgcccttcatggtttaatatatatttttcattcactgaagtgtcaaaaaaaaaaaaaa

SEQ ID NO: 28932 - DNA, 696 bp, Triticum aestivum
  Clone ID: PAT_TA_28932
aacaaagtcaatcaaaaatgggtcgtcgtcctgcacgttgttatcgttactgtaagaacaagccttaccccaagtccagatactgtcgtggtgtccccgatgccaagttgagaatctacgatttgggtcgtaagaaggcatccgttgacgatttccctctctgtattcacttggtctccaacgaatacgaacaactctctgccgaagctcttgaagccggtcgtatctgtgccaacaagtacatggccaagacctctggtaaggattctttccacatgcgtattcgtgtccacccctaccacgtcactcgtatcaacaagatgttgtcttgtgctggtgccgatagattgcaaactggtatgcgtggtgctttcggtaagcctaacggtttggtcgctcgtgtcaacattggtcaaatcattttctctgttcgttccaaggactccaacaaggctgttgttattgaagccttgagacgttgcaagtacaagttccctggtcaacaaaagatcattatctccaagaagtggggtttcactcctttggaccgtgctgactatgtcgaagctcgttccaaaggtctcgtcaagcccgatggttgttatgttaaatttgttcctcaaaagggtagccttgccaactactttaaggaagctgttaaggcttaaatataatgaaataaaatcatgtcttcat

SEQ ID NO: 28933 - DNA, 460 bp, Triticum aestivum
  Clone ID: PAT_TA_28933
tagccgtcctaaattctagggtccacggggtctcactggtccatatctctttctttagcaacattgaaatcctcttgaacctttagggaatgccgctgcagtctactaaagaaatcaaacagacccaactgctcaactacaaatttcttaggattaatctgtcgcacacatgcacctcataccgaggttaaataattcaaaatgattgacgaagctaaaatctaaagacaacttaagattactgaaaactgcccaaaacaataatatgactgaattgttagatggaaccaaaaaggaaattgtatttatcaagtttattaatctgcatgaactaagacagtctccgatattcaagaatgtagtggctcttgatttttaatcagagataacaaatgaccagatgcgtacaatagagggaaggagaagatactcacgtgtgtagcgcgcttgaatttgctgc

SEQ ID NO: 28934 - DNA, 941 bp, Triticum aestivum
  Clone ID: PAT_TA_28934
cccacgcgtccggaaagcagtcgtaacaggagcatccggtttattgggtagacaagttgttaaagcatttgaaaatgctaattgtgaagtggtcggcacagctttttcacgggcaagtggcaacttagttaagctgaatcttactgaagttgaagctgtgaagagtttcattgatgagcaacaacctgatgtccttgttcactgtgctgctgaacgtcgccctgatgtcgcagagaaagaccaatctggagtattacgtttgaacgtggaaacaccaagaaacctggcatccatctgtaagtcaaaaggagtcatgcttatttacatcagcaccgattatgtgttcgatggtacctcacctccttatgaagttgatgataagcccaaccctcttcaattctatggtcagactaaattggatggagaaaatgttattagagaagtgtaccctgacgcagttatccttcgtgtgcccattctttacggtgctactgaatacaatggtgaatcggcagtgaatgttttaattgataccgttctttctaaaaaagtttccaaggttgataatgtagctcaaagatatcctacgaatgtggctgatgtggctcgagtgcttaaggatctagctgtcaaaaagattaaaaataagcaagacattcgtggtatttatcatttctctgctaaagaaagtatgacaaaatatcaaatgtgtgaaacatttgctagcattttgaacgttcctatggaccatcttactcctcaaaatacggttgatccttcagcatcagtttcgagacccgataactcccacttatcagtcaaacgtcttgaagaagctggaattgatactcattttgtaaagtttgctacatggtttgatggtcaattgaagttatctgcataaaaaacataaagcatttttgactcttaaagctacaacg

SEQ ID NO: 28935 - DNA, 647 bp, Triticum aestivum
  Clone ID: PAT_TA_28935
tctcccacgcgtccgcccacgcgtccggtgcaaggcatattcaaaagtgatgagcgaaatgtctgaaaaagaagaattattatttttaaatgaaattcatgaattattagcttattgttatgcagcaaaagatgtattaaaagcaagggatcaaaagcaacttgattttgaagaattgtcgcggtatttggatcaagcagctttagaaaaagaacgaattttacatcccaaatttaatgatcgagctaatatcgcagaatatgtaacagacaagataaatgaagtaagaggaataagtatgcaacaagcaagacgagaaaaactttcaaggttggaaaccaaaattaaagagcttcaagaggaagtgacacaagcgaatgatgaatcaaacaagttttcaagccaagtggtaaaagaatttggcttgtttcaaaagacaaaaataatggaattaaagcaaggattactggcttacgctgattgccatattgcctttcatgaaaagggaatgtctatttgggaaaaaatactgcctgttctagaaaacatggatagtgttagaggtgatggtgaggctactgtgtaaaaacctactctattttttttttttcgaaatgaataaacttgtacatacattttgattggac

SEQ ID NO: 28936 - DNA, 719 bp, Triticum aestivum
  Clone ID: PAT_TA_28936
gccgcaaaaccggaaccccgcagccgcgatcgccggcaccttcctcgttcgttcccggcgacgctgctgtcgagccgcgatcgccggactttcctcgttcgttcgcgccgacgctgctgcagatcaatcccacgccgcgcgagaggccgaggagatgtcgacgccgggcggggaggaggacaagaagccggcgagcgcaggcggcgaaggcggcggcgcccacatcaacctcaaggtcaagggccaggatggcaatgaggtgttctttcgcatcaagagatctacccagctgaagaagctgatgaatgcctactgcgaccgccagtctgttgatatgaaagctatcgcgttcctgtttgacggccgcaggctccgagccgagcagacccctgatgagctcgagatggaagatggcgacgagatcgacgccatgcttcaccagaccggaggccgcctccctccaagcgcctagaagaagccgttgaaagtcttgctccttgttggtctacctgatccatcattagagagcacatgaatgaatgaaagtctaaaaagaacttgtgaggctctggccccatgccatagctgaaggacattaggggagcttttgtttagtgccgtttgggtactttggcctgtcatgactcgtttatccaacccttaatatatccacctatccagtacaaaaaaaaaaataaaaacaaaaaaaaaaaaaaaaa

SEQ ID NO: 28937 - DNA, 621 bp, Triticum aestivum
  Clone ID: PAT_TA_28937
ctccgctccctcgtctccccgctcaggaagctctggtgcaacatcaacaccgtgccaaggaagaagagagggatctacatcctgtacgacgacgtcaagtcgtgccagtgcgaggacgtgcacgtgctctggtccatcctcgtcgagtcccacggcctgccgccgcccacgccgccggtgctccggctcacgcggtgaccggaacgcgtcggacggcggctggctggcatcggcgcggcgctcccccggaataaggaacggccggcgcggtgtcgccgtggctccatgggaggtgaaccagtaacagtatagtagtagtagcatatgatgattctgatgtaaagagcacataggagttgttgtttacagttcatctggccttcgtccagcgcctcttttggagctgctgctgggacgagagagcgaggctgctgctgcgtttgcggcttcttgacgagtgtggtgatgggcttcttcgagcgcacccctcttttgagttttgattgattcaggcgtcgttttctgtcgagagtcgagactgcacttggatgcagctctttaattcatccccattaccagggactgcaccgggaggcagctcctgcattcatccccaataaa

SEQ ID NO: 28938 - DNA, 785 bp, Triticum aestivum
  unsure (1)..(785): unsure at all n locations
  Clone ID: PAT_TA_28938
ccccgtccccccccccctccgccccccccgccgcctagcccccgcaccccccccccccccccccccccccccggggacacgtgggctccgacgagcagcagccaccacggagcgacgcttcggcgggaagattgtaggacgggagtccaagcatctagcagcttgttagctacaaaatgaacaaggggaagattttcaagttggcaaagggatttagaggaagggcaaaaaattgcataaggatagcgcgggagagggttgagaaagccttgcaatattcctacagggacaggcgtaacaagaagagagacatgcggtccctatggattgagcgcatcaatgctggtacacgactgcatggggtgaattatggcaacttcatgcatggattgatgaaggagaacatccaactgaacaggaaggtgctctcagagctgtcaatgcacgagccatacagcttcaaggcacttgttgatgtatctagcactgcatttccggggaacaggccacctgcccaaaaggaaggtctagcagctattctgtgaaacagcttgtccaataaatcactgctgtcatgacggtcttccgttttcccttcgttgcaactgaaagttattaccagtccgccaatatcttgtatccgggaggtgactcatgtaatctcttctcgccattccctgtggtattctctttagcaggaacaccttttcattgaattattgctcatttggcccctttctgtnggtcttatagagagaggtctctgtgttacaagttaccaatgt

SEQ ID NO: 28939 - DNA, 438 bp, Triticum aestivum
  Clone ID: PAT_TA_28939
gtcgacgggttatcttggagtattaccatcttttatgtcaaggatgttgtgaggactgctccacctcttaaagaattcttggtattgtgatacttctcaccctcaccattctttcttggtccgcgtgttgattctaaccgggataccaacacgtgaaccatgctgcttggattctgtacttctagcaaccctattgctttgaagttaatggtcaacatttcatccttagaccattggttattgaatcaccattctaacattgatcctgctacctaagcccatatttcgggtgcacctttcaaccagtgattaattgtgtatgtttccctcgagtatacatcattatatcatttgatctgttaaatgttatctccttgttcacataattgtggaaatccacctttttgtaaatctcaatgaattgtcactgagcccatc

SEQ ID NO: 28940 - DNA, 754 bp, Triticum aestivum
  unsure (1)..(754): unsure at all n locations
  Clone ID: PAT_TA_28940
cgggtncgacccacgccgtcctcccacgccgtccgcttggctagttttagattagaagaaaacttgaatataactcaaaatcaattctctttggatgaatcacgtctttatgaagaatcaagtaaagaagatgagacgaaaagtttattatattcagtgggtgatgatttattgagtgaagatgaagaaaataaagaaatgagaggagatgaagaagaggatgatataatttataaaagtgaagatagtatagaggatgatgactctgattgggaaaaaccaagaaagatgaatcataaaagacaatcctttgcttcttttacaaataacaagactaaatctagaaaatcatcttttctatctcaaaaggacgatatcaaatgttatcactgtcagacaacaaacacaccactctggagacgaagccctgaaggcgcggtactttgtaatgcatgtggtctctttttaaaacttcatggagttgttcgacctctgagcttaaaatctgatgtcatcaaaaagagaaatagaagtggtaaacgccaaaagacaagaaagcaaaagaaacaaaggatttgattgtttatgaattaaacaagaagagactcttattttttcaacaaagaaaaggtctagagttgtccaaaataaaattaaaaaaaaaaaaaaaatagagtttatctttttttttttttattattttttcctaaaaaaaaaaaaataaaaataaataaaaatgctggttatcattttt

SEQ ID NO: 28941 - DNA, 884 bp, Triticum aestivum
  Clone ID: PAT_TA_28941
tcttgtttccccgcccgcccacgcggccccccacccgtccccaaactcatgcactcatttcacggccacagcattgcatctgcagtctgttgctgcagttttagaagcaaatcttgaagccgggtctagattgtacagagattgtcgattgcggaacatctttatgatgaacaatatctgctacatggtccagaaagtgaagaactcggatctcaagagctttcttggcgacgactggatccggctgcacaaccggatgtttcagcatcaggcgaccaactacgagagggcgtcgtggagtcaggtgctctcttacctgagtgatgatggcctatgtgccgccggaggtgccgcttctcgtaaaatcatcagggagaagttcaaaaacttcaacctgtcctttgaagatgtttatcgagttcagactgcatggtctgtccctgatgaccaactccgcgaagatgtcaggatttccatatcactgaaagtcatacaggcttacaggacatttgtgggaagatactctgccttccttgatggcaccaagcagagagatcgctacataaagtacaggcctgaggatctggaggaacttttgctggatctgtttgaaggaactcaaaagtcattgcagcattctggccgagcttgaagctgaaagcacagttcttcttcgagggataacgcggtggttgtaattttgctttgtaccaattaaaagaattttattgcttgttttgttgtattgatgtccatgctcaaaagaatatatttttggatgccttgtgtttgcagaagtgtatcagttccttcatggcagcaatggtgcataaagtgcttcatgtactatatatgtaaccgaagtacagatgatgcttagatgt

SEQ ID NO: 28942 - DNA, 555 bp, Triticum aestivum
  Clone ID: PAT_TA_28942
agcggcaccatcagcccggcgtaccaggggcggccggaggcggtgtgcccggcgaacacgagccagttcaccaacgtgacgacggagatcgacctgagcacgccggtggtgctggacaacaactactacaagctggtgcagctcaacctgggcctgcacttctccgacgaccagctcatccgcaacgccaccctcaaggccttcgtcgacgccttcgccgccaacgagacgctgtggaaggacaagttcctcgccgccatgatcaagatgggcaacatcagccccaagaccggcacgcagggggagatccgcctcaactgcagcctcgtcaacccggcctcctcttcttcgtccgcctacgctggggtgatcgagatgctccgccgacagggctccgacgataaggtcgccaagggctgatgtatgcgtccttgaatgcgaatgcacgggcgtgctggccggtcggtgtccgttcgcacgtatactagacttgtgatgaatgatgaataataaacgctgtcgtgctctgaaaaaaaaaaaaaaaaaaggccccta

SEQ ID NO: 28943 - DNA, 714 bp, Triticum aestivum
  unsure (1)..(714): unsure at all n locations
  Clone ID: PAT_TA_28943
ctcccacaccctgggccgctcccactgcaactccttcatcgtgaggaaccgggagcggctggcgagcggcaccatcggccccggccgccaggcgctgctggaggcgctgtgcccggcgaacacgagccagttcaccaacgtgacgacggagatcgacctgagcacgccggtggtgctggacaacaactactacaagctggtgcagctcaacctgggcctgcacttctccgacgaccagctcatccgcaacgccaccctcaagggcttcgtcgacaccttcgccgccaacgagacgctgtggaaggagaagttcatcgccgccatgatcaagatgggcaacatcgcccccaagaccggcacgcaaggggagatccgcctcaactgcagcatcgtcaacccgtcctccacctcttcgtccggttacgatggggcgatccagatgctccgccgcccgggctccgacgataaggtcgcctcgggctgatgtacagtatgtgcgcagagtaacgtgtgtggtgttggcacgtccttgctgcgtatgcgtatgcacgggcgtgctggccggtcggtgtccgttcgcacctacacttgtgatgaatgatgaagaataaacgatgtcgtgctctgnnnnnnnnnnnnnnnnnnnnnnnnnnnnnnnnnnnnnnnnnnnnnnnnnnnnnnnnnnnngaannnaaaaaaaaaaaaaggccccta

SEQ ID NO: 28944 - DNA, 1347 bp, Triticum aestivum
  Clone ID: PAT_TA_28944
cccacgcgtccgcccacgcgtccgcaccacgcgtccggtgcagtcgacgctcactgtgccgtccttgtgagggtgagcaagcagcagtaccagctacgctagctagctaggagtacagcgtgcggcggccatggcgagcagcagcagcagcctggccggtctgctgctcaccgccgtgctgtgcctgcagctgccggtccacagccgcgcgcagctgcgcgtggggttctacaacaccacctgccccaacgccgaggccatcgtccggcaggccgtcacggccgccttcgccaccaactccggcgtcgccgccggcctcatccgcctccactttccacgactgcttcgtcgagggctgtgattcctcggtgcctccgtgtcccgtcaaccccggcggcaggcacgccggagcgtgacgccgcgccgaacaacccgagcctgcgtggctttgcgctcgtcgacgccgccagggccgcactggagcagagctgcccgcgcacggtgtcatgcgccgacatcctggccttcgccgcccgggacagcgtgaacatcaccggcagcaacgccttctaccaggtcccttccggccgccgcgacgggaacctctcgaccgaggccggcgcgttcaccctcccggggccgaacctgacggcggacggcctcgtcagcgggttccgggacaggggcctcaccgcggaggacatggtggtcctgtccggctcccacaccctgggccgctcccactgcaactccttcatcgtgaggaaccgggagcggctggcgagcggcacgatcagcccggcgtaccaggcgctgctggaggcgctgtgcccggcgaacacgagccagttcaccaacgtgacgacggagatcgacctgagcacgccggtggtgctggacaacaactactacaagctggtgcagctcaacctgggcctgcacttctccgacgaccagctcatccgcaacgccaccctcaagggcttcgtggacgccttcgccgccaacgagacgctgtggaaggagaagttcatcgccgccatgatcaagatgggcaacatcgcccccaagaccggcacgcagggggagatccgcctcaactgcagcatcgtcaacccgtcctcctcttcttcgtccggttacgcaggggtgatcgagatgctccgccgcccgggctccgacgataagctcgccatgggctgatgcgtagtgtgtacacagtgtgttgtgttggcacgtccttgaatgcgtgctggccggtcggtgtccggtcacgctagacattgttgatgaataataaaagctgtcgagctctgagttgccgagtaaaaaaacgaggaaaaaaaa

SEQ ID NO: 28945 - DNA, 765 bp, Triticum aestivum
  unsure (1)..(765): unsure at all n locations
  Clone ID: PAT_TA_28945
gcacgacacggcacaaagaaaaacttcgtgcaacagctcataaatggatcgccagagcttgcgagtcggtggcgccggcgacgcgcaggagttctgctacgtcgggagccggcagctcgaggtcgccggcggggcgttcctgatggaactgctggaggacacgccggcgcccgccgaccaggcaccggaggccgccgacgaccggctgaggcgcgtcatgcggtccctcgaggccgagctcggcgtcgcggcggtgccggcaccctctgcggcggaggacggcgggagcacggcggacgggccgatgagcgactacgacgacggggagctggaggagatgctgtcggagttgggcggtagcctgggggccgaggcgccgtcgttggccgccgtgctgccgttcgagtactgggaggaggtgccgccggtgatgggcagcggcatgggcggctggtacgtcgacggcgagggcttcgtggcagggtaccagttcagggaatcatcctactacacctatggtgaggtctccgccgttgagcaggtgtacagtccccccctgtgcctgtgggagtgagcgttgaaatatgcgcgtgcgaaaaagaggttgtgagctgaaacttatgaaagacaaattgagctgtgccttatatttttggaaaaaagaccctcacagctggcgaccagggacgaccttgagaaaaattttgatggttgtttcggtcgcggcacactntctggaaaagaaggctgttgagcttgattagc

SEQ ID NO: 28946 - DNA, 1257 bp, Triticum aestivum
  Clone ID: PAT_TA_28946
ggtaaatctactatgggtggtaacattctttatttaactggtatggttgacaagcgtacacttggaaaagtatgaaagagaagccaaggaagctggacgtgaatcatggtatctttcttgggctttggacacaaacactgaagaacgagccaagggtaaaactgtcgaaaccggtcgagcctactttgaaaccgacaagcgtcgttatactattttggatgcacctggccacaagaactttgttcctagtatgattcaaggtgcttctcaagctgatattggtgttttggttatttctgctcgtaagggtgaattcgaaacaggttttgaacgtggtggtcaaacccgtgaacacaccatgttggccaagacatcaggtatcaacaagttgattattgctgtcaacaagatggatgatcctactgtacagtgggataaggcaagatatgatgaaattctcagcaaattgaacctcttcttgaagcaaacgggttataatcccaagacagatgttcactttatgcccttgtcaggattcacaggtgcaaacattaaggatcgcgataccaagtcttgtccttggtatgacggaccttcactcttggagttcttggatgactacaagacaaatgatagaaagatcaatgctcctttgatgattcctatttctgaaaaatacaaggatatgggtactattgttgtaggcaagattgaatctggtcacgtcaagaagggttctcatgttttgatgatgcccaacaagcaatctgtggaaattaccgccatttataatgaaacagaagaagaaattgaacaagctgtttgtggtgacaatatcagattgagattgaagggtatcgaagaagatgaagtcagtcctggttttgttctttgcagcaaaaagaaccctgtacaaaccacgactgtgtttgaagctcaattggccattcttgaacacaagagcatcatctgtgccggttacactgccgtcttgcacgttcactctgcttctgaagaggtcactctctctgctcttttacatttgattgacaaaaagacaggcaagcgatccaagagacctcctcaatttgtcaagcaaggtcaaaaggccattgctcgtatcgaaacctctggacctatctgtgtcgagacctttgccaagttgcctcaattgggtcgtttcactttacgtgatgaaggcaagacggttgctatcggaaagatcaccaaagttttggatcccaacgctgtttaagt

SEQ ID NO: 28947 - DNA, 810 bp, Triticum aestivum
  Clone ID: PAT_TA_28947
gtggcggccgcttcgaaaggccggccgtccgtcgacgcccgcacatagcaaatctagctaattacccaccctctccctgcgagccctccaccacaactacagctaactcggtcgagatggctcgcactgcagcaacaaagctcgtgctggtcgccctggtggcggcaatgctcctggtagcctccgacgcggcgatctcctgcggtcaggtgaactctgccctggcctcctgcgtctcctacgcaaaaggcagcggggccagcccgcctggggcctgctgttccggagttaggagattggccggcttagcgcggagcaccgccgacaagcaagcggcatgcaggtgcatcaagagtgctgccggtgggctcaaccccggaaaggctgcaagtatcccctccaagtgcggcgtcagcatcccctactccatcagcgcatccgtggactgctctaagatccactgatcgattacttgccgccatcatcgccgattatagctccagcgatagatgccgagtacgttgaggtcacacacacacatatatatatatatatatatacacatatacatgaataaatgctctgatatgatctccatgtgagagacaggagtacgtacgtcgagccagctctgcatagccggccactgttgtatctattttgtatcagcgtttgattgttcgttcactccctttgagcagagacgggagtttgttgtactttgtaccatgtgcactcatggtattataaattaatctagctctattcagttaaaaaaaaaaaaaaaaaaaaaaaacgcgtcgttatttg

SEQ ID NO: 28948 - DNA, 1390 bp, Triticum aestivum
  Clone ID: PAT_TA_28948
cgctccgcccccacgcgtccgcccccctcccccgctttccctttcccctttcccctcccccttcccctccagcgcgcgcgagagagctgagctgagcttctcggttagctgagctgagctgctttggtggtgcgggagcggtcgagcggcgcgtagcgaggaggaggaggaggcggccgatcgatctggagctagcggtcccggacgcggcggccggcggcgacggcatggggcgtggccgggtcgagctcaagcggatcgagaacaagatcaaccgacaggtcaccttcgccaagcgccgcaacggcctgctcaagaaggcctacgagctctccgtcctctgcgatgccgaggtcgcgctcatcatcttctccaaccgcggcaagctctacgagttctgcagcggccagagcatgcccaaaacacttgagagataccagaaatgcagttatggtgggccagatacagcaatacaaaataaggagaatgagttagtgcagagcagtcgaaacgagtacctcaaactgaaagcacgagtggagaatttgcagagaacccaacgaaatttgcttggtgaagatctcgggtcactcggcatcaaagatctggagcagctcgaaaagcaacttgattcatccttaaggcacataagatccacaaggacacagcatatgcttgaccagctcactgatctccaaaggaaggaacaaatgctgtgtgaagcgaataagtgccttcgaagaaaactggaggagagcagccagcagatgcagggccaaatgtgggagcagcacgccgccaacttgctcggctacgaccagctgcgacagtccccgcatcagcagcaggcgccacaccacggcggcaacggcttctttcaccccctggacccaaccactgagcctacacttcagatagggtatactcaggagcagataaacaacgcatgcgtggcggcgtcgttcatgccgacatggctgccctgaagatcgacgatccaaccagctaataaatgtgcgacggtgcttgcacagccgtcgcattctacctacgtacctacgtatattccggggccgggagcgactactatcgcgttcgcgtacgtcccatagtttgttctgtgtctctgttgtgtccttgtgtgaaaaacttttgtgatcgataatgatcgacgtgtatgtcaagactgtctggtacaaagggctgtccgtgcgtcgccgttaccataggctggctagctgcagcataaaagacgtatagtgcagtgcctgtacgtttcataatttccagtgcagctacatgtagctgtatgcatgatgttgtgatattatcaactgagtgtgctatatataaatgcaaaatatgcaattgcattattgaagttcggtgc

SEQ ID NO: 28949 - DNA, 1428 bp, Triticum aestivum
  Clone ID: PAT_TA_28949
cgtccgcctttcccctttcccctccccctccagcgcgcgcgagagagctgggctgagcttctcggttggctgagctgagctgcgctgctttggtggtgtgggagcggtcgggcggcgcgtagccaggaggaggaggaggaggaggaggagggcgatcgatctggagctagcggtcccggacgcggcggccggcggcgactactcaaaatcataccagaaatgggagctataaaaaataggggagctatggttcatacaccaaagtggggagcccaatgacagaacgtccgcccatgctcttccacgcgtgggtatcttcctcccctcctctcccttcttgctacgagtagtacgcttggtggtggtggtggtgtgtgtatggttgctgcagcatagctcagggacggggaaggtggaggaagcagcggagtcagccatggggagggggagggtggagctgaagcggatcgagaacaagatcaaccgccaggtcaccttcgccaagcgcaggaacggcctgctcaagaaggcctacgagctctccgtgctgtgcgacgccgaggtcgcgctcatcgtcttctccaaccgcggcaagctctacgagttctgcagcacccagagcatgacgaagacactcgacaagtatcaaaaatgcagttatgcaggacctgaaactactgtgcagaaccgagaaaatgagcaactgaaaaacagccgcaatgagtacctgaaactaaaggcacgggttgataatttacagcgaacacaaaggaatttgcttggtgaagatcttgattcattaggcataaaagagctcgagagccttgagaagcaactcgattcatccttgaagcacattcgaacaacaaggacacaacatatggttgaccaattgacagaactccagagaagggaacaaatgttttcagaggcgaataaatgtcttcgaataaaattggaggagagcaaccaggttcatgggcagcagctctgggagcacaacaacaatgtactgggctatgaacgtcagccggaagtgcagccgccgatgcacggcggcaatggatttttccacccccttgatgctgctggtgaacccacacttcacatagggtaccctcctgagtccatgagtaactcatgcatgactactttcatgcccccgtggttgccttgattgaagacggcgaagaaagtgtgaaaaataagtatatacgtggcacccggccggccgcatatatgcatgtatactacttcgagtgatggattattccagtcaagatcctcagttattttgcgtgcaacttttgtgtgatgaaaacttcagaaccctgtatttgatgctcaacattattgtgttactgcgtgtaaaagatcatacattgtattactagagtggctatgcgtgataattttttccccttaaaa

SEQ ID NO: 28950 - DNA, 1325 bp, Triticum aestivum
  Clone ID: PAT_TA_28950
gccagtccggccttcccacccccgctaagcgagctaccccaccctctccccgtcccctaccccccgtccacgcaaatctagctatcccaccctctctccgtgagctagccccaccaccacaaatggtccacaactacagctaactcggtcgagatggctcgcactgcagctactaagctcgtgctggtcgccctggtggcggcaatgatcctcgcagcctccgacgcggccatcagctgcggccaggtgagctctgccttgagccccctgcgtcgcctatgcgaagggcagcgggaccagcccgtctggggcctgctgcagcggcgtcaggaaattggccggcttagcgcggagcaccgccgacaagcaagctacatgcaggtgcctccaagagtgttgccggagggctcaaccccaacaaggccgcaggcattccctccaaggtgcggcgtcagcgtcccctacacgatcagcgcatccgtggactgctctaagatccactgatcgatttctggccgccatcatcgccgattatagttccagcgattgatgctgagtacgtttgaaggtctcacacacacatatatacatatacatgaataaatgctctgatatgatctccatgtgagagataggagtacgtacatcgagccagctttgcatagctggccactgttgtatctattttgtatcagcgtttgattgttcgttcactccctttgagcaagacacgggagtttgttgtactttgtacgatgtacgcttatcatatatggattataaattaatctaacgcaaatacagggcaccaaacggaatgataaactaccttcaaacctcctggagagaacgcatacttcacctaaggggttcattccgaagatcgctgcctagctgatgcaacaatacaagcatgctgtattggttgctacgcatgatggtgtggatgcaagtctaaaaataaagaatatacttcaggcccgggctagcgacatatatacttgtacacttctgcgtcagattgatttttctagttcaatgttcctcaagttactttgcgtgcaaattttgtgtgaatgaaaacttcggactattgagtacacaacgtttttttgttactgccgttaataggatccatataccggtaggattaatagcggctacgtaaaaagatgtacagctgaagtgcctgagacgtttcacaatttccagtccagctacatgtagctgtatgatgttgtgatattatcaactgtagtgtgcaatgcataaaatgcaattgccctattgcattatgggcaggctcgtacgtacaaaaaaaaaaa

SEQ ID NO: 28951 - DNA, 620 bp, Triticum aestivum
  Clone ID: PAT_TA_28951
ggtgcgacttaactacagtaaaagacagggttggtcgagttatcttacaggttacacgggggagaaacttcgcatacgaatggaagcctgtatatactagtactacaagagcagcttcacaatctgcaatggaagcttctttgttttgttttgcttttacttcgacaataaataaaaggcggcgacgcgaagattaaatgaaagaatgcaccaaagtctcagctcgtcccggtgccgtcacagaagcaacataatgtacatgcaatctcagggtctccgctggcaatgccgcggaggaaagaatgatcaatcctgtcttgggtggagaatgtggcgagggtcgccgccgtcaggtgttgcccggcttgtaccgcttcgctgcgtgcggtagctcttcggcggcgttgcccagcatcgtctgctgatggcccatcatttcgttcgtcggggctagatcgatgtgctccttaaaactggaggattgtccagcagtaggtcttttgacagcccgcttgcccaggttgatctggacagatatgttggcttgggacaaatctatacccgagctttgaagagcatgagccaacgtattaagtagcctgttgtgagttaaccggacg

SEQ ID NO: 28952 - DNA, 497 bp, Triticum aestivum
  Clone ID: PAT_TA_28952
gcaaaacaatccaatccaatcccccaagagagagaagaggaggaagatgtcgggccgcggcaagggaggcaaggggctcggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgccgcaagaccgtcaccgccatggacgtcgtctacgcgctcaagcgccagggccgcaccctctacggcttcggcggctaggccgagggcccagccgtccagctcgccacgccgccgtccgaccgagagtagtagtggtatctatctagttgctgtctagggttcgtggctctccgtgtatgcgcagtgtttcgctggtgtgtgtctgctcccgtcttgtgagctggtgttgtactggaagaaatctggaatggaaattgcagtagcttatccctgaaaaaaaaaa

SEQ ID NO: 28953 - DNA, 388 bp, Triticum aestivum
  Clone ID: PAT_TA_28953
gtttctgccctatcaactttcgatggtaggataggggcctaccatggtggtgacgggtgacggagaattagggttcgattccggagagggagcctgagaaacggctaccacatccaaggaaggcagctgcaggtcctggcgcgagcaactctcccccggcgccgccctccaacgccgctacctccgtcggtgccacagcaggatttggcctcgtcgccctactggcggccggtctcatggcttgaacgcatatattgatcagctgccgcgcgcacatacgagcttttatattgttaactactatactgtagttattatcacgggtgaatacatgtattcttttttagagcgagaatgtgatagttacttgtatctatcaaaaaaaaaa

SEQ ID NO: 28954 - DNA, 730 bp, Triticum aestivum
  Clone ID: PAT_TA_28954
gctaaatacaggggccccaatgccagttttagcagttgtgttcccgcgtgagggctctgatccatcgaagtggcgttcttatggcacgacacaggcgaggcaatgtttttctgtgagaggtgtctaccctttgatggggagtactgacgatgtatgcacttcttacttggtgataccagagcaagttctgttatttccaatgttaagcatatatggtggctgcggatgctttttgtttggagatctacggtgcaactatctcagagctgaaactggtgggctcaccaaggaagaatacgggataaaacttgcactgaactatggccggtcagtaggcataataaagccatacgacagggtgattatttttgaaaagatcggtgattcctctgttgtcaagatcatcgagtgcgacgattctgaaagatgaatgacccttctcaggcaacagtttcaactatacgcctgagattgcctcctctttttgttctccattcactttgaccagagataaaagagtagtatagcacgacaaggttgtcatgtttagcaccttggtattttagatttacatacttgttgccctaataaagtgaagagagctcattcactcaaacatccaagttttggacaaaattataggattgttgagataatacctatgagtgattcctagcttgtatttcatgttacataatacgctatatgacattatctgctattaccttgc

SEQ ID NO: 28955 - DNA, 429 bp, Triticum aestivum
  Clone ID: PAT_TA_28955
cagtgacgaacatactgagcctatttgtgagccatggcttccagctccagctgccggacatggcattgcttgcttgccctcttcctcctctcctcggcggcctatgggcagctctcgccatcattctacgcgaagagctgcccgtcgcttgagctcatcgtgcgcgccaccatgatcaaggctctcctcgccgagcgccgaatgggggcgtccctccttaggctccacttccatgactgctttgttcaaggctgcgacgggtccattctcttggatgacgtgggtagcttcgtgggcgaagaagacggctttcccgaacgtgaactcggtgcggggctacgaggtgatcgacgagatcaagaggaacgtggagctggtctgccctggcgtcgtctcctgcgccgacatcactgccctcgcagcacggga

SEQ ID NO: 28956 - DNA, 580 bp, Triticum aestivum
  unsure (1)..(580): unsure at all n locations
  Clone ID: PAT_TA_28956
tttagctagatcaatttgtgagcttagcatatcggtcatggcttccaggacatggcatttcttgctcgccctctccctcctgtcctccgccgcgtatgggcagctctcgccgtccttctacgccacgagctgtcccctgttagagctcaccgtgcgcgccaccatgatcgccgcgctcctcgccgagcgccgaatgggcgcctccctcctcaggctccaattccatgactgctttgttcaaggctgtgacggatccattcttctggatgacgtgggcagcttcgtcggcgagaagacggcttcccgaacgtgaactccgtgcgcggctacgaggtgatcgaccgaatcaaggcgaacgtggagcttgtctgccccggcatcgtctcctgcgctgacaatcgtcgccctcgccgcacgcgacggatttctggtacatactgtcatcaaaagaataaaaangattatcagattattaagtctagatacataattttgtcaattcaaacaagtatttcgacggnggataaatatggaacgcactcatcacgtgtaaatgcatgtgtnatattattatgcncaa

SEQ ID NO: 28957 - DNA, 708 bp, Triticum aestivum
  Clone ID: PAT_TA_28957
ccgtttcagtgaaagtgtgatcattgacttccacagcctatgtcaagaaaataaaattgcatagaacaaaagcaccacaatttgagtcgaaacctgacatggataatagacgattacttttgcttgaaaaaaatacatcaaagcttccattggtcactgaaacttctcctggcagaatatatggttcagcagaaagctacactaccggcaagtatgcaagctcatccatgttatctgttttgcatcttctctgaaattaaggacattactggcataattggtccatcaatcacccgctgaccgaaggttggatggtccgtagtttggttgaggatagagataccaaggaattgatgatcccactctctctgttttagtcatcaagggtgcccaacaatgtttttttgtatggctactgcataacggaagactgtatttggtggagtaatccatgggagcaatcaccagacgacagccttacgagctcctctatagacagtctccacgatgtcaacaaactcttccttgtctttcattgcccagttgatcttgttgttgtttcttgtcccaagatcaatcatgatgtgcttgttgcggaagaagaacatcaccgttgacgggtcgtacagctcgtacatggagttgaagtcaggaaccttggtgatgtcaacatggtagatcaggacaaagttcttgaggtctcagccc

SEQ ID NO: 28958 - DNA, 520 bp, Triticum aestivum
  Clone ID: PAT_TA_28958
ctagatcaatttgtgagcttagcatatcggccatggcttccaggacatggcatttcttgctcgccctctccctcctgtcctccgccgcatatgggcagctctcgccgtccttctacgccacgagctgccccctgctggagctcaccgtgcgcgccaccatgatcgccgcgctcctcgccgagcgccgaatgggcgcctccctcctcaggctccacttccatgactgctttgttcaaggctgtgacggatccattcttctggatgatgtgggcagcttcgtcggcgagaagacggccttcccgaacgtgaactccgtgcgcggctacgaggtgatcgaccggatcaaggccaccgtggagcttgtctgccccggcgtcgtctcctgcgccgacatcgtcgcccttgccgcacgcgacggcacgtttctgctaggcgggccgagctgggcggtgccgctgggccggcgggactcgacgacggcgagcctggcggaggcgaatgccgacctcccggggccgac

SEQ ID NO: 28959 - DNA, 838 bp, Triticum aestivum
  Clone ID: PAT_TA_28959
ggattcagcaactcatataccagttttattggtcataccaatgccaacatattctgtatggagcatttcgaacaatcatcgaggatcttacagatgcttatgagacgccaagatacaagactggataagctgggatgcttcacagtttgcattaagggtcacctcgttgaccagtgatcacagacattttacctgacagaatacgctagaaatagcacatgagcagccaggacacaaatggcctagtaacggtacttggtggagtaatcctttggagcaatcaccagaccacggcccttccgagctcccctgtacacagtctccacaatgtcgacgaactcttgcttgtctttcatggcccagttgatcttgttgttgtttcctgtcccaagatcaatcatgatgtgcttgttccggaagaagaacatcaccgtcgatgggtcatacaactcgtacatggtgttgaaatcaggaacctcggtgatgtcaacaaggtagatcactgcaaagttctttatggtctcagccacacctgatagcacctcatccatctgcatgcaggtctcgtcccaatcgtggccgaagcggatgatgacaagccgctcctcctcggcgaggatggcttggtccaccgcccatcccgagtgcagatgtggcagcaggtaggacatgtccgcctcgcgctcgtcgccgacggcccccgctgatccgcgagaagatttggggatttcgaacctcagaacgggtagcgagcagacagcagagggggaatgtgtgcgtggaacgcaacacggtgagattcgatcgaactttctgggagacagaaagagaaggagag

SEQ ID NO: 28960 - DNA, 884 bp, Triticum aestivum
  Clone ID: PAT_TA_28960
gcatagtttacccaaggtgacttcaaccaaactcctaaaagtaaataacagaacctctcagtggcatcactagatgcaaaaggtaactcgtaattacatgcaaattctgatttgacagatgatgaagctcccagccgacgaaagttcgaatcagataactatgctggccacgattcgaagtgatgaaacggctcgcaagcccggtgtaggttaatccagcatcaaaatgtgaaggcatttcactggaactctcatgcttcgaccatgggctcaggcacaggtgaatctggggcggttccgcttccgcttgccttgcttttgcttgacgggtgcacagagttgaagaggatgtccttgatgacctgtgacatgagaccatgaacctgttcagcagtaattttggagctatcccgggttaccttagccagcggcgactcctcttgctctttctttcgctgtgatggcataagcatgccaaatcgactgtgtgccagttgcccttcagcttgctctagtttatcagctaaatcaaagatttgtccagcaacataatccctgttgcccagaagtggtgatgaagataatgtgttgacccagtacttgttccagagtagatcaaggaggtgagagtccagggatgacttgaaataggttatatccaaagaatagtactgtttgcagtgaacaccaaaatcttctatcttgttgagtggtatggtctgatactcagacacaggctcatccggtggcttgtaatcttttgggtatgtcctaaaagctccaatgtccactttaccagcagaaacagtccttgtagggtctatcacaacagccaaccatggttcttgaaactgctgattaagcatctgagtgaaacatcaatg

SEQ ID NO: 28961 - DNA, 676 bp, Triticum aestivum
  Clone ID: PAT_TA_28961
cctcgagttttttttttttttttttgacatgctccagggtgcaacttaactaacagataaagagttggtcgagttatcttacaggttacacgggggagaaacttcgcatacgaatggaagcctgtatatactagtactacaagagcagcttcacaatctgcaatggaagcttctttgttttgttttgcttttacttcaacaataaataaagggcggcgacgcgaagattaaatgaaagaatgcaccaaagtcttgcccgtcccggtgctgtcacagaagcaacataatgtacatgcaatctcagggtctccgctggcaaatgccacggaggaaagaatgatcaatcctgtcttgggtggagaaatgtggttgagggtcgccgccgtcaggtgttgcccggcttgtaccgcttcgttgcatgcggaagctcttcggtggcgttacccagcatcacctgctgatggcccatcatgttgttcgtcgggcctaggtcggtgtgctccttgaaactggaggattgtccagcagtaggtcttttgacagcccgcttgcccaggttgatctggacagatatgttggcttgggacaaatctatacccgagctttgaagagcatgagtcaacgtattaagtagctcttgggaatattggcttgacacgctgattgttccttcatc

SEQ ID NO: 28962 - DNA, 785 bp, Triticum aestivum
  Clone ID: PAT_TA_28962
gaaaaaaaattgagcgcacagtttgatagagaccttgaacataggcagattgtgcccaccaatcagaaaggcagtcaacatagttaacccaaggtgacttcaacaaactcctaaaagtaaataacacaacctctcagtggcatcactagatgcaaaaggtaactcgtaattacatgccaattctgatttgacagatgatgaagctcccagccgacaaaagttcgaatcagataactatgctggccacgatcttgcgagcccggtgtaggttaatccagcatcaaaatgtaaaggcattttcactggaactctcaagcttcaaccatgggctcaggcacaggtgaatctggagcggttccgcttgcgcttgccttgcttttgcttgacgggtgcacagagttgaagaggatgtccttgatgacctgtgacatgagaccatgaacctgttcagcggtaattttggagctatcccgggttaccttagccagcggcgactcctcttgctctttctttcgctgtgatggcataagcatgccaaatcgactgtgtgccagttgcccttcagcttgctctagtttatcagctaaatcaaagatttgtccagcaatataatccctgttgcccagaagtggtgatgaagataatgtgttgacccagtaccaaccagctagcatgcatggcagaataagagccgtttggttcagataatgcctgggggctgggatccataggtaagtaaccctcaagctccagggttgttaggtacctcggccgcgaccacgcta

SEQ ID NO: 28963 - DNA, 1070 bp, Triticum aestivum
  unsure (1)..(1070): unsure at all n locations
  Clone ID: PAT_TA_28963
atgagagctgcggacacaccaacaagnctgacatactccagggtgcgacttaactaacaggaaatatagtcgatcgagttatcttacaggttacacgggggagaaacttcgcatacgaatggaagcctgtatatactagtactacaagagcagcttcacaatctgcaatggaagcttctttgttttgttttgcttttacttcaacaataaataaaaggtggcggcgcgaagattaaatgaaagaatgcaccaaagtctcgctcgtcccggtgccgtcacagaacaacataatgtacatgcaatctcagggtctccgctggcaatgccgcagaggaaagaatgatcaatcctgtcttgggtggagaatgcggcgagggtcgccgccgtcaggtgttgcccggcttgtaccgcttcgtcgcatggggaagctcttcggcggcgttgcccagcatcgtctgctgatggcccatcatgttgttcgtcgggcctagatcggtgtgctccttaaaattggaggattgtccagcaataggtcttttgacagctcgcttgcccaggttgatctggacagagatgttggcttgggacaaatctatacccgagctttgaagagcatgcgtcaatgtgttaagtagctcttgggaatattggcttgacacgctgattgttccttcatcaatcatcaattgttgattatttaacacgtcactgttcacagcggtcgacgcggccgcggaatatttgggatcattgaaaccacatgaagagacaggcacagatacctcagtacctgtatttggtggagtaatccatgggagcaatcaccagacgacagccttacgagctcctctatagacagtctccacgatgtcaacaaactcttccttgtctttcattgcccagttgatcttgttgttgtttcttgtcccaagatcaatcatgatgtgcttgttgcggaagaagaacatcaccgttgacgggtcgtacagctcgtacatggtgttgaagtcaggaaccttggtgatgtcaacatggtagatcaggacaaagttctgtcgacgcggccgcga

SEQ ID NO: 28964 - DNA, 644 bp, Triticum aestivum
  Clone ID: PAT_TA_28964
gtgtaaaactctgaagtcttatattacagcaagatgaaatgtatataatgcaaatggtccgggcaaatcacctcaacaccaacccaaatagacagcaatccaaacagaaattacaaatacatctcaagcaataaatccaggcaacagtatgagcccaagcgggcaaaaggcacagttatctgggccattccgacatagcggcgtaagatcaacagacccttttcgggatgcacatctggcctgtcatgtgccagctttcacccccatcatgatgcgcatacgggcacgccggggtgtagttgtcctccatgaccaggaggttccactgcgcatgcggatcgtgagtcgagaacacggtccagtcaggagtggcgttctcgtacctgctatgtgtgactcgggcaaactcctccacatcctggttcttctccatgtcatccgggtcgatatcaacggtgaagatgtcgccgtagggcctctgcgaatgcaacaagagcggcagcgacattgggtcagcagacaccgcggcaagatctgccgtcacgacgatgctccgcccatccgggctgaagaccgggtggttcacgtgcccggagaagtcatacccgctccggattaccctcaccacagagtagtcgattgcg

SEQ ID NO: 28965 - DNA, 562 bp, Triticum aestivum
  unsure (1)..(562): unsure at all n locations
  Clone ID: PAT_TA_28965
agccactgagctagcaatccttacagtgaagaacacactgagccaaagtacgtagctagataagtttgtgagtcatggcttccagctccagctgtagggcatggcattgcttgcttgccctcttcctcctctcctcggccgcgtatggtcagctgtcgccgtcattctatgcgaggagctgcccgacgttgcagctgatcgtgcgcgccaccatgatcaaggctctcctcgttgagcgccgaatgggcgcgtccctcctcaggctccacttccatgactgctttgttcaaggctgtgacgggtccattctcttggatgacgtgggtagcttcgttgggcgagaagacggccgccccgaacaataactcgttgcggggctacgaggtgatcgacgagattcaagcggaacgtggagcttgctctgccctggcgtccgtctcctgcgcggacatcgcttgctctcgcaacaagggacggcacgtttctgctaaggggggccaactgggcggtgccgctcggccggngcgatcaacaacngncancctgacgaagcaacgcccga

SEQ ID NO: 28966 - DNA, 777 bp, Triticum aestivum
  Clone ID: PAT_TA_28966
caaaccaaatatcactttaatcagtaataccaatagacagcaggtcctgtttcaaagggttacaggtttatgacatgtatttaagatacaaatacatagttacgcgacactttcaaagttgacagacattacatcaagggtcacacagctcatttcacagaacagagcaggccacacactgcacatgaatagccaggcacagatacctcagtaacggtacttggtggagtaatccttgggagcaatcaccagaccacggcccttacgagctcctctgtagacggtctccacaatgtcaacaaactcttgcttgtctttcattgcccagttgatcttgttgttgtttcctgtcccgagatcaatcatgatgtgcttgttgcggaagaagaacatcaccgtcgacgggtcgtacagctcgtacatggtgttgaagtccggaacctccgtgatgtcgacgaggtagatcaccgcaaagttctttatggtctcagccacccctgacagcacctcgtccatggagaattaagagcatttgctcccatattaatcagctatgtagcagcctagattgatttagaaccaaaacctgataaaattaaaaggtcaacctgcatgcacgtctcgtcccagtcgtggccgaagcggatcatgaccagccgctcctcctcggcgaggatggcctggtccaccgcccagccggagtgcaggtgcgggagtaggtaggacatctccgcccctcgccgagagtcgagtcgccgccgccggagagaataatgt

SEQ ID NO: 28967 - DNA, 739 bp, Triticum aestivum
  Clone ID: PAT_TA_28967
ggcatcagccttctacctcctctgctttgcattcctccttccagttccaaccgcaatcaatggctgccatgaagatcaccctccttgccgtggccgcaatctcggcactcttactaggcaccgcatcggcggcgacctacggtgtcggcgagccgggcggttcgtggaccctcaacaccgactacagcaactgggtgtccaacaagaagttccacccgggtgatgagatcgtcttcaagtactcgaccccggcgcacgacgtggtcgaggtgagcaaggccggctacgactcctgcagcaccgacggcgccatcaacaccttaacctccggcaacgacgtcatctccctcaacgccacaggcactcggtacttcatctgtggcgtccctagccattgcagccccaccgccgctgccagcatgaaggtcaccatcgaagtggtgccgggtgcctcctcgccatcgtcacccatgccggccgcgggtcccggcgcgaccaacccgccgccgccctcctctaccgcaacctccgtcggggccgcagcaggatttggcctcgtcgccctactggcggccggtctcatggcttaaaaagttagaatgcatatttcagctgcatgccccacgcacatatcagcttacatattgtttgactggctattacaaggaatatatacatgtattattgcttagagcgaagatgtgagaactaccaaaaaaaaaaaaaaaaaaggccccta

SEQ ID NO: 28968 - DNA, 679 bp, Triticum aestivum
  unsure (1)..(679): unsure at all n locations
  Clone ID: PAT_TA_28968
cgcccgggcaggtccccgctaagcatcagcattcagcaagcacctcccttctacctcctctgctttgcattcctccttccggtttcaaccgcaatcaatggctgccatgaagatcaccctccttgccgtggccgccttattaggcaccgcgtcagcggtaacctacaacgtcggcgagcagggcggttgggaccctcaacaccgactacagcagctgggtgtccggcaagaagttcaacgtgggtgatgagattcgtcttcaagtactcgtccgcccgcgcacgatgtggtcgaggtcaagcaaggccggctacgactcctggcagcatcgacggcgccatcaacaccttcaaatcctggcaacgacgtcatccccctcagcgccaccggaaccggctactcatctgcggcatcactggccactgcagccccaccgccgcggccagcatgaaggcatgatcgacgtcgcctcgggctcctcctcgccttcctcaaccatgccaaccgcaagtcctggcgcgacaatctccccggcgcaacctctccgcgctactccgtcgtgcacacangattggctctcgcctatggcggtggtcnaaggctnaaccatatatgatagngcaccnccattagctaaaatgtacacgcgtgnatacaggtaataatgatctttagtgga

SEQ ID NO: 28969 - DNA, 691 bp, Triticum aestivum
  Clone ID: PAT_TA_28969
gccggccgggttccgggcaacccaacccccgctaacatcatacaatcttgccttctacatcctctgctttgcattcctccttccagttccaaccgcaatcaatggccgccatgaagatcactctccttgccgtggccacaatctcggcagtcttactgggcaccgcgtcggcggcgacctacggtgttggcgagccgggcggttcgtggaccctcaacaccgactacagcaactgggtgtccaacaagaagttccacccgggtgatgagatcatcttcaagtactcccccgcggcgcacgatgtggtcgaggtcagcaaggctggctacgactcctgcagcaccgccagcgccatcaacaccttcaagtccggacgcgagcaacccgccgccaccctcctctaccgcatcctctgtcggggccacagcaggatttggccttgtcgtcctactggtcgccagtctcatggtttaaaatgcatatttcagccagctgcatgccgcacgcacatatgagcttacatattgtttgactggttattactggggaatacatacatgtattattgcttagagcgaagatgtgagaactactttgtaagtttgtatctctcacgtttgtatgtaatctactggcctttaggcatttcatattgatttttgaggtaaaaaaaaaaaaaaaaaggccccta

SEQ ID NO: 28970 - DNA, 1117 bp, Triticum aestivum
  unsure (1)..(1117): unsure at all n locations
  Clone ID: PAT_TA_28970
aggcggatggtatcatcatatcgcgaggagacctgggaattgacctcccaccagagagggtgttcatgtcccaaaagactggtattcataaatgcaacatggccggcaaacctgtgatcattactagagttgtggacagcatgattgacaatctgcgccctactcgcgcagaagctactgatgttgcaaatgctgtcctagatggaactgatggcattttgctcggtgcggagacacttcgagggcagtatcctgttgacgctgtgcgtactgtgggcagaatatgtgcagaagctgagaccgtgtataaccagtcacttcacttcaagaaagtagtgaggcatgtaggtgaaccaatggtccatgaagaatctgtggcatcatcagcggttcgttctgcaatgaaggtaaaagctgctgcaattgttgtgttcaccttctcggggagagctgctaggttaattgctaaatacagggccccaatgccagttttagcagttgtgttcccgcgtgagggctctgatccatcgaagtggcgttcttatggcacgacacaggcgaggcaatgtttttctgtgagaggtgtctaccctttgatggggagtactgacgatgctgaaactggtgggctcaccaaggaagaatacgggataaaacttgcactgaactatggccggtcagtaggcataataaagccatacgacagggtgattatttttgaaaagatcggtgattcctctgttgtcaagatcatcgagtgcgacgattctgaaagatgaatgacccttctcaggcaacagtttcaactatacgcctgagattgcctcctctttttgttctccattcactttgaccagagataaaagagtagtatagcacgacaaggttgtcatgtttagcaccttggtattttagatttacatacttgttgccctaataaagtgaagagagctcattcactcaaacatccaagttttggacaaaattataggattgttgagataatacctatgagtgatcctagcttgatttcatggttacataatacgctatatgacataactgctattaccttgcataacngtnccattcgtgtcngtantccantacactataa

SEQ ID NO: 28971 - DNA, 761 bp, Triticum aestivum
  Clone ID: PAT_TA_28971
aacagcaacccaacccccgctaagcatcagcagagtcttgccttctacctcctctgctctgcattcctccttccagttccaaccgcaatcaatggccgccatgaagatcaccctccttgccgtggccgcaatctcggcagtcttactaggcaccgcgtcggcggcgacctacggtgtcggcgagccgggcggttcgtggaccctcaacaccgactacagtaactgggtgtccaacaagaagttccacccgggtgacgagatcgtcttcaagtactcaaccccggcgcacaacgtggtcgaggtgagcaaggccggctacgactcctgcagcaccgacagcgccatcaacaccttaacctccggcaacgacgtcgtcgccatcaacgccaccggcacccgatacttcatctgcggcatccctggccactgcagccccactgccgcagccagcatgaaggtcgtgatcgacgtcgtcccgagttcctcctcaccgtcgtcacccatgccggctgccggtcccggcgcgagcaacctgccgccaccctcctctaccgcaacctctgccggggccacagcaggatttggccttgtcgtcctactggccgccagcctcatggcttagaacgcatatttcagccagctgcatccggcacgcacatatgagcttacatattgtttgattggttattatggggaatatatacatgtattattgcttagagcgaggatgtgagaactactttgtatctctcacgtttgta

SEQ ID NO: 28972 - DNA, 593 bp, Triticum aestivum
  unsure (1)..(593): unsure at all n locations
  Clone ID: PAT_TA_28972
catcagcattcaagcagcaccagccttctacctcctctgctttgcattccgccttccagttccaattccaaccgcaatcaatggctgccatgaagatcgccctccttgccgtggccgcgatggccgtcttgctaggcaccgcgtcagcggtaacctacaacgtcggcgatcagggcggttggaccctcagcaccgactacagcagctgggtgtccggcaagaagttcaacgtgggtgatgagattcgtcttcaagtactccgaccccaacgcacgacgtggtcgaggtcaagcaaggccggctacgactcctgcaacatccgacggcgccatcaacaccttggcctccggcaacgacgtcatcaacctcaaacgccaaccggcacccggtacttcatctgtggcgtccctaacattgcagcccacggccgccgccagcatgaaggtcgtgatcaactcgcctcggtcctcctcgccgtcgtcaccatcaactgcagtctggccgagaatctccccggngcgcctcaacgcgctactcgtcgtgcacanaggattggctctcccactggnggcggtccangcttaaccataatt

SEQ ID NO: 28973 - DNA, 623 bp, Triticum aestivum
  unsure (1)..(623): unsure at all n locations
  Clone ID: PAT_TA_28973
ccccgctaagcatcagcagcagtgcagcacctcccttctacctcctctgctttgcattcctccttccagctccagccgcaatcaatggccgccatgaagatcaccctcctcgccgtggccgcgatggccgtcttactaggcagcgcgtcagcggtaacctacaacgtcggcgatcagggcggttgggccctcagcaccgactacagcaactgggtgtccggcaagaagttcaacgtgggtgatgacatcgtcttcaaagtactccgaccccgacgcacgacgtggtcgaggtcaagcaaggccgggctacgactcctgcagcaccgacggcgccatcaacaccttaacctccgggcaacgacgtcatctccctcaaacgccaccgggacccgctacttcatctgtggcgtccctaacattgcaaccccgccgccgccggccagatgaaggcgtgatcgagtcgcctcgggtcctctcgccgtcgtcaccatgcaactgaaggctgngcganaatcccccggggcgcctcaaagcggtactcgtcggtgcaagaagattgctcgcccctctggggcggtcaaggttgacgataatgtagnccggccaananattacttgtataa

SEQ ID NO: 28974 - DNA, 1285 bp, Triticum aestivum
  Clone ID: PAT_TA_28974
tcgcgatctagaactagttttttttttttttttttttttttactcaattcagaatcatcatataaaactctgaagtcttatatattacagcaaggtgaaatgtgtagaatgcaaatggtccgggcaaatcacctcaacaccaacccaaatagacagcaagccaaacagaaattacaaatacatctcaagcaataaatccaggcaacagtatgagcccaagcacgaaacaggcacagttatccgggccattccgacatagcggcgtaagatcaacagacccttttcgggatgcacatctggcctgtcatgtgccagctttcacccccatcatgatgcgcatacgggcacgccggggtgtactcctcctccatgaccaggaggttccactgcgcatgcgggtcatgagttgagaacacggtccagtcaggagtggcgttctcatacctgctatgcgtgactcgggcaaactcctccacatcctggttcttctccatgtcatccgggtcgatatcaacggtgaagatgtcgccgtagggcctctgcgagtgcaacaagagcggcagcgacattgggtcagcagacaccgcggcaagatctgccgtcacgacgatgctccgcccgtccgggctgaagaccgggtggttcacgtgcccggagaagtcgtacccgctccggattaccctcaccacagagcggtcgattgcgttcatcaggtaaacagcaaagtaccccgggtccataccatggtcgcgctccggagcgtccgcgggcttgtcacggtttgacgagaacacgatccagtccctgtcccggcgaccactggcagtgtgtgtcaatccaatccccctctgttatccgttccgcttcaccgccgtcctccccgatctctgcgtccatcatgtatagattcttgtactttttgtctcccccatttcttgtcgatcggaaaacaagttttgtcccgtctgaattggtggatgggaacgcattattgaattttcccttcgtgagcagtcgccgctctcgtgcaccactcgatacgtgagggatggcgtagatctccaatatttcgttggctttgaaagacggtcccatacagacataaagtatatccttcttttggttccacaccggtgagaagacgccatcggggccatccgtttcgaagacaacacgcattccgtcactatcggccagccacacggctttgaattcgttatcgacgaatgcaagcttagagccatctttggaaaatgccgggaatgcaccggctcgtgccgaattc

SEQ ID NO: 28975 - DNA, 442 bp, Triticum aestivum
  Clone ID: PAT_TA_28975
ttttttttttttttgcaaagacccattttatagataaagaaattcttcataaagctgcaaaatatcatttcccaatcccaggcagcatgacaaaactttaggtaacgacatagatattctttggtcataacagaacacttggattaagttcaaaacagtagatcctagcgatacgtgagacatatggacaccttgcccgggcggccgcttcgatggtcgcggccaggtctgccgcgcgcacatacgagcttttatattgttaactactatactgtagttattatcacgggtgaatacatgtattcttttttagagcgagaatgtgatagttacttgtatctatcacgtctatatgtaatctgcaggccttcatgtctttttatataatgattctagactattattttaaaaaaaaaaaaaaactcgagacctggccccgggg

SEQ ID NO: 28976 - DNA, 1305 bp, Triticum aestivum
  Clone ID: PAT_TA_28976
caagggggggaaaccccccccctcccccgtttaaggggccccataggggggggggccatttccccctcgggttgggccctttttttaaagggcgaccgtttggccccttttcctttttacccaatcgaagaaaaagggggttttttccaaagggattaaatggggaacccccaaggttttttcctttccaagcgtttttaaagtgggtgccctttgggttattttgggttcccccttaaaaaaattatggcctttcggcccccgttaggttaactttggtcctttaaaaggccccccccttttttttttttttattttttttttttttttttttttttttttttttttttttttttttttttttttttttttttttttttttttttttttttttttttttttttttttttttttttttttttttttttttttttttttttttttttttttttaggattcagcaatatataccagttttattggtcataccaatgccaacatattctgtgtcgagcatttcgaacaatcattaaggattttatagatgcttatgagatgccaagatacaagactggataagctggcatactttcaatttgcattaaggttcacttgcctaaccggtggccagacattttaccggacagaatacgctagaaatagcacatgaacagccagacacaaatgacctagtaacggtacttggtggagtaatcctttggagcaatcaccagaccacggcccttcctggctcccctgtacacagtctccacaatgtcgacaaactcttgcttgtctttcatggcccagttgatcttgttgttgtttcctgtcccaagatcaatcatgatgtgcttgttccggaagaagaacatcaccgtcgacgggtcatacaactcgtacatggtgttgaaatcaggaacctccgtgatgtcaacaaggtagatcaccgcaaagttctttatggtctcagccacacctgatagcacctcatccatctgcatgcatgtctcgtcccaatcgtggccgaagcggatgatgactagccgctcctcctcggcgaggatggcctggtccaccgcccatcccgagtgcagatgtggcaacaggtaggacatgtccgcctcgcgctcgtcgccgacggcccccgctgatccgcgagacgatttggggatttcgaacctcggaacgggtagcgagcagacagcagaggggggatgtgcgtggaacgcaacacagtgagattcgatcgaccttttttcctgggggtgggggtgggggtgggggagtttcgaccgaactgcc

SEQ ID NO: 28977 - DNA, 819 bp, Triticum aestivum
  Clone ID: PAT_TA_28977
cggcacgaggtaagcatcagccttctacctcctctgctttgcattcctccttccggttccagccgcaatcaatggctgccatgaagatcaccctcctcgccgtggccgcgatggccgtcttactaggcaccgcgtcagcggtaacctacaacgtcggcgatcagggcggttggacccttagcaccgactacagcagctgggtgtccggcaagaagttcaacgtgggtgatgacatcgtcttcaagtactcgaccccggcgcacaacttggtcgaggtcagcaaggccggctacgactcctgcagcaccgacggcgccatcaacaccttggcctcgggcaacgacgtcatcaccctcaacgccaccggcacccgatacttcatctgtggcgtccctagccattgcagccccaccgccgccgccagcatgaaggtcgtgatcgacgtcgcctcgggctcctcctcgccgtcgtcacccatgccagctgcaggtcctggcgcgagcaactctcccccggcgccgccctccaacgccgctacctccgtcggtgccacagcaggatttggcctcgtcgccctactggcggccggtctcatggcttgaacgcatatattgatcagctgccgcgcgcacatacgagcttttatattgttaactactatactgtagttattatcacgggtgaatacatgtattcttttttagagcgagaatgtgatagttacttgtatctatcacgtctatatgtaatctgcaggccttcatgtctttttatataatgatacctcggccgcgaccacgctaatcacttagtgaattc

SEQ ID NO: 28978 - DNA, 1553 bp, Triticum aestivum
  Clone ID: PAT_TA_28978
aaattgagcgcactgtttgatagagaccttgaacataggtagattgtgccgaccaatcagaaaggctgtcaacatccaccaaacataatagccgcatggtttacccaaggtgacttcaatcaaactcctaaaagtaaataacagaacctcttcagtggcatcactagatgcaaaaggtaactcataattacatgccaattctgatttgacagatgatgaagctcccagccgaccaaagtccgaatcagataactatgctggccacgattcaaagtgatgaaacggctcgcaagcccggtgtaggttaatccagcatcaaaatttcactggaactctcatgcttcgaccatgggctcaggcactggtgaatctggggcggctccgcttgcgcttgccttgcttttgcttgacgggtgcacagagttgaagaggatgtccttgatgacctgtgacatgagaccatgaacctgttcagcggtaattttggagctatcccgggttaccttagccagcggcgactcctcttgctctttctttcgctgtgatggcataagcatgccaaatcgactgtgtgccagttgcccttcagcttgctctagtttatcagctaaatcaaagatttgtccagcaatataatccctgttgcccagaagtggtgatgaagataatgtgttgacccagtacttgttccagagtagatcaaggaggtgagagtccagggatgacttgaaataggttatatccaaagaatagtactgtttgcagtgaacaccaaaatcttctatcttgttgagtggtatggtctgatactcagacacaggctcatccggtggcttgtaatcttttgggtatgtcctaaaagctccaatgtccactttaccagcagaaacagtccttgtagggtctatcacaacagccaaccatggttcttgaaactgctgattaagcatctgagttgaaacatcaatgcctgacagccagcatccataaccaggatgtgagtggtaccagccaaccacattttccaaccttccagcctgcttgttgatggtggagtactcgaccatgtactcgtaggcgtcggcctgggcgttgaccctggtctcggtgccctcgacggggagcgcgaaggcgtccatgacgatgatggagtcgccctcgaacttgccctgcatgaggcccatgatctcgatggtgccgccggcgcgggcgtggacgaccatcttgaggagcgcgagggcggagatcctggcacggcggaagtggtgcgggtcggtggcccagggcttctcctggtgggcccgcgcgttggccgcctcgtcgtagtggtagatcgcgtccatggcgtccgggtcggaggcggccgccgggatgttgttctccagctcccacgtctgcctcgccaccgccgacgacgaggtgggctccatcgcgctggctggctgcgccgggcgtcgctgacggcaggccggcgggcaggcaaaaccctagctaggagcggaaggggggaggaggacgaaggggaataggggttctctcccgaaccggccggc

SEQ ID NO: 28979 - DNA, 983 bp, Triticum aestivum
  Clone ID: PAT_TA_28979
gacacctgagaagtcctacttcatcatacactttatttatttctgtatactgaactaaagcacatgcaactcgcatgcctaccacaggacgggtataaatataagaactaatgtgtcgagaacaaaaaatacaattacacaggcgaagccaggaatcctgtacaagaaagcagcagttcaacaggggccgggccttgcagccaagcgtcagcgaaccaatttacaggggtggttggttacctaggctgcaagaccgtgcagaagaatcttcgacggaatctgcaagctcgtttccagaagatgccttggacagagcttccacaaaattgcagcctttggtgacgttagtgatttaaaaggaccgcggtctgagaaaatcactttcaagtatcgcagtaagaacgcttaacctccgattagctttgatcattttgacgattgggcttcggctagtatcacttggcagattgtactgctgttttttgcctggcaagtactctctcaaactcagcacaagcttcaggcgagtcttcttcgctgggtggcaccaactgccagaacagtggcagatatgcctcccattcgttcagaattttggcacctttcgtgctgcccgttttttcaacataggcctcaatcaagcccttgagctgcatctgcccagctggagcattcactctctgcatcttgacaatctccttgtttaccttcgggactagtgtatcatcttcatctagcatgtaggccaggccaccagtcattccggctgcaacatttcttccaactttgccaagtacaactacgcatccaccagtcatgtattcgcagcaatgatctcctgtgccctcaaccactgcttgcccaagagaattccgaactgcaaatctttctcctgtcttgcctctcacaaatacttgaccacccgtagctccatacagacaagtgttcccaactatagcagcatcctcaggaacaaatcctgt

SEQ ID NO: 28980 - DNA, 529 bp, Triticum aestivum
  unsure (1)..(529): unsure at all n locations
  Clone ID: PAT_TA_28980
ggcgcgaattcactagtgatttcgagcggccgcccgggcaggtcgagtttttttttttttttttgatagagaccttgaacatagatagattgtgcccaccaatcagaaaggcaatcaacatccaccaacataatagccgcacagtttacccaaggtgacttcaacaaactcctaaaagtaaataacacaacctctcagtggcatcactagatgcaaaaggtaactcgtaattacatgccaattctgatttgacagatgatgaggctcccagccgacgaaagttcgaatcagataactatgctggccacgattcaaagtgatgaatggcttgcgagcccggtgtaggttaatccngcatcaaaatgtgaaggaatttcactggaactctcatgcttcgancatgggctcaggcactggtnaatctggggcggttccgcttgcgcttgccttgcttttgcttgncgggtgcacagagttgagaggatnccttgatgcctggacatgagncangaacctgntcagggaattt

SEQ ID NO: 28981 - DNA, 348 bp, Triticum aestivum
  Clone ID: PAT_TA_28981
ccgcgggaattcgattttcgagcggccgcccgggcaggtttttttgaacaacaaactagacatttattcctttatggaactccttacaacatgtgccacaatatttagaatctatttgacatatcgtgcataaacatgagactacaaaatgctcttataggtaccttgctcgtatatgcgagcataaggagcaaattttattcaagcacatcaagcatgtttttgtgggactgaacatgttttatttaaaacacatatatatgtctagttgtttcttggtgacatccaccattttgacccctttcaccatatccacccacctcaaggataaccaccaccacacctcgg

SEQ ID NO: 28982 - DNA, 1503 bp, Triticum aestivum
  unsure (1)..(1503): unsure at all n locations
  Clone ID: PAT_TA_28982
gcgggggggcaaagccactgagctagcaatccttacagtgaagaacacactgagccaaagtacgtagctagataagtttgcgagccatggcttccaactccacctgtagggcatggcattgcttgcttgccctcttcctcctcgcctcggccgcgtatgggcagctctcaccgtcgttctatgcgaggagctgcccgacgttgcagctgatcgtgcgcgccaccatgatcaaggcgctcctcgttgagcgccgaatgggcgcgtccctcctcaggctccacttccatgactgctttgttcaaggctgtgacgggtccattctcttggatgacgtgggtagcttcctgggcgagaagaccgccgccccgaacaataactcggtgcggggctacgaggtgatcgacgagatcaagcggaacgtggagctgctctgccctggcgtcgtctcctgcgcggacatcgctgctctcgcagcacgggacggcacgtttctgctaggggggcccagctgggcggtgccgctcggccggcgcgactcaacgacggccagcctgaccgaggcgaacgccgacctcccagctcccttcttaaccctgggacgggctcgtcatggcgttcgacaagaagaagctaaacccgcgtgacctcacggcgttatccggcgcgcacactatcggcttctctcagtgcctcaacttccgcgaccacatctacaacggcaccaacatcgacccggcattcgccacactgcgcaagcgtacctgccccgcccagccccccaacggcgacatgaacctggcgccgttcgacgtgcagacgcagctcgtcttcgacaacgcctactaccgcaacctggtcgccaagcgcggcttgctgaactccgaccaggtgctcttcaacggcggctcacaggacgcgctggtgcgccagtatatcgccaacccggcgctcttcgcctccgactttgtgacggcgatgatcaagatggggaacatcacaccgctgactggaaccgccggccagattaggcgcaactgcagggtcgtcaacagctgattcgtccatcgtctcgccatatatacgtgttacatatgggcgtaaaatgagtgcgtaaagttaggttggttacgtctacgtagtaatcacctagcatgcatggcagaataagcggcaatgctacacgtacaaacaatttacaggcttttacaggatggttgaccttgattggtcaataggtgagcggggcggcccacccccctgaaaattaggtgggagagatttgtgattggttgttagatggaacgagcgtgtaaaagcgtgtaagtctttgtatgtctagcatttttgcagaataagagccgtttggttcagataatgcctggattgagtaaccttccaactccagggttgtaagatacatgcttcatcatgtaagtatctccgatcgtatgcatgcagtgctataatggaanccaagaatgcatggttttttatgcaaaaaaa

SEQ ID NO: 28983 - DNA, 811 bp, Triticum aestivum
  Clone ID: PAT_TA_28983
cgcaccaccccaaaataaaggagtactagttttattggtcatacccatgccaacatattctgtgtcgagcatttcgaacaatcatcaaggattttacagatgcttatgagatgccaagatacaacactggataagctggcatacttcacagttcgcatcaatggtcaccggcctaaccggtgatcagacattttaccagacagaatacgctagaaatagcacatgagcagccagacacaagtggcttagtaacggtacttggtggagtaatcctttggagcaatcaccagaccacggcccttccgggctcccctgtacacagtctccacaatgtcgacgaactcttgcttgtctttcatggcccagttgatcttgttgttgtttcctgtcccaagatcaatcatgatgtgcttgttccggaagaagaacatcaccgtggacgggtcatacaactcgtacatggtgttgaaatcaggaacctcggtgatgtcaacaaggtagatcactgcaaagttctttatggtctcagccacacctgatagcacttcatccatctgcatgcatgtctcgtcccaatcgtggccgaagcggatgatgaccagcctctcctcctcggcgaggatggcttggtccaccgcccatcccgagtgcaggtgtggcagcaggtaggacatgtcctcctcgcgctcgtcgccgacggcccccgctgatccgcgagaagatttggggatttcgaaccctcagaacgggtagcgagcaggcagcagaggtggaatgtgcgtggaaccccacgcgtccgcccacgcgtccg

SEQ ID NO: 28984 - DNA, 532 bp, Triticum aestivum
  unsure (1)..(532): unsure at all n locations
  Clone ID: PAT_TA_28984
gcaatccttacggtgaaagaacacactgagcctacgtacgtagctagatagatttgtgagccatggcttccagctccagctgcagggcctgggcattgcttgctagccctcttcctcctctcctcttccgcgtatagtcagctgtccccgtccgttctacgccaagagctgccccacgctgcagctcatcgtgcgggccacaatgatcaaggcgcttctccgcccgagccgccgaatgggcgcctccctcctcaaggctccacttccacgactgctttgtccaaaggctgtgacgggtccattctcctgggatgacgtgggtaagcttcgtggggcgaagaagacagcctttcccgaacgtcgattcggtgcgggggctacgaggtgatcgacgaagatcaagaagaacttggagctgctcctgccctgggcatcgtctcctgcgccgacatcggccgccctcgcaacacgggacggacttccctgctaggcgggccaactggtccgtgccgctcggccgncggatcgacac

SEQ ID NO: 28985 - DNA, 858 bp, Triticum aestivum
  Clone ID: PAT_TA_28985
ccggccgggccggggcaacccaacccccgctaagcatcagcacaatcttgccttctacatcctctgctttgcattcctccttccagttccaaccgcaatcaatggccgccatgaagatcactctccttgccgtggccacaatctcggcagtcttactgggcaccgcgtcggcggcgacctacggtgttggcgagccgggcggttcgtggaccctcaacaccgactacagcaactgggtgtccaacaagaagttccacccgggtgatgagatcatcttcaagtactcccccgcggcgcacgatgtggtcgaggtcagcaaggctggctacgactcctgcagcaccgccagcgccatcaacaccttcaagtccggcaacgacgtcgtccccctcaacgccaccggcacccgctacttcatctgcggcatcactggccactgcagccccaccgccgccgccagcatgaaggtcgtgatcgacgtcgtcccgagttcctcctcaccgtcgtcacccatgccggctgccggtccggacgcgagcaacccgccgccaccctcctctaccgcatcctctgtcggggccacagcaggatttggccttgtcgtcctactggtcgccagtctcatggtttaaaatgcatatttcagccagctgcatgccgcacgcacatatgagcttacatattgtttgactggttattactggggaatacatacatgtattattgcttagagcgaagatgtgagaactactttgtaagtttgtatctctcacgtttgtatgtaatctactggcctttaggcatttcatattgatttttgaggtaaaattagtaaaaaaaaaaaaaaaaaaactcgag

SEQ ID NO: 28986 - DNA, 978 bp, Triticum aestivum
  unsure (1)..(978): unsure at all n locations
  Clone ID: PAT_TA_28986
aaaaaattagaagctttatttcaagaaaatcagagacacaggggccttcctccacttctgctacatatcctaactaaccacctattctctcaggcgcctgcaggatgtgtagatggtacctggggagcagcacaattgcaaagcactaagagcatctgtttacatataatcaatcatccgaatacaagtgctgcaccgagattcctaaagacctctgttcagcaattcacacacatagttcaaaccaaatatcactttaatcagtaataccaatagacagcaggtcctgtttcaaagggttacaggtttatgacatgttgatattcaagatacaaatacatagttacgcgacactttcaaagttgacagacattacatcaagggtcacacagcgcacttcacagaacagagcaggccacacactgcacctgaatagccaagcacagatacctcagtaacggtatttggtggagtaatccttgggagcaatcaccagcccacggcccttacgagctcctctgtatacagtctccacaatgtcaacaaactcttgcttgtccttcattgcccagttgatcttgttgttgtttcctgtcccgagatcaatcatgatgtgcttgttgcggaagaaaaacatcaccgttgatgggtcgtacagctcgtacatggtgttgaagtcaggaacctccgtgatgtcgacgaggtagatcaccgcaaagttctttatggtctcagccacccctgacagcacttcgtccatctgcatgcacgtctcgtcccagtcgtggccgaagcggatcatgaccagccgctcctcctcggcgaggatggcctggtccaccgcccagccggagtgcaggtgggggagcaagtaggacatctccgcccctcgccaagagtcgagtcgccgccgccggagagaataatgtggagacgaactcccgaggtgaatcagcgcctcgtgccgaattncctgca

SEQ ID NO: 28987 - DNA, 703 bp, Triticum aestivum
  Clone ID: PAT_TA_28987
agcagtaataccaatagacagcaggtcctgttttaaagggttacaggtttatgacatgttgatattcaagatacaaatacatagttacgacactttcaaagttgacagacattacatcaagggtcacacagcgcatatcacggaacagagcaggccacacactgcacatgaatagccaggcacagatacctcagtaacggtattttgtggagtaatccttgggagcaatcaccagaccacgccccttacgagctcctctgtagacagtctccacaatgtcaacaaactcttgcttgtctttcattgcccagttgatcttgttgttgtttcccgtcccgagatcaatcatgatgtgcttgttgcggaagaagaacatcaccgttgacggatcatacagctcgtacatggtgttgaagtcaggaacctccgtgatgtcgacgaggtagatcaccgcaaagttctttatggtctcagccacccctgacagcacctcgtccatctgcatgcacgtctcgtcccagtcgtggccgaagcggatcatgaccagccgctcctcctcggcgaggatggcctggtccaccgcccagccggagtgcaggtgcgggagtaggtaggacatctccgcccctcgccgagagtcgagtcgccgccgccggagagaataatgtggagacgaacagccgaggtgaatccgtggcgtgcc

SEQ ID NO: 28988 - DNA, 978 bp, Triticum aestivum
  Clone ID: PAT_TA_28988
ttttttttttttaatggaaatcgtttaagttggccgacgccccgtagaacttgaaaaaagaaaaacaagttccaccgattatcgacacctgagaagtcctacttcatcatacacttcatttattctgtatactgaactaaagcacatgcaactcgcatgcctaccacaggacgggtataaatataagaactaatgtgtccagaacaaaaaatataattacacagcgaagccaggaatcctgtacaagaaagcggcagttcaacaggggccgggccttgcagcctagcgtcagcgaaccaatttacaggggtggttggttacctaggctgcaagagcgtgcagaagaatcctcgacggagtctgcaagctcgtttccagaagatgccttggacagagcttccacaaaattgcagcctttggtgacgttagtgcttcagaaggaccgcggtctgagaagatcactttccagtatcgcaataagaacgctttccctccatttagctttggtcattttggcgattgggctttggctagtatcacttggcagattgcactgctgtttttttgcctggcaagtactctctcaaactcagcacaagcttctggtgagtcttcttcgctgggtggcaccaactgccagaacagtggcagatatgcctcccattcgctcagaattttagcgcctttcgtgctgcccgttttttcaacataggcctcaatcaaacccttgagctgcatctgcccagctggagcattcactctctgcatcttgacaatctccttgttaaccttcgggactagtgtatcatcttcatctaacatgtaggctaggccaccggtcattccggctgcaacgtttcttccaactttgccgagtacaactacacatccaccggtcatgtactcgcagcaatgatctcctgtgccctcaaccactgcttgcccaagagaattccgaactgcaaatctttctcctgt

SEQ ID NO: 28989 - DNA, 1394 bp, Triticum aestivum
  Clone ID: PAT_TA_28989
gccggccgggtccggggcaaagccactgagctagcaatccttacggtgaaagaacacactgagcctacgtacgtagctagatagatttgtgagccatggcttccagctccagctgcagggcctggcattgcttgctagccctcttcctcctctcctcttccgcgtatagtcagctgtccccgtcgttctacgccaagagctgccccacgctgcagctcatcgtgcgggccacaatgatcaaggcgcttctcgccgagcgccgaatgggcgcctccctcctcaggctccacttccacgactgctttgtccaaggctgtgacgggtccattctcctggatgacgtgggtagcttcgtgggcgagaagacagcctttccgaacgtcgattcggtgcggggctacgaggtgatcgacgagatcaagaagaacgtggagctgctctgccctggcatcgtctcctgcgccgacatcgccgccctcgcagcacgggacggcactttcctgctaggcgggcccagctggtcggtgccgctcggccggcgggactcgacgacggccagtttgactgaggcgaacagcgacctcccggcgccaagcttaagcctgaacctgctcatcaaggcgttcgacaagaagcagctgagcccgcaggacctcactgcgctgtccggcgcgcacaccatcggcttctcccagtgcctcaacttccgcgaccacatctacaatggcaccaacatcgacccggcgttcgccacgctgcgcaagcgcacctgccccgcccaggcccccaacggcgacaagaacctggcaccgttcgacgtgcagacacagctcctcttcgacaacgcctactaccgcaacctggtcgctaagcgcggcttgctgaactccgaccaggtgctcttcaacggcggctcccaggacgcgctagtgcgccagtacgtcgctaacccggcgctcttcgcctccgactttgtgacggcgatgatcaagatgggtaacatcaacccgctcacgggaaccgccggccagattaggcgcaactgcagggtcgtcaacagctgatccgtccatcgtctcgccatatgtgttacaaatatataggcgtaaaatgtgtatgtaaagttaggttggctacgtaccaaccagctagcatgcatggcagaataagagccgtttggttcagataatgcctgggggctgggatccataggtaagtaaccctcaagctccagggttgttaggtacctgcttcatcatgtaagtcgctccgacgtatgcatgcagtgctataaaagaaaccaagcatggagtgagatttgcgacaaaactgtgagagaaaacaaatgtgaagagagatttttttcgaaaaaaaaaaaaaaaaaaactcgagac

SEQ ID NO: 28990 - DNA, 637 bp, Triticum aestivum
  unsure (1)..(637): unsure at all n locations
  Clone ID: PAT_TA_28990
cggcacgaggtgcattngaaagacacattttatagataaagaagttctcataaagctgcaaatatcatttccaacccaccaccaaacacaatccaagccaatcccaccggagagaagagaagatgtcgggccgcggcaagggaggcaaggggctgggcaagggcggcgccaagcgccaccggaaggtgctgcgcgacaacatccagggcatcaccaagccggcgatccgccgtcttgcgcggcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggccgagggcccagccagctcgcgacgccgccgtccggcagagtagtggtatctatctagttgctgtctagggttcgtggttctccttgtatgtcgctggtgtttgtctgctcccgtcttgtgagctgatgttgtactggaagaaatttggaatggaaattgcagtagcttacccccgaaaaaaaaaaaaaaaaaaggccccta

SEQ ID NO: 28991 - DNA, 735 bp, Triticum aestivum
  Clone ID: PAT_TA_28991
gaattcactagtgattagcgtggtcgcggccgaggtgagagaactagtctcgaggtttttttttttttttttttttttttttttttttttttttttttttttaactagacaattattcctttatggaactccttacaacatgtgctacaatatcaagaatctatttgacatatcgtgcatccttctgatttcttgctcttataggtaccttgctcgtatatgcgagcataatgagcaatttttattcaagcacatcaagcatgtttttgggggactgaacatgttttatttaaaacacatatatatgtctaagttgttccttgggtgacatccaccatttaagacctcttccacaatatcctgctcaagggatagccaccaccaccaccgggatcctccaccgtaaacctccaaccccgccgggacccggcacctgccccgggcggccgctcgagccgcccgggcaggtggcggccggtctcatggcttgaacgcatatattgatcagctgccgcgcgcacatacgactttatcttttgttattaactactatactgtagttattatcacgggtgaatacatgtattcttttttagagcgagaatgtgatagttacttgtatctatcacgtctatatgtaatctgcaggccttcatgtctttttatataatgattctagactattattttataaaaaaaacctcggccgcgaccacgctaatcactagtgaattc

SEQ ID NO: 28992 - DNA, 589 bp, Triticum aestivum
  unsure (1)..(589): unsure at all n locations
  Clone ID: PAT_TA_28992
gacagcaaaagcagggactattcagttcagaatcatcatataaaactctgaagtcttgtacgtattacagcaagatgaaatgtgtggaaaagatgaaatgtgtggaatacaaagggtcgatagcaacccagacaaggcagcaatccaaacagaaataacaaatacatctcaagcaatcgatccaggcaacaatgtgagcccaagcgtcaatccagccattccaacatagcggcgaaagatcaacaaacccttttggggatgcacatctggcctgtcatgtgccagctttcacccccatcatgatgcgcatacgggcacgctggggtgtaccttgcttcgtatatgcgaagcataaggagcaaattttattcaagcacatcaagcatgtttttgtgggactaaacatgttttattcaaaacacatatatatgtcttgttttttttggtgacatccaccattttgacctcttccaccatatccacctcaagggataagccaacctcggccgcgaccacgctaatcgaattccccgccggccgccnaggggggccnggangcaatgcnaacgtcnggcccaattncccccaa

SEQ ID NO: 28993 - DNA, 744 bp, Triticum aestivum
  unsure (1)..(744): unsure at all n locations
  Clone ID: PAT_TA_28993
ttttttttttttttttttttttttttttttttttttttttttttttttttttttttttttttttttttttttttttttttttttttttttgctcaatgcacaaacattgcattcaaagacacattttttagataaagaaattctcataaggctgcaaatatcatttccaatccagcagcatgacaaaacttaggtaacgacatagatattctttggtcatacagaacactggattaacaggttcaaaacagtagatcctagcgatacacgagacatatcgaccatcagaaactcgtccatcttacttctcaacctctccctcaccagccttgacgttgtgcttcctcgagtacctcaggttcctcaggaacttcgggtccatccccttggtggaggcctggcgctggcgcttgggcttcttgatgccgttcctgtgcgccttgtacgactggttgtgcgccgtgtggttcttcgacttggccatctccgatcccttctgctgcggctcctgtgcgctggggttcggcggcgggcaaataggaatcctcggnagtaaaatattctgcaagtaaaaaagaagntgctgctgggaacaccataggacaatccgccaaggacaacaagcaagacgcgggcaaacacacatccaaagggtcaaggaaaggagacctgatnaatgaangctcncnagaaaanaccacattaaanatatcaactcggaagnnttaagaatancccagnaag

SEQ ID NO: 28994 - DNA, 579 bp, Triticum aestivum
  Clone ID: PAT_TA_28994
gcaaaacaatccaatccaatcccccgagagagagaagaggaggaagatgtcgggccgcggcaagggaggcaaggggctcggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccgagggcccagccgtccagctcgccacgccgccgtccgaccgagagtagtagtggtatctatctagttgctgtctagggttcgtggctctccgtgtatgcgcagtgtttcgctggtgtgtgtctgctcccgtcttgtgagctggtgttgtactggaagaaatctggaatggaaattgcagtagcttatccctgaaaaaaaaaaaaaaaaaaggccccta

SEQ ID NO: 28995 - DNA, 1333 bp, Triticum aestivum
  Clone ID: PAT_TA_28995
ttttttttttttgaatgctcaaattcacaaacattgcattcgaagacacattttatagataaagaagttctcataaagctgcaaatatcatttccaatccagcagcatgacaaaacttaggtaacgacatagatattctttggtcatacagaacactggattaagttcaaaacagtagatcctagcgatacacgagacatatcgaccaccagaaactcatccatcttacttctcaacctctccctcaccagccttgacgttgtgcttcctcgagtacctcaggttcctcaggaacttcgggtccatccccttggtggaggcctggcgctggcgcttgggcttcttaatgccgttcctgtgcgccttgtacgactggttgtgcgccgtgtggttcttcgacttggccatctccgatcccttctgctgcggctcctcctgcggtgcgctggggttcggcggcggcggaagaagggctagggtttcttttttttttttttttttttttttttttttttttttttttttttcaaaccaaatatcactttaatcagtaataccaatagacagcaggtcctgtttcaaagggttacaggtttatgacatgtatttaagatacaaatacatagttacgcgacactttcaaagttgacagacattacatcaagggtcacacagctcatttcacagaacagagcaggccacacactgcacatgaatagccaggcacagatacctcagtaacggtacttggtggagtaatccttgggagcaatcaccagaccacggcccttacgagctcctctgtagacggtctccacaatgtcaacaaactcttgcttgtctttcattgcccagttgatcttgttgttgtttcctgtcccgagatcaatcatgatgtgcttgttgcggaagaagaacatcaccgtcgacgggtcgtacagctcgtacatggtgttgaagtccggaacctccgtgatgtcgacgaggtagatcaccgcaaagttctttatggtctcagccacccctgacagcacctcgtccatctgcatgcatgtctcgtcccagtcgtggccgaagcgtatcatgaccagccgctcctcctcggcgaggatggcctggtccaccgcccagccggagtgcaggtgcgggagtaggtaggacatctccgcccctcgccgagagtcgagtcgccgccgccggagagaataatgtggagacgaactgccgaggtgaatcagcggcgtgcgctggtgctggtcgcctgggcctggttaaaatagggcggcctggcggaggtgccaactaatccgagtcggcctgctaccccgagtcg

SEQ ID NO: 28996 - DNA, 736 bp, Triticum aestivum
  Clone ID: PAT_TA_28996
ggaattcggcacgaggaaacaatccaatccaatcccaccgtagagaggggagaagcgcggaggatgtcgggccgcggcaagggaggcaaggggctgggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctaggccgagggttcatcgatccagctcgcgacgccgccgtccgaccgagagtagtagtgctatctatctagttgctgtctagggttcgtggttctccgtgcaagagcagtggtatctccttggtgtttgctcccgtcttgtgagctgatgttgctgttgtagagatgtactggaagaagtttggaatggaaattgcagcagtttatccctgaaaaaaaaaaaaaaaaaaaaaaaaaaaaaaaaaaaaaaaaaaaaaaaaaaaaaaaaaaaaaaaaaaaaaaaaaaaaaagggaaaaaaagaaaaaaaaaaaaaaaaaaaagcgggggcgctcaaggatttcaacttttttatccgtgtaagggg

SEQ ID NO: 28997 - DNA, 543 bp, Triticum aestivum
  Clone ID: PAT_TA_28997
ttaggggccttttttttttttttttttttttttttttttttttttttttttttttttttttttttttttttttaagaagaacaatgcatgcaaagacacattttatagataaagaaattctcataaagctgcaaatatcatttccaatccagcagcatgacaaaacttaggtaacgacatagatattctttggtcatacagaacactggattaagttcaaaacagtagatcctagcgatacatgagacatatcgaccaccagaaactcgtccatcttacttctcaacctctccctcaccagccttgacgttgtgcttccttgagtacctcaggttcctcaggaacttcgggtccatccccttggtggaggcctggcgctggcgcttgggcttcttgatgccgttcctgtgcgccttgtacgactggttgtgcgccgtgtggttcttcgacttggccatctccgatcccttctgctgcggctccggtgcgctggggttcggcggcggcggaagaagggctagggtttcgcccggaacggccggc

SEQ ID NO: 28998 - DNA, 884 bp, Triticum aestivum
  Clone ID: PAT_TA_28998
gccggccgggtcgggaaaccaaaccccgctaagcatcagcattcagcagcacctcccttctacctcctctgctttgcattcctccttccggtttcaaccgcaatcaatggctgccatgaagatcaccctccttgccgtggccgccttattaggcaccgcgtcagcggtaacctacaacgtcggcgagcagggcggttggaccctcaacaccgactacagcagctgggtgtccggcaagaagttcaacgtgggtgatgagatcgtcttcaagtactcgtccgccgcgcacgatgtggtcgaggtcagcaaggccggctacgactcctgcagcatcgacggcgccatcaacaccttcaaatctggcaacgacgtcatccccctcagcgccaccggcacccgctacttcatctgcggcatcactggccactgcagccccaccgccgcggccagcatgaaggtcatgatcgacgtcgcctcgggctcctcttcgccttcctcacccatgccagccgcaggtcctggcgcgagcaactctcccccggcgccaccctcctccgccgctacctccgtcggtgccacagcaggatttggcctcgtcgccctactggcggctggtctcatggcttgaacgcatatattgatcagctgccacgcgcacatatgagcttatatattgttaactactgctgtagtcattatcacgggtgaatacatgtattcttttttagagtgagaatgtgatagttacttgtatctatcacgtctatatgtaatctgcagaccttcatgtcttttatataatcattctagagcattattttatactaaaaaaaaaaaaaaaaaaaacacctcggccgcgaccacgctaatcacttagtgaattc

SEQ ID NO: 28999 - DNA, 3902 bp, Triticum aestivum
  unsure (1)..(3902): unsure at all n locations
  Clone ID: PAT_TA_28999
cccaattgggtaacattcattgttggagcattcttgatagtaacagtccctcccttcccccaggtttgcccacttacccagaagttagagcccaatgctttgaaattttnttatttttttttttgtttgccagccaatcccaacctttcacatatncagggaggctttcccagtgtcttgagcccccggtcttgacgttacttgtgcatctcaaaaatacttgatgtaaccctttggagaacagtgatgttccggaacaaacaacatataaccccctgacttggatcgggcgacagcggcgaaggtagtgggatgtagcgaagactgtggttgtcaaggagaaggtcacagatgataatgccccgcctaaggtcgacccaaccaacagagccatgctcccctccgatggtgatccccttgttgcgagaatggaactcaaaatcccggcggcgaatcaaggcgcatcaacttggtgctccatgtctttgtcttggagctgtacaggtggagatgaaagtgcccgtcggtgtaatcccgatcaacgaaggccctgcggagcacggcgatgaagaacatgtcctagtcgcggcggcgcagcaacgcgacctcgtggccgaagaaggtgaagtcggggggcgagtggacgagcttgaccgacggcggagtgttcttggtgccggcctggtagacgaagtagcggatgttcttggcgtactgaactacagcacatgcaactcgcatgcctaacacaggacgggtataaatataagaactaatgtgtgcagaacaaaaaatataattacacaggcgaagccaggaatcatgtacaagaaagcagcagttcaacaggggccgggccttgcagcctagcgtcagcgaaccaatttacaggggtggttggttacctaggctgcaagagcgtgcagaagaatcctcgacggtatctgcaagctcgtttccagaagatgccttggacagagcttccacaaaattgcagcctttggtgacgttagtgcttcagaaggaccgcggtctgagaaaatcactttcaagtatcgcagtaagaacgctttccctccgtttagctttggtcattttggcgattgggctttggctagtatcacttagcagattgtactgccgttttttgcctggcaagtactctctcaaactcggcacaagcttcaggcgagtcttcttcgctgggtggcaccaactgccagaacagtggcagatatgcctcccattcgctcagaattttagcgcctttcgtgctgcctgttttttcaacataggcctcaatcaaacccttgagctgcatctgcccagctggagcattcactctctgcatcttgacaatctccttgttaaccttcgggactagtgtatcatcttcatctaacatgtaggctaggccaccggtcattccggctgcaacgtttcttccaactttgccgagtacaactacacatccaccggtcatgtactcgcagcaatgatctcctgtgccctcaaccactgcttgcccaagagaattccgaactgcaaatctttctcctgtcttgcctctcacaaatacttgaccacccgtagctccatacagacaagtgttcccaactatagcagcatcctcaggaacaaatcctgtatcatctacaggaactacaaccagctctccaccagccataccctttcccacataatcgttggcctctcctactaggcgaacattcatgccaggtgtcagaaaacaaccaaaggactgtcctgcacttccggtgaacgtaatgttcagctggcctgcaaagcctgtatctccgtacttcttagcaatggcacccgctacacggccgcaaacagccctatcaacattataaattggatatgtctttgaaacctctttctcattctcaattgcatcggatacctcaggatctgcaaggattgtctcatcaaggacagggccattagaatggacgtcctggctccttatctgagagctgctccatttgggtaatccagcattcattaataggtatgcaagatcaatgtgctgcgttttcaccaaagagatatgttttggcttaagtaaatctgtccgcccaattatgtcatccagtttctcataacccaactgggctaatgtggctcgtacctcctctgcaacaaagaggaagtagttcacaagatcaccaggaacaccagggaacctagcgcgtagctcttctctctgactagcaactccaactgggcaattgtttgtgtggcaaatgcgtgccatgacacatccggtagctatcatagctacagaaccaaagccatattcatcagcacccatggcagcagccaaaaggacatctaggccactcctgaatccaccatccaccctaagtaccaccctctctctcaatccattttgtatgagtgtctggtgtgtttccgtaagaccaagttcccaaggacccccagcatgcttgattgagctaattgggctagctccagtaccaccatcatgacctgatatctgaatcacgtctgcatttgccttagatactccagaggctacagttccaattcctgcttcagctacaagctttaccgacaccttcgctttaggattgatctgatgtaggtcaaaaattagctgcgccagatcctcaatagaatagatgtcatggtgtggtggtggggatatgagaggaacaccaggtttggagtttctcaaccgagctatgtatgcactgacttttttcccaggaagttgacccccttcaccaggcttagccccttgtgcaatctttatctcaatttgttcagcattaactaaaaatgttggtgtaacaccaaaacgtccagatgcaacctgcttaatggcacttgtggcggtgtccccgttctgaagaccttttagatgagggagtgtcgcagaatacccatcaacaacatctgtaaggggactccagcggattgggtcctcaccaccttctcctgaattagatttcccacctatcctattcattgcaatggcaatagcttcgtgtgtttctctagaaatagcacccaaggacattccacctgtgcaaaaacgctcaacgatagaggttgcaggctcaactttgccaataggaataggcgtccgttcactctttagttctacaagatctcgaagaacattcacaggacggccttgcaagatgttgttggtagatggtaatagccattatcccctttttttcacgaaattggctttgtgcagcaagctttgacatctcaggattatttgcatgaaattcacctccaggtctggattggatgaatccgaagttttccagcctctttgcggtatcttctgagaaagccctcacccagaatgatagtgtttctcggcccagctcattaagggtgagtcctccaattttcgatacactcccacagaacgcaaggtcgacaacttcttggccaagaccatatatttcaaagatctgagctccacagtaacttgagagcaaggatatgcccatttttgagagtatcttgagcaggccagattttactgccttgataaagtttctttgagcctgctcgatggtcactgtgggcatcttgccatttcgcatcaaattgacagttttgttgctcagcctccattgccggcatgtttccaatgccagatatgggcatatagcactggctccatatcctatcaaacaggcaaactgatgggtgctgaaacactgagcagtgtcagcaacaattgaagctgacatgcggaggccattctgaatcaaatgctggtggatggcaccaacagctaaaagtattgggacagcaggccgtgttggttcaagcgcttcagaacgatcggaaagcacaagaagttgagagccactccgcctcgtgcc

SEQ ID NO: 29000 - DNA, 960 bp, Triticum aestivum
  Clone ID: PAT_TA_29000
cgcaaccggcctcgcttaggcgcttgcttctatttaaagggcatggcagcagacaccacagcaacccaaaccccgctaagcatcagcattcagcagcaccagccttctacctcctctgctttgcattccggccttccagttccaattccaaccgcaatcaatggctgccatgaagatcgccctccttgccgtggccgcgatggccgtcttgctaggcaccgcgtcagcggtaacctacaacgtcggcgatcagggcggttggaccctcagcaccgactacagcagctgggtgtccggcaagaagttcaacgtgggtgatgagatcgtcttcaagtactcgaccccaacgcacgacgtggtcgaggtcagcaaggccggctacgactcctgcagcatcgacggcgccatcaacaccttggcctccggcaacgacgtcatcaccctcaacgccaccggcacccggtacttcatctgtggcgtccctaaccattgcagccccaccgccgccgccagcatgaaggtcgtgatcaacgtcgcctcgggctcctcctcgccgtcgtcacccatgccagctgcaggtcctggcgcgagcaactctcccccggcgccgccctccaacgccgctacctccgtcggtgccacagcaggatttggcctcgtcgccctactggcggccggtctcatggcttgaacgcatatattgatcagctgccgcgcgcacatacgagcttttatattgttaactactatactgtagttattatcacgggtgaatacatgtattcttttttagagcgagaatgtgatagttacttgtatctatcacgtctatatgtaatctgcaggccttcatgtctttttatataatgattctagactattattttaaaaaaaaaaaaaaaaaaaaaaaaaactcgagactagacctcggccgcgaccacgctaatcactagtgaattc

SEQ ID NO: 29001 - DNA, 3973 bp, Triticum aestivum
  Clone ID: PAT_TA_29001
cgtccggctttgcccgctcggagctagactcgatcgcatcgcgtcacatccgagggaggcaaaaccctaggcagatccctcccgaagcctaccgcgaccttccgcccccggaggagatgcagggcggcaaccacatgctcctcgaggagcccgtccgcctcgcctccgtcctcgcccccgccaagcccaaagttttcccatccctcactaagattgttgggacgcttgggcccaactcgcactcagtcgaagtgattgaagaatgcctcactgctgggatgtcagttgcgcggtttgatttctcttggaaggatgctacttatcatcaggagaccctcgacaatctgaggaaagcggcacagaatgtgaagaagttatgtcctataatgctggatacagtgggtccagaaattcaggttcacaattcaactggtggagcaatcgagttgataggggggaatcatgtcacaataacaccagatctttctaaagctccttcggctgatatcctaccaattaaatttggcgatcttgcaaaagttgtgaagaagggtgatactcttttcattggtcaatatcttttcacaggaagtgaaacaacatctctatggcttgaagttacggagacttctggtgcagaagtgatttgttacgtgaagaacacagctacactgtcagggcccattttcactctacatgtttcacaagtacatatcagtatgcccactttgagtgaatatgataaacaggtcatatcaacatgggggctgcaaaacagtgttgacattatatcgctttcccatacccgctcttctgaggatgtcagggagcttagagcctttttaaaatctcatgatcttcaagacacacagatatatgcgaaggttgaaaatgctgagggtttggaacattttgatgaaattctccaagaggcagatggtatcatcatatcgcgaggagacctgggaattgacctcccaccagagagggtgttcatgtcccaaaagactggtattcataaatgcaacatggccggcaaacctgtgatcattactagggttgtggacagcatgattgacaatctgcgccctactcgcgcagaagctactgatgttgcaaatgctgtcctagatggaactgatggcattttgctcggtgcggagacacttcgagggcagtatcctgttgatgctgtgcgtactgtgggcagaatatgtgcagaagctgagaccgtgtataaccagtcacttcacttcaagaaagtagtgaggcatgtaggtgaaccaatggcccatgaagaatctgtggcatcatcagcggttcgttctgcaatgaaagtaaaagctgctgcaattgttgtgttcaccttctcggggagagctgctaggttaattgctaaatacagggccccaatgccagttttagcagttgtgttcccacgcgagggctctgatccatcgaagtggcgttcttatggcacgacacaggcgaggcaatgtttttctgtgagaggtgtctaccctttgatggggagtactgacgaggctgaaactggtgggctcaccaaggaagaatacgggataaaacttgcactgaactatggccggtcagtcggcataataaagccatacgacagggtgattatttttgaaaagatcggtgattcttctgttgtcaagatcatcgagtgcgacgattctgaaagatgaatgacccttctcaggcaacagtttcaactatacgcctgagattgcctcctctttttgttctccattcactttgaccagagataaaagagtagtatagcacgacaaggttgccctgtttagcaccttggtattttagatttacatacttgttgccctaataaagtgaagagagcttctcattcactcaaacatccaagttttggacaaaattataggattgttgagataatacctatgagtgattcctagcttgtatttcatgttacatcatacgctatatgacatattatctgctattacctttgcatatactatatcattcgtgtctgtagtccagtactaccatacagcatctttctgttctatcagtattgctccttgaagaagagggcgtagatgatgcagcagatgctgaagatgatgatgccgatgtcgaacgcgagggctgtcatggcctggtcgctgagctccatgttcttcccgccaaggcgatccactgtgtcgggcacgggctcgtagttctggaggtcgagctcgtaggggtcctcgaggcgggacctgagctgctgcagccggcggctctcggcctcctgcgccagcgtccagtcgtagaagcggcggctctcctccttgctcagcaccttgtacacctcccgggagccggatgaacttctccgacgccgacttgagcggcagcctcgtcgtgtccgggtggtactccttggacagccaccggtacgccgccttgatctcctccaagtccgcgccaggcgatattcctaggaactggtagtgtgactcggacgggttgttgatgaggtcggcgaatcgtcgccccatcggctcgtccttgcggccgtcgccttccttgttcgcctttcctcccacccacccttcgtccgggtcagaccagtgtatcctcgtgtccaccgtcttcttcttccctggccctgccgttgacgaggacgacgccgctgtagcctctggggacggctcggcgtccgccgtgctcgccgcgacgacgaaccttgcgcggcgtcggctgcgtgcgtcgtgccgatggaggaaggccgtcaaggggctagacgacgctgtggatgccgccatgaggcggcagccgtctcgtgccgaattcggcacgagctcgtgccgaattcggcacgagtaagcatcagcagcagtgcagcacctcccttctacctcctctgctttgcattcctccttccagctccagccgcaatcaatggccgccatgaagatcaccctcctcgccgtggccgcgatggccgtcttactaggcagcgcgtcagcggtaacctacaacgtcggcgatcagggcggttgggccctcagcaccgactacagcaactgggtgtccggcaagaagttcaacgtgggtgatgacatcgtcttcaagtactcgaccccgacgcacgacgtggtcgaggtcagcaaggccggctacgactcctgcagcaccgacggcgccatcaacaccttaacctccggcaacgacgtcatctccctcaacgccaccggcacccgctacttcatctgtggcgtccctaaccattgcagccccgccgccgccgccagcatgaaggtcgtgatcgacgtcgcctcgggctcctcctcgccgtcgtcacccatgccagctgcaggtcctgggcgcgaggcaactctcccccggcgccgccctccaacgccgctacctccgtcggtgcccacagcaggatttggcctcgtcgccctcctggcggccggtctcatggcttgaacgcatatattgatcagctgccggcgcgcacatacgactttatcttttgttattaactactatactgtagttattatcacgggtgaggaatacatgtattcttttttagagcgagaatgtgatagttacttgtatctatcacgtctatatgtaatctgcaggccttcatgtctttttatataatgattctagactattattttataaaaaaaaaaaaaaaaaactcgagactagttctctcacctgcccgggcggccgctcgacgcccgggcaggtcgcttagcaaatctcagaggaggatagggtgggtcttagcacgatacttacaaaatctacctttttgttgtattgtagtcaccagtcactgatgagtagtactgaatcataactgttgtatatatgtacagagacaaatttatacagaataaagttgctcttggttgagctgtaaaaaaaaaaaaaaactcacctcggccgcgaccacgct

SEQ ID NO: 29002 - DNA, 887 bp, Triticum aestivum
  Clone ID: PAT_TA_29002
ggcacgagcatcaaccagccaaccaacccatcatcatcatcagagctctacgcaagaatcagacacagctttcaacaactagctctagctggccggcatggagctggagctcgggctggcgccgccgaccaacgccggccgcctcctcggcagcgggaagaggggcttcggcgaggcgtttgaggatcaagagcggagggcggcggtggccacgacgctgcccggacgcgtgggcgacggcagcagtagcagcagctgcgacagcggcagcggcggcggcgttggggggagcaagaaggcgctggtggggtggccgccggtgagctccgcgcgcagcagggcgtgcggcaggcacgtgaaggtgtggaaggagggcgcggccatcgggcggaaggtgtacctgcccttccacggctcctacgccgacctcctcgccacgctcgcccgcatgttccccgaccccgccggcgacagggcgggttgcctcggtggtgctgccggcaagggcgagggcgagatggtggtcacgtacgaggacgccgacggcgactggatgctggtcggcgacgtgccgtgggaggatttcgcgcggtcggtgaaacgcctcaagattttgctctgaagaaacaaacagaacggcactgctagactttgagaaatgtttttcttttctcttctgtgagatttcagctatgcaacttcagtggctgctcatgttgcagacatcttgtaatactataaatacttataatatactactacaacatttcctcgtatcattttcccgttttctctcccagaacgtgtaaacatgttgcggctatatgtatgtttttccaaccagaggggccaattcaattctgttatgttcgatcaaaaaaaaaaaa

SEQ ID NO: 29003 - DNA, 1110 bp, Triticum aestivum
  Clone ID: PAT_TA_29003
acggacataccgaaccgaatacccacgcgtccgaaaatacagacgcacgtacaacataagtctgcaaaatgtcagctctagctctagctctagtactgctctgctcggcggcgatcatggtggcgccggcggcggcggacgtggagtcccacagcttccccgtcttcaacgccaccacgaccgagagcctgtgggtcgccacgaacatgtccatcgtcatgcccgcagcgctcctcttcatgcccgagcagccgcttcccgaggtcaacgtttccgaggggtttctgctgctccccaagaggatcgacgtctggcgcgccggcgccggcgcgctgccgacacgcgaggcgtccttcaacacgagcttcacggtggaaagctctgcccctcccgtctcgttcgtcctcctcctcgacaggttcccgacgctcaacaaccccttgggcctccgtggcgctaacgactcgtggacgggcgccgcgcccaacgccacggacggcctcagcgcggtcgaggtcggcacggtgaggtcgtacgcgccagagtctcccaacgtcggcctcaacgtcaccatcgcgcccaacggcaccgcggcgcctggccgccgcgccgtgtgggtcgagtacaacgccgtcgagcacatcctacgcgtgtacgtcgccgccggtggggaaccgaggccagccagagcgctcctcgacgcgcgtctctccctcgctggccaaggcaccacgcaaaccgcgttggttggcttcttcgccgccagagtccgcgatatcttcctcgctgttcgtgattgggacctcacggtggacaggctcgacaccaatggcaagaagaagggaacgccgtggtgggtgatactgatcgcggtgatcgggtccgtggccgccactgccgccatcgtctcgctggtggtgtgctcctttgtatcgaggcgacgggcgcgcgatatggaacccaagcaatagtctatacagacttgtcatgtgcgtgtagacgatctgtgtgcaactctgcaaactactatgtttttatgttactttcaagtttgaaattcaaatttaacgagtgaagagagcgtacggcacttttcttttcctacttaaa

SEQ ID NO: 29004 - DNA, 519 bp, Triticum aestivum
  Clone ID: PAT_TA_29004
cagctccgctggtcgtcggcgccgtatggggcgtcggagatgggattctgaacacgcagttgagtgggttgatcgggcttctcttcgagaacgacaaggaggcggcattcgcgctggggaagatgtggcaggcggcggcgacggcagcggtcttcttcctgagccccggcgccacgctgcagggcatgctcgctgcgctggccgccgcgctggtcgtcgccgtcgcggctttcctgttcctctcactcgtcatcgagaggtcgcacgcgctgaaattctgacgcatgcacggctccgcggctttgtgagttatcatattcataggcgttgaggagacaaactgatagagatgtaaatggaggggaatgtgtagtttttggaaaagaaagcttttttcttttgatctttctcgacaaagggtaaacttttattagcttaaaatggagcatcgttgatctttctcgacaaagggtaaacttttattagctcaaaaaaaaaaaaaaaaaaaacctcgtgccg

SEQ ID NO: 29005 - DNA, 131 bp, Triticum aestivum
  Clone ID: PAT_TA_29005
aaagtcatttataaatacttgtgctacgataatgtatacactataattcctttcacttaaggaaagagtaatcaaataaacttgttttttttaaacctcaagtattcattaaatggattggaggatacatt

SEQ ID NO: 29006 - DNA, 1484 bp, Triticum aestivum
  Clone ID: PAT_TA_29006
cgtccgcgccgccgtcgtggcctcggcgtccgcggcggcggccggcgacgacacttatccggtgcggtgggaggtcgggtacatgacggtggcgccgctcggcgtctcgcagaaggtgattgcaatcaacaaccagttccctgggccactactgaacgtgacaaccaactggaacgtgagggtgaacgtccaaaacaacctggatgagcctctcctcctcacctgggatggcatccagatgaggatgaactcatggcaggacggcgtcgccggcaccaactgcccaatccctcccggatggaactggacctaccagttccagctcaaagaccagatcggaagcttcttctacttcccttctctcggcctccagcgggctgcgggcggctacggccctgtaaccgtcaacaaccgcgccattgtgcccgtccccttcaaccagcctgatggcgacatcaccttgttcatcggagattggtacaccaagagccacacggaactgagggacatgctagatgatggcaaggatcttgggatacctgatgggattctgataaatgcaaagggcccttacagatatgacaccacactggttccagaaggccttcaatatgagattgttggagttgaaccaggcaaaacatatcgcttccgcgttcacaatgttggcacctcaaccagcctgaacttcagaatccagaaccacaacatgcgtctcgtagaggctgaaggaacatacacttatcagcagaattacaccaacctcgacatacatgtcggacagtcgtactctttcttggtgagcatggaccaaaatgcaagcacagactattacattgtggcaagcccgaggtttgtgagcagcgaagctcgctggcacgatgtcaatggtgtagcaatcctgcagtactcaaactccaaaggcagtgcttctggccccctccctgatgctcctgatgacttctacgacaagtactatcccatgatcctggcacggtctatcaggatgcatgcgagttccggtgctgcacgtcccaaccctcactgaccatcaccctccggccagttcaccaccccgccgccagatgccgggtgcgacaaccagccacggcgtgccgagaggacgcgtcgcccgtcgagccacagggtgtcgtactctcctcccgagactccactgaggcttgctgatctccacaaccttacaggggtctacaaaacagactttcccacaatgccaagtaatgcgccacctatggccgcttcatccatgctgaatgctttttacaacggcttcctcgaaatggtcttccagcacaatgaaacggatgttcagacctaccatctggatggttattcattctttgtagtcgggatggactatggtgagtggacgccaaacagtaggggttcatacaacaagtgggatgccatctctcgcagtactacacaggtcttcccaagagggtggactgccgttctggtct

SEQ ID NO: 29007 - DNA, 1143 bp, Triticum aestivum
  unsure (1)..(1143): unsure at all n locations
  Clone ID: PAT_TA_29007
cccgcccggcgcccccccccccccggcccgcacggtgaacgtgcacctggccggcggcaccatcctgccgctgcagcagagcgcgctgacgacgtcgcgcgcgcgccggaccgcgttccacctcctggtcgcgctcgcggaggacggcacggccagcggggaccttttcctggacgacggcgagtcgccggagatgggcggcagaagcgattggagcctggtaaggttacagctgcgcgacggggagcgacgggtccatcaaagtgaggtcggaggtggtgcacaactcgtacgcacagaccaggacgctggtgatcagcaaggtggtgctcatgggccaccggtcgccggcggcgccgaagaagctcaccgtccacgtcaacggcgcggaggtggagccgagctcgccagccggcacacggtaccagaacgcaggaggactcggcggcgtcgcccacatcggcgggctgtccctggtcgtcggggaggagttcgagctgaaggtcgccgtgtcctatttagatttaggcaatttgagatttgggtcataacattaattgaatgcctacttccccgcgggccggtccttctgaatggctgcaattccaaaagcagacaccacggcgtccggtctgcgcgtctccctcccggcgccggccgtctcgcggtgcgcgcccgtcgccgcccgcactgtcctgccgctgctcctgtccgcgctgacgacgtcgcgcgcccgccggaccgcgttccacctcctggtcgcgctcacggaggacggcacggccagtggggaccttttcctggacgacggcgagtcgccggagatgggcggcagaagcgattggagcctggtaaagttcagctgcgcgacagggagcgacggggccatcaaagtgaggtcggaggtggtgcacaactcgtacgcacagagcaggacgctggtgatcagcaaggtggtgctcatgggccaccggtcgccggcggcgccgaagaagctcaccgtccacgtcaacggcgcggaggtggactcgagcgcggaagccggcacacggtaccagaacgcaggaggactcggcggcgtcgccacgtcggcgggctgtcgctggtcgtcggggaggagttcganctgaacgtagccatgtc

SEQ ID NO: 29008 - DNA, 609 bp, Triticum aestivum
  unsure (1)..(609): unsure at all n locations
  Clone ID: PAT_TA_29008
gacaaaacgtaaattagcacttattgcagcagccactgaagaacttggtattggnccgaaaaggtgatttaccttggcgtcttccaagggatttaaaatattttagagatgtgacgaccaagataccaaaaggaaacagtgttcaaaatgtggttattatgggtcgagtcacttgggaatcgattcctcccaaatatcgtcctttagataaccgatttaatattgttgtatcaagaaatcccaactatgatcttcagacaacggatccaaatgcgatacttgttacttcatttgaagaagctcttgaaaaaatcgacgctaccaaaacaaatcctcgtgtatttgtggtgggtggcgcacagctttacagccatgctatcaaacgtgcagattgtactgatattttgctgacaaagatcaaggccaagattgagtgtgacgcattttttccaaagattgatgaacatgtgtatcgacccagtactcacgaggaactagaagcgtatgtagaagaaagtgtaccagaaggaatacagacctataaagatctggagtatgaatttacgtattataaaagaatggtttaaataaaaaatgccatgaatcttt

SEQ ID NO: 29009 - DNA, 797 bp, Triticum aestivum
  Clone ID: PAT_TA_29009
ctttttcaacttactttccttctatttcaaaatgaagttccattttgccactcttttgcttttagctattacctttgttagcactgtgtttgccacttcctctgccgcctctggtttggtcgcacgccatgtcaaataccctgttaaggccaatgatgctttaattgtcaaaatcatggcctccatcgaagcccaattgaacgccaaggtcttggcccagatctctgctagcttttctgaagaaatctctggtcatttggatgtcgatgccaaggttcttggtggtcttgtttctgctgacgttagtgttagtgctgtcgaaaagcttgctatcaaaaaattgaaggctgaacttgaagctgaattgaaggctaaagccaaggttgatgtctatgcctctgttgaagcttatctccgcaagaagtgtggttccaagagacttactgaaaagaaactcttgcagatcatcgctgatgttgaagccaaggctattgaaactcttaaagttgaactccctaaaattggtgccgacttgaagcttaactccaaggctcaggtcgatattattctcaagaaggtctcggttaacattcctctcattgctagcatcaacgtcaagggtgcttttgatataaaggccgctattagtgcttgtgttaaggtcggtgtcaaggtctgtgccaagttgagtgccaccgaaagcgctaaggttatccttaaggctctttaaatcaacttgtatcattatagatttatctattacattttaattaataaaccgtctgttttcttcatgt

SEQ ID NO: 29010 - DNA, 1008 bp, Triticum aestivum
  Clone ID: PAT_TA_29010
tattaaagatatgacagaggttattgaaggggatgtggactcgattatagcacgtctcttagaagtaagaggaagtcgacctggtaaacaagttcaattattggaaaatgaaattcgatacctttgtcaaaaatcacgcgagatattcatgaaccaacctattctattagacttggaagcacctattaaagtatgtggtgatattcatggtcaatattatgaccttttaagattatttgaatacggagggtttcctcctgacgccaactatttatttatgggtgattatgtggatagaggaaaacaatccttggaaactatttgcttattattggcttacaagattaaataccctgaaaacttttttattttgcgaggtaatcatgaatcagcaagtattaatcgtatctatggcttttatgatgaatgtaaaagaagatataatattaaactctggaagacttttacggattgttttaattgcttacctatcgctgctgttattgatgaaaagatcctttgtatgcacggtggtctctcacccgatttacagtccatggaacaaatacgaagggtgatgcgtccaactgatatacctgatactggtttactctgtgacttgctctggtctgatcctgataaagatatcgtaggttggagtggtaatgaccgtggtatctcttttacttttggtgcggatatcgtttccaagtttctgcaaaaacacgacttggatctcatctgtcgtgctcatcaagttgttgaagatggttatgaattctttgcaaagagacaactagtcaccttattctctgctccgaattactgtggtgaatttgataatgcgggtgctatgatgagtgtagatgaatcattaatgtgttcttttcagattttaaaaccagctgagaagaaagcaaaaacaggattgaacaataaacaacgaaacaccagaggaagagtgatgtaaaatacattgattgcatgaataaaactattgtttgcatt

SEQ ID NO: 29011 - DNA, 918 bp, Triticum aestivum
  Clone ID: PAT_TA_29011
gagcgagccatcagcgcgtgctcatgcgtgtcgtgcgtgggtcgtgcacggttgcacgacacgacgtggtaggatcgacatgcccataacctacccatgccgctcgtacctagctactacttctactgaaaaaacgtatgtggactgtaccgggttaacaacatgcttgcgtttctcgctacctacgcgggggattaactgggccagctgtggtgcgctagtgtagtctaaaattatgagtgacgactatgactttatttaaggttgtattgattggtgattcaggtgttggtaaaacaaacctcttgggtcgatttactcgtaacgagttcaatcttgagtcaaaaatattggtgtagagtttgctactcgtagtattcaagtagataacaaggtcatcaaggctcagatttgggatacagctggtcaagaaagatacagagccattactagcgcatattatcgtggtgcagtaggtgctttattatgttatgatatctctaagcattccacatttgaaagtgtcagtcgctggttaaaagagttacgtgaccatgcagactcaaatatcgttattatgcttgttggcaataagagtgatttgagacatttacgtgctgtcccaactgatgaagcaaaacagtttgcctctgaaaatggtttatcatttattgaaacttctgctttggatgcaactaatgttgagttatcatttcaaagaatcttaacagaaatccctcgtatcgtttccaacaaagccttagaaacttccaacaacgccatccaaccaactggagggccaactattttgggatcgccatcccctgatgaacccaagccccgtggtggttgttgctaagtagccccgaatatgtatagaaattgattatgttttaataaatgtatggtttaactatg

SEQ ID NO: 29012 - DNA, 437 bp, Triticum aestivum
  Clone ID: PAT_TA_29012
aatgaactctcttcgtaaattgacaacgcccactacacaaattattcgctctttccacgctgcttatcctcgtttcactggaaagacggttgaagctaacacaaaaacttttgatgaacttgtcagaaaggccgatcaccctgttattgttgacttttatgcagactggtgtgggccctgtagagtattgacacctttattatctaaaactgttgctgccaacccccaagtgacattagttaaactcaacgtagacgattgtccagaaattgctggtgaattcaaggttgccgcattacccactgtttctgccttttatgaaggaaaagtcgtagatacttttgttggagctcaaccagctaaagtagcctcttttattgaaaagcatgctgagcttgccaaaaaataaaaactgtttattatacattgtgtctatt

SEQ ID NO: 29013 - DNA, 306 bp, Triticum aestivum
  Clone ID: PAT_TA_29013
aaacgcaggaaaaagtgagcgagtgggagacatcaggaagcgacggagtctcagctgtgtgtacatgttgtagggtaggagctcctgggtcttttgattccagtgttgtaggaaatggcgcgatggatgggttctactagtagttttccttttggacggggggtgtacgaaactgacttggcgcgcgtctctccgctcgtgggactcggggaaacagtgttccccttcgaactgttgtcctgtatgttttggactagaatttggaagatttatatactaaaagcacaccggtggtacttgaacttg

SEQ ID NO: 29014 - DNA, 1171 bp, Triticum aestivum
  Clone ID: PAT_TA_29014
tcgacggcggaatgcggtggacttcctgaagcggatgaagcagaactcagtgccgtcaacggagagagtgtcgttgctagagacactgaaactctctgcgacagaacagaagaaggctgccaaggctgatggccggaaagagccgggcagctcctccggctccaagaaggctgccgagacagcgtcaggagggaggagaagcgttggccggccgccgaaacgggccgctgcgcctccgacgcctccaccatccaagagggcgaaggacgaccggccgacgaggaagcgcgggaaaaagtgagcgagtgggagacatcaggaagcgacggagtctcagctgtgtgtacatgttgtagggtaggggcccgggcggcttttgatgccactcacaatcacactcttccatcacaacatctaaacaactatcactttctcaatttgatctttcagatctcaacaaaatcatcaaaatgaaggcctctatcgtcctcgctcttcctgccctcgccatcgcggctgccactcctccaactgtcgagccaaggcagctccctgttcctcttcctcttcctcttgacacccaatgccttcgcaacattcccgacatcaccagatgtcttacaaaccttggaacagttaccggtaacccctttgttatcgctgacatccttgcctgtactgcgactcttcctctagaggtcgttaatgctctggtgaccgctgctacccaatgcattcgccttccccttcctggtctcccccgcaaggaatagatccagacccctatattcacttcttggaggattgggttacagattcggtcacatttcacactactcgccttgtcctgctagcggatacctaaatttacactcttttgaggcgaaaaaaaaaaaaaaaaaaggcccctaggtcttttgattccagtgttgtaggaaatggcgcgatggatgggttctagtagtttttcttttggacggggggtgtacgaaactgacttggcgcgcgtctctccgctcgtgggactcggggaaacagtgttccccttcgaactgttgtcctgtatgttttggactagaatttggaagatttatatactgaaaatgcactggcggtacttgaacttgaaaagaaaaatatcaacaaaacctaaaaaaaaaaacgcggccgc

SEQ ID NO: 29015 - DNA, 971 bp, Triticum aestivum
  Clone ID: PAT_TA_29015
ggggcgacggcagcttcaggtacgaagacgccaacaacctgccgccggcggtggactggcggcagaagggcgccgtcaccggcatcaaggaccaagggcagtgcgggagctgctgggcgttctcgacgatcgtggctgtggagggcatcaacaagatcaggacggggaagctggtgtcgctgtcggagcaggagctcatggactgcgacaacgtcaacaaccagggctgcgacggcggcctcatggactacgccttccagttcatccacaagaagcgggatccaccaccgagtccaactacccgggtacgggcgagcagggcagctgcgaccaggcaaaggaaaaggctcatgccgtgacgatcgacggctacgaggatgtccccgccaacgacgagtctgccctacagaaagccgtcgccggccagcccgtgtccgtggcaatagacgccagcggcaacgacttccagttctactcagagggcgtcttcaccggagaatgcagcacggatctcgaccacggcgtcgccgccgtcgggtacggcactaccagggatggcaccaaatactggatcgtcaagaactcgtggggagaggactggggtgagaagggctacatcaggatgcagcgcggggtgtcgcaggcagaggggcagtgtggcatcgccatgcaggcgtcgtacccaactaagtcggcaccacatgctagggcagtcagggaagggtctcatactgatgagctctgatggcacacatacgatcattcggagtgcaacctctgcgttgaggagaactgaatctcccactgttgtgttatttactttatgcaagatgttaccatagaatgtaataaacgtaagcaaaggacattatagcaaaagaattgcaactaatttgtcaaatcaaatgaattaagtgaaattcaagattgggttgtattcggattggtaaaaaaataaaaaaaaaaaaaaa

SEQ ID NO: 29016 - DNA, 727 bp, Triticum aestivum
  Clone ID: PAT_TA_29016
ggggcaccgcccaatcgacctgaaacgcactgatggtacacacgggccatcgaaccatgcacatactcaacggctgaatgggaggagttcaccgaggaatcgaccagaaacgctctgatggaacacacagcgaccccagagttcgcccaatgggctgctgacaatgctcaccggttgcgggtggagcgggacgacgtgtccgaggacgagtcgatcgagagctactctagctcttccgaagaagccgagaaaggcggaaaagcttctcgtctgttgagcaggtttatgtgatatcgtcaccggctaaaactgtagggagctcgacgtgctgcttttgcggacgatgtgtataaggtaggattggaaacttggtagcggtagggggtggaagttcatcgtttccacatggttcgccattgcagcagaatgcttggtgactgtaggcggtagttggttggttaaccatcatccatctcaattcaactaatgttaggtttagctggcagtctgccatccatggatctttagatttttagtcgatgcatcaggggatgtggaccggtgtcggttctgcaaccattcgatggattagggacagtcgatcctgttggggtcttgtcattgtcttgttgaacatctcctgtttcattctcaggtgtgtgagagtagcatttcaaggatctttatctcttgttagctgggcatgtactatgtgagagttatgcag

SEQ ID NO: 29017 - DNA, 731 bp, Triticum aestivum
  Clone ID: PAT_TA_29017
cgtcgcgcggcaacatgaccaccacgttcgcccagcggttcagcttcgcgaactctaacgtggtgagcaacaagggcagctcgcaggtgatcaaccagaccaccgacgctcacgccgacgtcggcggcggggcgtacgcgcagtaggtgcaccagagcttcccgctctacatcttccagggcggtgacggcagcggcacctcctcgcagcggctgaagcggcgcgtggagatcgggttcgtggagtcctgcgcgggcgccggcggggcggggacgagcacgctgcggaacgagcaggtggcggaggcggaggtggtgctccgggacgaccaggtggccggcgcgtcgtggcggatgcaccaggtgtacaactacggcgccagcaacggcggctgctacttgaggaacgtgaccagcgtcggctacgacgtgcttttcgaccataatgtggcgtcgtgcaccgggacgcgccgacgttgacgcctgtcggccggcgcccgcctacgtggcgcgcgcgcgtagatgggggataacggccaggaagggacctggtgtaaactgtaatgggaacagaagtgggcccaaatagtttcgtactactatagtctttgcgttatgatgggtcgtctcgtgtccttagctctaaataagaaaggagtgatgtgatgtagtatatcagtatatatatatgtaaccaaaatacaaaggcgaaaaaaaaaaaaaaaaaaaaaa

SEQ ID NO: 29018 - DNA, 1710 bp, Triticum aestivum
  Clone ID: PAT_TA_29018
cccccgggggccgcgccggcccgcgggctgggctcccgagcagatcgccgtcgcgctctccgccgctcccacctccgcctgggtctcctggatcacaggggatttccagatgggcggcgccgtcaagccgctggatcccggcacggtcggcagcgtcgtgcgctacggcctcgccgccgattctttggtccgcgaggccaccggcgacgcgctcgtgtacagccagctctaccccttcgagggcctccagaactacacctccggcatcatccaccacgtccgcctccaagggcttgagcctgggacgaagtactactaccagtgcggcgacccatccatcccgggggcgatgagcgccgtccacgcgttccggacgatgccggccgtcgggccgcggagctacccggggaggatcgccgtggtcggggacctcgggctcacgtacaacaccacctcgaccgtggagcacatggcgagcaaccagcccgacctggtcctcctcctcggcgacgtgagctacgccaacctgtacctgaccaacggcaccggaacggactgctactcctgctcgttcgccaagtccacgcccatccacgagacgtaccagccgcgctgggattactgggggaggtacatggagcccgtgacgtcgggcacgccgatgatggtggtcgaagggaaccatgagatcgagcagcagatcggcaacaagacgttcgcggcctacagcgcgcggttcgcgttcccgtcgacggagagcgagtccttctcccccttctactactcgttcgacgctggcggcatccatttcatcatgctcgctgcctacgctgactacagcaaatcaggggagcagtacagatggctggagaaggacctggcaaaggtggacagatcggtgaccccgtggctggtcgccgggtggcacgcgccatggtacagcacctacaaggctcactacagggaggcggagtgcatgagagtggccatggaggagctgctctactcctacggcctcgacatcgccttcaccggccatgtgcacgcgtacgagcgctccaaccgggtgttcaactacacgctggacccgtgcggcgccgtgcacatctcggtgggcgacggcgggaaccgcgagaagatggccaccacccacgccgacgagccagggcgctgcccggagccactgtccacgcctgacgccttcatgggcggcttctgcgccttcaacttcacgtccgaccccgccgccggcagcttctgctgggaccggcagccggactacagcgcctaccgggagagcagcttcggccacggcattctcgaggtgaagaatgagacgcacgctctgtggaaatggcacaggaaccaggatctgtatcaaggtgctgtcggagatgagatttatatcgtccgggagccggaaagatgcctgctcaaatccagcatagcggcatacttttgatctaacactagccaaatcaaacttcacgtgtataatgttccctgctcttggtagtactagcagctggtaggtactttgacctgtggtccaagcgaactctctattctttcacgagctctctgcgagctctgacgagattaagataggttgagatttgtggggtagcatgaaagacttgtgatctagtatcagtctatacactgtgaaaaaaaatgcgcgttcatttttaagaaaaaaaaaaaaaaaaa

SEQ ID NO: 29019 - DNA, 1097 bp, Triticum aestivum
  Clone ID: PAT_TA_29019
aactcacctacagccagctgagaagaacgacttgcaagttgtaaccacctctagtcggtagacacgcacctcgtcgccggagacaggaactgatggcggctgccatgagctacgtgcatgccgacgtggagaacctcaaggcgacggagctgaggctcggcctgccgggcgtcgaggagagcgacaagatgccgtcgccgccgtccactcccagggccggcaccaagcgcgcgctcgccggggagcaccgcgaggaggagcccaaggccgcgcccccggccgccaaggcgcaggtggttgggtggccgcccgtgaggtcctacaggaagagctgcttccagcaggcgagcagcaagaccaaggaggccgcgccggcacctgtggtggtgaagcaggaggaggctgccgttgccgcggcgccgcccgccgccgcagccgcgggcggatcactgtacgtgaaggtgagcatggacggagccccctacctgaggaagatcgacctcaagatgtacaagggctaccgcgagctcagggaggccctggaggccatgttcctcggcttctccggcgacgcaggcagcgtgaacccgtcggacttcgccgtgacctacgaggacaaggacggcgacctcatgctcgtcggcgacgtgcccttcgggatgttcatgagcacttgcaagaggatgaggatcatgaagggatccgaagcaagaggcctaggatcatcaaaggagtgaaactggaatccatctacgaagaacacgcaacatgccatgggtgcatgtgtgcaacatggaggaattcttttgttcttttgggcatgttgtcgactcatctaccacagtgctactcttcaaggcaaagacgcaagctgattcgagtggagttttatttttattttgttttttaaaataggtgttagcaacacaaaaggagtggagatccgttcgagttgaatcggatctccatgtgtgtttgtacaaagaaaacagctttctttccgtgttaagccatgtcaatggttggttgatgtctcccttgagtttggttatatcaaaggttgcaagaaaatttcatccggtggcaaaaaaaaaaaa

SEQ ID NO: 29020 - DNA, 2137 bp, Triticum aestivum
  Clone ID: PAT_TA_29020
tctgccctggccgcgctggccctccgtggcctatggcagctgtggccggtccagtggtccttggctgcgaccttcctgggcccgtacatggcggtccgatgggcgcgtctcccttggtcctgttggaggtcccctctcgcgcttcctcgcccctgcctgctcgagcgggcggcatgactgtctctacggccggtgctggcggcgcttccgtcgccctctcctggctgggtcttgccaatacccggttgcctacgtctcctcccccgttgggcctgtccgcccgacccagaaatcccagaaacaggagcgcaggaaaattcatgagattatcagactttctggcttttgcaagccatctacaaatcagacatatggctcaatgctgaaaaatctatcatccatcaagacttttgcttctggaatacttgttcccaaacactatatctgctgttgatgactctggttacagcaaacagagcgcccagaaagtgatgatccagtcaacaaacagctcaacgctggtgaagttgaagcatctggccaagtataaccttgtgtacaagatcgacgaagtcgtgaaagacgcggctccttcctccctcgcagacatgaaaaagtttgcggacgctgcttctgtcagcatcaagtccgtttacccagagtcgagtaatttcctgataaaccagacgaatcctctcgtcaagtccctgcagtctgctggccttccagtctatgtgtacctgctgaggaacgagttcttttctcaaccgtatgacttcttctcagacgccacgtcacagatcaatgcccttgtgcacaaagggggagaaggaggcggagtggatggactcatcaccgatttcccggggacggctcacagatacaaattgaactcgtgcaggaacatgggggacaagacgccctactacatgctgcctccccagcgcggcggcctggttggggtcatacaggataaagcagcattgccaccagcaatggccccagagccggtgttgactgtctccgacgtggcggagccgccccttcctccggtgaggaacacccaagctccaacgcgattccacggctccggcgaagtctccgtctcgatcccgatcactgctgcggtgcgagcgcgcttcattcattgcagagaaacttgggtttggtgtggtagatgcagtgatcaaagctgtcgatgattccggttacagcaaacagcaccgccaagaaagtgatgatccagtcaacaaacagctcaactctggtgaagttcaagcagctggccaagtataaccttgtgtacaagatcgacgaagtcgtgaaagacgccgcgccttcctccctcgcagacatcaaaaagtttgcggatgctgtttctgtcagcaccaagtccgtttacccagagtcgagcaatttcctgataaaccagacgaaccctctcgtcaagtccctgcagtctgctggtcttccagtctatgtgtatctgctgaggaacgagttcttttctcaaccgtacgacttcttctcagacgccacgtcacagatcaacgcccttgtgcacaaagggggagagggaggcggagtggatggactcatcaccgatttccccgggacggctcacagatacaaattgaactcgtgcaggaacatgggggacaagacgccctactacatgctgcctccccagcgcggcggcctccttggggtcatacaggataaagcagcattgccaccagcaatggccccagagccggtgttgactgtctccgacgtggcggagccgccccttcctcctgtgagcaacaccacagctccagcgccctcccacgccgccgtcgatgtctccgtctcgatcccgatcactgtggcggtgctagtgctatgcgcttctctgcttatctgaggaccactaagtcattcttttaatgccacccgttctattctatgtagcgagcgattcgtttttccttttgctttgggtctcatttggggtggtggatgttgaggttaaatgatgattcatgcctggatggtggcacttacttatgtccctagttaaaacaacattctggtaaataccactctatgattgttaaagaggagaagtgatgcattcagtcccaaaaaaaaaaaa

SEQ ID NO: 29021 - DNA, 2050 bp, Triticum aestivum
  Clone ID: PAT_TA_29021
cgtccggcgcatctcctcgagagctcgcactgatccttgtgtcacccggtaaagggagtaggagagggggctcttggcttcgggactagttcttggctaagatcttctctctctctctctctccctccctcctttcctctccctccagttgataccttcactacgctagcagtagccgagtcttcttcgccgtcgtggtcgcaatggctgggggcctcttcgacatgtctcacccggcgacgcgccctcgccgggcatcgcaggaaacatcgtctccttcttcgctgttcctcgcgcccaatggcggacgtttcctgcaagatctagaggaacgaagacgacggggcgggcttcacgctcgggtgcggtacgtcggtgggcgctcttcactctgctcgcttcttatcttctacgctccccccctcctcccactctcccctcctcctctccttcaccatcgtgcccctcccccaccgcggcgcccctctctcctcgcctcacctcgccctgcgccgcggccccggggcccgcctccgcacgcgcgtgcgcccccgcggggtcgcagttgctcgagaggctcgcactgatccttgtgtcaccgggaaagggagtaggagaggggactcttggctccgggacactagttcttggctaagatcttctccctccctcctttcctctccctccagctgataccttcactagctagcagtagccgagtcttcttcgccgtcgtcgtcgcaatggctgggggcctcttcgacatgtctcacccggcgagcgccctcgccggcatcgcaggaaacatcgtctccttcttcgtgttcctcgcgccaatggcgacgttcctgcagatctacaggaagaagacgacgggcgggttcagctcggtgccgtacgtggtggcgctcttcagctgctcgctgctcatcttctacgcgctgctcaagaccgactcccccctcctgctcaccatcaacagcttcggctgctgcatcgagaccgtctacatcgtcgcctacctcgtctacgcgccgccccgcgccaggctcaggacgctcgcctacttcttcgtcctcgacgtcgccgccttcggcctcgtcctcgtcgtcaccatgtacgccttcgcgccggcccaccacgcggtcaagttcctcggcagcgtctgcctcgcattctccatggccgtcttcgtcgcgccgctctccatcatcgtcaaggtgatcaagaccaagagcgtggagttcctgcccgtcggcctctccttctgcctcgtcctcagcgccgtcgcgtggttctgctacggcctcttcaccaaggacccattcgtcatgtacccgaacgtgggcggcttcttcttcagctgcgtccagattgggctctactgctggtaccgcaagcccagcaacgccgtgctgcccactactaccgccgacgccggcaacggcaatggcggctccgcagaccagccgcaggtgcaggtgatcgagctgcccgtgcactccgtcgccatcctgtccgtgggccccgtcccgatcctcggcgtgcacaagatcgaggtcatcgcggcagagcagcagaccgtcatcgacgtcaaggacgccgccagggctgccgaggtcgaccagccggaggtcatcgagatcgtccccgcccccgccgtgtgagacagacttccacccccaccccaccccaccaacatcgacgacgacacacgacacgagcatgcatgacacgccacacggcatgcatggagatggagaactgatgggtttggttaattaagtagttaattattactgagtagtatcatcgtactgcagggtgcgcgcgcgtgtggattacttactttagttaatttattattactggattgtactgcgtggcgttagttaaattattaccttcaggtgtgtgcctcgatctctcttaatcagtagtagtccgcgttggtgcggtgacaataataaaacacgacctactacttgtgcatgttgtgatgcatgcatgtgtactggtcattcatgctgtaaaaaaaaaaaaaaaaaaa

SEQ ID NO: 29022 - DNA, 877 bp, Triticum aestivum
  Clone ID: PAT_TA_29022
atttttaccgactacttcaattactatcttccaaaaatgggaaccagcttggaaagtatttgttatgaaaaggagttcgctagtaaggaaaaggtggggaggcttgaaagggaggctgtatcaagcctgtttcgtccccctactgctaatcagtcatggaggaaagttttgagcatgggaaatcttttgaacggacatgaacctgtacaaagagagatcgtattctcagttctggcaaacctattgtacggtcactattgttgactaactccgttatgtatagatgaacgtgttgagacacattacatgtatatatctggcacgtctaatgatctctgggttgctttatctgtgacatcctgggactgagatgttcatcagacacatgaagaacaatcataggagttagccggatgtgttgatattgcagatctatcaattcctgggttgaaggttgagtgtacaagaaaagcgatcctttggcatgagaataatggtggcggctgaatcgcaaagccagtgttacgagaaaattgaagtgtcaagtgtcaacttgttatccatgaaaaacagtgtgatctgcatgaggtggcaagcaattggatcgtccagcgactgggattaagaagcctggaccatttttcctgatgacaaagttgtagcttttgtgcttgtgggcatctggagatatgcaggctgccaagctcccatgtgatatgatgatttacagttgcgtgcatgaaccgtttgtgcaaggtcttgtacagattgttttgtttactcaccctcagtggagtagttaactgtggtttcaagtattacaccccctccactgagggtgatggcactttgtcctttttttagttgcattatatcc

SEQ ID NO: 29023 - DNA, 829 bp, Triticum aestivum
  Clone ID: PAT_TA_29023
gttgttgttgttgttgttgttgttgttgttgttgttgttgttgttggtcaaatgaagctggccttacaagaattaaaggacaaatataatccagacagaattatcattgaaacaagtggttcagcctttcctgcgcctattgcatggcaaatcagagaaatggaagcagagggattcatgttggattctattatcactgtagtagactgtgagaactttagtggttatgaagatacgagttatacagccaaattacaagctcagtatactgatgttattttactcaacaagtatgaattagtgaatgagcgccaattggactctgtattggatgccattaatgttttgaatacggatacacccaaagtaaagtgtgacaaggaaggtgtctctcccgatcttgtttttggactggacacagaactttttaaagtgggatacagcaagagcaacacattagaagcaatggtatttgacccacatcatcaaaaaaatgaagtggatctgattcaaattactcaagacattaataacaatggattgacaattgagagtttagagacctttttgaaatcaatgcctaaagacgatatttaccgtatcaagggattcgttcgactaaatgacagtcaattgatcattgtgaaccatgcctttggtcgcttttctatcaccccagttgagaatgaagaaacattggagaatacaaaaaatgttcaagtaaagatcactgtcatgggccaggatctaagaatgtatacagagagggtcaaaggtttactgaacggtcaagacggtgaagtcaggttaactaaggctcatcgtcatt

SEQ ID NO: 29024 - DNA, 991 bp, Triticum aestivum
  Clone ID: PAT_TA_29024
ctctccggcctcgccccgcgccgctgctcgcgcggggagagagagagagagagagacggacgacgcggagatcgatcgggcgaaggccgccgccgcatcggagcacgcgcgtgcgcgacgacgtccccgcctcgctcggcccgggagttagggcgcgatggcggcgccgccggccagggctcgggccgactacgactacctcatcaagctcctcctcatcggcgacagcggtgttggaaaaagttgtctgctcctacggttctcagatggctccttcaccactagcttcatcacaactattggtatcgacttcaagataaggactgttgagttggatggcaaacggatcaagttgcagatctgggatactgctggccaagaacgctttcggactataactactgcctactacaggggagcgatgggcattttacttgtttatgatgtcacggatgaggcgtcattcaataacataagaaattggatcaaaaacattgaacagcatgcttcagataacgtgagcaaaattttggtggggaacaaagcggatatggatgaaagcaaaagggctgttcccacttcaaagggccaggccctggccgatgaatatggcattcagttctttgaagcgagtgcaaagacaaacatgaatgtcgagcaggttttcttctctatagcaagagacatcaaacagagactctcggaggctgattccaaggctgagggggggactatcaagatcaacacggagggtgatgccagtgcagcagcaggacagaagtcggcttgctgtgggtcttgaaccgtcgtcgtcgctacggggaaaaaagatggttgcgacacggtgcttgtaattcttgtcattccattctttgcctgctggtttcgttgtgttaatttaagttatcgctgttgttaggatttgggcaaatttggtgttgagtcagagcaattactttgcagtatcggtggaatttttttgttttttttg

SEQ ID NO: 29025 - DNA, 832 bp, Triticum aestivum
  Clone ID: PAT_TA_29025
cagatatcgaggtagtccatataattgatgatgaaccaaagcctagcacaccgatggaggtggatattgtgagaacaaaccctcaaggaaacggcgataagtggttctccatcccagcccatcagttggagctttctctcagaagatctgactatggcagatcagaggaccaagagaaaaatgatacgagaaccctgaaccactcaacttcatctgccttttcattgtacaactgcaggcctatatcctcttttggtaacgctggtgatgctcagccatgcagcacctcagcaacacacgcagatctgcaaaacaaaaatggagattcggcagctccctttcaagacaaggccgacccaatttgccatcctatcagagttgtagcacttcccgttcctgttggaggcctcacgtttgacgggcaaccattctggagtggtgcacctgtggcaccccttctctatccacagtcaggtcctcctatttggaacggcagaactccagtgtcgcaagaggtggacacgcaagcaacttcatcgcagcagagtgatcccacagagatggactgtcagcagactgaaagcacacagcgacaagaagtgctaccttcaccgactgcaaatgaaaagcatctgcacgttgaaatcccctcagacagcaaccctcagcaggtttcacccatggccagcgaaagcggaaccggaagtagtacctgcccggccgcccctcgaaatgctctcagtggaagtgcctgtggaagctcttccaaccggatcgccacccctaccgaacagtgtaacgcatctgacggtgctactgaaaatccaagcat

SEQ ID NO: 29026 - DNA, 1347 bp, Triticum aestivum
  Clone ID: PAT_TA_29026
aagaacttaacaggaacggcgtcaggttccacctccagctataaattcaggcagcctcgccgcacagaagtcaccttggaatctcttggatatccaccgaaaaagatgttaagatgaagtcttcgatggtagtgggtcggtgctgggaacaagaaacggcagcatgagaaaattagcggaaggaaaatggccacttaaactgaggccctctgtcgtggatatcctactgaatttgcatcttatttccattactcgcgcgcactgcgctttgaagacgcgccagattatcagtatctccagagattgttcagtagacctttttattcggaaaggagttgcaatttgattatgtttttgagtgtgacgattctcaaggtatcaacagtcacagatgaccagtgctccaccgcgcgccatggctgcggcagcagggacaaggctctggagatggctcccattggcaaataggcattcagccgctgtagaagggaggaggaggcggtgctcagatggggatgccatgctccgcttggttacacctccagctataaatgcaggcagcctggccaaccagaagtcgccaatcagacatgaccaatccacctcaaaagatgctatgttctccagttcgactttgctgggacggtcaagcgggtcctcaaggcgacctgctgtctctagcagccgggagccgagcacggacgcggagcagacgcgcagccgcacgactgacgcgagcccaggggcgttccagcggtcgtccgccccgcggtggagcccgcaggttggcgactcgtcggacacgaggggccggtcgtcctcgggcaggcaccagtcgtcgagcgccaagaactacgagtccacggtgcggggcatccagggcctcaacttcgacggcgacgacaccaggaaccactactaggccccgagacggaggaggccgggcaaataagaggtgtggtctggcggggatgtctcagccaggcagcggctaccacgggcgggcgtgccatggtcttctttaacgaatgaatggatggaaatggaatgaacgaatggtgtttgatgacggcggtgggttgcttggccgttttaatttgtacagtttgtttctcccctttgttgtggtcgcttgcggcgtgggtaattttagtcccttgatgaagatggatgatgttctatttcggagagatgtatgcaggccggcgtggcataacgccgctcgtttggaatccgttggttttaaattaaaatggccgaatgcctgcgaatatataaaacaaaaaaaaaaaaaaaaaaaaaaaaaaaaaaaaaaaaaaagaaaaaaaaaaaaaaaaaaggccccta

SEQ ID NO: 29027 - DNA, 834 bp, Triticum aestivum
  Clone ID: PAT_TA_29027
ccccgcgtccgccagtaatgagtgacatctcgactggattagctaatttagtttgtataggcttcactgttatttatgtcattggcttttatgtattcaaaacatctggatcgcgcaatcatccttcagtcattcgagcgcgtatgaaagcagtaacagtggcttctgtcttatcaattctaatcgtaaagtcacttactcctcttgacttaatcaccacacttggacttacgccagtatttggtatctttaagcccttattgttgtccgtcttgttgttcctgggacctttgtcaattctttattttgatcgtgaacttccctttcaagaaaactttgatctgcaaagagatgtcgttgaaagcttcacaaaacctttgggacaacgcaattattttgtggcaccatttacagaagaacttgtttttagagcttgtatgattgcagtgctttatcaagcaaattattctaaaaattatttaatatttgtatctccactctattttggtatagcccacctacatcatgcttgggaaaactatcatgcattaggaaagccaagggaaggattgatacaagtgatatgtggatcgttgtttcagtttacgtatacaactatctttggttggtatgccagctatttattcataaagaccggtaatctatggccacctgttctttgtcattcattttgtaaaaaaatgggattccctgattttagtagaataacgtataataaacaagtcattttagcttgtttcccaatcggtgtcattctgtttatttgcctgtttaatccactaacagacattggtgtaaaatcagtatattttt

SEQ ID NO: 29028 - DNA, 1133 bp, Triticum aestivum
  Clone ID: PAT_TA_29028
cagcgtgcgtactacttttcaaacgagtacctggtggatttgttctcaaaatgtggatttactcttgaggaaatttgtgtacacaacaaaaaggttgagaaccgttcactagacttggtgatgaacaggaattggatccaagctacctttacccttaatccagctggtcctctaagtccaaataatcaacatgaccacaatacttgtgaaggaaaggatgataagctagctgttgacatgtctcagaagaagagcgaaagtgaagaaattgacctttctgtggattttagcaatatgttcggaacgtcgcactatcttaatgaggcacaaattattaggattaaagcaaagggtcatgacttcaaaataaaaatgctcgcgaaagaataccagcacacctgcaaatcaactggactaatgctctgggaatcagctcagttcatgtgcagtcttctagcggagaatccttccatagtcgctggcaaaagggtgctggaaatgggctgtggttcagctggcatctgctcaatggttgctgccagttctgctcagtttgttgtagccaccgacggggatgcagaatcgctcgatcttctcagacagaacacttcctcaaatttggaggctgaacttctcaacagaatttcaattaggaagttattctggggtgacgaagatgacgtgaaggcagtccgagagctttctggtgatggtgcaggcttcgattgcataataggcaccgacgtgacctacaaccctgatgctacacttcctctcttcaagactgctagggcactgatttctgacggtggcgatgctggttcaaaggcagcccttattctttgctacatccagcgtcgtgtcgacgaggattcggtcctctcagccgcagaggcccagggcttcaggctcgtggacaaatggataaatggagggcacgcgtgcatcggtctctggtcctcgtggtcccgcggccttcccgtgtgcggtcctttcccgtgtggtacgctggccttctcgccctgggacgcgggtgtcactggtgtttacctgcatctcatggttaacttgcaggttttgttttaccttcctgcattggtgtaccgaagaatgtttttgtatactaaaaggaa

SEQ ID NO: 29029 - DNA, 517 bp, Triticum aestivum
  unsure (1)..(517): unsure at all n locations
  Clone ID: PAT_TA_29029
gtgatcaacgcgtctcaggagatcatcatccagagcgacaagcgggtcgaccggcgcggggcgcaggtgcacgtggccaacggcggtgggctcaccatccagcaccagaacaacgtcatcatcaacaacctccacgtgcacggcatcgtacacacgtcgggcggcaacgtgtcgatgacggcaacccactccacgatccgtacccgcgccgacggcgacggcgtctccatcttcaacgccaccaaagtgtgggtggaccacctgtccatggataattgcgaggacggcatgatcgacgtggtggccatgtccacggccgtcaccgtctccaacacccacctggcccaccacaacgacgtgatgctcttcggcgccaccgatgggaaggaggaggacaaggtgatgcaggtcaccgtcgccttcaaccacttcgggaggggcctggtgcagaggatgccnngctgccgctacggcttcttccacgtcgtcaacaacgnctacaccnactggctcatgt

SEQ ID NO: 29030 - DNA, 1160 bp, Triticum aestivum
  Clone ID: PAT_TA_29030
aggcaggcgtatggcatctaaaatatctaagctgttgggggcagttgtgcgaagcttccgagcagcatccatggactgcattgcttagagaccctggatttaaggagaaccagagataaagacattgcccatagaggccattattctgtaccacttagctcatctgttcggaaagtttacagttgacatagatgatctgaacaatgcaaacaagatgagcaaagcaatgaagttcttgtccggaaacaagagcaacctgaaaactttagctggatttgtcgcaaaagagatgcgagggcttcttcaactgatggttcacatgagaaatctgaggaaggtcaagatatggtgtgggccagttgcaaatggaagtaactacgccagtgatctttccaaggccattcaggaattcaccaaggtccccatggacaatgtgggtgcccgttctctatcacttgattcagaagaatgttctcaagacttgctgagttcgcttgcttttgagccatgccctgaagattccaaatatgatgtaaggtcactgaagctacgtggcaagctactccagttacccccatttgttaccttgctgtcaggtctcactgaactgtgtatttcatcagctactctgacacggaatcttctatcgtctctgatcaatttgagaaacttgctttatctcaagttgatcgcaagtgagcttgagaaatttgaaatgaaatcaggggcattcccaagcctgcggcgtctgtgctttgcagtgcaaagtttcgcttcatctctgccagcaatcgaacaaggagctctgccgaaccttgtctcactccatctgctctgcccaggtctagttggtctttccggcatccaaatcagacacctcagacatctcaaggaggtcatggttgactctggagtgcctgatcaaacacgacaagactgggagcaagcaacaaagaaccacccaaataggccgagactcgtgttgcacaaaagtggtgttcgagtggaaaccgaaggcccggggaatgaagaagcttcggctgtgagggagaagcggaaaatatgtgtagtccaaccaagttcggatgagggactggattccagtctcaagaagatgagactttcatcagattcttcttcgcggcttcaagtgattgttc

SEQ ID NO: 29031 - DNA, 536 bp, Triticum aestivum
  Clone ID: PAT_TA_29031
cactcattcggtcttcgtgctcgtactcgtcacatgttctctcgtagctttagagaacatggtgtcattcctctttctacctacttgaagacctacaaggttggtgatattgtcgacatcaaggccaatgctgccgttcaaaagggtatgccccacaagttctaccacggtcgtactggcatcatctacaacgtcaccaagtcttctgtcggtgtcatcgttcacaaggtcgtcggtaaccgatacattgaaaagcgtgtcaacgttcgtgttgaacacatcagacactccaagtgtcgtcaagaattcttggaccgtgtcaagtccaacgctcaaaaaaagaaggaagccaaggctgctggtgtcaccttcaacctcaagagacttcctgctcaacctcgtgatgctcgtcacgtctctacccagaacaatgttccccaaaccattgctcctattccttacgaaactcttatttaaggaagtttgtattttaatgcccccgaaaaaaaaaaaaaaataaagagcgtcttgtcttt

SEQ ID NO: 29032 - DNA, 582 bp, Triticum aestivum
  Clone ID: PAT_TA_29032
tggtctgaacaaccagcacagcagcagaagaagaagaactatggggccttattgtttgccaccatgagagccctagatatgtcccttttccgctgcgctatgcttgtgagttcttagcacaggtgtttgctgtccatgtcaacaaggagtttgaagtacagaaacagttacgtgaaaaaagcatactgaggatgcaaacaattctctctgacatgctgttcaaggaagcctctcccctgactatagtatcaggggcacccaatatcatggacctaatcaaatgtgacggtgctgctcttttgtatgggggcaaagtatggcgtctgggtactgcaccaaccgagtctcagatacgcgatcttgccttgtggctgtcggaagttcacatggactccactggcctgagtactgagagcctccatgatgctggctacccaggagcctctgctcttggtgatacggtttgtgggatggcagtggctaagatcaattccagtgatattcttttttggttcaggtcacctacagctaaagaaatcagatggggaggtgcaaagaatgatccatcggacatggatgaca

SEQ ID NO: 29033 - DNA, 1004 bp, Triticum aestivum
  Clone ID: PAT_TA_29033
gccggccggtccgggtctggaaagccagccgtccgcctcttccctttcccctttccacctcccctcctctccagctgccctggccccctcctcaggcgcctcacgagcgccgcgaggtcagcgcgggagccgcgcccgcacgagcgccgcgagggaggtggccaatacggcgaggcgccgtgcccgcacgagcgccgtgaggtcaaagtgcagcggcggccaatacggggaggcgcagcgaccgctcgggctccgcgaggtccaggggcggaagcagccaatacggcgagcggtgcctgtccggcgaccatacagcctccgcggcgtgctcgaccttgctcctacgcctcctacccgggctggacatccccccgtgcgttgtccccacccgcatcaccaagctccccaacggcgtccgcgatccccgtcgcctccgaggacttccagggagcagcacagggatggcgattttggtagctctgctctgatgatgccgtcagagcacaacttgctcgttttcagcatgaggaagaagatgatttgacagggagcaacacagcttgcttgttttgtttctctgtagcaagttattctataaatactgaacactatgcaaggaaatcagcagctgccattgttcaagaatgtactaattctctgaacattgttttgtctttctatagcaagttatttctataaatactgaacattgcaaggaaatcagcagctttcattgtaaagaggtcgagctagtatcgttctgtgatgattctgccaacaaacaaaggaagaacaaggaagaagagaattcttgtcctgttgcagtgcagttgccatctgaagaaggcgatcaagagctgaagcacatggagcatcccggccatccttgaattttctggcagcaggaggcacaggcgcagaggtaacagaaagaagggggaagatggttctgcttcgagtcctattgaagctcatgtgccatctgaaaaaacgaagcaaaacaa

SEQ ID NO: 29034 - DNA, 1717 bp, Triticum aestivum
  Clone ID: PAT_TA_29034
cgcctgggcacgcgccgctccccccgattcgactcacgagcccactcctcccccggcgcataaatacaaatccccgaatccctatcgagaccaaaccctgaccctagcgaatccacatcgagagatcgagagagagagaagcatggcgcgcgccaaggccatggagggcacggacccggcggccagagccacacatgcgacggccccggcggcgaagttttgtgctgtgcaaacccgtgccactcccgccgcccgcccactacacccgaggcagatcacgtcctagagccgcgaaacctggaggctcctgtgctgtccaccctcactgtttgctgcgcgtgggatgatgctatccatacttgcggcgggtcggaagtttcttttcacatggtgagaggcatgcttggttggcagactcaatccggggcttgtattgggccaaatggatgactgcgctgcgtctcaactcttgagtgttgctggtgcaccgaagatagtacttattcccgttgtggtcgctgttgattgccctttccctccatcagataaaattggtataaattctgtccaaagggaaaatgaagaaatagtaccaatgagggcgatgaaaatggcttgggtgccctatgttccactagaggaccggctcagctgaattgacagtttgaaaacaaaaatattcactcttggctgcactcagcgaaggtctgccctgaagcatctgaaagaagaacgagtgaagaagtttgactactgcatgccttattatatgccacttagtcctcctgaagatgaagatgataccgttgtcaatatcatgtatcctttagaaccccccgatagtatgcgacttcgactgggaaatggatgatatggaggactactgcatgccttattatatgccacttagtcctcctgaagatgaagatgatacagttgtcaatatcatgtatcctctagaacccccgatagtatgcgacttcgactgggaaatggatgatatggaggattttattgatgagaaagtcaaagacgaggtcttgccggaggatgagaaggaaaaattcaaggacttcataaaggagagagttagagaaaggaagagagagctgaagcaggctaaagaagcgagaaagaaagctattgatgatatggatccaaagttgaaagaggcatttgaaaatatccggttttacaaattttatcctataaaaaccgatgacactcctgatgtgagccaagtacaggcgaagtacattaatagatactaccgccacgcgcatgagctgctgtgatgtgcaacctcgtaatttgctgtgcgcggtatcaagctatccatccaagctacgggtggaaattttggaaaactggagggttgcctgcttggtaggcagactcaattcggggcttgtattgggccaatggataactttgttgcctctgaactctattgtagtacagtttcacccatgctcctgagtgtctcctcctccggcattttacttctctttgtactgcggcgatatgtaacattgtgggagatagttgtagcggccagaaagtagagatcctgtaagagcagaacaattgttccaggaacagtttgttccctttctcacccagtacagctctggcttccattattgtttagcttaccctgtgtattttgaccggatccctatatatattttgatgtttaaccctgtgcgcgttgtgt

SEQ ID NO: 29035 - DNA, 463 bp, Triticum aestivum
  Clone ID: PAT_TA_29035
catgagggggattgagcttgaggagttcaacaaggccgtaacagcggccaatagctcaagggacgcggtgaaactgaagctcttggacacttacagcatttcgtccatgagacctgacggccatgctggtccttacaggatgttccatccatttgcacagggcaacaaggatggctcatcggttcagaatgattgcctgcattggtgcgtgccagggcccatcgacgcctggaacgatctgattatgaagctagttctcaactgatgaaacctctagatctcgcgctccttgctgaccaagagttgtagggctggttgtgggccaagttggcaacctcgattcggggtttagttcctcgcatgctagtttagcaggaagtagtagtcgattctcaaaaaaaaaagcaggaagtagtagtagtcaagaatatataggtgcgtacattatagtttggatggtgtg

SEQ ID NO: 29036 - DNA, 645 bp, Triticum aestivum
  Clone ID: PAT_TA_29036
gcacaccataagccagttgtcctcttcagaacatgggcgcctgatcactttgagaacggcgagtggttcagcggtggaacctgtaacagggtattgccttacaagaagggagagtacggtgggaaatacatggaacatatcatgagggggatcgagcttgaggagttcaacaaggccgtaacagcggccaatagctcaagggacgcggtgaaactgaagctcttggacacttacagcatttcgtccatgagacctgacggccatgctggtccttacaggatgttccatccatttgcacagggcaacaaggatggctcatcggttcagaatgattgcctgcattggtgcgtgccagggcccatcgacgcctggaacgatctgattatgaagctggttctcaactgatgaaacctctagatctcgcgctccttgctgaccaagagttgtagggctggttgtgggccaagttggctacctcgattcggggtttagttcctcgcatgctagcgtggcgggatgctggtgtcgctgctcgtagtagtcagcaggatgcaggtgtgggcgtcttttttttgctgcgtacggtggacttcccgccgcggcatctggccgcgcgtgctgcgatgtgtctggttggcaccgagc

SEQ ID NO: 29037 - DNA, 573 bp, Triticum aestivum
  Clone ID: PAT_TA_29037
aaccctcttgatcacatccattcgaggaactgaagagacacacatacccaggtcttcctaattccacttgtccttttcaagaccgagctcctgccgtccaattggctcgagaaccttcaccaaaatggcaccagcactcacttctcccttgcctaatgcaccacacacactctccgatccaaccactacaaccacaaagaaagcccccaaatccatcttcccagatggaatacgcacatcaggccaacacgagcccatctactccctcttacaaccctactctgccttccccaaagaaatcaccggcccaacagcatggagcaaaacagactacgcatccaaccccgaacgctggacgcacatcttctccgccgacgaagtgcgcgagatgagcgaagcagcagatgccttcatcgcctctggaacacccttgaccggcatcaccaaagatctatttccactacccaacttctccaatttccttgagccgttgcggaaagaattgatcgatgggaagggattcattctctttaaaggtatgccctgtttggagcaaggggggggggaaacccc

SEQ ID NO: 29038 - DNA, 263 bp, Triticum aestivum
  Clone ID: PAT_TA_29038
acgccgcccagatgcctctgcccgatgaggacgacgccgatttgtagatacggtcatgagcttgctctaggccacggctagggctctaatgggtatacgacatggacgagatttagtggaatgggacaacggatatgcagctcgagaattgaggacattcttggcgaaaacggggcatgcggaggaggactggcggaagtatccgactggaagcgctggactagctggcgtttcgacgaatgaacaatagactgttcctgatc

SEQ ID NO: 29039 - DNA, 781 bp, Triticum aestivum
  Clone ID: PAT_TA_29039
acttgtgcatgtgttttcccaacgtcatcggttatgctcttgctgagctgccgtccattatgccaactcttgagactcttgaaataggttcagaggatgaggtggttaatacaccaatgctgcctacaaaattcatccacctcaagcacctgaatattcaaattacggaatccgatgattattttcacctggcttctttcttggatgcatctccttccttggagactttgttcttggatgtatctaaggataaggaatatgtggatcgtgaatcagtttttggaggttcctcactacatttgaggcagctgcccgaagaccgccatgtctgcctcaaactcaaacgtgtggagatcatagggttcagctctgcaaagagcttgattgagctcacacgttgcattgtcaagaaggcagtctcacttgagctgcttgtgttggacacccttgatggtagtgataggtgttgtggtgaatataagtgtaggcccattggcaagactgttctcgaggaaaataagtgtaggcccattagcgagactgttttcaaggaagcctctagagcggtcgtggctgtaagaaggttcattgaggatcaagtcccgcctacagctaagctgagtgtcctggagccatgcacacggtgtcattcgagtcatgagcttgcagccggtgatatggcggtggagggtggttgatagatgtcataagttatcttattataattgcgccgtgtatgatcatttattgaattcgatttgatttgataccatgctttgtt

SEQ ID NO: 29040 - DNA, 726 bp, Triticum aestivum
  unsure (1)..(726): unsure at all n locations
  Clone ID: PAT_TA_29040
ttcagcggccgccgggcagntcttcgtaaaaatnacagattgtcgcttaaaccgttgcttgtttttttaacagaggtgccaagcaccggtgcttaagaaaacaacatgttcatttttacaagcacctctctaggccccttcgcctggaccccttgctttctctctctctcgggatcgctccacgccacctccgtctccgccaaccagggcgcgggatccctcgggtagaattgcgaagctgcagatcgagaagtgagccatggcgaagatcaagccgagagcactgctggcacagagcaagcagaagaagagccctactaaaatcggcccaacaatgtttgccttcatcgtcgttggtgccctagtggtgtcctcactctacgcatacaggtactggatgagcaaaggaccagctggagcagaaagtgttgctgggaactaagcccgagcaagtgtggaatgattgatttttgttgttgtatgtatcatcttgttggctaatttctgttgttgtactccagtaaatggtacgtagacagatttattttttttgccatgtttagttcctcttacccacctggtacattgtattaatacttgttttgttacactcttttctttgacttgatatttttctcgcctgggatgatattgctgggaggcttgggaacgactggccgcatgttcgttgcaaaactaaaaaagaaacagaaaaaaaaaaaacag

SEQ ID NO: 29041 - DNA, 746 bp, Triticum aestivum
  Clone ID: PAT_TA_29041
cggctaccgcccgagtcggggagtcggcggcgggagcaggcagccagccagcccgtgccttggtggaagcagaaatggcgatgcgcaggaggctgccgcagttccaggccatcctcgcgcagcaagccgtccgcagcgccatccccaaacccagacccctagccaacccccacagccgcctcctccactgcgcctccccgccagtagccgcctcccgctgcccgctgtcacactccctctggcgcagcccaggcagcgccggaacgctcctgccggtgagcgcggcggccgttgcgtcggccgcccgggccgccgccaagcggtggctgaccgcgcgcgccgccgggtcgcttgagctcttctcgctgcagcggaggcggtccccgggcttgctctcttcgtcctccacattcctccgccgcgtaccctgggggcgctggctaccatcagcggacgggatggtgttgatgcttatgggcgcgaatgtggccgtcttcatgctctggcaaatggccagtccggatttcatgagggatcatttctcgatttcgctggacaatctcaagagcgggcggttgcacacattgctcactaatgccttcagccactatgactcaggtcacctcttcggcaatatgatgagtctctacttcttcggttcaaatatttcgagcgcgtttggccctgcttttctgttgaagctgtacatagcaggagcacttgttggatccacattcttcttggta

SEQ ID NO: 29042 - DNA, 745 bp, Triticum aestivum
  Clone ID: PAT_TA_29042
cgctgcgtccgggggaggacggggaggggggacatcgaggtggggtcgatccggaggacgctgttcaaggtcttcggcgaggaagcgagccccaagatcaagaagttcatgaaggtgatgctggcgaagcggcagcaggggcagcacggcggcgtggtgggcctggtgggcgcgctggcacaggagccaccgagggccaagctgcagggcaagcaggaggagctgaagccggccatggagcaggaggtgcacggcgtggaggaggtgtacgccgggacggcggcgagggcgccccacaacggcgtcctcatcagcgggtgccagaccgaccagacctcggcggacgcgacgaccgccaagggcctgtcctacggcgcgctcagcaacgccatccaggccatcctcgcggagaaggacggcaaggtgagcaacaaggagctggtgctgagggcgcgcgggctgctgtccaagcaggggtacaagcagcagcctgggctctactgcagcgacaggcacaccgaggtggctttcatatgctgagagcgtgaaacatcatccgttgtctttgtccgtcgatgagagagaacgttttctcctcgtgtgtcaaaactgtctgctattgtctgtggactgtggttttggatacccggacgccatgtgttgctaagattggactgtttgatgtttcatctcagaataacaatcacatgctctcaggtaataatatacctataatatattaaaa

SEQ ID NO: 29043 - DNA, 1502 bp, Triticum aestivum
  Clone ID: PAT_TA_29043
cgaggccgcgtcggccgcctccaccacggaggaggccgcgcgccccgacacggtgatcccgcctgacaaccgcatccccgccaccatcatcaccggcttcctcggctccggcaagacaactttactaaatcacatactgacatctcaccatggaaaacggatcgctgtcattgagaatgagtatggtgaagttgacattgatggttcgttagttgccgcacaaactgctggagctgaggacataatgatgctgaacaatggttgtctttgctgcactgtgcgtggtgatttagtacgaatgatcggtgaattggttgacaagaagaagggaaagtttgaccatcttgttattgaaaccacaggtttagcaaacccagcacccataatacagacattctatgcagaagatacagtttttaatgatgtcaagctagatggtgttgttactctagtggattcaaagcatgcaaggttgcatttggatgaagtgaagcccaagggtatagtcaatgaggcagttcagcaaattgcttatgctgacagaattataattaacaagactgaccttgttagcgagcctgaagtttcttccttggttgagcgtataaggagtatcaatcgcatggctaatttgaaacgagctcagtatggtaaagttgatttggattatgtgcttggaattggaggctttgatttggagaggattgagagtgctgtcactgaagaaccacatgatgagcacgaacatgaacatgaacacaagcatgaacatgaacatgaccatgaccacgatcaccatcatcatgatcatgaccataaacatgaccatcatgcacatgatcacacccatgatcctggtgtttcttctgtaagcatcgtttgcgaaggggagatggatcttgaaaaggctgacatgtggttggggaacctactgctggaacgcagtgatgacatataccggatgaaggggctgctctctgtcagtggaatgcctcaacgcttcgtctttcagggagtgcacgacattttccagggatctcccgacaggatgtgggagcccaacgagccgcgcatcaacaagattgtgttcatcggcaggaacctcaaccgggaagagctggagacgggcttcaaggactgcctgctgaagtaggccagagcttctgcttttggatggatctccagcttcatgattttgagctttgcggctgcagaccttatccttcattaaaatgtccgaaactgtaaccgttattgaactgacacggaacgcgagatgtatatatagattggggaacagtagcatatccttggaacctggccacgatgttgttcgcagatgtctactgttatgcatgatgttgcactgtgacttgcagagatttatagactgtactgtgacttgaggaattgctctgtaagtcctaaaaatttccatagcatgtgtttcgttcaaaatttgcattttttaataaatacggttgaagttggtaaaaaaaaaa

SEQ ID NO: 29044 - DNA, 832 bp, Triticum aestivum
  Clone ID: PAT_TA_29044
gccggccgggctcgggacccatcagctactgaatccgatcgacagcacagcacagcagaagcaactcgtggccaggcgacatacctgatggagaacaacaggagcaaccagcaggctcctccaccgccaccagggtacccgacggcggcggcggagcaaggccaggccggcgggaagaagggccgccgggcgagcaccaaatccaggggcgagaagggcttcatagagggatgcctcgccgcactgtgctgctgctggatctgcgagatgtgctgcgactaaccggccggcgacggcgaggccgctgctgccacaagacctcggtgctatagcacccacgaggaggaggagcgtacgcgtatacggagagagaaattgttcctaatttcagtgcccgttgttttaggttctatacatatatactcctaaggtgatgcacgcatgatcagtaccagtgtgagatatcgattcatgtatccgtgttcggtgccatattcatgcacctcgtcgtgtgtaattattcggtgtgtacgagaccgacgatatatacttacaagtactgtctactgtgattgagcataaactgaggatgcttccagtgcgtatttcactcatctgcatcttcaggtaatcgagactggccccgcgactggagcctaactgaacaaaggggcggcccatttaaaggacccggatttccttccccttccacgccacggcatatatttattttagtgccccctaattgcaaatatttggcggtttgttttcaactttgagacggggaaacccctgtgttgacccaaattaatagggtggctgccaatccctt

SEQ ID NO: 29045 - DNA, 703 bp, Triticum aestivum
  unsure (1)..(703): unsure at all n locations
  Clone ID: PAT_TA_29045
cggccgctggaagtccgccgacgccgatcgatagcacagcacagcacagcagaagcaactggtagccagaggacataccagcagatcagctgaatccgatcgacagcacagcacagcagaagcaactcgtagccagaggacatacctgatggagaacaacaggagcaaccagcaggctcctccaccaccgccagggtacccaacggcggctgcggagcaaggccaagcgggcgggaagaaggggggccgggcgagcaccaaatccaggggcgagaagggcttcatcgaggggtgcctggcggcgctgtgctgctgctggatctgcgagatgtgctgcgactaaccggccggcgacggcgaggttcctggcacaaggcctcggtgctatcgtacccacgaggagcgtatgcgtatacagagagagaattgttcttaatttcagtgcccgttgttttaggttctacatatatactcctaaggtgatgcacgcatgatcagtactgtacccgcctacctgtgtgcgtgtgtgagatatttcatgtatccgtccgtgtgcagtgccatattcatgcaccgcgtcgtgtgtaattaaccggtgtgtacgagaccgatatactactcagtaatactgtgattgagtaataaaaaaaaaaaaaaaaaaccctagacgacttcaaatctacagaaacctggtnccactacc

SEQ ID NO: 29046 - DNA, 410 bp, Triticum aestivum
  Clone ID: PAT_TA_29046
gaaattcactctgtactttacttacataatagataatacacatgcaacttgcatatacatttgcaatacatatattgtaccaatggatattttacagggggaaatgacctatcctaggtgcaggcagtaggcctagcctaggcattccagcagcgtgacgtggtactagtattgcgtacactctacggacatgtccggtcagacgattgccggcggcgacgtggaactgcggcgtgtaggtgtgcgccgtgcccggcctctcctcctgcggcggttcgttgaggaaggcccagttgctcctcgtccaccagtcccggctcttgccggcgtcggcggcgtcgatctcctcgtggccgccagccaccggagacgacgccggtgacctgctcctctgcgtctgcgagcttccc

SEQ ID NO: 29047 - DNA, 732 bp, Triticum aestivum
  Clone ID: PAT_TA_29047
atgtgctataaattagtccaagttaattttttttaacacagtacagacgcaagcgctcagacatacgcgcatacactcaaccctatgaacgtacacatacacatcctacccctatgagcacctccgagaaactcatataattttatcattttgaaattcactctgtattttacttacataatacataggcaacttaaatatacatttacaatacatctattgtacaagggatattttacagggaaatgacccatatggacatatggtgcatctccgcgcggtactcaggcagtaggcctagcctaggcattccagcagcgtgacgtgacgtggtactactagtattgcgtacactctacgagcatgtccggtcaggcgttgccggcggcgacgtggaactgcggcgtgtaggtgtgcgccgttcccggcctctcctcctgcggcggctcgttgaggaaggcccagttgctcctcgtccaccagtcccggctcttgccggcgtcggcggcgccgatcgtctcctcgtgtacgccagacaccggagacgacgccggtgacctgctcctctgcgagcttcccagcgggctcttctccataggtcgaccaggggagccaagcggcgaggtgacgtcgccgccgtcctccggcgccggcttcccgcgctgccgccagaaagcctccacctcctcctttgtcagggaccggttcctcgtcacacgagctttggtgcca

SEQ ID NO: 29048 - DNA, 953 bp, Triticum aestivum
  Clone ID: PAT_TA_29048
ccatttttctttgtattttttgtacttgttaaattatagttttatcttttctggaattcactctgtattttacttacataatccatacgcaacttacagatacatttgcaatacatttattgtacaaggcatatatcaaagggtatccactcgtatgctgcctctctattttacttacataattacataggcaacttaaatatacatttacaatacatctattgtacaagggacattttacagggaaatgacccatatggacatatggtgcatctccacgcggtgcaggcagtaggcctagcctaggcattgttccagcagcgtgacatggtactagtattgcgtacactctacggacatgtccggtcaggcgttgcgggcggcgacgtggaactgcggcgtgtagctgtgcgccgtgcccggcctctcctcgtgcggcggctcgttgaggaaggcccagttgctcctcgtccaccagtcccggctcttgccggcgtcggcggcgtcagctgcgtcgatctcctcgtggccggcagccaccggagacgacgccggtgacctgctcctctgcgagcttcccagcgggctcttctccataggtcgaccaggggaggcgaacagggaggtgacgtcgacggcaagggtctcaccgccgccgtcctcccgcgccggcttcccgcgctgcctccagaaggcctccacctcctcctttgtcagggaccggttcctcatcacacgagctttggtgtcatcgccaagaaccggcgaatcccagccggccatcagagaccccatctaggctctagctaggattaggatgatcaacttcttcttgagatggatgtggtagaatcgaatagatacttgtaggatcgaatagacaagaatgtgtagttgcgaatggtaccgaagagtagtgtaatgatccttttcgccgcctgagcgccgcacag

SEQ ID NO: 29049 - DNA, 1330 bp, Triticum aestivum
  Clone ID: PAT_TA_29049
gcatagagaacctctcctccccatcctcctccactcccccaccccaccccacccgctccaatgtcgccgcccctcgagccgcacgactacatcggcctctccgcccccacctcctcctcctcctgctcctcctcgcccagccccgccgccgaggccgggccccgcctcacgctccgcctcggcctcccgggatccgagtcccccgaccgcgacggctccgtcgacgtcgtcgcgccggcgctcaccctcggccccgcctcccacaaggccgcctccaagcgcgccttccccgacgcctccccccgccgcggatgctccgccaccgccagggccgaggagaagccgccctccgcagccccgccggccgccaaggcgcaggttgtgggatggccgcccgtgcgcaactaccggaagaacacgctggcggcgagcgcctccaaggccaagggggcagacgacggcgcgcctcactacgtgaaggtgagcatggatggcgccccgtacctcaggaaggtggacctcaagatgtattccagctacgaggatctctccatggcacttcagaagatgttcagctgcttcatcactggtcaaagctcgctgcgcaaaccatcaaccaaggacaggctcactaatcgttcaaatgttgattccctccaagatcaagagtatgtccttacatacgaagacaaggacgctgactggatgcttgtcggtgatcttccatgggatttgtttaccacaatatgcaggaaactgaaaatcatgagaggatctgatgcagctggaatagctccaagatccctagagcagacaggtcagaacaaataagattgaccttcttccggagtaaagaaaatgaaccgagctaagttgcgatgatgtcgatggtctaaattattcatgtcaagtacctcaaatatcccaaatgttagtgtagttacacgtgtttcttagacctgtttgtcaaatgtctgtaatgtgatctgctgaggtatcgcaattatggttgacgtattttcacttggaagcttatgtgaggaagctctgcacttcctgaatgcaagctttccacccgtattatttcatatgtatattcaagtgttgcactacgtattatgctctgttgcaattatccaattgccaaaaactttatattggctactgtcaatgcaatgctctgttctgatcgaagaaaactgctacattgttgtacaatttatttgcgattgagaaaactgctaatgtacaatttgatcaagttgctgaacgatttgtttgtacgccaagaagtacaacaatttgacaaaaaaaaaaaaaaaaaactcga

SEQ ID NO: 29050 - DNA, 1455 bp, Triticum aestivum
  Clone ID: PAT_TA_29050
ctcagctgtccgtcttcttggaccctgcttctccgccgtcctcgccgctacgagctgcgagcggtcatcttttctcccttcaagatcaccatcatcgtcgagcagcccctggatgatgtggcgccgggtcttctcggaccgtgcttccctgccgccctcgctgctgctgcgagctccggtcggcaatcttttcccggttcaagatgaccatcatcatcgagcagcctcagttcgatgcggcggcggagaggaaggtcgccggcgacccggcggagctcgtgctcgacggcggcttcaccgtaccggactccaacgccttcggccacaccttcagggactacgacgcggagtcggagcggaagaagactgtggaggagttctaccgcgtgaaccacatcaaccagacgtacgagtttgtgcagcggatgcgggacgcatacgggcggctggacaagacggagatgagcatctgggagtgcatcgaggcttctcaacgagttcatcgacgacagcgaccctgacctggacatgccgcagatcgagcacctcctccagaccgccgaggccatccggcaaaggactacccccgatgaggactggctccacctcactggcctcatccatgatctgggcaaggtgctgctgcatcccagcttcggggagcttcctcagtgggcagtcgtagggtgacaccttccccgtcggctgcgcgttcgacgaatgcaacgtccacttcaagtacttcaaggagaaccctgaactaccacaacccggagttcaacaccaagttcggggcctactccgatggggtgccgggctggaccaacgtgctcatgtcatggggccatgacgactacatgtgcctgggttagccaaggagaacaaagaccacccttccttccgcagggctgttcatcatcaagataccactccttctaccccctgcacaagcatggagcctacatgcacctgatgaacgacggaggacaaggagaacctcgaaatggctgcacgtcttcaacaagtatgacctgtacagcaagagcagcgtcaggatcgacgtcgaggaagtgaagccctactacatgtcgctcatcgacaagtacttcccggggaagctgcgatggtgaggaggccgcacccagacagggaacggagcccagacaacatattatatagtttatttaccttcgaaagcaaaaagaaagaaagattgttccaagctgtcgtacgtgtatggtgcgtgatactactatatatacggatcatgacacatccaagttgagtgagcgttgccagtagggccatcagccatgcgtattgtggcgtatagctaataaaatttatttgccggtatttgttgtccaacgagtgggcgcggttctacttctacaggttgtaagcgaaatgattttgctcaccttgcaattacatacagatacagttatgtgcgga

SEQ ID NO: 29051 - DNA, 976 bp, Triticum aestivum
  Clone ID: PAT_TA_29051
ctttccccctcccatctggctcactcgcccctttgcctgtctccgacaggacccagcttcttttttctctttgtttctccctctgtctccgtgaccagcaatggccttggagacatgcctcaggggctgggccctgcacgcgccccaggctggcatcagggaacggcttagcagtggcagctacgcgccatcccggccaaggaccgccgcccccgccgtcgtctcgccgtccccatacaagtccgctctggttgcggcacggcggccgtctcgcttcgtctgcaagtgcaagaacgtcgtcgacgaagtgattgtggctgacgagaagaattgggataacatggtgatcgcgtgcgagtcgccggtgctggtggagttctgggcgccgtggtgcgggccgtgccggatgattgccccggtgatcgacgaactggcaaaggactacgtggggaagatcaagtgctgcaaggtgaacacggacgactgcccaaacatcgcatccacctacggcatccggagcatccccaccgtgctcatgttcaaggacggcgagaagaaggagagcgtcatcggcgccgtcccgaagacaaccctctgcaccataatcgacaagtacatcggcagctaattaatcattcttaattagcgattaatcgaggacgcacacacctttactgttctgttcgcgagacagcatatatgtatgtatatgatgcgcgtatacgatccaccgaccagttgtgacttgtactactcttaattctgatgcaaatcaaaactgatttattcgggcactactgttaattcagatgaaaattaaaactgatttaatcgggactcaacatcctataaatagaaaaaaaaaaaaaataaaaaaatatacgagagggggacgtggtactcttttcgcacctgcgtggcgttagaacaatagttcaaggaaaagaaaacatagttttccgggaaaaaaaaaaaa

SEQ ID NO: 29052 - DNA, 950 bp, Triticum aestivum
  Clone ID: PAT_TA_29052
ggcagctaggctttgagcccccgtcatggggtgactttttcatcgcatacgcttcacccccacccaagagggtggaggtatggatgatagcgcgagccgaaaaactgaagggggacgtcaatggattatttaagacttggaacgacacgacgaggcgaatgttcttggtggatacactccaacatcttggacgacgccaccactttgggtagcagatccatgacttgttaaacgaactcctggagagtgactttagtagctcatccagcctccatgaggtctctcttcgattccgtttacttaaggagaatgggcattgggtatctctagatgttttcgacaaatacaagggtgaagatgggagctttagaaaggatataactaatgaaccaaaagggatgcggggtttagaaaagatataacatctgatcaataaggaataccatgtttatacaatgcaactgatcttctcattcatggtgagccaaaactggaagaagccatgtgttttgcaaggcaacatcttgtatcagctaatcatagtctgcgagcccccctagctaagcaagtcaaacgcgccattcatagagcacttccaagggcgtgtaggagggtggaagcgctacaatatatttcagagtatgaagaagaggaagggcataaccaaattttgttggagctagcaaaattagattttaaccttctacaacatgtccacttgaaggagctcaaagatattacagagctgggatgagcacaaatataatgacacataggatgtaatgttgtatcatgcaaatgcatctgaacataattttctccatatgtctcatggattattcaatacagctacctttttctatttaacaacatacagtatccatgtaatttttcaaaatactccactaaatacaattcacaggtggtggaaacatttttcgggattcatc

SEQ ID NO: 29053 - DNA, 633 bp, Triticum aestivum
  Clone ID: PAT_TA_29053
aaaaaagtcaccaaagaaagctgttgtatttttagctgaaggtgcagaagacatggaatttagtattagtgtggacgtcttacgtcgtgctaaaattgaagttactgttgttggtgttgatatcagtggtgattatgcaacttgtgctcgaggcattaaagtagttcctgatacaaagcttgataaaattagcctgaaggcttcagagtatgatgttgctattgttccaggcggtgctggttctgcaaagacattgggtgcgcacaagggagtacataaaatactcatggaattttatgaacatgcgaagcttgtcgctttcatttgtgctggtactcttgttgcaaaggaagcaggtattcctgctcatcatactgttacctcattccctggtgttaaaaatcaattgactggtgtctacacttattctgaagacagagttgtcgtaagtgacaatgtaatcactagtcgtgctcctggaacagccttcttatttgctttaacaattgctgagaaattagtaggctctgagatcgttgacacagtcaagcatgatttattaaccttacctgaattataattaaacacatccttatttacatgtgaatgaaaattaccttttttttttctgtg

SEQ ID NO: 29054 - DNA, 763 bp, Triticum aestivum
  Clone ID: PAT_TA_29054
cccacgcgtccgttttttttagtattattcataatgaatggcttataaaaccagctctttcaattgaagtttacagccaagcaattaaacaaacaatccaagcggtgtcaaaaagatgaacaaacagaaaaaaataagttgaaaaaatctatacaagatgggaatatggaaggagctcgtatttatgcttctaatgccattgcgaaaaaagaatgaggcacttaatctacttaagttgtcttctcgtattgatgccgttgcaagtcgtgttcaaacagctattactatgcgaaaggtctctaattcaatggcaagtgttgttaaaggaatgggaagagctatggaaacaatgaacttggaacagatttctatggttatggataagtttgaatcacaatttgaagatttggacgttcaaacaggttacatggaaggtgccatggctggtacaacaacattaaatacacctcaagatgaagttgaatcacttatgcatcaagtggctgatgagcatggtttagagttaaatgataccctgaatgaattagagccaagtaaaacattagccgatggaagtgctagtaaacaaaaagaaaaagatgaagataagatgttgactgaaagattaagggctttgagacaatagaaagagtaaagaagaattatgtttatatgaccagtaaataataaagacaaccagacttaacagaacatatacaaatgtatactcttttagtggcaaataaaaaatgtatgtcttcct

SEQ ID NO: 29055 - DNA, 1163 bp, Triticum aestivum
  unsure (1)..(1163): unsure at all n locations
  Clone ID: PAT_TA_29055
gcgcggacacccccaaatccccggaaccctagtgaagagaaggctcgagttcgacatggagacgacgagcgagtccaccgccaactccaccgtaacgggcgcgacggccgacggaggcacagagcgtgagcaagagcacggcaatggcgcggctgccgcccctgccgtggtgcagcatgaggaggagggggaagagttgatcggtccgggccccgcgccggcgcggcagcggcagaagcgcccgctccagttcgagcaggctttcctcgacgccctcccctccgccgccatgtacgagaagagttatatgcacagggacgtcgtcacgcacgtcgccgtttcccccgctgacttcttcattaccgggagcgcagatggacatctgaaattctggaagaagaagcccagtggaatcgaatttgctaaacattttcggtctcatctcagtcccatcgaaggcttagctgtcagtgttgatggcttactttgctgcacgatctctaacgaccggtctgtcaagatatatgatgttgtaaactatgacatgatgttcatgatgcgcctcccgtttgtccctggggcgattgagtgggtctatcggcagggtgatgttaaaccgaaacttgctgttagtgaccggaatacatcttctgttcacatatatgacactcattctggttcaaatgatcccatcatctccaaagagattcatgctggccctgtaaaagttatgaaatataaccatgcccaggatgtngtgatatctgctgatgccaaaggactcttggagtattggtctccatccacccttaagtttccagaggatgcggtgaattttcgtttaaaaacagatacaaatctatttgaacttgcaaaaggcaagactagtgtgtctgccattgagctctacttaatgagctgatctttcccaggtgagcaacgatggcactcaatttgtggtcacatcccctgaccgcaggataagggtattttggttcaaaactggtaaattaagacgcgtgtatgatgagtcccttgaggtggcacaagatcttcagaaaagtgacgttccgttgtatcatcttgatgctattgattttgggagaagaatggctgtcnaaaaggaaatanaaaagacagaaaatgttcctcaacctaatgct

SEQ ID NO: 29056 - DNA, 1529 bp, Triticum aestivum
  Clone ID: PAT_TA_29056
gaaaatgccagtgaccatggcgatttttacaatgagataatggcagaacagtatggcaagctgtgcattgcacttgatgttcttcatgaatgttttgttactattatcgagccccgcacacgaagagatctttctgaagacattgtgttcaatagagaatcaggtctccgacggcttaattttaggggattctacacgatacttctccagaaagatggtgagctgatatctgtcggcacttttagggtatgcgggaagaagtttgctgagctgcctcttattggcacaagaattcaatatcgtcgacaaggaatgtgtcgcctactgatgaatgaactggagaagttactttctggcttgggggtggaaaggcttatcttaccggcgattcctcagcttctagaaacatggacaggatcatttggtttcacagcaatgtcttgctctcagaggtttgaattggcagagagcagcattctcagtttccagggaaccaccatctgtcagaagattttagatgccacggatcataatccaagagatatgagcatccagttggtgcttaatgcggaagaaattgagttggggaagaacagcattgtcagttttgaaagaaccaccgcatgtgacacggttgtgaacaatgcatccaatcattcagaagagttgaaggttacagcacagactaactataacagtctagcatgtgacacggttgtgaacaatgcatccaatcattcagaagagttgaaggttacagcgcagactaactataacagtctagcattggcagagaactccgttttcagctcttggggaaccactatttgtcagaaggtttcaagtaatgcatttagccatccagaagagttgaatggatctgactaccaactggaatgtactagtatcgtccctgagacattggaaagtgatagtcaagaaagcacatcagtgggggtagaagatagagaccaaccggagcctgagctgttactggaaattcggagtaacagtagtgaagagggcaattgtgctgttggtgttcccattattacgccaaacccagaagttaactttaccgtggacagtcatgggcagccgtatgacaggtatgctttcttctattaagatcagtgcagcgggagttgtgtttcaactgaggttaagcctgttgcggcagctccaggatccaaatacaagggtaagtgctacgagcggaatagatggagcaacggccgtaggaaactagaaatgcccggctacggggtctccacaaaatgaccagaactgggttcattccaccaaaggtttggatccaccaggcttgcaattttgtgcaataaacattcggggaatgtgcatagtcaacaggtaatttgctctttctagcgagggttgcctcgcgtaagtcagtttcaagcactcatattatcattttgggaaagaaaaatgttgtatcagtctctgtggatgttttcccacctgatttttcaattcaaattgttggttttcaactgtgcaaaaaaaac

SEQ ID NO: 29057 - DNA, 1548 bp, Triticum aestivum
  Clone ID: PAT_TA_29057
cgccgcgtgcaccccggctcggaacggctagtcagggagtcgccgggcgcggccgcgtccctgttagcgctgtgccggctctcggctgctctctggtgcgctgccctggtgccggcgccggtgctctccctcgccacccagccccggccggacttgctggagcccacgccgaccccgccccggggcttcccgctcgtgggggccccggccgacgtcccccgcctgccgcggtgctccgggttcccccgccccctccaccaggacgatttctgagggagcaccgctctgaatgggctgatcctggtgttgatgcttattctgccgctgctttgcgagctagtccttatgcagttcctggtctacgagcgagtggatttatgggcagtcaggttatactgccacttgcacacaccttagagcatgaagagttcttggaggttattagactggagggacacagtctctgtcatgatgaagttgttctatcaagagatatgtatcttctgcagttatgcagcggtgttgatgagaatgctgctggtgcatgtgcacagcttgtctttgcgccgattgatgaatcgttcgctgatgatgctccactgctaccgtcaggcttccgtgtgataccacttgatgccaagacggatgcaccatctgcgacacgtacacttgaccttgcatccactcttgaggttggacctggtgggactcgtgctcccagcgacgcatccagcaccagcaacacaagatcagtgcttaccattgctttccagttctcgtatgagaaccaccttcgagagagtgttgcggcaatggcgaggcagtatgtgaggactgttgtggcatcggtgcagagagtggccatggcgatagccccttcccgccctggtggacagcttgaaatgaagaaccctccaggatctcctgaggctcacacgcttgcgaggtggatcggcaggagctacaggtttcacactggggcggaactcctatgcacggagtcacagagcgcggacgcttccctgaaggcgctgtggcagcactcggattcaatcatgtgctgttccctgaaggctgctccggtgttcaccttcgccaatcaggccgggctcgacatgctggagacgacgctgatcgcgctccaggacatctcgctcgagaagatcctcgacgacgacggccgcaaggcgctgtgctccgagttccccaagatcatgcagcagggtttcgcgtacctcccgggcggcgtgtgcgtgtcgagcatggggcggccggtgtcgtacgagcaggcggtggcgtggaaggtgctgggcgacgacgacgcgccgcactgcctcgccttcatgttcgtcaactggtccttcgtctagtagtttgtagttactagttcacaaactgttctgcaaagaaccttcgtgtgccggcgctcggtcgcttttgccttgtgtctagagtcaagaccctctttcattcagttttatcatcatcattcatcaccctgtggaacacgcctacctgctttgttgttgttgttgcccgccgctacac

SEQ ID NO: 29058 - DNA, 775 bp, Triticum aestivum
  Clone ID: PAT_TA_29058
acagctatggtttcttacgttattactggcacttctcgtggtattggactcgaatttgttaaacaaatttctgatcgaggagacactgtctttgcttgtgctcgtaatcctgataaatctgaaggattgcagaaattggttgatggtaagaaggtgtacggcatcaaattggacaccactagtgaaaagtccatcaaggaagctgttgaagagatttcaaagcttgcccctgaaggtgttgatgtcttgattaacaatgccggtatttcaggatcacataccactcctgaacaaacccccaagaaagaaatccttgaggtctttgaaacaaacgtattagctgtcaatgaagtcaccaatgcattcttgcctttactccgcaaacgtggtcctgaccgcgttaaaaagattctcaacatgtcatcccttcttggaagcattgaattggctgacttccctgagggtgctgcttacagaatcgccaagggtggtcttaacatgcttaccaagttacaatccattcaactcgccaaggaaaactttgttgtctattcttctcatcctggcttggtcaagactgacatgagtgttggtattagtaaaatctttccagaactggtaattaatccagatgaatcaatctcaaaacaattggccaagcttgacagcgctacagctgctgattcaggcaaatttattgattacgaaggacagtttttgcaatactaaatgctgaatacatattgcttaataaatatggcagttttttttttct

SEQ ID NO: 29059 - DNA, 1128 bp, Triticum aestivum
  Clone ID: PAT_TA_29059
cacaagtagccacatcgcgcttagctgggttccaagagagagagctacaaggtacgtagtgactagcggtcacgagcgcgcgcccatggcttccacgtcgacgagcttcgtggccatggcgctcgtcatggccgtcatgctcagcacgtgccatgccgcgcgcctcctcgccgacgttccggccttgcccacaccgatgctgccccccgtgcccgtcgtccctacagtccccgccgtgccaggcggcgtcgttcccacggtgcccaccgtgccgaacgtcccgaggcgtcccgacggtgccgacagttcccaccgtgcccggcgtgccgacggtgcccaccgtgccaggtgtgccgacagttccagtacctggcgccgccctgccaaccatcccggcggttcccaccgtgccaggcgtgccgactgtgccgcacccggcagtacctggcgccgtcgtgccgacagtgcccactgcgccgagcgtgccgacggttcccacagtgccacgcgttccgacgttgcctatgccgtccgtccccggcgtgcctaccttgccgctgccgcctatgccgtccatccccgacctgcccaaccgccggttcctccgccgccgatgccctccctccccgacctgcccaaggtgccactgccaccgatgtcgtccgtccctggcgtgcccaaggtgccagtgcccccggcgccggtcgttcccggtcggccggccgcgccctagcgccttgcacctccaccgtcgacgcactagacgtacgtgcgtgcgtgcctacatgtaattaaactttatcgttccaaccacatggttactttaacttggtagtattcgtttgagcagcacttgtgtcttcgtgtgcaagtaaaaaagaaagaactacccacgtgtgtacgtgtgtggtatatcttttcgatgggtgcgtgtggtgtggaactgtggatgtgtgtaatgtatgcttgtacgtttatgtggtgcaagacattgtttgtgtaggcaaaggggtattgctccatgtatacgtgtgccactgtataatattattttcatttgtatcaatatatacactattcatgtagatataagcttgagtagtttggctttaaaaaaccccgtgccga

SEQ ID NO: 29060 - DNA, 1456 bp, Triticum aestivum
  Clone ID: PAT_TA_29060
catctccacacatttcagcggagaagcatggtctccatggcggcggccaggatcgccgccctcctgaccgtggcggcgctcttcaccgcggcgggggcagcggatccccaacgcgcaaagggagcacattgctggcggtcctactcttcctgcatgcacaagtgcgacggctaccgtgatgccgccgcccgctccgtcaatcgtactcagcccgcagtccacacaaccgtcgatgatggtgcagcagccgcctccatccccgtcaactctatcgatggcactgcagcaatcacacactccaccgatggcactctagccgctgtcgacaaaaccgatggtgcagtcgtccacatcgccggcggctaccaccaaaggcacgacgatgaccaccgcccacaaaaccaataacgccgacgccaccgacgccaacgacgcccatgccaacgacgacgaccccgcccatgccgccaacgacgcccatgccaccgacgacaaccccgcccaagctgccgagccctcctaatacaccgaagcaaaagccaaagccgaaggcgcccgtgtccgctcaagactaagcctaagccaaaaccgccatgcccaccatcagccattgtatcttcgtcgacgaacaccagcagcaactgataggtgtaagccacgacgtctacacgcacatatttggagcagagctcgcaacatatatacaacatataagtagagagattatggttgctgcgtatcagtatatatagattattaccccggaaaagaatatagattattctataaggttactctatagatgaagaagtaattcatcagctctacctaagctgggtatagaacagcaggtgttaccaaatatccgatccgcgccaccggtgcccttgccgccaccgtcgcccatatcgccgccgtcgcccatgccgccgaaaccaaccccgccgaagccgctgctaaagcggccgtgccatcctaatgcacggaagccaaggctaccgtgtccgtcgaagactaactcgaaaccgaaggcaaagtcgaagccgaagccaccgtgcccgtcgtcggccactgtatctgtgtcgaccaacactagcaacaactgatggttatacaccatgacgtctatgcgcacatatttgaaacagagcttgtcatatatatagcacaaagccattatgagtatatatagattattgtataaggttactctatagatgaagaactaattcatcagctctagctaagctgggtacagagctaattcatcagctcaccagtgatcatgcgtgttgctgaatatctcatctatgtgcgtgttgtgtaatgagattaatgtgggaatacatcatgggcggagtcaggatttgaaaataggggggctaagaggacaatgcacatgcaaaaaatgcagcaccagacgtatatatcatttctttatttctttaatatagtg

SEQ ID NO: 29061 - DNA, 458 bp, Triticum aestivum
  Clone ID: PAT_TA_29061
cacgatcaagggtaccacaatcggttcatccaaggtctctagttccttcagtgccatccttgacactggtaccactctcttgatcttgcccaacaatgttgcctctgctgttgctagatcctatggtgctagtgataacggtgatggtacctataccattgactgtgatacatctagcttcaagcctcttgttttctctatcggttcctctacctttgaagtccctgctgattccttggtctttgaacaagatggcagcacttgttatgcaggctttggttatggtgattatgactttgccatctttggtgatgtcttcttgaagaacaactatgttgtctttaaccaagaggttcccgaagtccaaatcgctcccattgcttaatttatttgaatttttattttatttattctattattgtttattgaaaaattaaataatttacttgttttctcct

SEQ ID NO: 29062 - DNA, 613 bp, Triticum aestivum
  unsure (1)..(613): unsure at all n locations
  Clone ID: PAT_TA_29062
anaaacttcacaagacttccactgtccccaagcgtcctttcgaatctgcccgtcttgaccaagaactcaagttgattggtgaattcggtttgaagaacaagagagaaatctggagagttggtttcactctttccaagattcgtcgtgctgctcgtgaacttttaaagttggacgaaaaggaccctcgtcgtctctttgaaggtaatgccttgattcgtcgtttggttcgtatcggtgtccttgacgaaacccgcatgaagcttgattacgttcttgccctcaagattgaagatttcttggaacgtcgtctccaaacccaagttttcaagttgggtcttgccaagtctattcaccacgctcgtgtcttgatccgtcaacgtcacattcgtgttggtaagcaaatcgtcaatgttccctctttcatcgtccgtttggattctcaaaagcacatcgactttgccttgacctctccctacggtggtggccgtgctggtcgtgtcaaaagaaaaagagctgctgccggtagcggtgaagctgctgatgaagaagatgaagaataaatgatttaattcaaattatttacaatgttttcatattaaattgtcttggtttt

SEQ ID NO: 29063 - DNA, 884 bp, Triticum aestivum
  Clone ID: PAT_TA_29063
gaggacggctccggcggccggatcgtgtacgtctgccgggaccccaaggacacgctggtttccttctggcacttccaccagaagaccacgtcggtgttgcagcaggtgcccggcatgagcgcgtcgtcccccgccatgcccactttcgaggaggcgtttgagctcttctgccagggccagacggtgacggggtgcctgaagaagatggcgtccttcatggggtgccccttctcgccggaggaggaggcggccggggtggtgcgggaggtcgtggagctctgcagcttgggtaagctcaaggggctgcaggtgaacaagagcggaagcacggtgctggggattaagaacgaggcattcttcaggagcgggacggtgggggattggagtagctgcatgactccggccatggcggcacagctggacgggatcgtcgcggaggcgctcaggggctccacgctcacctttgggcctttggcacctccaataatttgtgagcctggcttcctataatactgctgctcgatcatttgctacttacgttacgcactactcctactttgttagtatttccgttagcaaaataagggccatgcagtgtggtgtgtgcatgtaaacgtcctggccaagcctgtgcttctttttgtgttggcttccaggattgcttcgtgggatggcacgagctcaagtgatcatggcggcattctagttctaggggagaagggacgagtggctatgggatggcatggccgggaagctcggatcatcacccagtttctttttttttatctcaagtcagttttgtaaccagagaagtaaataaagtgagaaaagcagtgtctaccgttcactggatatatatcctgtggaggttctttcttttcttg

SEQ ID NO: 29064 - DNA, 971 bp, Triticum aestivum
  unsure (1)..(971): unsure at all n locations
  Clone ID: PAT_TA_29064
cggggcaccagcgacagcgacggcgacaagcacggcaaggaccggtacgacgacgggcacaacgacgatgctaacccggaggagccggggccggggcaagccacgccgacctcgtccacggagacgatccgcggccccaagagagtcagatgcatactggctaatcgccagtcggctccaagccctcgggtgaggaagctgcagtacatctccgagctcgagcggtgcgtcacaacgctgcagaacgaggtgtccgtactgtctccccgggtggcatttctggatcagcagcggccgatcctcaccgtcggcaacagccacctcaagcagcggatcgcagctctggcgcaggacaagcttttcaaggacgctcatcacgaggcgctcaaggaggagatcgagaggctgccgcaggtgtaccagcagcagaacctcaggatgtcgtccggcgcgggcgcggcctccgaccacggcgggccgccccctgtgcgcgcggagaaggagctcatgagctgaagcgatcatcgcatgtcccttccgcgcagccgccccgccgccgcatcattgacctgggagggaacacatggcatcatgaaatgcatgaatgaaaccgtccatgcgcgctttttttctcttgttcttctttttgcttgtccattgacctgtgtatcattctttgcatatcgatttcagttttgggtttttttactgtgaagaaaaaactgaagggtgtgcctccgttgtaaattccgtgtgtagcattgcatcttgtgtacgtagagctgttttcagtttaggtttggagccatcgttttttaggaaagttttttgggaaaccacataagcacagctcttgctttgtatcctcgtactgagttagcgcaactgttgggatagctccgtggccttcctcataagcacaactcntgctttgtatcctcgtactgatttagcagaactgttgtatgtat

SEQ ID NO: 29065 - DNA, 387 bp, Triticum aestivum
  unsure (1)..(387): unsure at all n locations
  Clone ID: PAT_TA_29065
naagcatagatgtatcgaagcaactgaagatctagcagtacccttaaatgtatctcaatgtgttaatggactcagtactgtcaagctcttggatgattttaaacatgtactgtacacttatggcaatgaatcattacaatcatggattagtggagcttttccgtatggaaagatatggtttcaaggttgcagacctttgaataatgctctggcattggttgaaccaggcggtatattgattgaaggcaaccgtcaaaattacagggctatcaccaatcaaggaatggaatctatgatgtctaccatcattaaaagatttgattattacttaacgaatttgacaagaagtaacgaataaaatgccacttttacatttcaaagatctca

SEQ ID NO: 29066 - DNA, 1057 bp, Triticum aestivum
  Clone ID: PAT_TA_29066
attcaagtcagacacatatgctctgggaattattatcataacaactgttaactgggaacagtatgtcaagtcttgagaattgggatggattcatagatgtggattgcccacgggcgaggatgtgcgccgcaatagctctaagatgcacggacgctgaggaatataataggcctaccttacatgaaataatttgtgaactgaacaaggtggagagcatggtttcacagtttcccataaaccagctgctgcaccctgtcggcactagttttgcagtactggcagcttatgcattgttgcttatgatcagtacaaactacatccaaatagctgcgatcccggctatcatactcgttttcatcggtgttttgtaggggcaatttctgggtcaagggaagacttcagcatagaaacaacaatggaactgctgctaaccaggggagtggcagcgggcaagcttggaggatgctgctacccacggtactactgtcgtattgtttgcagctaatccagcttgcctgtgcacaagtgaccaatggacaacaaagtgacaatttcctcttctctcactccctcctcttcctgagttccgcgcttggtgcactggccgtgatgattgccgcgctgcccatcagagccaatcaatgtgtggcgcagggacagcagcttattcacaggatcttcattgtggtttttatgatagcagtgcacatgatggctacagaatggatgatggtggaggtcatgccactggtttgcatgccggagtttattgcatcacttgtgtggctcaccactggtaattttgatcacgccagatgtatggtgctcatcgacaaggtaacatcacgcagatcaacagtcacctttctcactgcagcagtggctctgttagcgttcatgtttgcatttgagaacgagatggtacttgctagttactggtacagaggaatcatgtactcctgtacctcgtcagggcttctatcctgcttgtgcgtgtggatgatccttcagtggcggccggatatctctgctaatgtgccccttgactggccgagcg

SEQ ID NO: 29067 - DNA, 769 bp, Triticum aestivum
  Clone ID: PAT_TA_29067
agcggaagctggacccacgcgtccgggtgcagctcgccgcggagctgggactggacaccaagcaggtcgccgtgtggttccagaaccgccgcgcccgctacaagagcaaactcatcgaggaggagttctccaagctccgcgcggcccacgacgccgtcgtcgtccacaactgccgcctcgaggccgagctgctgaggctcaaggagaggttggcggagacggaggaggagaaaaacaaggccatggcggcgtcggcggcggcaacgggcggcgggggtggcagcagcccgagctcttcgtcgttctcgacggtgacggcaatggtaggggggcagcagttcgggatggaggaggtggagaccgacctgacctacatgagcgagtacgcctacaccaactacatgatggacctggcggccggcggctacctcggaggggtgtacgatcagttcagctgatccggatagagggggtgaaagaacagtgctagtggtagtttactatgctcaatcaatgttaattaattaattaatcaaccgggattgcggggcaatcgtatgcacgtactagcagtagtagcagcaagtcagaactgggtagtattggtggtagtttcaatgggtggatgccctaacggagaatctcagtagtagtacgtactatttgctaagccatgtacattatgaattggtaatctttgtaagtatatattatgtacgggttatcatcatgctggtggtttatcgtgaaaaaaaaaaaaaaaaaaaaa

SEQ ID NO: 29068 - DNA, 991 bp, Triticum aestivum
  unsure (1)..(991): unsure at all n locations
  Clone ID: PAT_TA_29068
cacgcccgtccggnaatgaagaagataaaaaatccagtgtgaacaatgatgcaaagtcaacatgtntctgaaaagaatatcattccacactcaaacagagattttcataaagaggagacttcgacttattggctaccgaaagatcaagaagaacaatatagactgacaggacaacattttgctgtcaaagaactttaccaaggaaacatattaaaagatgtttgtgaaaaattagatttcaagaaagggatatctgttttggacgtgggttgtggatcgggtgcatggattttggacatggtatccgactatccaaattgtacctacgaaggatgcgatattgaggatgtcaccaacaaacgattatcactcaagcagacacactttcggactggcaatgtgctccaaggacttccttaccctgacaacagctttgattttgtgcacatgagactactcatcttggctttcaaggttgaagaatggccgatggcaattgatgagattttacgtgtaacaaaaccaggtggaatgattcaacttcttgagtttgatcttaagatgaccggcaacgaagcagttcaaagaattctgaatgagattcatgctgtatgtcaatcgagaggtcaagatcctcgtattgctttaaagttgaagaacatggtggcagaaaacaagcatgcaaggtcagtaaaagcagattatagatcggtggatatggcttccaatagcatggcagccaagaggtttatttgggactggattgaaacagtaaagagtatgttgcctgtcgtaggatcaagaatgggtctcgaaagtaaaaaagatcaagatgcgtattttagagaactccaatatggattgactcactctgatgcttatacttatatgaatgctgtagtggcagaaaaggcataagcacttacaactagatcttagaccttggctgttaaaagcttgtgatgtatattaaaaacaaaatgctatcagg

SEQ ID NO: 29069 - DNA, 634 bp, Triticum aestivum
  Clone ID: PAT_TA_29069
cggacgcgtgggtttaaaatgacctactttgatactcttgctcgatcctatgttgatgttgataccagcaaaggtgtagataccgaacaattcttggaagctactgagggacttgttaagctttttgatttactcggttctgctgccttctctgttgttcagaatgacatgaacggtaatattaagaaaatcagagagcgctacttgtccaaccctactgccaataacacgcttgaagaattaatgaaaaatgaatctcctgagaagaaaagagtggccactgagggtcttctttggttgacaagaggtctcgattttaccgcacaagctttacgtcgtagtttggataatcctacggaagaattgaatacttcttttaccaaatcctatgagcaaacactcagaaaacaccatagcattgttattcgtcctgtctttggtcttgctatgaaggcctgtccttatcgtaaggacttttacgagaagattggtgtcttgactgaagatggtttagctcaaatgagagcatggcttgaagctcttgaaaatattatttctatcattcaaaatgtatttaaagccaaccctgcatacattaagggcatgtaaataaaaaaaagtgcatttgatttat

SEQ ID NO: 29070 - DNA, 957 bp, Triticum aestivum
  Clone ID: PAT_TA_29070
tcttaaaaaagtttctttccaaacgaaacaaaacactatatttatttttattattatcgatccttggtacctatttaggtgactttgtcacggctgctcccatcataagtggtgatggaaattcagccacattaacattcgctggtcacactgtcacagtacatggtattgtctttagtgtaatggtatttgtaactggtggttatctatgcttccttggaggtgtattccagaactttactatgtttattattggattctatgttggtgcaaatatagcatacattgtcttatcaaacgctaaagcagactatgggtccaacacagatacaattttattagttgttagtatcgttgccggtattttatgcggtggtttattatgctgctgctttttcttggctgtttatctcttgggtgccttacttggttacttggctgccctttggttattatcctggagcacgaacggtcttattcaatccaactggggccgtgctgttttgattatttgttttgtgatcgcaggtgttctcttgatggcattccttgaacgacctgtgtttgtagtgggttctgcatttatcggttcatttgccatcatgtgcggtgctgatgtttatgtcaaatcaggtttcttggaactcgtaaatcagttcatacacgcaaagaacttggatattctagtagatgcaacacctaccttgagaggtatgttggccggttgtttaggccttaccattgttggtagtttgattcaatggtgtatgatccgtcgtgattcctctgtttatagaggatggaatgaacgttatccttaccgtgctggttggagacgtgtataaaggatatcctattaaaaattatctctttctactgtatatcaaatcatttcttttgtatattattatatcgcataagttttcaaaataaaacattgtatccctatttttatgt

SEQ ID NO: 29071 - DNA, 696 bp, Triticum aestivum
  unsure (1)..(696): unsure at all n locations
  Clone ID: PAT_TA_29071
ccgccgtgcggctgcctcccgagttcctggaggccaccaaggggaggtgcctcgtggcgagctggtgcgagcaggaggcggtgttgcggcaccaggccgtcggcgtcttcctcacccacagcgggtggaactcggccctggtgtcnatcagcgccggggtgcccatgctctgctggcccttcttcgccgagcagcagaccaacgcccgctacgcgtgtgtcgagtggggcgtcggcatggaggtcggcgacgacgtgcgccgcgatgaggtggaggccaggataagggaggtgatgggaggcgagggagctgggagggagatgaagcgcagggcggccgagtgggaggagatgtgtgtccgtgcaaccgcgcagccgggtggcaggtccatggccaaccttgacagcctcatcaaggatgtgctgctcaccgcaacaccaacaaactaaaacactttgattcatgagtagtatccaagtgtttgttttcagaataaataaccatgtttgaattttagttcatccatgaattaatgcgctttcctatgcctgtaatccataattttaattaataaataaaaattccagtttcatccaaaaaaaaaaaaaacctcggccgcgaccacgctattcaccaatttccccgccgccccccacggcccggggggcagcccacgcccgcggccgggcccaattt

SEQ ID NO: 29072 - DNA, 363 bp, Triticum aestivum
  Clone ID: PAT_TA_29072
ggcggtgactcgtccgctgagtctggtagcgtggaggcagaggcgccgtcgttgcccacgccgtcaggcgggaagaagtcgccaccagcgggagcggcgtccaccacccacgcctcggctccggtgctgatcgtgcttctggcattggtgggtttcttggcgattgtgtgatgtgagtgagattaatctgtccacgggagggaaggatgtaggatcgatcgagctagttttattgtctcttggacacggatgtataattttgcccttctcttgttcatttttttctctgggttgaaataaaagtgattgctgcattgtcaaaaaaaaaagtgattgctgcattgtccgagaaaaaacagaact

SEQ ID NO: 29073 - DNA, 383 bp, Triticum aestivum
  unsure (1)..(383): unsure at all n locations
  Clone ID: PAT_TA_29073
ttttgccagacgcagtgtctcagcgtggagggatatccgcaattgaaggcgaactgtgtctacttcaccgatgatgatggatttatttcatcgtatcagaatagtaaacgtgatataggtgttataaatttggaaaacgacaccagggaagaaattgtacctcagatttattgcagctggacaaattccacatggattacacccagtcttagaatgatgcactcgggattgatgtaattgtgttcaaatgctatgacaatggaggcatactccatttatatttgtcgaatcaataatataaggccctgtttggttcgtnnnnannnnnnnnnnnnnnnnnggggggnnnnnnnnnnnnnnnnnntttttttnttttnntnttt

SEQ ID NO: 29074 - DNA, 2108 bp, Triticum aestivum
  unsure (1)..(2108): unsure at all n locations
  Clone ID: PAT_TA_29074
tggtgccccctaacctttccctgctttccactgaaatctcctatctgcaaccatacacactgttgctcttcttgctcaattctgctctcagcaaccatttctccatatataagtcactatcccctctgcatttcccaccccttcttcagccatggattcctgaagaagctccgtgctaccagaggaggcttctgctgtgagcaattgcaagctgtgtgagttccgcgaacctcgtcgggtctgcgaatttcaagctcgcaggctctgcattgcactgaaatggggaggcattcgtgctgctacaagcagaagctgaggaaggggctctggtcccctgaggaggatgagaagctcatgaaccacataaccaagcatggccatggctgctggagctctgtccctaaacttgcagggctccaaaggtgtggcaagagctgcaggctgaggtggataaactacctgaggccagaccttaagagaggtgccttcgctcaggacgaggaagacctcatcgttgaactccatgctgtgcttgggaacaggtggtctcaaattgcagcacagatgcctgggaggactgacaatgagattaagaacctctggaactcgtccctcaagaagaagctgcggcagaagggcattgaccccaacacccacaagcccctcaccgaggctgatcgcagtggagcagctcccaccatcagcaccgagaggacctctggttccagtgacgtcaacccgtcaagcgctggtgctcaagggaacttcggtcacctcctcagcgagacagcccaatcgtcaatgctgctgccggtgtatgacaagaagcaccctgaaactccaagcttggcacgacctaaggtgccagcaaaggagttgttcctggaccagcttactgctggtcacgagagcccatcaagctgccgttcatcaggtccaacgctgtattttcctttccagcagcaattaggctacaagcaacgagtgtggcagtggagatggtgcaaatatgaactcgctctcgctctgccaagaatgatttcaagttgcaacacaatttccactgtgatgccaacagtttcaccatcaagccctctcgacgccnatgggactgaacctcccaccaagacaatcaccaccatgggggcactggcatcggcagtgcccctttctactgggatggtgttaatcctagcagcagcggtagtaccgggagcagcggaagcaacagcatggggttcgagccacagagcacgaactcaattctggagaacagtgtattcccatggacagatatcggagttgggcaagaaaaggataccagagttcagttagtggaggaactcaagtggcctgacttgcttcatggaacctttgcagaggcaaccacagcgatgcagaaccagagccaatcactatacgatgatgtgatcaaagcagagagccagttcaacatggaagggatatgtgcttcttggttccagaatcagcagccacagcaacagctgcaagcagcatcagacatgtatgataaagacttgcaaagaatgcccttgtcttttgagcatatctaggtaccatgttctgccatacatggaacagagaagatcagcagaagttcagacttgtctcacaatttcgtgagcaggctatgctgaggtgcttgcatagatacatatgcgggttgatacaggaatcaaccctccacaaccttccttggttaaagatcatgcagtgccacggaaaagacagctctgtcatcaggagtggcgtcaaattgcacagaaaagtacattctggagtctccctttctttctcttgaaaattgttgttttcttctgtacacgacagctcaacttttggatacttgagtttttgttcactctctgtttatcaaataaatagacaggaatgggaaaaactgcatgtgtcggtagctatcactgaccatacaagtagtcccagacttttcaactgctgccatgcacgtagatgggaattaattattgcaagttgtatttttatatcttttgagaagttgccgacaaactgcagttgtatatttgtaaaggcagaaaattggaatattgacccatgagctttttctc

SEQ ID NO: 29075 - DNA, 3459 bp, Triticum aestivum
  Clone ID: PAT_TA_29075
ccgggacccggcctcgcgggtatcgggcttagtcagctacctcattcgcatcgggagatcctccctccccctcctccccctccccggatcaggccggccaaaccccctctcccggatctcggatcgggaggcggaggccgacccctcccccaaggtgccatcatggcagcaaacacaggggcttcaggatggctaaggggcaaggtgaaggctgtgacgtctggagactgccttctcatcatggggagcaccaaggcagagattccaccagagaagtccatcactctgtcataccttatggccccaaggctggctcgtcgtggtggagtggatgggcaatttgcttgggaaagcagggagtatctgaggaaactctgcgtaggaaaggaggtcacatttagagtggattacactgctcataacatcggactagcaattggcactgtctaccttggcgacaagaacgttgcctacttggtggttgatgcaggatgggcaaaggtgactaaggggggccccaacgggggtgaaccactcccaaatgtgtatgaggttctgatgctagtggacgttggtaggcagcactgttccgagcgatgtggtgacgagacagctgctgcaatagatccacaactagcaatcgtcccagatgaggtgggcgaactaagtggtgcttatgcaaagggttatgcagtgatagtcctagccaagtttagcgtcgccaactcctggaaacggcctgatgtcgttactgtaccctcctgagctcgtcgagtttggcaatgacgcctttgaattattctacagtgtgtttggcaaacaagaagtgggtccttaagcccgtatccatcttgcagacccatcagtatgcacttctaatcgtcttgctcagctcggcgaccttggcgacactactgcaccaggtctgaaggaacaaagtggtgctgcagcggcagagtatactagcgtttgcccagagagcagttcaagacaatatcgggcaatgatcgaggagcgcgttactactcgtggaagagtgaagtgaggtggcactgaacctgtgctcatggtgtctcatgttgttgcagagttacaatccagcgtcaaatgctaccaattgctcctagggcgggctgaacacgacttgaaaggagcaggagagttgagaccccaaggggaagaagacgaacttctcgagaagctgaagaaggtccaagcagaaggcgaagaaggaaaggctgcggctgtggcatggaggagacgtcgaatccagacgaggaagatcaagctccaggcgggaggagacccccgccgcgtcggtagatgagagaaggcactggcgcagtcatggtttagatatgaaagttttggacaccgagcggaactcagtcgagagcttatatatgaaaactagtgagagagagaagactatatttatgcaattagaagagaactatatacattgtttttccctaagctcaataaggtctgtgtcctttgtggactgcgtttcttctttgtagagacagaacatataataccgaggattgcagtcaaatggaaattaaattcaggtttggaactttaatataacagtttaagtttatggatcagtttttctaggttcgccatcaccggcggacggagatgacacatcttctgctccaagcacaggcacccagcctaaaattaatgttgctgagcttttgctctcacggggcttcgctgagatatcaaaacaccgtgactacgaggaaagatcacattattttgatgctctattagcggctcactcacgtgctgagaaagcaaagaaaggaattcactctgacaaacttcctcctgtgatgcatataaccgatttaacaatggttaattctaagaaggccaaagatttccttcccttcctgcagcggaatagaaggcatactgctgttgttgaatatgtgttcagcggtcatcgtttcaaactgacaattccaaaggagacttgcagcatcgctttttcattgtctggtgttaggtgccctggtaaagatgagcctactcgagcgaagctattgctttgatgaggaggatgattctacagcgtgatgtggagattgaggttgaaacagttgatagaactggaacattcataggttccttgtgggagtctaagaccaacgtgggttctgttcttttagagtctggcttggccaagcttagttcatttggcttggataggattccagatgctcatgtcctcacaagagctgaaaagttagcaaagcagcagaaactgaagatatgggagaactacgtcgagggtgaagaagttactaatgggtcagcctctgaatccaaacaaaaggaaattctcaaggttgttgctactgaggttcttggtggtggaaagttctatgcccagacagtaggtgaccagagagtagcttccatccaacaacagcttgcatccttgaaacttaaggaggcaccagtcattggtgcttttaatcctgggaagggagagatagtccttgctcagtttagcctcgacaactcttggaatagagccatgattgttaatggaccccgaggagctgtagagtctgtagatgacaaatttgaagtattctacattgattttggtaaccaagaagtggttccttacaaccgcatccggcctgcagacccatcagtatcctcctctcctcctcttgctcagctgtgcagccttgccttcatcaaagtgcctggtctggaagatgataatggtcaggaagcagcagagtatcttagtgaatgcttgctaagcagttcaaaacaataccgggcaatgatcgaagagcgcgacactactggtggaaaagtgaagggacaaggcactggacctgttctcattgtgactcttgttgatccagagacagaatccagcatcaatgctgccatgctcgaggaagggcttgcccgacttgaaaggggcaagagatgggacaccaaggagaggaagacagctctcgagaatctggaacagttccaggagaaggcgaagaaggaaaggctgcggctgtggcagtatggagacgtcgaatctgacgaggaagatcaagctccaggcgggaggagacccccgccgcgtcggtagacgagataatgccgcggcaggcagtggcgcagtcatggtttagatatgaaagttttggacaccgagcggaactcagtcgagagcttatatatgaaaactagtgagagagagaagactatatttatgcaattagaagagaactatatacattgtttttcccctaagctcaataaggtctgtgtcctttgtggactgcgtttcttctttgtagagacagaacatataatactgaggattgcagtcaaatggaaattaaattcaggtttgatactttaatataccaaataaaaaaaaaaaaaaaaaaaaaaaaattcgccctatagtgagtctat

SEQ ID NO: 29076 - DNA, 752 bp, Triticum aestivum
  Clone ID: PAT_TA_29076
ttctagttctagatcgcgagcggccggtcttttttttttttttttgctagttataacagcctagtaaagactattcatatttatttataataagcaagcaatatggtataagaaattaagcattcgtatcttgacaacaatcccagcaaggaccaaactgcttggaaagccagcctggagggggggggtgcctttgggaaaacatgctttcaaacagttatcttgctctccaagccgccgccctcgtcggtctcctcctccaggccgaggtcatccacgtcggcctcctcctcctcctccccctcctcctgccaggccggagaagccgcctcagccggctgacgcggcggctgcggtggactctcgggggcatcgcaattgcggcagcggcccccggcgtagagccgctccacgatgccgtcacggcgcgcgcggaggtcggctggcgcggccgcggcgagcgcggcatcgacgaggtcccacacgtctccgcccccgaaggcggcgagcgcgcgccgcaggcgaccgtcggcgtccatccgctcgccctgatagtcaacacccacgaactccgataaggcaacccggcgcgcaccaccgatacactacggtccgatcgctacgcagacggactacgcggccccgccgccgagtggagcgcagccatgtgagggaacggattggtggtgggaggcggcgatttggattggaggagggagaatggggccgcgattggggaaattggacgcgag

SEQ ID NO: 29077 - DNA, 1991 bp, Triticum aestivum
  Clone ID: PAT_TA_29077
ccgcacggcagacccactcctcccgtcggcggccaaccacctcaaattctccacctccgtccccaattcgcaagtgcttgccgattctcctgtggagcgcgcgccgtcgatatcttgggatttcggcgcggtccggccagggtcgcgcgggagctattgacgagcccgtggccgccatctctcccgcggtcggcgttgccgtccccgacccacaactcaactgccggtttagcttcgtatccaccgccactctcggcatgcccccggaagaagcctacatccgcatttcagggggctgcgagggcatgccagccgccccatgtcgacccgcctctcccgccgatgccggcaggggggatcgccacgcggatcctcggaggagcggagctgaccgcgtcgtccgaatgcgagtgatttgcagggcaccctctcttggctgcatccgggagggcattggtcagaagcgattcaatgcccggttactccctcctcgaccttcgcccaccccctcgcctccctagcgggtttcataaggaggagtccttcctggaccttcacccttagtcttccctgctcagaggcgagcagatggaggaggctactaacccaaggaaagcttcttctgatgggagcacgttggaggggctgggggtgccgccgagccaggacgattacaacgctgccaagatcaaggtcgtcggagtcgggggtgggggttcgaatgctgtcaacaggatgattgagtactccatgaatggtgtcgagttttggatcgtcaacaccgatgtccaggcgataaggatgtccccggtgcattcccagaacaggctgcagattgggcaggagctcactcggggtttgggtgcgggtgggaaccctgatattgggatgaatgccgccaaggagagctgtgagtccatagaggaagcacttcatggtgctgacatggtttttgtcacggctggaatgggtggaggaactggaactggaggtgctcctgtaattgctggaattgccaagtccatgggtatactgacagtgggtattgtcacaacgcccttttcatttgaggggaggaggcgtgcagttcaggctcaagaaggaatatcagccttgagaaatagtgtggacactctcattgtcatcccaaatgacaagctgttgtctgctgtttctccaaacactcctgtcacggaagcattcaacttggctgatgatattctttggcaaggaattcgcggtatctctgatatcattacggttcctgggttggttaatgttgattttgctgatgtgcgagccataatgcaaaatgcagggtcatctttgatgggtatagggactgcaacaggcaagtcaagagcaagagacgccgctcttaatgccattcagtcaccactgctagatattggaattgagagggctacaggcatcgtgtggaatatcactggaggaaatgatttgactttgtttgaggtaaatgctgcagccgaagtaatctacgatctagttgatccaaatgctaacctgatatttggttctgtcatagacccatcgctcaatggccaggttagcataacgttgatcgctactggctttaaacggcaggatgaagcagaaggtcgcaccgcaaagggtggccagcaaatgcaaggagacaatggtcgacatccatcttccacaggtggcagcaaggtggagattcctgagttccttcggaggagaggtccttctcgcttcccgcgaatttgactcttctccagggctccctttctcagatatgcctgttgagactcgcctctcgtagattagatgccctattgtaagataccagacctgtagagtctagctgttttccgtagaggttttatttttttgtagttttgtttgatctttctgttctttatcttggaatgctactgccaataatgtgtagctgtgagcatatcagtgttgtagaaaatgttctgccctcctggtgtgtcgtatcg

SEQ ID NO: 29078 - DNA, 859 bp, Triticum aestivum
  Clone ID: PAT_TA_29078
ctgataagattgcacattcttgggttactattccactggagagcaataaagaggaatggtttgttaagcaaggtgctatggttaagcaggtcgttggcagttcccctgtccatttccagtccaagtataaagaaagcatgggcgaagataagattgtgttctgtggcagcgaactgttttatgtgccccgacagtttgttgaggacttcggtgatcttgtgggtctcgttggcagtttggatctgcatcataagattgcggtcccgatgttcttcttggcgatggactcgcctcaaaattttgattccgaagctctggccggaacagttttcaagaccaacttggcagccaatgagactttctcaagtatttatacagctcagtcacctgctgttttcccagttaaagtgatgaacgagattgatttcatcaaggtaatccggcttatgtccaaaggagaccctcttctgatggagttggtataaatatcattcttgtagttgaaatgcaaacattattcttccggagcgaggccagagtagacagcgatagttttgagttttcaggggtttctctgttgtaattgcatttattctgtagctgttcatttcaaaggtgttgtacattgtgttgtatcaatagtgacaaggttactgggggttcagcttggtccggctgtcctgctgaaggaaagaaaggatagctaagacttcactgagaagagcctcgacgtgggcatcggtttttgcaagagttttggtggtcggttatagtacagattcacacttgagcagtctattgtacccttcaacattggcaaatgaaaatcaggcatactctctggcttccgcttggtttt

SEQ ID NO: 29079 - DNA, 771 bp, Triticum aestivum
  Clone ID: PAT_TA_29079
gtattgttggtgctcaagttcctcttggggccggcgttgccttctctcaaaagtacctcaacaacccctctgtcacctttgctctttatggtgatggtgcttctaaccaaggtcaggtctttgaagctttcaacatggccaagttgtgggatcttccttgtgtctttgtctgtgagaacaacaagtacggtatgggtacctctgacaagcgttcttctgcttctactgaatactttaagcgtggtgactacattcctggtatcaaagtaaacggtatggacgttctctctgtctacagagcctgtcaatatgccaaggaatggactaccactggtaagggacctcttgtgatggaaatttccacataccgttacggtggtcactccatgtccgatcctggtaccacttatcgtactcgtgaagaaatccaacatatgcgttccacctctgatcctattaatggtttgaagcaacgcttgatcgatatcggtatggctacagaagctgatcttaaggccattgataaagaatgtcgtaagattgttgatgaagctctcaagaaggctgaagctgctcccgaacctcctctctctgagttccatacacaaatctatcaacctggaactgagcctcctgttgttcgtggtcgtgagcctaatgaagtctatcactactaaataacttgtattatcatctcttattccttactccccatacttttttagataaaaaaaataaaacattttaaatgtacgtacatcatttaatctc

SEQ ID NO: 29080 - DNA, 649 bp, Triticum aestivum
  Clone ID: PAT_TA_29080
gcaccccgcccgcgacgggacgcaccgccgcgatggactcctcgagcacgagaaggccagccgcgttctccgtacgttatgcacgacaacaacatccgtggcgcgtcgtccccgccgcggccggcggctgcctgctgcggtgggagttcgagtgcgagcccgtgcggggcacgcccaaggaggcgctcgaggcgcggctgcaggccgggctcgacggcatggccgcgcgcgtgcacgagcacctcatgtccgcgcgcggggccgtcgccgccgccgcgccgtggccgcagggctggaggccgccgatgagctcaagctggacagctccatcgcggcctgagctctgagcactgagcactcgacgtacgcacacggttccacctctgtgtgcacgtaccgacgacgcacgtacgtttggttgtgatctcgtctcgttcttttctcgcggtactattacgttgtctgatgatattttatctttgttctgttgttctgggcctttgtctgcttgccgttatgtatgtgcgcgtacgtaccgtttactacagtacggtagtgcccttatatatacagctgtaccgggaataaatgtatgatattactcgtaatatatgcaagtgatcagtgcatgtgcagtcttttcaaaaaa

SEQ ID NO: 29081 - DNA, 1168 bp, Triticum aestivum
  Clone ID: PAT_TA_29081
gtcgcccagagccccacgccggtatcaccctggcctccaccgcccatctgcccctcccccgcgctctccggccggtttctcccgcaaccccgccagccgcaacccccccccccacctgctagcgcaagggctgccggccccagccgtcggcggccgccccgtcgtcggccgcgcccgccagcccgccccgtccgaggccgcgttcaccaaagaaccgccactccgagatctttaaactgggaaatcgaaaacatattcttgatcgactggtttgggggtcctaaacctatatctccttcacagtatgcttgattatggaagggaccagggctctgtgatgttcttgtgagtgcggaatgctgccgaaatccaatatccttagcatgtttgggtatgcctttctgaaagacgtcaaaactgtacatactgtaatgacatgcgggattaaataaacacataatatcgcttttgttgaacatttatgtcctcaccgcggagcccaagaaccgctgttcattgccacatccggcttatggtttgggcatagtggcagaaaacctcaggatgccgtaccgtgaccgtttgaaagcgtcgttgtagtaggtattctcaagggtaccaaatggggcagggttacggtgcactggtggtattttgttgtggcactgtaaagcagcatttattccgcaatatagtaaatactattgtcaaagacttccaaactgtacatactgtaatgacctatacggatttaataaacacttaatattgcctttgtcgacggtcaaaactgtacatactgtaatgagcctacgggattaattaaacacataatattgcctttgtcgacatttatgtcctcaccgcggagcccaagaaccgttgtccatgatcgcctcttgccacagccggcttatggtttgggcatagtggcacaggatgctgtactgtgaccgttcgaaagcggcgttgcggtaggaattcttaaggtgccaaatggggcagggttacggtgcaatggtggtattttgttttggcagtgtaaagcaacatctattgcgcaatatactccgtagtaaatagtattgttacatgttgcaccaagagatggtgtatgaaattgagtttcagtgaggtaataaagtcccattcttgctgaaaaaaaaaa

SEQ ID NO: 29082 - DNA, 936 bp, Triticum aestivum
  Clone ID: PAT_TA_29082
ctcaacaaccaacgcgaacaacggaaagaagatggcgcaatccgtcctccggttcctccaacaaaggtacaatgcaatccgctcccccaagaaaggccgttaatttaacaatccgctggcaacggaaagccaacctcccgtaaatcggcacgaggctttgctgcccacttgcgacagccttgacatcttggacgcctgcaatggcctcctgctctgccgctgctggaaggctgctgatcccctggaattggattatgttgtttgcaatcccaccactgagaaatgggtgtccttccctgccaccgactggtccagcaaggtgagcgtcgctcgcctcggatttgacccggccgttacttcccacttccatgtattcgagttcatagatgaggaggcctggggtatagccgaggacgagcaaagcgagtgctatggacgcatccaaacactagcaatttactcgtccaaagctggagcgtggaaatatcaaacagttgagcatggaccatttgcgatacccaagaattcacccggctcatttttaaacgggatccttaatttggctgcctataataatttaattgtagctgttgatgtggaaggagataattggtcacttgttcatattcctaagccaccgtactatgcggatgatatcaatggcatatttccatcacagggacagttgtattttgcaaatagtcctgctgattctgatggttctgaattatcaatctgggttcttgacgacttggttacaggaaaatggactttgaagcacaatgtgagccacttgcagttgtttggaacaaagtattcatcgtatgcgaatgattatagtgttatttcaatgcatccagaacacagtttgatttttatagtcggtggacatgacaagacactaatgtcatatgacatggattctagacagctgcg

SEQ ID NO: 29083 - DNA, 225 bp, Triticum aestivum
  Clone ID: PAT_TA_29083
taccggtcgacttcagggtgcaccgggcccacgtatttccggggatgtctgtccagggatgtggataagggcggtgttgtaatacctactctctccatgccggtgtattagtcattttaggttatacaccgcgatcaaggcgagggaaaaacgagagaatttgatgtttaattactagtacttaatatcatttcatgctgagaattgaagattgcatgttatgct

SEQ ID NO: 29084 - DNA, 648 bp, Triticum aestivum
  Clone ID: PAT_TA_29084
cctttactgatgtgtttgcctttgggattttccttcttgaggttgcctgtgggcaaaggccagttaacagcaatgcacgagcaaatcaacctttgttagttgattgggttcttgagcattggaataagggatcactggctgaggcagtagatacgaggctacagaatgactataatgttgacgaggcatgcctagtgctaaagctaggactactatgtgcacacccatttaccaatgcaaggcccaacatgcagagtatcatgcggtaccttgctggcgagtcgcaattcccagagttgacagatacagatatgagcttcagcttgctctctcaaatgcagggtcaagggtttgaccgttatgcgttgtcatatctttcattaaacacgagcattggcacaatatctggtctttcaggaggaagatgatatcaatcttggttgatgttataattataatatatgtgagcttgcatgccacatattatatttagtaccaggtcatgtaatgtttggggctaggttactcttctcagaggcttttcttattgttagagtagtgcgtaattgctttccgaaaggtgtttacagctcataattttaataactaaacgaagaagctacctgcgtacttgtggggttgatttta

SEQ ID NO: 29085 - DNA, 935 bp, Triticum aestivum
  Clone ID: PAT_TA_29085
gcgctctcccccccacgcctccgcacaggaagagacacgctacagaacagaacaaacagtaggaggagcgctctccttcggccgcgcgcgtctgcgtccgtcccgcaatggaggcgtgactcgcgagcggtggtgggcgcggatagagggggtagcgggtgagcaatctgccgggagaacgccgacgccgagcccagcccagcccaggtccattatctcccgtgtttgaggaagtcccctaggctactatggggaagtccccgcctaagtgggaaatcaacaaaatccaattctaccaagccaaaggatcttccagcaaaggctgcaaacagcaacggatacactgctgggaaggagcctgaatcctctgataattctcccctcatctcggagccggtacttgttagctcccacaatgtgtctgaaatttccaacttgccaaatgggagggcaatcgaaaacatggttagagttgggtccgacacgcaaagtaatcgagtgggtctgacacgagaactagcagcagtgaactcgcaggccgcttttcgaggttacctggcacgcagggccttccgggcattaaaaggtatcatcagacttcaggcactgattccgagggcatcttgtaaggaggcaggctgtttcaacccttcatgcaacgtggttgattgtgaagtttcaagctctagttcgtggaagaaatgttagaatttctagtgctgccatgcaattagccgtgaagtttggccaacataagtatgggggtgacaagtcatcggatgcatggaaggagaagctatcttcgcatccatatgttcgaaagcttctgtcttcaccagttttggtacaagctcttcacgttcagtatgacgagacaaaccccaattcagccctcaactggctggagagatggacaataagctgcatctggaagc

SEQ ID NO: 29086 - DNA, 500 bp, Triticum aestivum
  Clone ID: PAT_TA_29086
gaccttcaaaaccggaaaaaaggatcccatacagggggcaacggcaacgacaatgggaacagatcaagggagcacgaccgtgaccgctactatgagcggagccgtgacagagagaggccctatgagcagggaggtagagggtcggactatagaggcggttcctataacagccggagggattctgaaagggcgaggcccagagacaggaacggtggtgatttttcaagaagaggagacccggggaggatgaggagcaggtcccggtctccgggcaggcatggttattaatcatttcaagttatatgagactcgtgaggtagaccattatgctcctttgtttattcattcagtcgcaatgtctgggtgttgtcatgattaaatttaaaccttactctgctctagcagctctttgttgaaaccatacctatggtcttccttttattatagagaggataaaaaacagaggaaggtaccaaaaaaaaaaaaaaaaaaaaaaaaaa

SEQ ID NO: 29087 - DNA, 679 bp, Triticum aestivum
  Clone ID: PAT_TA_29087
cacaggacaatggggcgcgcttctcagcttacagagctcctacaccaacaatggcagctccttgtattcattctcccacttatctccctcctcttcctacgccggagatgggacaggtccggtggccttaggctgccaccagggccctggaagctgcccgtcgtcggcaacctccatcagatcggcccgttgccccaccggagcctctcgaagctcgcgaggcggcacgggccggtcatgatgctgcgcctgggcacggttccgacggtggtgctgtcctcgccggaggccgtgcgggaggctctaaaggtgcacgacgcggagtgctgcagccggcctcccgcggccgggccgcgtctgctgtcgtacggctacaaggacgtcgccttctccccctacagcgactacgtccgcgacatgcgcaagcttttcatcgtcgagctgctcagccgccgccgcgtgcaggccgcttgctacgctcgcgatacccagatggcaaatcttgtgaagaacctcaccaataccggtcgaaagccagtggcggttgccgaccacatctttgccacgctggacgggatcatcggctctttcgcctttggcgaaaactacgcggcggagcagttcaaggggcagtttgtccccgtgctgaacgagaccatggacatgctgagcggcttct

SEQ ID NO: 29088 - DNA, 770 bp, Triticum aestivum
  unsure (1)..(770): unsure at all n locations
  Clone ID: PAT_TA_29088
gcgcctcacacttccacggtccgcgctccccacgaccacgagccccccctccctccctcccgggtcacgcaccacgacccgacttcccaacagctggccggagacgaagaagaagacgaccacacatcctctgtgtcccgggcaacctcaaccgccagcacccacgcgtccggctgaacaggagatattaggcaataacaccagccggccttcttcccggctacattaactaacggtttgtggagaagccaaattcagggtcacgcatgggctcctctactgagagcagaagcagaatgggtagcataaagcccatggggattcagctcatcgagtgtgtccgcggcggccctctctccttcagatcatctcaggctcttgtgttggtgctcaccttcctgtcatatgctagttatcatgctactaggaaaaccacaagcattgtcaagagtgttcttgatcccaagacaacaaacctaggcttgttgcactggccgagccatatgtatcttcaagaactgaaaggtgcagcgaacaacacggctctccagagcggctgggctccgttcaatggcgaggatggcaccgggctgctcggcgagatcgacttggctttccttggggtgtatgccattggcatgttctttgccggccatttgggtgaccggntggatctcaagatcctcctgaccatcggaatggtagggaccgggctgttcaccgccgctttcggagctggctactggctgaacatccacagagactactac

SEQ ID NO: 29089 - DNA, 1731 bp, Triticum aestivum
  Clone ID: PAT_TA_29089
ttttttttttttttttttgatcctggttgctcatgtccgaaccgcacacctaatttttttttttttataaacttggttcagtcttataaatcatggataaagaccagtaaaagaataaacaacgcaaatacagttaacaattgtcgctttatactcactgctaccattctctcaacaacttccttgttttatcaggtggtagacaggtccgagatactgccagaagctacaatcctagtagaaggtagatttacaaaacttgcagtcaactatccaggacaaccctctcttcttcaaccattgacaaaactcaaagatgataagtatccaaccactaacatacttcaagatgatgatggggtaccatgttcatcagaatcatcgaccatcctttctaacgactcgatatcaccagcttcagaaagggtacgactgcgaaggctgtctgcatcctcgtctgtaactccaaagatttctttgacaacaagcgagccgtcccgggaacagaactctgggagctctgataagtacatgatttttccgaacaatgtttgcacagcaagcttccgcttaaaaccttgctctgtaaacccagataagtccataactattggacctttttcccgaacaattcgtctagatatctcattcagaatttcggcaacttcattatctgctaacatcgatgctttcctaagatgtatgagatccacaaccacatcaggattgaattgtttttcattcagtgtgtatcggatgtactttcttactacatcatccatgtcaaatcctgtcttttgcattagttcttgaagagctggaaaatccactgcttccctgcccttctgaaacaactcgtctagtgacttcaacaagaatatattcttggtcaccctcttcttcttctgagtgcgcggggaggtgaacctgcggaaggtgcggacggcggcgagggcgaaggagacgccgacgtaggcgagcggcacggcgaggagccacggcacggggctggagccgacgcgggggccggggatggcctgcgtgacggtgccggtgaactccacgaggtccagcgccttgtcctggatccacggcagctcctcctcgacctcaacctcctcgtccgcctctcgcttcggggcagcggtggagttattggtgcgcttggcgcgggcgacgaggaggggcgtcggccgccggggggccgtgcgggccggggcgagcagggtgagggggcagcgccggacgcgtcccccggcgatgggcacggagagcggatggaaaagggtggtggtggtcgccatggagaaggaggtggaggggctagggcttatcgcggcggaggtggagttgggcggggctcctccggggtgcggagaagacgcgcctcggtgccggtgaactcgacgaggtccagcgccttgtcctggatccacggcagctcctcctcgacctcgacctcctcgtccgcctctcgcttcggggcagcggtggagttattggtgcgcttggcgcggaaaattccccactgctgcctcccgtaggagtctgggccgtgtctcagtcccagtgtggctgatcatcctctcggaccagctactgatcatcgccttggtaagctattacctcaccaactagctaatcagacgcgagcccctccttgggcggatttctccttttgctcctcagcctacggggtattagcaaccgtttccagctcgtgccgaattc

SEQ ID NO: 29090 - DNA, 1135 bp, Triticum aestivum
  Clone ID: PAT_TA_29090
ccccgggctgcaggcgcaaatcgaactcgcttcgctttactttttcgccaaaagaaaagaaagctcgctccgcttccgccgccgcctaaatcgagaccatggacagtgccgcctccgtcgcgggagcgcccccggcggtgccgcccgcggtgctgtgcgccgccgaggaggccctggctgccaccgagtccgtgggggaccacctcgccgagatgctcgccgcggcggccgaggaccccgacgccatagccgagctcccgcccctgcaacgggcgcgcgccttcctcgccgtagcccacgccgcgacctccctcttctcagtgcggctgcggtgttcggggataaatccggacgagcaccctatcaagaaggagttcgagaggttaagcctgtggcaggagaagttaaatcgattgaacgaatgggacaaggcaccactgcgaccttccaccaccgtgaacacgcaagcggctgcaaggttcattggtcgttcgttgtcccatttgactgatgaccagaagaggggcatgcaggcaatcagtaaaggggaaggggcgggctggtctgggaggaagaggaagtcacagccactgccagagaggaagtctgttcgtgctgccgcggaagagttcctcgcgaaggcttctcaggagctcattgggtataatggtagcggggtgaagggccctgttagaactgtttttgatgaagacgaggactagattgatgtgttggtcttatctcttgtgcagctctcagggaaacaggagctcggaaaatccgtcgcagcgggcgtgtggcaagtcttcctggtcctgacggccaatggtttcttcagcgtgaagcgaggctggcctcgtgtcattctcaggatcggagacggttagaagaaaagctgttgtggggataagtctcgttagctgtatgtagcgttggacatatgtatttttagtggttgctgttgctcgttcgttttgagatgtttggaagaataatttacccctgtgcgggtcttgtgtgccagaggcacttttgttactcgatctgaggtttcgaaaagcctgtttgtgctgtggccggtaaaacttgctctgagattctcacggagtgtgcttggtaacctgcaccgaattta

SEQ ID NO: 29091 - DNA, 886 bp, Triticum aestivum
  unsure (1)..(886): unsure at all n locations
  Clone ID: PAT_TA_29091
cccccttcgaattcggcacgaggcacaccaccacgcctcgagatctctcgaaattcgttcgtccatggcgatgcaacagaccagggaccccaccgccaagctcccctccgcctcccccttcgccagcgccagccctcctcccccataccaccaccaccactacggcaccttctcccctcctccgccgccgcccgtcgctgcagccgcctacgacccctccctgaaaggacgcagtgctcagggcgttgttgctttcccgtgcactatccagcagcaggtcttcgtggagggcctcccagtccgggagccgcggctgccgttctgcggcgtcggcgtcggctgggctttgttcttactagggttcttcttggctgcaattccctggtatattggtgcttttcttctattctttgttgctttggatcaccgggagaagcctggattgattgcctgcacagttgctggcatttttgcagtagtccctttcatgctcaatggcgtaagaatgcgtccgttctttttttgagaacgaatgcgtcctttctggtgacgctggagcctggaagtcatcaatccagattcttaatggccttattctgtcatgctggaagtcggcaatccaaatccacatgttcctcaccatatttgtcatgtctatagttgtaccatacggttcatccatgtgaataacacaatcgattatcttatatcattcacaggggcgtatatatgtgatctgtgtgttgaattggtaggacaaaccccggcctctgcatctgggagatgcatgcagccactttatatatatgtgatctgtgtgttgaattgttagtccagaattttttccggagatatagtaatatgttgtaacngggggaaaaaaaag

SEQ ID NO: 29092 - DNA, 947 bp, Triticum aestivum
  Clone ID: PAT_TA_29092
gggtcgacttctcgtggttgccgatgcgcggaactgcatgggaggtttgaggagatcacattccaagctgccgatgaagaggaatctggtttgcatgactcagggggcagctctgatgatggaggcgctcaaaaggagcaacatgtcaaagacaaggaacccatacgcctgaatgggtttccaaagatgggtagaagaggtctttctgatcggctttgcttcagttctttccaggagcggtcgtgcccaaccgagaattatgaaagcgatgctcagtctaaggggttcgacataaagcatgaagtgaagatggccaagtacaaagcacggaaaatggcacacctgaagagagctattcatccatctctggacttcgacaacaccaccaatggagcaagcaggacgaagcctacactgagcaagctggagtctttccatgttggcaagcaccacaatttccgtgtaccgacctgccagcgaagccccggcacagcaagtagccctggcacagcaagcaccgatcagcatccaggcatgagtaaccaagtgtgtccgagcccaggagcccaaagggccctgcgcaccgagagcagcccggactgtatgttcacagccagaaactattatactggagctcagttgccaccaaacctcccaagaacaaaatctgtacccctaagcgccatcgacgcctgagatgtttcgccatgtaaattctgcagggaactgtacattcctttcgttctttatgtatgcgatatgaaagatagtcggtaggcatgaggctgtaatgtggctgtggattacccctgggctgttaactctctgctgccttgcggtaggcttgggcctgaaatgtggctgcggattatgcctgagccgtagctctctgctctcccttgtctatctacaggataccggtttcaaacttgccccggattaaaaaa

SEQ ID NO: 29093 - DNA, 663 bp, Triticum aestivum
  Clone ID: PAT_TA_29093
ctccaatacacaagtaagtttctcagtcagctagagaaatggctttcgcgctcaatgcgtcttgctatccttcgtctttccagtcgtcgctgctcccgaggcggatggcagcagcggtgatgataccgaggcggaggaatgttctgcctgtcattagggcggttgccgtggctccgcccgccccggcgccggcgaagccagcagccgtgaggagccggcccgtgtcggtcaccatggccaagctcatggctaagggcaagacagcgctcatcccgtatatcaccgccggtgatcctgacctggccacaacggcagaggcgctgcatctcctggatgcctgtggcgccgacgtcattgagctcggcgtgccgtgctccgacccctacgtggacggtccgatcatccaggcttcgagtgcgagggctctcgctggcggtgccacaatggacggcgtgctggcgatgctcaaggaggtgacgccggagctgtcgtgccctgtggtgctcttctcgtactacaggcctatcttatgtcgagggttggccgaaatcaaagaagccggtgtacacggtcttatagtgcctgatctcccttatgtagccgcgcatgcattatggagtgaagccaagaagaacaacctcgagctggtgctgctcacaacac

SEQ ID NO: 29094 - DNA, 910 bp, Triticum aestivum
  unsure (1)..(910): unsure at all n locations
  Clone ID: PAT_TA_29094
cggacgcgtgggcggacgcgtgggcgggcttggccgaattcccacgccaacttcacacgggaccagattcgcgctcgcgctctaagctctagctgcgctgcagcacgcatacacaggcagccgcccttgctacgtcgggagatacatcaccagttgatcggccacgagagaaagctagctagctagcttgcttgcttgctaactaggaggcgaaaggcggcagctggccggaggcgcgatcgaagtggacggacggaagcgagagctcgccggagatcatcatgttcgaggggatggagcgggcggggtacggcgtgggcgccggggtggtgctgtcgcgggaccccaagccccggctgcgctggacgcccgacctgcacgagcgcttcgtggaggccgtcaccaagctcggcgggcccgacaaggcgacgcccaagtcggtgctgagactggtgggcatgaaagggctcaccttggtaccacctcaagatcatcttcaagaaatacaggatgggaaagcaagagcaagaaagacacaggttccgaaaccaacaaaccttccgcccgcacaaggatcatttctcctctgcgatcctcccaacgtccgtcccgccggggaataacactacgggagaaacgcatccncggaccattgagatatcaaatcgaancccaaaggatttcacgaacactttaggtcaanaagaactgcaaatcgcatcnagggcaagggaanactgcagacatcctggagaaggcaanaagacctcctacgaacaagngggaccaacctanaacacaannccaagncacgactaactactcccggggtnatggcaacgaccagntgcacaaaangnggaactgcaagcctnccacangctaaacggaactngntcagcnacagggg

SEQ ID NO: 29095 - DNA, 762 bp, Triticum aestivum
  Clone ID: PAT_TA_29095
cgtactcgtgggcggacgcgtgggtacacttccggcgggtccctggacccgatcaccggggtgaaccagcgctccttcttcatctacatcaacaaccagacggcgcaggagcagatggacgtcatcgcgtggagcggagggataggggttccggtgtacaccgactacctcgtcgtcacgacgggctccggccagatggatatgtgggtcgcgctgcacccggacctcagcagcaggccggagtactacgacgcgatactcaacggcctcgaggtgttcaagctccagacgtacggcagcaacaacctcgccggggccaacccgccgatcccacagaaacagttctaccaaggggagtccaagaggaaaagtgccgtagctgcggccgttggtggaacggtcgccggtggcctccttgcggtgttgatcggctgcctatgcgcgtgcgctatgtgcagacggggcagaaaggcgacatcggtggtcgtgtgcgagccagaagccattcctgataaacaagcccatggtccccctagcccaacaaaaagctctgctttgtttaagtcgggccagacataaatgggcctccccaaagaagttacgaacagaccatagtgtgagaaatcctataaagtttctttatttaacctgcgcaaatacaaaagttcgtgcatctcagaaaaggctcattgcatatatataaagtgtgcttattcatctaaaaatatattctgtttatctataaaaatatattcatgcatt

SEQ ID NO: 29096 - DNA, 624 bp, Triticum aestivum
  Clone ID: PAT_TA_29096
caacagtgccctccgaaattcactccaaatcaaatcgggagtgcgctggacgttgacgtgaaggcctctccttactccggcgaggtgccggagtgatctactatgctgctgcagttcgtcatcagactccacttcctccaccgagatggcctctccaaacggagctttgaacccatcacttatttttgggctcctaaactcaattgagcacctcaatgggactaactttcctacatggaaggagcagatttccattaaccttggggtcatggatcttgactacgcacttagggagaaggctccagttcccttgtcctctgatgatgaaaaccttactgagagaactaaggtttatgaggctaacaaggagaagtgggagcgctccaatcgattgtccctcatgatcatgaaaagcacaattactcttgggattaggggagctatccccgattccgaatgtgctaagacttatctggcatcggtggaggaacagtttaaaggctccacaaaagtctatgccagtacactgatcatgaaaatgctcaccactaagtatgatggtacaagcggcgtgagagaacatatcatgactatgaatgatatggccgcaaaattaaagggcat

SEQ ID NO: 29097 - DNA, 765 bp, Triticum aestivum
  Clone ID: PAT_TA_29097
gggataacgccccctcgcactcacctggtccacgcattctgtggggcggcgggccagttttcccccaaatccaccaccgtcgctctcgggaatcgccggaatagtggaaggcgaagggagaaggggagaaggggggaggggagaaagagagcgaccccctgcgactgccaaaatgacgacgggatgagggccggctcgccatacgcgcgcggcaaccagcaagcggaggagggaggagacaggtgtcggagtcccggtgaccagcaagcgaagagccgaggggacagcgtcgtctgtgcgccgcgaccacctagcggggaggagctagatcggggaaggtgccgtcgccaggtggtcgaggaatcgggcagcaaagtgccgaaaaaaaggtggagctggagaggccgttggggaggaggaaacttacattctaatgcaggaggcgccgggagggaggtgctgagcggttatgatcgggggtaggatcctgcgccatgtgcgatggtggttaggaccctttctttccttttttgtatgacagctggcaaagggtgcgggacaccactgccatatttaggtgtgtgctctggaacgctacccagccaacgtgtggtggctagtcgcgtccaaataaaagcgcgcgcatctctccacggaacccgggccccacacagttgggccttttccttgctttaatttttttcaacagagacgttttccctgctgccacgtttcaaaaaaaaaaaaaaaaaataaaaaaaaaaa

SEQ ID NO: 29098 - DNA, 907 bp, Triticum aestivum
  Clone ID: PAT_TA_29098
gccctagggcccttttttttttttttttttttgaaaaattggatagctacgtgcattcgccagaccaaatattttacagtaccttgcatcacagaataacaacaaatatttgaaatttgaccatagaggaacactacaatacagtcaagtaaaatatctgaacattcttagtttaccgtccaaaatacttgaaccacaggccggcattcatatctgacttgttctatttctcgcagatcatgtctttatgcgcaccacaaaagaacatgctggaaggtttgacatatctgcagagacagcacacggaattcccaagtttgtgagagcacctcttattaacccacatgggaaatataaaagcatgcttgttgtttgggctgcagaatcacccaatgacccagagtcattctcagttgcatcagtgctctctactgctggatctagagaaacacgagtaagccaccggaaatggttatcttgaagaacgaaggtacccctatgatttgttttcagattgtcaatctgcttcttgaacagttctgaccaaaaatctttgcaaataaatttgattgcctcaagatgatcagtaaatcgagggcgctccatcgtgtacctctcggagagctgatggccaacctggaagccgatggcctcaatgcgaccggcggcgagctccggcttggcggcgtagaagcggccgcagtaggcagccaccatctccatcaccaccccatcaacgcagctctccgacacctcccgccccataccctcgccctcctactcctcggcgacttcccctgtggaagagagatctaggtagctagctgagcggcggaaaggatcggtcgggagtcgggaccccccacgcgccttgtgggctgcgccggggagagatcgaccgggccga

SEQ ID NO: 29099 - DNA, 616 bp, Triticum aestivum
  Clone ID: PAT_TA_29099
gttttcacgtggcgttgtcgagcggccgcccgggcaggtagagaactagtctcgagttttttttttgtattttttttcatctttgcttttttcgatctgttttatatctgtgatatattaatattggaacaagcaccaatgaaaatttttatgcatagaaaaaattataatataaatgatgcagtgtctcagctgcagcaactgcatgtagtggtcgaagatgtactgaacgatgaccttgtaggcccgctgcgtggggtggtagctgtcgaagaagacatgctccgacacgtcgtcgcacaccggcatgaacctcgcgtcgcacagcaccgccacctcggccgtgccggtgccgcagcaccccttcttcgtctcgctgaacccgtaccgcaccccgttgtccaccaggtcctggatcacggtgtagatgtcgatgaacacgagggtggggaacccggccgggtcctcctcggccagccggcggatcagctcctgcaccctcgcgttgtagagctgcgcggcggcgttgcgctccggccgcggctcgccgcccatggtccgctgcgacggcacgcacccgatgggtgggagacccacgaagccgatccgcttggct

SEQ ID NO: 29100 - DNA, 1003 bp, Triticum aestivum
  Clone ID: PAT_TA_29100
atcctcgtcgtctcacgctaccgcctcctcccccccaaactcccaactacccgctctgctcctgagttccgagcccgctcgacctccgccgacgccgctccgtcaactcgcacggggaatctcgccatggccgccgcgtcctccgccacctccgtccacgacttcaccgtcaaggatgcaagcggcaaggacgtcgacctgagcgtctacaaggggaaggttcttctcattgttaacgtcgcttcgcagtgtggcttgaccaactccaactacaccgagctgagccagctgtacccgaagtacaaggaccaaggttttttcttcatccattttttttgtaccttttaccttgttatgtcatatggattactgggtttaattttctaattgcttaacactgctagctagtcgatttaaacagcaaactccgtttattggatgctaacctctgtgttctattgccaacttgtggtttacaggctttgagatcttggctttcccatgcaatcagtttggtgggcaggagcctggcaccaatgatgagatcgttcagtttgcctgcacccgcttcaaggccgagtaccccattttcgacaaggttgatgtcaacggcagcaatgtttcccccctgtacaagttcctgaagtctagcaaaggtggccttttcggcgacagcatcaagtggaacttctccaagttcttggttgacaaggagggtcacgttgttgaccgctatgccccgaccacttccccactaagcattgagaaggatatcaagaagctgcttgggagctcttagacccgccgctggctggagcctcgagagaaatcggcactctgtattctagaaacaagaataatgtcgtgttgaaataaaatctgtacccagcatttcagaggatgcatctgctatattttcagcatcctactctgtacttgttgtatatgttgtgttaatgaatgcattcaaatattgcaaaaaaaaaaaaaaaaaaggccccta

SEQ ID NO: 29101 - DNA, 1015 bp, Triticum aestivum
  Clone ID: PAT_TA_29101
ctcgtgcccattttgtcgtcgtccgctaacgcctcctccccccaaactcccaactacccgcttactcctgagtcctgagccccgcgcctccccccccccctcccccacccacccgctcccacctgactgctgtgccccggcgatccccgccgcagccaccgccgccgcctccgccaactcgcacggcgcacgcctaacctctccacgccccccgcgtcgtccgccacctccgcgaattcactgtccatggaatgcgcaagcggaaagacatcgcctcatcgtctacaaggggaaggttcttctcatcttaaacgtcgcagtcccttctgagtgtgacttaactaaatccaactacaccgagctgagcctggccgtgcactaagtacgaggaccaaggtcttggagctcttggtctttcacatagctaatcatgtttggtgggcaaggctggtgaccaccattgattgaaatcgttcagtttgcctgcactcgcttcaagggcccgagtaccccattttttcgacaaggttgatgtcaaggcaacaatgtttctccccctagacaaaatttcctgaaatctagcaaaagtggccttttcggcgacagcatcaagtggaaacttctccacgtccttggttgacaaggagggaccgcgttgtgtgaccgctatgccccgaccactcccccccctgatgcattgagaaggatatcaagaagatgcttgggaagctcttaattcccgcctgctagctggaagcgtcgttggagaaaatcggcactctgtattctaagaaacaagcaataatgtcgtttttcgaaataaaatctgtacccagcatttcagaggatgcatctgctatattttcagcatcctgctctgtacttgttgtatatgtcgtgttaatgaatgaattcaaatattgtaactaatcggtgagactttcattagatcgtgttgttttgtggtcaagtttctgaagaacataatttctcgctgttcggtgtgcctttcatt

SEQ ID NO: 29102 - DNA, 531 bp, Triticum aestivum
  Clone ID: PAT_TA_29102
acaaagataaatattttattcaagttgatatgaaatacatgcataaaaaatgttatttttaacaaaagtcaatgcttttttggtttactctttctcgtattatttaattcttgctagaaagagcggtgacaccaggaagttctttgccttcgaggagttcaagagaggcaccaccaccagtagagatgtgagaaactttgtccgcagcatcccaattgagagcagcagtagcagtgtcaccaccaccaatgatagtagtagcaccttcctttgtagcttcaatgacagcttcaagaacagacttggtacccttagcaaaagcatcgaattcaaatacacccgagggaccgttccagacgatggtcttggactttaagatttcttcacggaacaacttggaagattgttcaccacagtcaagaccttcccattcatcaggaataccatcagcatcggtggcataaccagttttagcatcaggagcgaatttatcagcagtgacaaagtcaatagggaaaacgagcttgacgt

SEQ ID NO: 29103 - DNA, 440 bp, Triticum aestivum
  Clone ID: PAT_TA_29103
gggggtgctgacatacacttccatatagtgtattaaactaagtatatgaaagggattcattacaacgatttctagtgaatttttggcacgaacctcctcaaacatatatgcaagataaatggcaacgcgacgtcctcaaaaaagaagccggaagcattattgtaagcttcaaagtttggcgcatttgtccccaaattaaacatctgactttccaccaaggcgacacgtgaagaaggcgggccaatcgatctccactgggaacgccgtcttgcagccgtcgagaccacggcaaaactgcttgtcggtcgtctcctccattgcgccgctttccagatcggcgatgtacatgcagcggtgaaggtccttgatcagcaacgtgccgctcctctcccccaagcacatgcacaccggcatgtcgattgttcccccgcggggggggg

SEQ ID NO: 29104 - DNA, 1095 bp, Triticum aestivum
  Clone ID: PAT_TA_29104
gaaaattacaaatttcaaattccgggctcctatccaaaactttacacccttttctttacccaattcagcatcatgcaagctaaatacagatgcattacaaagtcaccaaataatggccttccaagaaagaaggaaaaacacataacttaaggacaatttgacgaaataaacatataacatgctaaccaagactactgtatgtactaacaagctcatcactggcatgtcatccaaaattagaggcataaactcatagatatcttcaagaaaataaagagacctgaacccagcccctcccccccacgtcgacggcgagtcccatagccggcacacttctgaatcggataactgaaaacacaaatctagactggtccacttatttgttattgtccttgaaccctgcaaggagaggctctttcttctcgtcccacttgttcaaccttttctgtgcctcctctacctctttggtccagtcagttcttatggtgacccatagcagaatggctgtctgcaaggccgttcccccaatcaagccaccccaaataccctttgcgccaagattgaagaaaaaaccgagaacaacaccaagtggaacgcctacaacgtagtaagagccgacgttcacgtaagcaacaaattgttgccatccacacccaacggcaacacctgtcagtacaggttggatgccaccgagaacgagggttacggcgagcaacgggcagagatctgccaccgcgtccgaaactgcttcaccatctgtgaacaagtagctgatgtggttgcggaggcagaggatcacaacagcaaggatggtagagattgttgcagagagcccggtcacgacccacacagagaaaaatgcagacttggggttgccggcgccaagctcattgctcactcgtacacttgcagcggcattgaacccaacggagatcatgaacacccaaccataaatcgtcatgcacacagagagggaatccagggcaatctcagggttggggagcaatccagcaatgatcaccagcacctgaaagtaccccgccgccgcgcccaccctcacggcacccacgcgtccgcccacgcgtccgcgaacaa

SEQ ID NO: 29105 - DNA, 1029 bp, Triticum aestivum
  Clone ID: PAT_TA_29105
tttttttccaagataaaaacatgacaactttattcacaatgaaatgggcatacttattataggcacaactgtttcctggtaaaaaaaaggtaaacaagcacaatcggctatgacaatcggctatgtagcagatatacgtatctaacagctctaatttaaacaagaaaatgtagttcggttgaacaatgtatctcctagtactgagctccttcctacatgcactatttccatcagctacaacaatctacatcacaaatcccggcggaaaaaagggttcctccagaacaactgcatctatcgtttataacttgcaggaaaactaatttgacctcaattaccacaacaaacaagaaagcagtggccgtctttgtcaatgcttatatcttccattattgcgtatccccacggacaggatcaaatatttgcagttactacatgctaccaggacctcccatattggcactttgcagctgttccattggagagtttgcaatgctgctgactgaaccttgggtctgtgagtgtgagctcaactgtggactttgaggagggcctggcgtccccacaggattgactacattgttattcacttgttgcagagcccctgagctcaattgcgggctcatcgcagccatttgctgcgggcttatttgctgctgctgcatcaccaatgactgttgtgaaccagcaggcgaacctacttgtgctgcctgctgcaaaggagatcccatttgttgttgctgttgatgctgatgctgatgctgatgctgctgctgctgctgatgctgatgctgatgctgctgctgctgctgctgctgctgctgtagttgctgctgctgctgctgctgctgctgctgatgctgctgctgctgctgtgggttctgttggagttgctgctgctgcagttgctgctgctgcagttgctgctgctgcagttgctgctgttgctggagctgctgctgctgttgctggagctgctgcagctgttgcatctgctgttgggcattcatctgaaaattacccactggc

SEQ ID NO: 29106 - DNA, 857 bp, Triticum aestivum
  Clone ID: PAT_TA_29106
cccacgcgtccgctagccgccgccgccgacgtggagcagagcatcagagcggcgcgatggccggggggaagatggcggcggcgacggcggcgaagtgggcggaggggtacccgtggaaggagaagctggccaagtacaagggggagctgagcaagggggtgtgggggtactgggagctcggggcgtggaagccgctggggatcagcggccggcagcgcgcgcggctccgcaaggaggtgctcctcgccggcgaggactggacctacgacccgccccgcggcgagatgcgcaccaagcgcaagggccacaaggtcgaccgcatcgccgccgagaagcgtgccaacaccgttgagctgatgaagaagatgccccagatgctcctcgactacaagaaacgcagatgggataaaaaggtggaagaaggaaggacggcagcagcagcaaaggctacttgagggactggtcctgctggatgattctaccgtttgttgtggcaatcggggaaggaactcttaaagataaacatatgcgtgcgctcgcagaaactaaggtccctttgttatgtttagatgaggccaagctgttgattaatgtctcctgctccttcccatggactaagtgctgagggagtattcatctcatcatttacaatagccttattggcgtttgcagtctttttcacgccttgctgcttttccaactctttagtgccacctgccacacttttgtaatgcattttttttataacatcggtcatataatcaggattccagcctggtcccaacctgtctagcctggcccaacctgcattgaacccaacttgtttgctgaaacagatcaaaattatgagtgtgttt

SEQ ID NO: 29107 - DNA, 689 bp, Triticum aestivum
  unsure (1)..(689): unsure at all n locations
  Clone ID: PAT_TA_29107
tcgcagtacctgtaccacgtgccgcggtgcattcgcaggtcgacggggaacgtgctgaccatcttcgaggaggaaggcgggcggccggacgccatcatgatcctgacggtgaagcgcgacaacatctgcagcttcatctcggagaccaaccccgggcacgtgcggtcgtgggagaccaaggacagccagctgacgatggtggcggacgacctgaagccgcgggcggtgctgacgtgcccggagaagaagatgatccagcaggtggtgttcgccagctacgggaacccgctggggatctgcggcaactacacggtgggcaaatgccacacgcccaaggccaaggagattgtggagaaggcgtgcgtggggaagaggagctgcgtgctggccgtgtcgcacgaggtgtacggcggggacctcaactgcccgggcaccacggccacgctggccgtgcaggcaaagtgctccaagaggcagaggaccgccgagcaataagtaagctaagctcagatatgtactgctatgtagatcatctcatcaccttcacctttgccgaccatggtctttttcatgctggttgtttgggatgcgtgcatacgtgttgtactttgttgattcctgtgacttgttctaggagtagatggagcgctagatagaagcaagaggcangaaatcaatcgatccatttt

SEQ ID NO: 29108 - DNA, 924 bp, Triticum aestivum
  Clone ID: PAT_TA_29108
tcccccccggcacgtccggaaacatccgacgaagacaggcaacgagaggcgagagcgtggataatggcattaagggtggtgttctccaacaggatcccgctggtgcgcgccatggagaacctcctggccgcgtcctccgggtctgctctcaggccggctgccgtcgccggcggcgtccgcgggtacaacgccggcgcgcccctccgtagctacgaccggcgccgggcgctcgcagggagcgacggcggagcctggagcatggcctcaggggtggtgctctcctacatgatcccgctggtgcgccccgtgcagatcctcctggccccgtcctccgggtcggcgctcagcccgcctgccgtcgccggcggcgcccccccgacaacgccggcgcgcccctccggagctccgccgggacgaggcggtcgagcgcagcccccgcagcggcgcgcgcgagcgcgacgtcggcgtgcccagcttcttctcagatgtgttccgtgacccgttcagcgcgccgcagagcctgggccggctgctgagcatgctggacgacgtggcggcggcgtcccccgacggcgcggcgcgggcggcgccgctccggcgcgggtggaacgcgagggaggacgcggacgcgcggcggctgagggtggacatgccggggctgggcaaggagcacgtgtcaaggtgggcggagccaaggacgtcttcgaggtcaacgtggactaggaagaatcaggatcatgcccaagtttcgcgtcacggaatagccgagtcgtctcgtgtgagccgagtgtgaataacaaaaaataactcaagtttttttgtttgtcgtgttgggtctggatgtgttggtctcgtgttaagtgcctgtaagagtatgaatcgatcaaacaatggatccggttttcttggtctttcttctgaagc

SEQ ID NO: 29109 - DNA, 460 bp, Triticum aestivum
  unsure (1)..(460): unsure at all n locations
  Clone ID: PAT_TA_29109
aagatagtagagtacaagagtttgagaataaccaccattgtttatttccgaacccaggggaggagaaaaaacatgcacgcacacattacctcgttcgctagagctagctagcttagccggccaaacacatcttaacttgcatgtacagagtgaaaaagggggtgtaatgacggttcgcctcgcctaattaagctctcctccactgttggaaaaggctgagggctaaaggactccaacacgtcacaaacaacgtacacgcaaattaactcacacaccggccggtaattaaacccgtcactagctataaaaatctctcctttctttccaaagatctcctcttcgncttcctccatcttcttccagcccacacacggcaatcaaatcaatggtggctccaagggcgcgcgctaatacgcgcatgcgccgcgtcgaatcgatgcatggatccgtatttcacact

SEQ ID NO: 29110 - DNA, 575 bp, Triticum aestivum
  Clone ID: PAT_TA_29110
acaatcaattttcaaagtcatattttattcaataaaaaaatttttttttttctgagctaaagcgtagcaatcattatggtttacggttgacgttgattttaacggttttgacctggatatagttgtctaaagcgtattcaccattttcacgaccaataccactttgacggaaaccaccgaaaggtgtgttgtaatccaattcgttatagcagttgacccagatagttccggcttgaagacgatttgaaacatcaacagcacgagcagtgttttgtgtaaatacagcggcggcaagaccatattcagtatcaagagccatgtgcataacatcgtcaatgtccttgaacttggagacagtgacaacaggaccaaagatttcctctttaacgattgtcatgttttcatttacatctgtaaagacagtaggctcaacgtaatatccctcatttccccagcgtttaccgcccatgtaacacgtagcaccttctttctttcctatatcaatatatcccataattctgtcaaattgaagttgagagatttgagggccttggaaggtatcatcatcgtggggg

SEQ ID NO: 29111 - DNA, 1401 bp, Triticum aestivum
  unsure (1)..(1401): unsure at all n locations
  Clone ID: PAT_TA_29111
cctcccggccctgactccacctcgctcgcggcgccctgcgcagccgccctcgacggaccgtcgcggtccgcgtccggctaggaggaggaagccatgggtgaagagggggagctggccgcggagaagcacgtccgctacatcgtcaccgcggagaagaagaaggactcgttcgagtcgctggtgatggagcacctccgggccagcggcgcctactggggcctcaccacgctcgacctcctccacaagcttcacggcgtggtcgcggccgaggtcgtcgactggatcatgtcgtgctaccacccggaatctggtgggttcggggggaacgtggggcacgacccgcatgtcctctacacgctcagcgccgtgcaggtcctctgcctcttcgatcggctcgatgttcttgatgcagacaaaattgctgattatattactggacttcagaatgaggatggatcattttctggtgatatttggggtgaagttgatactaggttctcttatatttccatatgcaccttgtcattactgcatcgtctgcacaaaattaatgtggacaaggctgtagaatatattgttagctgtaagaacttggacggcgggtttggagcgatgccaaggagggggagtctcatgcctgggcagatattctgttgtgttggtgctctcgccaatcaccggctctttgcatcacattgatagagatctcctcggatggtggctttgtgagcgccagtgtagagatggagggctcaatgggcgtcctgagaaacttgctgatgtgtgctactcatggtgggtgttatcaagcttgataattattgatagagtgcactggattgacaaggaaaaacttgcaaagttcatattgaactgtcaggacaaggaaaatggtggaatttctgatagaccagataatgcggtcgatatctaccacacgtactttggagttgcagggctttcattgatggagtatcctggagtgaagcctatcgatcctgcctacgccctccctttagatgttgtcaacaggatcttcttgacaaaacaacaatagtgtgccttagctaggaagatcatgttgtgactgcgatgacgtcaggtcagcacgagtggagagcttacccctccttcggtagctcgcactgatgtttctgatcactcccatgcatgagatcatggctttgaacgtttgatgatatagtgcaggcctcatatttaccaggaaatccggacacttggttatgtagaagagtgtaacgtccaaggactgagaatcaaattcaatcaagattatttttgttggaaaagtataaaatatcaaaaaaaaaaaaaaaacccgccccggcgcgcccgctcaatctctttggggattccnnnnnnnnnnnnnnnnnnnnnnnn

SEQ ID NO: 29112 - DNA, 2190 bp, Triticum aestivum
  Clone ID: PAT_TA_29112
gatactaactaaagccgacacgcgaggcccatccccgcccatagctgccattgcccgcccgtcgaccgatcgaagagtgattcgaggtagaaggttcccccttggcatcgtcccgcgccccgtccatggccaccgccacgctccctctccgcgtcctcccctcgagaaaccccactcctccacaccgccgccttcctccctgcgcagcacttgtctctcggtcaccgcgtccgcgccccgcaactcgacgcatgttccgccgccgccgaggaggcgcccgctccggtggaagccgaggcggaggaggtgggtagaggatgccgccggttcccggagcctgttgaaggtgcagctggctgctgctggcgcgggggagggcacgccgacatcttcgccgttcgtcattgagttgggtacaagacatttacatttcgtggactgccatggtcaggaacatatacacacacgcagggtgatagtaacgccaatgttaatgatcgtatcattttggtacaagatactactagtgttaactaatgagataaagcttagtattggcatgccactgggcatgacaaattgctgctggttcatgcaattggtcgaataaaacgagggattggaacgttaaggtgatagttttagtgtccaagggaaaagaaaatcacagacaaaaaatactacataaagcaaaacagggataagtggatatggggaattccctgctgatccaatacttcaagttccagcttaagtgtaattgtaagttgtttagttacaaatgcttggtattacattagagtgcaagagcattttccccactgttccccaagtgaggctcttccccaagttaatgtactcgaaatgctgccattcgtagagtggttggttccatccttttgtttattcccccagctctttcttctagaatccaattgtattatcttgattgtgcagaaagacaagaaagagcagggaaagcatttaattacaatgtagacatgttacttaacaccaggggcggataatggcggacgacatggagaggatcttcaagaggttcgacacgaacggcgacgggaagatctcgctgactgagctgacggacgcgctgcggacgctggggtcgacctccgcggacgaggtgcagcgcatgatggcggagatcgacaccgacggtgacggcttcatcgacttcagcgagttcatctccttctgcaacgccaacccggggctcatgaaggacgtcgccaaggtcttctgaatcagttcatttcacctcagccgtccgatccaggagccgatccatctacgtacggcttcgtatatcaatttcatgcaactacctactccggtcccgatccagcctcagcttcacctgaggccggccctaattttgtttgatcaatttttttgctactagtagtaactagtgatgatcactgttgcatcatttatttattttatatcatcacaactttcctgtgtttcttttctttctctacctttttgtcgatcgtcggctccagctcgatcgaacgatccatgctgctaattgtttgtgtacgggtgattaagtaacctgtgcacttgtgcttataattaatcaggaagcattgcacattaggaaaacccttaagttacccaacttaatttgctatgacaaaaatcaattttgccagatagcataaaccaaagaggtccccttatacttttcccaacaatatctaactaaggggggccctttttaaaacatcttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagaaaacaaaaaaaaaaaaaagggggggggcctttaaaaaggaccaaattttaaaaccccgggcgtgcacaaaataatttttttttgggggcacccaaatttaatcccgggggggggtttttaaaaggccgggaaggggaaaacctcgggggaaccccaaataatgggtggggaaaaaaacccccttttcaccgggggataaaaagaaaaaggcccggccctaaccccctttcaaaaagttgccccccccaaaggggaaaggggccccccccttaatggggccaataacgcgggggggggggggg

SEQ ID NO: 29113 - DNA, 1144 bp, Triticum aestivum
  Clone ID: PAT_TA_29113
ccccatggccacctccagggctcccagaagcgttgcgcacctccccccccctccgcaccaagtgcgaagccatggccaccatcaccaccatggccttcatggccacctttccggctcccagaaccgttgcgcagccctcggccacgctgccatctcgcccggacgtcgtgtcgttcgcggcccgggcgatgcgcgcgcacggccggcggctggtggccgtggcgggctcgccgtccacgcccccggagctggcgcagaaggtgacggagagcatcaagcaggcggaggagacgtgcgcgggggacccggagggcggcgagtgcgtggcggcgtgggacgaggtggaggagctcagcgcggcggccagccacgcgcgcgaccgcaagaaggagcacagcgacccgctggaggagttctgcgaggacaaccccgagaccgacgagtgccgcacctacgacagctagccgtgagtagctgctccagccgtcttctgccattgccggccgtcatcatgagcggtagcttctggcttagcttgcgtggcacattggcatgttgggcgtgtaagtttggtttgttgctttatttggcttggcttactataaagcgagcagagatttgtttgtgaaattacaagatactataatgtttattaggagttctgaatatcaaattatcaaggcaagctgcgaggtatcatgctaatcaagtaggacttcaataacatcatccaaatcggagggccgcggcgggggcctggtgcgcccgcttcccacaggtcccaggaccgcaccctcgctccggtattggacatatttgctgaaacacttccggaagaaacgatccagtctgtcaagatagctgattctgaagatttattgaaggcagtgtacacactcgaggatgttgtccttcctttgcctggctcagaaacattgtttcctggaaatgaagttgctgggatttaccatgaaatagctaacaaggatggtattagcctgacagagagcacccatggagtcaagtaagttagtttgttcctatatatgtatgttgctttctgaagctagtttatagctctgtacgataattgtgatcataatgggcctttataaagcgggtgttcaaataacccatccaaagg

SEQ ID NO: 29114 - DNA, 741 bp, Triticum aestivum
  unsure (1)..(741): unsure at all n locations
  Clone ID: PAT_TA_29114
ccgcctgcccgccgccggccaccgccgccgcccctgccccgcccgcgggctggtcgcccgccgccggctccgcccccccctcggccctccaggccaccgccgccggcgctgccccggcctacgactgcgcccccgccctcgactccgccgtcgacgaggccttcgccgccaccactcgccacgacgccgggggctacaaatacgtccccgccctcgagtccgcggtcaaggaggcctacgcccccactaatcccaaaaaccctaagatcaggcttatgacctatgagaccgccatggtcgagaccatcttcgccatggctgccgtcgccaccgccgccgctcccacgcccgccaccgctgccggtggctacaaaagctgagctagtgagctcaccgtacctatgctgcatatgcatacgtgcgtatgtgaatgtggcggcagcatttttgatcgacaatcaatatcaattcttgttcttcgtgtcatgcacccgcgatcgagattgatgacttctcataattactaaatgcaaaaagtctgaaaaaaacaagatttcataggcgaagtctgaaatctatatctatatctatacctactattaaagggaatatgtattcttggtttggtttagtccttctcccttggtttacacacgctaagcgatccggcccaggtacttgtatgttgaagggccttttatgggctttcgtaaaataatnggtcaaaataaatcaacatta

SEQ ID NO: 29115 - DNA, 554 bp, Triticum aestivum
  Clone ID: PAT_TA_29115
gggtcttaaaacaaactcgggatttttttattgagctttaaagagtgtatacagagacatcatatttacaattcgtgagcattacggaagttttcaccagcgtagatacagttttcacccaattcttcttcaatacggagaagttggttgtacttggcaagacgttcagaacggcaaggagcaccagtcttaatttgaccggtacggagaccaacaacgaggtcggcaatggtagtatcttcagtttcaccagaacggtgagaaaccatgacaccccaaccagcagcttgagagtccttggcggcttgaatagattcagtgagggtaccgatttggttaaccttgagcaagagagcgttacaagacttcttttcaatggcagtagcaatacgcttggggttagtaaccaaaagatcatcaccgaccaattggaattcagaagtttcgttcaagtgagtccaagcttcccaatcatcttgatcgaaagcgtcttcaatagaaacgatagggtatttggaagcgaaagagctgtagagagcagtgagttccttacc

SEQ ID NO: 29116 - DNA, 1056 bp, Triticum aestivum
  Clone ID: PAT_TA_29116
gaacttgcataattttccaacacatatatacatacaatacaatacacttttttttggaattatagatacatacatacatacacttggaacgcaacgtctgttaatttatttcgcatgacattctgttacggaggaacaggacgcgacacgacacgcagaagacactaacagaaagcatttgcatccgatcggtttaaacagctggtttgcagcggtcctgtcggccgcggtgatcagctcatgagatgatgcgggcatccgcagacttggtgagcccccagctgtgcaagacggcgccggagacgtcgtaaaaggcgaggtgcgcctcggtcgcggtgagtttcatggacaagaagccctggccgtcatacaagaactccatcttgtcagacgtggccttgaacttgcccgcccacgctttggacccgccgccgctcgtcacgaactccaccgggctgtcgatgctgctgatgcgctgcaggcagtggtcgtgaccgttgaggtacatgtcaaccccatgggccttgaggagtggtaggaggtgctcgcggagctcggtggtgttgccgtgctcgcagccgctgctgacggggtggtggccgacgacgaccttccacgtcgcgttggacgccgccagggcgtcgtccaggtcctggaggagggtggcgatgtaggtgtcgcggggagccacgttcctccagtcgaacttgctctcgttccagtacttgaggacgaagggcgacgtgtccaccaggaagaagtccacgatgtctgcctccacgatgaaggacttgttgacggaggtccaccggctgtccacctcgcggatggcggggctctgctgcgccagcgcgtcgcccgtgtagtcgtggttgccgaggacgatgtaccaaggcttctgaaggctggaggcggtgtagatgtcggtgaaggacgccatgaagaaggccgtgtcgttgtcgccggcgaggccgtcgttgtagaagttgtcgcccgtggagatgacaaagtcggcggccagcttctcgccgaccactcccatctgctcggcaaccc

SEQ ID NO: 29117 - DNA, 447 bp, Triticum aestivum
  Clone ID: PAT_TA_29117
cgtccgcggacgcgtgggcaagaatccaaaatcacagcagagaggggagggaaagaggagagagaaagaggagagagagaccatggcctccgccgtcgtttgcaagggcgagggtgccgcgccggccagcctcctcaagtccgctgctcccgtggccttctgcccgctccgctcccccgccgtcaccgccgcccgctgcccgtacaacacccaggtcaaggaggtcagccgctacgacgacgacaacgacgacgaccgcgacctcgtcatccccagcttcttctcgcaggacgtgctcgacccgctcggcgcgccgaccagcatggcccgtctgctgtctctgatggaggacgtcgcaactaagaccggcggcctctcctccactgctggtgctggggcgtcgcggctcggacggtgggtggccaaggaggacgacgacgcggtgta

SEQ ID NO: 29118 - DNA, 1051 bp, Triticum aestivum
  Clone ID: PAT_TA_29118
cgtccgcccacgcgtccgcccacgcgtccgacaaaaccccccaccatttcccaccccctctcgctgaccacaagaatccaaaatcatcaccgcagagagagagagagagaagagagggaaagaagagagagagagacaggagaaagagagaagagagaccatggcctccgccgtcgcttgcaagggcaaggatatcgcgccggccggacgcctcaagtccggtgctcccttggccttctgcgcgcccgactgccccgccgtcaacgccgtccgccgcccgtacaacacccaggtcaaggaggtcaaccgctacgacgacgacgactatagcgaccgcgacctcgtcatccccagctccttctcgcaggacgtgctcgacccgctcggcgcgctgaccagcatggcccgtctgctgtctctgatggaggacgttgcagctcagaccggcctctccactgctggggcgtcgcggctcggacgctgggtggccaaggaggacgacgacgcggtgtacctcaaggtgccgatgcccgggctgaccaaggagcacgtgaaggtgcgcgcggacaagaacatcctggtggtcgagggcgagggcgagaagcagccctgggacggcgacgacgactccgcggtgccgaggtacaaccgccgcatcgagatgcccgctgacgcgtacaagttggacaagatcaaggccgagatgaagaacggcgtgctctgggtgaccctgctcaaggtgaaggaggaggagcgcaaggacgtgttccacgtcaaggtcgagtaggtagtggtagtgctcatgcaggatggccggcgcgagagtgtgagagacgccctgttgatctggtcatgtttggtgtctttcttccttgttttgcttcgttggtcgtcttggatcgagttggtggtggtctggtggtgaagttggtcgcgaactctgttaatttcctctagtttggcatatgatgaacttactttggtggtgaaattggtcatgaaattctgttgatttcctcaatttggtatatgatgaactgatttggtgggg

SEQ ID NO: 29119 - DNA, 996 bp, Triticum aestivum
  Clone ID: PAT_TA_29119
gcaagaatccaaaatcatcaccgaccacggcaacgagagcaaggaagagagagagaagggagagaaaaccagagagagagacaggagagggacggcgaaggcagtcgccacggccagcgccgtcgcgtccgcggcccccggggcctcgcgagcggccggccccctcgccgccgccgctccccccgcctcctccgccccccacgccccggccgtcacccgcgccaacgaccccgacgacaaccacggcgacgacgacaccgccgtccccggccgcctcccccgcgtcctccgcgaccagctgctcgagccgctcggcgcggcccgcgcgctgccccttctggaggccgtcctgtatgacaccgccggcctctccgccggtgccgggctcggcgcgtcgcggcgcggacgctgggtggccaggggggacgacgacgcggaggacctcgaggtggcgatgccggggctgaccaaggagcaggtggaggtgcacgcggagaaggacagcctggtgatcaaggtcgagggcgagaaggagcccggggagggggacgccgacgactccgcggtgcccgaggtgcaaccgcaccatcggggggcccgctgctgacgcggacaagatggacaagatcaaggccgagatgaagaacggcgtgctctgggtcaccctgctcaaggtcaaggaggaggagcgcaaggacgtcttccacgtcaaggtcgagtagtccttgtggatgtggtagtgctcatggaggatggccggcgcgagagtgtgagagatgccctgtttatgtggtcatgtttggtgtctttcttccttgttttgcttcgttgatcgtctttcatcgattgggtgaagtgggccgcgaactctgatagtgtcctcaagtttggcatatgatgaactgatttggtggtgatattggtcatgaaattctgttgatttcctcaaatttggcatatgatgaactcatttggtgctgaaattggtcatgcttt

SEQ ID NO: 29120 - DNA, 423 bp, Triticum aestivum
  Clone ID: PAT_TA_29120
ggtcgacggcgactcgccagtgatcaatccccatcactcgccggcgattggtctggacgcgaccaatggcagaaaccgcagcgatagcaccaccaccacaaccaatggcaccaccgcaaccagtggaggaaaacgcaacggcggcaccgtcacaaccaatggcaccaccgcaaccaatggcggaaaacgcaacggcagcaccaccgcaaccaatggcggaaagcgcaactgtcgttgtggtggtgccaccaccaccgccagacggcaccacgacattcctctgcctcatcctcgccttcttcatccctcccctcggcgttttcctcaagtacaaatgtgagattgaattctggatctgcctcatcctaacattcttggcctacgcgccgggcatcatccaagccgtccgggtgatcgtgaagt

SEQ ID NO: 29121 - DNA, 835 bp, Triticum aestivum
  Clone ID: PAT_TA_29121
gtcttcttccggtgaagcggggaagccaaagctattgcccgcatccccgcggcggagtctttcgacgtccacacaaccacaagaaacgtcggggactcgccggtgatcaatccccatcactcgccggcgattggtctggacgcgaccaatggcagaaaccgcagtgatagcaccaccaccacaaccaatggcaccaccgcaaccagtggaggaaaacgcaacggcggcaccgtcacaaccaatggcaccactgcaaccaatggcggaaagcgcaactgccgcaccaccaccaccaaacgcaacacaacaaccaatggtggaaaacgcaacggtcgttgtggtggtgccaccaccaccgccagacggcaccacgacattcctctgcctcatcctcgccttcttcatccctcccctcggcgttttcctcaagtacaaatgtgagattgaattctggatctgcctcatcctaacattcttggcctacgcgccgggcatcatctacgccgtctgggtgatcgtaaagtagagattacgcccatgaacgttaggacaacagggatttgattcttctcttcgaatcccagacatagaagaaaagaaagacttcacagaggcaagaacaatttgggaaatcccagggggaaatgatgccgttggaatgtggcgactaaaggatttgtcgcctcagttttaggctatgtctctttttcaccttccatgttttggtgctgagaattggttattgttatctgggaaattaacaataacaggttgtgttgtcattgacatatcgtggctgcaaaattccagagaaacatgtcattctctctttttc

SEQ ID NO: 29122 - DNA, 679 bp, Triticum aestivum
  Clone ID: PAT_TA_29122
aaagtctgttactttggaacttcccttggctcttcacatcctcgaagctgttatttctgaaaacaaatacattgcttccaacgacaaggctactgaagccgatgtcactgttgccaaggctttaggttctgctcctgctgctgaattcaccaaccttaacaaatggttctccgaagttaagcctgccgaagccgctcctgctgctgaagctgctgatgaagacgatattgatctttttggctctgacgaagaagaagatgctgaagccgaaagaatcaaggctgaacgtgttgctgaatacaatgctagaaaggccaacaagcccaagactattgccaagactaccattactcttgaaatcaagccttgggacgatgaaaccgatatggaagccatgaccaaggccgtcaaggatatcgctatggatggtctcttgtggggtggtcaccaattggttcctattggttacggtatcagaaaacttcaaatcaactgtgttgtcgaagatgacaaggtcttgttggatgacttgactgatcaaatcactgaattggaagactatgttcaatctgttgatattgctgctatgcaaaagatctaagtgtatctatgaccccagcttgtataaaataaccaataaatgcaatgatagtcatctaaggctattttgattttgttt

SEQ ID NO: 29123 - DNA, 675 bp, Triticum aestivum
  Clone ID: PAT_TA_29123
cccacgcgtccggtctttcactctcgaagctcctttggcctacaagattctcgatagctactttgaaaacgtctcttacgttaagggcgttgaactttctgaagctgatgtttccgttttcaatgctttgactgaaggtgtctctgctgaagcctaccctcacttggccagatggtactctcacatcgctgccgtcaagggtttagccaccaaggaagctgctgctcctgctgctgctgctgaagaagaagaagacattgatcttttcggttctgatgaagaagaagatgctgaagctgaaagaatcaaggctcaacgtgttgccgaatacaacgccaaaaaggccaacaagcccaagactattgccaagaccaccatcactcttgaaatcaagccttgggatgatgaaaccgatatggatgccatgaccaaggaagtcaaggacattgctatggacggtctcttgtggggtggtcaccaattggtccctattggttacggtatcagaaagcttcaaatcaactgtgttgttgaagatgacaaggtcttgttggatgacttgactgacaagatcactgaattggaagactatgttcaatctgttgatattgctgccatgcaaaagatctaagaggaagagagaaaaggatgttttatattaaaattttttttatc

SEQ ID NO: 29124 - DNA, 1106 bp, Triticum aestivum
  unsure (1)..(1106): unsure at all n locations
  Clone ID: PAT_TA_29124
aggaattcggacgagggcgagttcnggcggaggtggagatatcagccgcgtccccaccgccacctcgtctccctcgtcggctactgatctccgaggaccaccgcctcctcgtctacgacttcgtcgccaacgacaccatgcaccacaacctccacgggaggggaaggccggtgatggactggccgacgagggtgaagatcgcggcgggatcggcgcgggggttggcctacctgcacgaagattgtcatccaaggatcatccacagggacatcaagtcatccaacatcctgctcgatgacaacttcgaagctcaggtcgcagatttcgggctcgccaggctcgcggagaacgacgtgacgcacgtctcgacgcgcgtgatgggcacattcgggtacttggcgccggagtacgcttcgaccgggaagctgacggagaagtcggacgtgttctccttcggcgtggtgctgctggagctcatcaccggccgcaagcccgtcgactcgtcccgccccctcggcgacgagagcctcgtagagtggtcgaggccgctgctgaaccgcgcgatcgacgagcaggagttcgaggagctggtggaccctcgcctcgacggcaactacgacgacgtcgagatgttccgcgtcatcgaggcggcggcggcgtgcatccggcactcggccgccaggaggcccaagatggggcaggtcgttaggatcctggacagcctgaccctgaacgacgtggacctgaccaacggcgtgcggcccgggaagagccagatgttcaacgccgccaacacggcggacatcaggcagttccagcggatggcgttcggcagccaggacttcagctcctccgagtacacccagtccaaggccagcctgagcggcaggagggatctgtagccacgcaagaagaaaggatccatgagagctttgcttccgatgattttgtttctgttcatctcttgattcttttatgtttttttacagtgaatttgtatttgctgtcttactgtatgtttgtgcctttgatgtgtacattaacagggtatgcccacagggtcatgtatttttagctattctgaagagatataaattgtttttgtc

SEQ ID NO: 29125 - DNA, 684 bp, Triticum aestivum
  Clone ID: PAT_TA_29125
ccccgcgtccgcccacgcgtccgcaattatgcaatataatggtggctccgtagtagccatggtcggtaaagactgtgtcgctattgctgcagataaacgtttaggtgcccaattcatgacagtttccactgattttcaaaagatttttaaagcaactgacaagactttcattggattaccgggattagctactgatgtactcacacttgcagatcgattccgttttaagacaaacatgtacaaaatgcgtgaagagagagaaattgaaccaaaaacactagctcacatggtttcctctaccctgtatgaaagaagatttggaccttattttgtcgaaccagttgttgcaggtttaggaaaagataataagccatttatttgtgctatggatttgattggatgtatcaactttgcaaaagactttgttgttagtggaacagctggacctaacttgtatggaatgtgtgaatctctttgggaaccagatcttgaacctgaggatctctttgaaacaatttctcaagcattattaaacgcacaggatagagatgctctttcaggatggggtgctgttgtttatgtcataacacctactgaagttactgttcgcagcctcaaagctcgtcaggattaaacaataatttcatttcgcagatatataaaaaaataaaagctttattcatg

SEQ ID NO: 29126 - DNA, 1475 bp, Triticum aestivum
  Clone ID: PAT_TA_29126
gaattcactatttcactaacagacgtagtggttaatgcgtctataaggaaatgattcatattaatgatgattacacaaacaaacatgttatttaatattccggtaaggaaaagatacaactttaagaatgatagaaattacaagcttttcacttaagctgtcacatgataatatccctgcaaacataagtaactccctttatttttcttcattggagttcaccatccatccatacataaacaaagcacactgcaatggtacttgagagtacgccttttggataaacttttgagaaaggcttcacttgtagacctcgatgacacctcgtgcaccgagtttcttgataattttgtagtcggtgaaccctgctttcatgaagagctcacgccagtcattttcgctacgttgacggcctctcgtgaacacaagcatgagcaagtccatgagagtctgggcctcaaacatgacaggtcctaatgatggttctgacccacaatgtcaatgacaatcaccgttccctccttgcttcacgggaaggaatggcattcttacactgggtaaggatcttcacacagtcgtcgtcactccagtggtgcagcacaagcttgagcatcacggcctgagcctttgggacggtgtggaagaggtcaccggcgacatagttgactacacagtccgacggagttttttggatcaccttggggagatccagcacggtgcacttgacgtgcgggtgggccttggtgatggccctcgccgtctttccatcgccaccacagcagtcagttagagactcgagccccttgaagaggtcatggcactcacgcatgatcgtgccgatccccaggttgtcgtgggcttcgagaccttcggtgaccagcgcgtcgagctccgggtccaaggccgccgtggtctcgtcgaagagcgacgcgctatgcacgtcctcgaacaccgacggcactggtccggtgacgtccttcttgaaccagtcggccatccccagcgcggcctccatgtagtgcggcgacgtcccggcgagcacgaaggacgtctggctgtggtgctcgtccgcgaccacgtcatccaccaggacacgggaaagggggttgaggcggaagagctccgccccggaatcgtccttgccgccggcggcgaagacgcctgaggtgaccagggcacgcatcaggcggcccaggaacggctgcttgcttgcggggatggacagcgcggccgccaggtcgggcagcgaggtgaccccgccgagtttgtgcatggccgtcgggatgccgagcttgacggcgcagcggagccccatggaggtgaggtagtagagggtgtggcgccacaggtcggcctgagcctgcagcagctcggcatcagtgggaacctcgatcgccggtgcctgggcggccattgtttttcgtgtctcggatcgatcactggctgttttttctctgctcagcttgacctaatct

SEQ ID NO: 29127 - DNA, 912 bp, Triticum aestivum
  unsure (1)..(912): unsure at all n locations
  Clone ID: PAT_TA_29127
ggtccagatatccgggtcgacacggattgcgattttctcgagcaggaaaacattatggattacagtcttttggtgggcgtacattttagagacaaaagagttataatgactgaaggttcctttgacagtgatagcagcagaggatcatcaccccacctatcacctcacctatctagaggagatactgatccaaacaggttgtccaagataaagctcgggtcgaacatgccaacaaaagctggattgacaattcgaaagagtgattgtgaaccacagcttattggagaacctaccggggagttgtacgatgttatattgtactttgggattatagacatacttcaggactatgatatcagcaaaaagcttgagcatgcatacaagtctttccaatatgacccaacgtctatttcagcagtagatccaaaactgtattccaggcgctttaaagattttgtatacaaagcgttccaagaagacaaggtagacatctgaaaagacattgagactcagcagctcctaggacttctggcatggatttatgcgttgactgtcgaaacaccatgctgctggcgttgcagcagggctcgatgcctctacatgtacatcatcgggtcgccggactccactggatgagaaagagcttgagaatcgggatggtcgtactgcccactgcttggaaattccaaggaattcagctggaaaataaagctccatttgagacagttgcatttgaataatcnnntcgaacagtccatttttgtttgtttacaaaatagacacaactgcctttctacaggtactttttcagccagtgtagcatagcgcagcaatgccaagctatgcctaaatagctatatacacgcatacagagttaactannnnnnagtgtnnntgctgacttgannnnnn

SEQ ID NO: 29128 - DNA, 470 bp, Triticum aestivum
  Clone ID: PAT_TA_29128
cgggtcgacggggtgcgcgttctgggcgcggctgctgcggacggttggggtcaaggtcggcgggaacccgaacgtgtacgcgagcctccttggggttctgtggtcttccgtggcaaacaggtggcacctggagatgccagacattatagatggctcgatttcgatcatgtcaaggaccggccttgggatcggaatgtttaacacgggcctgttcataggtctacaggacaagctcgtcgtgtgccggcctggacttacggcgttgggcatggcgatgaggttcgtcgctgctccggcagccaccgcggtcggagcgctacttttgggactgcgtggtgaccttttgcgtgttgccatcttacaggctgcactgcctcagtctgtcggagcatttatcttcgcgctagagtatgacctgcacgctgatgtactcagtaccgtggtaatagtcggcacgctggcttcgctgc

SEQ ID NO: 29129 - DNA, 1409 bp, Triticum aestivum
  Clone ID: PAT_TA_29129
agcggccgcccgggcaggtacttctcgacatccctgatgtttgaaaccagggttgacacgtccagttctggtttgaattttgcgagtatctcggcctcttcttccgagtggacgtgagatttgtgggttccattcagctgctttgcatctctgtcatagttgttggccaacacagagataagcctgcgtagtgtatttctcctgaagagaaatatcacagagacacccttcttgttcaaataactaagtatatcatcatgatggtccataaagccctgatttagcatccacttgaatccaaatgcagccgtgcactcattctttgctgcacttgtgagccagtccaggtcatacagtttgtcgagtgtttgtacctcggccgcgacctcgcgtcttctatccactctgttaaatatttcgccattcgagctgatgttagggtggctgtttagcaatgtctcgaaccatccacttcccgatctttgcatcgacacgatcacaaagaaccgaacaggattacacgaacattccgccctgctgtaaccctttggctttgggaagtgcacgtagggcagctcctcacttggaacataaggccttgtgcaaacatgttcatcttgttcttgcgcaccattctcctccacatgcttgctctccatccttatctgattgaaggagaggtagcacacgtagaggccaaagagcgcgatgaggaagacgagggtcggccgcggcggcaacgacgcccccttggagcctttgagcgggtatgggtgcattgtgtgactggaagtctgtagcagaagaagattctagtgcgtgggccgggttctggtcctcctgctcgcgcacagcagcagagtaacatgccgaggcctcctcgtggtcgtcggcggcagcggcccctgcgcgccgggtgcggcggcgcgcttcctggcaccgcgcatcccgcaccccggctgccagcttccccagcagaacacccccgcgactctgccgaaaggggtgctgcccccgtaatagtacataccagcacctaagactctgctaatttcaagaaaagaaaagcaccaggactctgccgaaagggatgcttccgggaaaccgggagaaccctaggctgagggggagggagaagggagagaagccccggggcaggattcggcgccgagaaatggcggaaaggagagttgggcgaagagcgttcccgcgaaatgccggcgcgaatctgccgccgagagcctcggcacgaaatcaggaacccgcgggccggattcgagctccgaggcggcgaagaacccaaagccggccggctggttggagcaggagcaggagcaggaggcggaggaggaagacgagcccaggtgagattttgccggacgcgtgggtcgacccgggaatccggaccg

SEQ ID NO: 29130 - DNA, 768 bp, Triticum aestivum
  Clone ID: PAT_TA_29130
tctagatcccccgatgtcagtgaaattgggaacattgttaagacttgaccataaagagcagatgattccatgttgacgtagcctaaaaactgcccaccctgcactaatacccacaggcatcagtctctacgcttcataccctttcacaacctcatggtacaaaagaaccaatcctctggggactccagatgtacagaccatcgccactcagcgagcttcgaaagagcacaggcaattgatcttgacccagcggcagaactgctagcgcgtcacatcacggaatctgtgtcgtcgagcatgcgcgcccacgcggtcacggtggatcagctctccacgtcctgccagtgcctcgcccgctccggaggcgtgaggatatctgtcagctcgcgcctcctcacctgtttcaacgtaccgacaaggtccaccgccagctgaagatagataccagaaaaggtcagtggtgttttggagggcgcctcgtctgtatgtattccatctgtgtaagttaattcatttgggtgattggttcggctgtaggcggtatatctcaatacagtgggggatttgtaatgtttctggttttgtgttccttgtgagatgaaataataacttaacttgtttataacatgctcctcaattttcttcatctaacaaaaaataaataattacaaaaaaaaaaaaaaaaaaaaaaacaaaaatataagaaaaaactaaaaataaaaaaaaaaaattaaaaaaaaaagaaaccctaaagtttcaacgaattaa

SEQ ID NO: 29131 - DNA, 568 bp, Triticum aestivum
  Clone ID: PAT_TA_29131
acatgaatacttctttatatgtatattttattgacaaaaaacgctaaatttttttaagtggaatgcatgattataaacaacagttcatgaaatttaagccaagcgaccatcgaccttagcagcgtgaatgaggagatcaacaactctgttggagtaacccatttcgttatcataccaagatacgagcttgacgaagttagagttaagagcaataccagcactagcatcgaatacggaagaagcagcagaaccaacaaagtcagtggagacaacagcatcttcagtgtattcgaggatacccttcaattcgttttcggaggccttcttgacggcttccttgatttgatcgtaagaggcacccttttccaatctgacggtgaggtcaacaacggagacgtcaggagtagggacacggaaagccataccggtcaacttaccgttgagctcggggataaccttaccgacagccttggcggcaccagtagaagaggggatgatgttggcaccagcaccacgaccacctctccagtccttgttggagggaccatcaacggtcttttgggtagca

SEQ ID NO: 29132 - DNA, 986 bp, Triticum aestivum
  unsure (1)..(986): unsure at all n locations
  Clone ID: PAT_TA_29132
gcccccggccgcgtcccgcttcctgttgccctccacggccgcccgccgccggttcctccaccacctcctcgccgcgcccgcgcccccgaggccgccgcagcttcggcgctgctccccgttaccactgggatggcgcaattttgggctgaaggatcactggagaagaacaacgctctggttgaatcacccgcagcttcgtcgctgctccccgtcaccactggtatgggcgcaattttggaactgaaagcgatcactggtagaacgaacaacgctctggttttaatacctgaaacagtatggtgttgttcagaacagataaagtggcacaacttatgggaactatcgatgctagccctatttgtacgattatggatttaccccttagattgatattcccattggatcaggcagtggttacttgactgcttgctttgcaatgatggtcggaccagaaggtcgcgcagtggggattgaacacattcctgaactcgttgttgcttctactgaaaatgtcgaacggagtgctgcagcagcactaatgaaggatggttcactttcttttcatgtttcagatggaaggcttggctggccggatgcggcgccatacgatgctattcatgtgggcgcagcggcacctgagatccctcggccactgctggagcagctgaagcctggcgggcggatggtcatacccgttggcacatactctcaggacctgcaggtgattgacaagagctccgacggatccaccagcgtccggaacgatgcctctgttcgatacgtccctctgaccagccgctctgctcagctgcaggacagctgagatccttcgctctggatctggaaatgtgtgtgtatatatgtgagtgccgatgatctttgtctaccaatgtggcgtctgatgttttagatggtttggttttgtataatgcttactgctggttgatgttgcttanaatatgcgaatacctgctgtgtgtgataag

SEQ ID NO: 29133 - DNA, 429 bp, Triticum aestivum
  Clone ID: PAT_TA_29133
cggggccaagaaagaaggcggcgacggcggcgacgccaagaaggagggcgacggcaagaaggacggcgacgggaagaaggacggcgacaagaaggaggagggcgacggcaagaaggacgaccagaagaagcccgccgccgtggccccgctgccgtacccgcaccacatgccgctgccgcaccacatgccgccgccctacatgttcaacgccgactacatgatgaaccagtaccggccggcgccgccggcctacccgccgccgtacgtgccgccgcagcactactacgtgcggaacatgagcatggaggagaacccaaactcgtgcgtcatctgctaagtcaaagtctatccctcgatcgctcgcgtacgtcccgtggggcgaccatgcatgcatctgtgtatagtagtattttctcgatcgtttttacg

SEQ ID NO: 29134 - DNA, 1414 bp, Triticum aestivum
  Clone ID: PAT_TA_29134
gccggccccaggggcgcgtgacgcgccaccctcacctcccctccgcgccggcacgctcctccttcccacccctcctcccctgccgtggctgcaccgcccggccgcccgctccgccccaccacccccacacaccccccctcccctagccgcgcccgtccgtatcgcccctcccctacccagcccctttaccttcgctctgccgttcatctccactctcccggcaggtcggccaagcggatcgcggttcagctggagctgcaggacaacagggagaagcacaaggccaggaggacggtctccgtgctcgtcgggatggacgcgatatccatggacctggcgtcgcgccagatggccaggtgagccgcacgggtggacgccggtgggaacggggtaacccaagccgcggagtggctcagcggcccacatcgcgtccggcggcccccggaggccgccggaagagaagggggcgagggatgggcagcctacatagagtccgtcggcccggccaaggaacccgggaagaaggaggagacggcggaggaggccaagaaggaaagcggcgccggggcgaagaaggaaggcggcgacagcggcgacgccgagaaggaaggcgagggggagaaggaaagagacggggcgacgagaaaggagggcgcgaaggaaggaggcacgaccagaagaagccggccgccgtggacccgctgccgttcgcggaccacatgccgctgccgcaccacatgccgccgccctacatgttcaacgccgactacatgatgaaccagtaccggccggcgccgccggcctacccgccgccgcccgtgccgccgcagcactactacgtgcggaacatgagcatggaggagaacccaaactcgtgcgtcatctgctaagtcaaagtcgatccctcgatcgctcgcgtacgtacgttccgtggggcgaccatgcatgcatctgtgtatagtagtattttctcgatcgtttttacgagaccagcaaagtttgcaagatgaaactgtacatctagtagtagtctattaaagcactatgtacgtacatacgtacatttgtaaagtgaaaatttagacctagtatgtcggtgtactgtcccagtacacgtacataccacaattacatcatttgtcatttcaacaatagagaacaaaagtagagcgaggaaagagtgggtttagagagagagagagagagcagtgtgcggtgcatgatgggtggtgatgcagcatgtggctgctgttcaaactttgctttctagaaaaagggaaattgaggcgcaataatacggctatttttggcttttctcttgcaattgtagccaggcgcatcttgcatgtgcaacgccgttgtacagaatactgtgtatatatggaccaggagaatcaaaaaaaaaaaaaaaaaa

SEQ ID NO: 29135 - DNA, 992 bp, Triticum aestivum
  Clone ID: PAT_TA_29135
cccccgggtcgggccccttgccgaccgcttcccttctgcagggatcgccccccgcccccccccccccgcgcccgccgcgcgagagattgatcctcctccctgccctcgcgccgcaagtatctgacaggcgcgctgatttgggggggatgggctgcttcgggtgcttcgccccggcggcgcgccgaggggccggcgacctcaagccctccaagctcgcccaccactgcaccgacgacgactcagtcgcggacccgcagaggaaggtggcgccggacgtggggagcggctgcgcgcacagcttcaccttcaaggatctgcttcgtcgccaccggctacttcaacgaggccaatttcatcggcgagggcggcttcggcaaggggcccaggggcatcctccccccggccatcgcgccgcaaatatctgacaggtgttctgatttggggccggcggccgggatgggctgcttcggatgcttcgccccggcggcgcgccgaggggccggcgacctcaagccctccaagctcgcccaccactggcaccgacgacgactcagtcgcggacgcgcaaaggaaggtggcgccggacgttgggacgcggctgcccgcacagcttcaccttcaaggatctgctcgtcgccaccggctacttcaacgaggccaatttcatcggcgagggcggcttcggcaaggtgtacaagggcaagatctccaagaccaactcgcagggcgcttccgatgcgcagatggtggcgggcacgcggctggcccgggagagcgtgcaggggaggaaggagttcctggtggaggtgctgatgctcaccgtgctcagccaccccaacctcgtcagcctcgtcggcttctgcgcgcagggggacgagcgcctgctggtctacgagtacatgcccttcggcagcctcgagagccacctctttgatgtgcctcatggcaagccaccactcgactggaatacacgagtgaaaatagctgttggg

SEQ ID NO: 29136 - DNA, 1201 bp, Triticum aestivum
  Clone ID: PAT_TA_29136
cactttggccgtctcgtcagtacctgatactattcctcctagagcacaggtgcaaatcccagtcgaggttacaaatcttcgcgcgagtagagatgttgctgttcttgatttctcatataaacatggagctgcactggtgaacgctaaacttcgacttcctattgtgttgcataaattcttgcaacctataactctttcccctgaagattttttcgcccattggaaaacatggaatgttcagtcactcaaggttcaagaagtggttagaggtgtaaaaccattacctattcctgagatggctagtcttctattgagccttcacctggcggatactcctggacttgataccgacccgaacaacatggtggcgtgtgctacattcttttcggggacaaccaattccgcgcttggtctggtgagagttgaaacagatccccaagacagaagtcagctccggctaacagtcgcatcaggagatcaaaatctgacattcgagttgaaggagtacattcggggacagctgatcgatatttcgagggcccgggtggcccccccccccgctccccggcaaccgcaaccccttcccgcagcgccggcgaccccgcatcgacacacgcgcgccgcgggcggtgggtacccctgacaccggacggttgtttgacccgaccgttggcagccttacatcgaaattagcgtggtcgcggccgaggtaacactgccctgcccagaagcttccatccatcttgccaccaagacgacgacgaagcgctgtcgaaggtatgataacggctgggcaggaaggaaggggctggcggggtcggttctccttgcaccggagaaaaggaagcactgtattattgtattcttttgggcccttagtagcatcgatcgatcgatcataatttgtgtttgccatagcgtgtaatcgtggttctcttgtatccttgagatgtatcctattactacagtaagcactacctgggaaggaaggaagcggattggtggtggtgaagatgacttacatgtgtagctttttttgtgcggtcgtgcgagtgtttatatataaagaaaaatgttgttaggtttgtgacctaccaaatacatacacagtaagtaactggccgatgatgatgcccattgcattccatgccgctgtttatggttgtttatttagtgcattcttcatgtgaaaaaaaaaaaa

SEQ ID NO: 29137 - DNA, 2008 bp, Triticum aestivum
  Clone ID: PAT_TA_29137
ctcaggccgcacctggcggtggcatcctcacctgcaatgcctgaccttttaggggactcgataggggacgatctggtctctataatggcagcagtcgaaacagacaatcctgatctgcgtgatcgagcttacatatactggcgacttctttctactgatcctgaggcagcaaaagatgttgttctggcagagaagcctgtgattagtgatgactctaaccagcttgactcttcgcttcttgatgaattattagcaaacatttctacattatcatcagtttatcacaagcccccagaagcctttgttagccgtgttaaggcagctcctagggtggatgatgaggaagtttgctgatgctggagaaactgggtattcggagtcaccatctcagggactggatggggcatcaccgtcctctagtactggcaattcatcaaatgtaccagtgaagcagccggcagctgcagccccagcagttgctgctccgatcccagatctcctaggtgatttaatgggatttggataatgccctggttcttgttgacgagcctacagcatcttcatgatcttcattgtctggtggctggaattgaagtactgccggcagacaagcctgtgatcagcgatgactctgaccagatggactcttatactatgatatatcttttgagaatgggacccagggtgtattagatggatttatgattcagtttaacaagaacacatttggtcttgcagccggtggaccacttcaggttcctccactccaacctgggtcctcagccaggacgctcctagctatggttttctcccagaatgtctcccctgcagcaccaaacttgctactgcaggttgcagtgaagaataatcagcaacctgtgtggtatttcagtgacaaaggttcgctccatgtcttctttggtgaagatggcaaaatggagcgaacgggttttctcgaggcctggaaatctttacctgatgacaatgaattttcaaaagaataccccaattctgtcatcagcagcatagatgccaccgttgaacaccttgcagcatcaaatgtgttctttattgccaaacggaaaaatgcaaacatggacgtgctgtatctgtctgcgaagatcccccgtgggattccattcctgatagagcttactgctgctgttggtgttcctggtgccaagtgtgcagtcaagactccaaacagggagtttgtgcctctattctttgaagccatggagtctcttatcaagtaagtgacggaaacttgaggatcggtattccatcaaagttattcagttatgagcatacactggtgtgctgttccatggaagtgtgaatagtagagtgtacgagttgttctgtagccttgaaattattacctgttgacaatgcattttcaaaagaataccccaattctgtcatcagcaccatagatgctaccgttgaacaccttgcagcatcaaatgtgttctttattgccaagcggaaaaatgcaaacatggatgtgctgtatctgtctgcgaagatcccccgtgggattccatttctgatagagcttactgctgctgttggtgttcctggtgccaagtgtgcagtcaagactccaaacagggagtttgtgcctctattctttgaagctatggagtctcttatcaattaagtgacggtaaacttgaagatcggtattccgtcaaaattattcggtcatgagcatacacaggtgtgctgttccatggaagttagtgtgaattgtattgtgttgttattgtattactattagatcaccgtatttaaactgttagttttttggtttcagaattttcctctagggatactcaacctggacattttgtgccgcataaattgtatatcggcctgaacattttttcttgccatgtcatagcacatgaaaatacgtcttgtttctttttggtttgacgagtaaacatgacgtttttgacggcagaggaatgcacatgtaatatgtttcaagttaaaaaaacaa

SEQ ID NO: 29138 - DNA, 886 bp, Triticum aestivum
  Clone ID: PAT_TA_29138
cggacgcgtgggagaagatgagaaaggcattgtagtacgtttcatagttggaagaagtgcaaatcgaggagatcgttttgacagggaaatcgatgacgagaatagaagtacaaatgattttgtgatcttggatgatcatatagagtctgatgaagagctccctaagaagacaaaacgttactttgctaatgctgcagagacatttgatgctgaattttatgctaaggtcaatgatgatatatacataaatgttgacactctgagtgcaatgcttgaaactcactgggacaagcctcgtgtctacataggctgtatgaaatctggggaggtcttttctgaagcgacccataagtggtatgaaccggattggtggaaatttggtgacgggaaatcatactttcgacatgcttctggtgaaatgtttgtcgtatcaagggccgtggctcagttcatttctataaacaggtctgttctccggacatatgcacatgatgatgttagtgttggatcgtggatgattgggcttgctgtaaagcatgtaaatgaagcaaagctatgttgttcatcatggccctcaggagccatgtgttcagctctttgatgggcagtgcttccccgtccctgggttttgtgaagagtgtgccacactgaatagattttcgttttctcttgccatttcttttttctctatgccatcattgagcaagcagtgtcggttcatagtgaatgtggtttgccgcaatgcgaaggagaagtattgtaccttttcctcgtatgccgacactacctgccgtggttttttttggtcattccctagatctccatccgtaccattctttccgacaaacatcactgttcgaggacagaaataaagcacttaggaaat

SEQ ID NO: 29139 - DNA, 1062 bp, Triticum aestivum
  unsure (1)..(1062): unsure at all n locations
  Clone ID: PAT_TA_29139
aagacattggttctattgcattaacaacaaagaacgttcctgtcttgaaaccggtgaagtcttgattcgagttgcagcttctggtatttgtggtaccgatttacacatctgtaagggagaaacccctcaggctactaaaaacgtggtggtgggtcacgaattctgtggttacgttgaagagatacatccagagacgatggcggttgtcaaggtaggcgacttggttgctattgaccccaacatgccttgtaatcaatgtactttttgtcgtaacaaaaagtaccacctttgtttgaatctgttctgtatcggtgtgactgtggatggtggtatgtctcaatatgtggccgtgcccgctcgtgcggccatcacggtgcctgcacacgttcctcctgaggtagcctgtttgtccgaacccttgtcttgcgttgtccatgcggtagacaaaggtcatgtcaagagtggtgattctgtattggtcattggtgctggtcccatcggtttgatgaccacggctctggtgaatgccagcggaggtaaagtgaccgtgattgaaccgaatgaatttagacgtaaggaagctttggaaatctttggcgccgctgctgcctatggtcctggagaattgggacctgtcaatggtgctcttggagagggctatgatgttgtgtttgaatgtgtaggtcgtcccaacacggccgatgatgctgtcaagtttgcaaaggctggtggtacggtggtatgggttggtgtggccaaggtagaagatcgtgtgtccatctctccttatgatgtctatcgaagagaattgacaattacctccacctttaccaatccctacggtattgatcgtgctgtgaagattttggccgaaggaagagttaattggcgtgcgcttgtttctcactctttcaaattgagtgaatttgacaaggcttgggaagtatttacggctggtactggattaaaggtcgttgttaagccttaaagaaatttctagaagcaagaantgtatatatttgtttgtgtgtttaaactttaataaacgtatgttgtgtcaat

SEQ ID NO: 29140 - DNA, 739 bp, Triticum aestivum
  Clone ID: PAT_TA_29140
acaaaaatcaagcaataaactagagaacacacatcagtttaagttcaactgactcatatatcccaaagggttcctctgctcctattcaacttttcgaccaaaaggtttgaatgtacccatataccccgacagaactgcagcattcagcatatatccatgaacagctgaaccaggtaaaacttatgagacggagctgactctttcttcacaaaggtaaaaaaagaaaaggcaaagatgaccacgagttcagtttttctttgccccaagcgaaaccaagtctgcggcagcatcaccaccaggtgcctcagttggaggaggcaccgaaaaccctgatcctctcctcgatcttggcgttgcagctggggcagcgaactgcgcctttctcctcatgctgcttgttgcagccgacacacagcacctggtgagcacactgcagcagcatcacgcaagcctcctccctcttgcagataatgcagcctctgcggcggcctgtattctggataggctcctgctgcctgttggatgcgggcggtgccttctggttgggctgcttgggtgcccgcgctgtattgcggtcagtcatagccggaggataggctgatggaactgtcggcgcatttgcacccatggacttctgcagacgggataactgatcctggagcctccggaggtcatctttgtagcactgggactctacttctgtcttccggcgaatttcttcaagtcggcgatcagcatc

SEQ ID NO: 29141 - DNA, 706 bp, Triticum aestivum
  unsure (1)..(706): unsure at all n locations
  Clone ID: PAT_TA_29141
cgtccgcggacgcgtgggcggacgcgtgggcggacgcgtgggttgcattcaaccgtgaggttctggggcctgtgatgttccctggcctgcggatccgcaaggaagggaagcacagatgggacacccttgaagacatatggaatggcctgtgtgctaaggtggtctgcgacagcttgggctacggcgtgaagactggactgccttacgtgatgagaagtgatgcagaggcaggcaaggccttggagagcctcaaagagtgggaaggggtgaaagtgatggacgatgtccttcccttctttgagtcgctcaagctatcaaggaccgcagttactgtcgatgactgcgttaaggagctagctggcgttgtgaggcagaagctggcgccaaagaatgcaatcttcgccaaagctgccgatgccatggaggaatggaccaagctctggaaatctcatggagctcagaacgcgtaatactggactgcgtccatcttatccatcaagatacttatttttcttcttcttggactttaaaatttccatatgcactgttatgatgcagctgaataaacaatgtttccgtgtgaggggaatttgtgatgtagaacatgtagttgccaggtgttcggtttgtgtatgctcaagaaccgtgtataccaaatcaaaaagacttgcatgatttacaaggaagtgttgtgttgcatccaana

SEQ ID NO: 29142 - DNA, 1959 bp, Triticum aestivum
  Clone ID: PAT_TA_29142
attcggaaaaaacaaaaacagcaaagaacagaggaaacaaagaaaaaaagtcgccgattcgtcggtggcgcgggcctcctccctccctcgtctgccggcagacgcgacgcaacagcacgcgcgagagagcgggggcgaggatcgaggcccgcaacgtggcctgcgcctttgcttcgcttcgcagggaagtctggtagtagcgctagcgtgggtatataacgagcgcgagatccagatctggagccgatgcgccccgccccgaccctgctcgccctcaccctcgacgccgcgctcctccgcatcgccaccctccccgacctctcccgcctccccgaccacatcctcgtcgacctcttccgcagaacccttagtgctggtaagctgacagagagagtcctcaaattgtttctggcaaccgactgcgaggagatcatcttgcttgttcagctcctcaacattaagcagccacttctaccggtccttcccacgaggtgctctgagaagttctagtactgctgctgcttagatcaggctgattagctgtgaagatgtctttggaagttcatgatagcgaggttgacattgtgattgcagcactccagcccaacctgacctctttctttcaggcgtggcagccatttttctcccggtttgacatcattgttgtcaaagacccagagttgacagcagatcttcagatcccttcaggttttaatgtgaaggtttacacaaagtctgacattgatggactgcttggtgccacatccatcaacttctctggccactcatgccgttactttggataccttgtttcacgcaagaagtatgtcatctcgattgatgacaactgcctcccagcaaaggaccctgccgggatgactgttgatgctgttacacagcacatgatcaatttgaagacaccagctactcctttcttcttcaacacactgtatgacccataccgcaagggtgctgactttgtccgtggatacccattcagcctgcgtgagggggttgaatgcatgctctcatgtgggctctggctgcacaatgcggactacgacccaatgacgcatgtggtgaagcggaaccagcgcaacacgaactatgtggatgctgtgatgacagttccgctcggtgcgatgttccctgtcagcgggataaatgttgcattcaaccgtgaggttctggggcctgtgatgttccctggcctgcggatccgcaaggaagggaagcacagatgggacacccttgaagacatatggaatggcctgtgtgctaaggtggtctgcgacagcttgggctacggcgtgaagactggactgccttacgtgatgagaagtgatgcagaggcaggcaaggccttggagagcctcaaagagtgggaaggggtgaaagtgatggacgatgtccttcccttcttcgagtcgctcaagctctcgaggaccgcagttactgtcgatgactgcattaaggagctagctggcgttgtgaggcagaagctggcgccaaagaatgcaatcttcgccaaagctgccgatgccatggaggaatggaccaagctctggaaatctcatggagctcagaacgcgtaatactggactgcgtccattttatccatcaagatacttatgtttcttcttcttggacttcaaaatttccatatgcactgttatgatgcagctgaataaacaatgtttccgtgtgaggggaatttgtgatgtagaacatgtagttgccaggttttcggtttgtgtatgctcaagaaccgtatataccaaatcaaaactgttttcttccagctgaataaacaatgtttccgtgtgaggggaatttgtgatgtagaacatgtagttgccaggtgttcggtttgtgtatgctcaagaaccgtgtataccaaatcaaaaagacttgcatgatttacaaaaaagtgttgtgttgcacccgccgcggccgcga

SEQ ID NO: 29143 - DNA, 739 bp, Triticum aestivum
  Clone ID: PAT_TA_29143
cccacgcgtccgacagacaacagagaggcatacactgctgtcattggaacggtagcgacccatgccatgaggcccggagccgagtaccccatggcccacggccccgcggcggcgccgcgctcgacgtggcagacgccggtgccgtacctcttcggcgggctcgcgacgatgctggccctcatcgcgctctcgctcctcaccctggcctgctcctactggaagctctccggcggcctcgccggcccggacgaggaccaacccccgggctccgacggcgagaagggctcggccgccgggcccgcgagggagtggctggggcacgtggtggtcatcatggccggcgacgagcagccgagtttcctggccacgccggcgtcgatgacgagcagtgccgctgacggcggcgctgagaccgcagccggcgccgcggcgtgctgcgccgcgtgcaggtcggaggagaggaagatggaggatgcgcgcgaggccggtgcgcagccagccggctccgaggacgacgcgcggccagccagcccaagtgagctaccaagtagcagtaccagctctgtaattagcagctagcgagatagtacaatttacatggaaggtctttttacatggaaggtctttttttctgtttaacttgcagttttcctctgcggggttttctgctgtttaattcagtagctgtaaattttctactgtggcgatcattgaagaatacctcgtttagaaaaaaaaa

SEQ ID NO: 29144 - DNA, 901 bp, Triticum aestivum
  Clone ID: PAT_TA_29144
atcgaatcctcacagtgaaaaagcacatcaagcattatctgaactcaaacaacttgcttctactaccgatggttggaatttgactcaagaaaaggaaggtgtcaaactttataacaagacggtcgatggcaaccctattcctatcgtgcgtggtgatattgtgctcgaaggtgattatacagtacaacaagtattgaccgtctgtaccttgcctggctgtcgaaagatttgggatgataaattcgatgcttctgaagtcaaggcatggtacagtcgctatgagaccttgttctggacaaagttgaaggcaccttggcctattagtccacgtgacatagcagggacctcactccgtgaattttcagaggatgaaggctatatcgtcatgatctccgtcaccgatccagctgtgcctgtcatgtctggtaatgttcgagccaacttgatggtctctggttggaaagtgaccaagacgagtacgggtgccatctctctgatttatatcacccagatcgatttagcaggttctcttcctctttcctttctaaaggcagtacagcagcaagttcctctctgtgctagaaaggtagtggattacattaaagatcatggttacccacctctcctgatctcttccactgcacaatttaaagaagagagttttgatcatgccaagggattgtatgaggttcatttggaaggtgagggtgaagcaaaatggtcgatctctggaaagatgtatcctggtggattccgtgctgagctggtgggcactggtacttgtgaagcagtctctgttcatgaactggtcgtcaagggaatcagtggtcctgtgactgtaaagattttgaaaaaataaaagttgcgagtttcaaacaagttgtgattgacatgacttgag

SEQ ID NO: 29145 - DNA, 884 bp, Triticum aestivum
  Clone ID: PAT_TA_29145
agcaaaataatatttatttatttttgccacacaggcaaagaactaaacatcttcacacaccaaaaatacaagcatgggttacccctcaaagaaactacaagcatgggttcttctgctaagacacattattttcttccggttacatatccgtccgcagataacagacatattagtagggaagtatccccgtggtcttgccgtattcaacgaggtcgtcaaagatctcacttaaatcatcgtgcttgaactcgaacccttccccgatgagcttctgagacgataaacacgctcttggcttctcttgggacccagcaaagcgttcaagtttcacattgtattgtgggtacttttcggctaggagacgggcaagctgcacgacggtggtgttgtggctgcagcagatgtacctgcccaccgaggacttgttctcggctacaaacacctgggcccgacacaggtcatccacgtggcatatcgacaccgagtcggtgactgactgcaggcctatcatgatgttcagctgcgtctcgtcaccagacaacagggagagggtgacggggacgctggtcctggccttggagacaggagcggcacccagcgtgaacacgggcaacacggtgacgaggctgatgccattctcctccgcgaatttgctcgccgccttctccagaagcaccttggacaccgcgtattcccaagttggtggcttgttggctctgaggtactcgacgtcggaccaggagccctcgtctagcaggtggccgccgccctgcagcggcctcctcgacacgccggcgtccgatgacgtcaggatcacccgccctctctctctctctctctctctctctctctctctctctctctctctctctctctctctcctc

SEQ ID NO: 29146 - DNA, 312 bp, Triticum aestivum
  unsure (1)..(312): unsure at all n locations
  Clone ID: PAT_TA_29146
attcccgggntcgaccagcgtccgcggacgcgtgggtttttctaggtctagaaatatatgctgttggttcacctggggagattggctcgaaggtacgctcgcaggatagcaaactgtagctataaacaaccaagatggcctgagagttattataccgtctgctcgttccgagtgtgactatttaagaggaatgctccgatgaaaaaagaatcttgtttcagttgatacttgtacatattttttccatcaagctcttttcatgaggatatttaactttttgggctgtaacaatttcaaagagcttcaccaaaa

SEQ ID NO: 29147 - DNA, 2093 bp, Triticum aestivum
  Clone ID: PAT_TA_29147
agcacactgctctgcctctctctctctcggaagggggagggagagacgaaagcagagttcgctcgctcgctgcccctcctcagataccccgcccgctatgcgatgagatgctctgctctgctctgctcgcctgccctccttccttcctaaggcgagggctgcggtggccacgtcaactgcttctgcgtgactcaggcacagccggtgttgactaagacactggctgtcggcgtggcctgcgatctggtcacggaatcgcatgcggtgacgaggacgatggcgatgaagcccgtgctcgtgctcttcatgaccagcagggggtcgtaggcactcggccgcgcagccctcgctgcgctgctcgcggtgcggtaaggtcaggacaaagcagacgccggccaacccacgccacgccactgcgcccaccccatggagccgccctggcgtgccggaccggtcgcatgactggagttcccagtggattgagtcggggcctgcccagcagcggaccgacccgccaccggcgctgcgagaagacatagatatcgtctctaaaactaatctcggggttgcagttaatacgtaagctgcggatagcggacatataaaatatatgttggtggaaggactagagatctacggtgacgtgtcaactggggagattggctcgaaggtacgctcacaggacagtaaactgtaactataaacaaccaatatggcctgagagttattatacccattgctcgctgtgagtgtgacgatgaaaaccaaatgctgggagtggcagcctgatgcctgcgacctcccaaggttcgatgctaagttgcttcttgagaagctaaggaacaaaaggatgatgtttgtgggggattcactgaacaggaaccagtgggagtccatggtgtgcctggtccagtctgtggctccatgggataagaaaaagcttgtcaagaatggatctctaaatgtgttccgccttaatgagtacaatgcaacgattgagttctattgggctcctttcctagttgagtcgaactcagatgatccagacatccatagcatcaccgaccgaatgatcacgccaacatcgatcgccaagcatgcagcaaattggataggggtggactatttgatcttcaacacttacatttggtggatgaacaccccgaagatgaaaattgtgcctgacggatccttcacaaggaaaccggttaagtacgatgaattggatcgtgtggttgcataccgacagatcctcgagacatggtctggatgggtagaagagaatgtagatcccaaaaggacaatggtcttattcatgagtgtttcaccagtacatatgcagagtgaaggctggggcagccctgacaacataaaatgcttctctgagacacaaccagtgctaaattacacaaaaacactggatgtaggcactgactgggatcttttcacggaatctcatgaagtgacgaaggcgatgaagaaggtgcccgtgcacttcatcaacataaccgcattgtcggagatccgcaaggacgcacacacatctgtgcacacgctgcggcagggtaagctcctgacaaaggagcagcaggccaacccacgcaagttcgccgactgcatccactggtgcctccctggcttgccggacacatggaacgagttcatttacggccacattgtgtcgagccctctacagcggcagattgagaatcaatctgcaagatgacaatgcatatatatatatatctcctccaaatctgctagttcccgttagtacgtaagatggtaattgcggccatacaatatatatattttttctaggtctagaaatctatgctgttggttcacctggggagattggctcgaaggtacgctcgcaggatagcaaactgtagctataaacaaccaagatggcctgagagttattataccgtctgctcgctctgagtgtgactatttaagaggaatgcttcgatgcttttcatctgaaaagaatcttatttcagttgatacttgtacatatttttttttttcatcaaactcttttcatgagaatatttaaccttttgggactgtaacaatattcaagagct

SEQ ID NO: 29148 - DNA, 807 bp, Triticum aestivum
  Clone ID: PAT_TA_29148
tagcagcaagatttttatgaatattggtattgtgtgacgctataattatggccaaaaaatatcccaacggcccagaaaagaagatagtgtcattctaaacttacagatcttacctaaattatctggcaacagtgactggtctatctatagtttgtgacggtccagtggctacttctaatctttctgcatcatcaaccttttccttgtgaaaagatttgctttccagttttcgtggatagaaaataacccaggtagttcgtttccctccagcagcaaacgtgtcctatctgcaactggaagcaattccgtcatgcgcagcaggaagttgcatctcaagctagtccaacactagtaataaacttcagggggctttgacccggccggacgccctcctccagtggagtcgagccatcctgcttggatgtccggcctctcgagatcgggtctccgcgttggccccgcttcatgccccgctggccggccattaccatccggccgcctgctggcttctctgcggccctctagaccttttataggctgattgcatgctgtttggacagcataatgcattagggttgcaccatctctatcatagacggatggatttgctgaattccttaagagatagttgatgatagcatgcttcttcgaaataattgctttatgaattgctggcaaaccgtccttatcaagtgcatttacatcgaccttatgtttcagaagattgtccaatagatagaagtctcctgatgcagcaagggtgtgaagtggcagccacttactagaagcagcacttccagatcaggt

SEQ ID NO: 29149 - DNA, 755 bp, Triticum aestivum
  Clone ID: PAT_TA_29149
ttttttttttttagcacgcaaatatcctaattgaacagattgatacggatagtaatagaatacggacaataatacatgataggcatgacaacaaactacaagcagatgttgttggagcacaccagcatggcaaacacatgcatatgaaaataccaactgctttaatacttttctaatcgaacgtcacatggaccgtaaagcaactaatgtttatacttcagctacttcaagacccgtggaactttcccttagaaaaataagcacctcctttatttccacctttaaagcacaatatcttacgggtagacctcgatgacggatcgagctcccaatttcttcacaattttgtagtccgtgaatccggctttcttgaatagctcggaccagtggttttcatcacgttggccacccctcgtgtttaccatcatgagcatatccatcaggagttgggcttcaaacattactggccctaaggaaggtccaaccacaatctctatgattatcacctttcctccctcctcacgtggaggaatggcctttctgcactgggccaggattttcacacagtcctcgtcgctccaaaagtgtagcacaagcttgagcatcacggcttgagatggtggcacagtgtggaacaggtcacccgcaatatagttaatgacaccatcagttggggctttgtcgatcaccttcggaaggtctaaaacagtgcacttaatgtgagggtaagccttgacgagggccctcgacctcgg

SEQ ID NO: 29150 - DNA, 735 bp, Triticum aestivum
  Clone ID: PAT_TA_29150
acccgtattgcagggttgatcgaagcgggcggccaggtgcgcggtacttgctttctgacgaagctcgttgcgacagagggacgactttccatctaagtcccgggccgacggggggattgattttcctgcaggaggcgcggtcgccgagtctgattcggacgaggaagatcagatccaggtcaatggaaaagcaccctcaatcgggtcaaggtgcagcgtgaagaagttgcacgacctgatttcctcatttgatgaggagaaacgacagtatgtagccgagatggagtttggggggctgctagagctaccaaagataacaaggacggataggcatttcttgatgtctatcctaagccacatcgatgaggaggcaagttcaattacaattgatcacaaacgcgacatgcaatttttcgatgaagatgtcaaactggtcatcggcataccatgtggaactgctcctgttcgccctccagaccacgctgttccggaggcagtggtgacacagataagagagatgtttggaattggtccaggagagcacagcatactgccaatcgttgaagctgtgaagcagacatacgggcgtcctatgacgacacacgagaagaacaggttcaaagtggggctggtcatatgcgcatgcacatacctcctcgctccaacaatgaagaacgactacttctgtactgattattggggcgcgctggcaacggcagagctcatacatatgca

SEQ ID NO: 29151 - DNA, 474 bp, Triticum aestivum
  unsure (1)..(474): unsure at all n locations
  Clone ID: PAT_TA_29151
tgtattttttaagggccacatgggcgtcctatatgattcgatctatacacgtaaaattcacgtatctacactatcttgcacacccagggatgctaatgtttatacaacacaaatcctagagcaaagggaatgaatgcccgttaaaaaaggttaaaaaaaatggtcgtgaatcgatcgacccaagaacatagcacgacagagctagtgcgagcgcagccgccatggccacgcaggccgctccacggcccgaaaagcgcgctgggggcggcgctgtgggtctcctcgctgctggtggccggcggcgtgacgcccttgaagttagggttgccgccgtagaggctctggatgccgtcgacgtcgtccttggccagctccaccttctgcgtgcgcgacgtgatggtcgggtacatgatggcaccctccaccgacgcgtgggcggcacgcgtgggcggacgcgtggncacccgcgtgggt

SEQ ID NO: 29152 - DNA, 1515 bp, Triticum aestivum
  Clone ID: PAT_TA_29152
ttttttttttttgatatcacatggccacatgggcgcaccactttcgttctatatgattcgatctatacacgtaaaattcacgtatctacactatctttgcacacccagtggctaatgtttatacaacacaaatcctagagcaaagtgaatatatgcccgttaaaaaaaggttaagaaaaaatggtcgtgaatggatcgacccaagaactagcacgacatgtgatgcgtgtaatctaagtattattctgtataccaaaaatcaatggcagtagtatgtacagaagaatctacccaaaaatatcagtggccaatcgaactagcaatcgtggcagagcctgcagagacgaacgtggcgtgaccgtcacggcggccaggcgttctacagtgacagtaggagcagcaggccaaccgccacaactaccgcaacgaaccggccgcccggccgggagccggcgccggcgctgctgtccatctcccggctgctcgtcgacggcgacgtcggcgcgacgcccttgaagttggggttggtcccgtacatgctctggatcccctgcacgtcatccgcctccaggtccaccttcctcgtccccgtcctgatggtcgggtacatgatggcgccctgcaccgacgagtggcccagccccagcaggtgcccgatctcgtgcaccgccaccgactccaggtcgacggcggcgtccagcgccgcgcgcgacacgtcgccgccggccacccacgcctccgacgcgtccaggtggaaccgcccgtcggtcggcgagaaggcgtgcgccagcgtgcccagcggcccgtcgaacgcctcgccgtcgccgtgcgcgcccgcgtggaacccgatggtgatgtcggcgtcgtacgccgacgccgtctccgtgaagttgagcgtggtggccgccgaccagcgcgcgaaggcgctcgcgaagaccttgctcagcgtggcccggtcgatggtcgtctcggtggccgccgtgatggcgtacctgaggctcttcttggagcgcggccacgagggggaccccgggaagtaggagtagaggttccggccgtggaccgtcttgcccatggcggaggtgccgttgatgatgtcggcgacgccgcaccgcggggacatcatcttggtgaccgtggccgcgtccagctggccggtgacctccaggccgaagttctgctggtaggtccggatggcggactccatgtcggcgtcgaacatgtcgttgaacttggccggcggcgcggggaggtagccgaagcggctgaggtagtccttgagcctcgcgaggccctgccgctcgtccccgaactggcagccggagaggttctggaacgccgaccacgggttggacagcagcggcttgatgtccgggagaccctccggcaagctccgggcggacgcgggcgacagcgcggccagcaccgtggccgcggcggcgagcagagcgaggaggggggagacacttcttctgatgctcgccatttagctctcggcgagatgtgtgtgtaatt

SEQ ID NO: 29153 - DNA, 519 bp, Triticum aestivum
  Clone ID: PAT_TA_29153
ggcaccgtctctctcttcctcacgacacgagcgcttgcggcggcggcggcagcggaaggaggcgacgatggggcactccaacgtgtggaactcgcaccccaagaactacgggcccggatcccgcgtctgccgggtctgtgcgaaccctcatggattgatcaggaagtacgggctgatgtgctgcaggcagtgcttccgcagcaacgccaaggacattggcttcatcaagtaccgctgaaatcagctgggctacgagggtgaggtttggcatggaccctatgaggacgaggattgacatgggccctagtggtagatcgaggccacaattttaattccagtaatttagatgttttgttcagaactctgctagtaaagtctgccatgtttgtcatattgaacatgagttacttgcgttgtgcttaagctatcttgtgtcctaccgtcatatttctcactcgggtatcaggattctgtaatgtcgaatggttaaggtgccataataaaaaaaaaaaaaaaaaa

SEQ ID NO: 29154 - DNA, 536 bp, Triticum aestivum
  unsure (1)..(536): unsure at all n locations
  Clone ID: PAT_TA_29154
tctcctacgcgtccggtagggtttccagttgcaagccgcgccgccgccgccgccgccatgggacactcgaacgtctggaactcgcaccccaagaactacggccccggatcgagggtttgccgtgtctgcggcaactcgcatggcctgatccgcaagtacgggctgatgtgctgcaggcagtgcttccgcagcaacgccaaggacattggcttcatcaaggtatgcgacgccacactgtccatggatttcctaaatttgatggccgccgagtaatactataccgttaagaatggaaacctcaaaggaagcaaggactaggaaattatcaacgaactgtggtgcttcatcgaggctgatctttatcctataagctatgtaatgaactgctattatgtttgaatcctggtgacaaaaccgtgaaacaaattagtgactgctgtttgacaagttnaaaccgatattctgttacccttgtccatcctggttagaaattgctctgcnccttaanattttataatttggcgaaaaaaaaaaaa

SEQ ID NO: 29155 - DNA, 1101 bp, Triticum aestivum
  Clone ID: PAT_TA_29155
gtgtctcagcttaaactcatccgatactctataagacaaaagaatcgacagctccagaagcttcagaaccgtcgcaaccatgtctcaatacccccacatcctcctgcgcgctgaggagaagcccctcgagcaccgatctttctctccctcaattatcaagactcttgtcgacgctggatatcccgtctctgtcgagcgatcatctacagaccccaagttcaagcgcatctttgaagactccgagtatgaggctgctggtgcgcgcctcgtcaacgagggcacctggcccaacgccgaagccggaactttgattctgggcctcaaggagattcccgaggaagactttcctctcaagaacgaccacatttcatttgcccattgttacaagaaccaaggtggatgggaaaaggtcctcggccgcttccctcaaggaggcagcgttctatacgatttggagttccttgtcgatgagcaaggacgccgagtttctgctttcggtttccacgctggattcgctggcgctgccctcggtatcaagactcttgcccaccagcttcaggacccctcctccaagctcccctcagtggagacattcaccgatggtcgtggatactacctaaacgaggaggagctcgttaaccagatccgagaagaccttgccaaggccgagaagtctcttggacgcaagcccactgctctcgtcctcggtgctcttggacgatgtgggaagggtgccgtggacctgttcctcaaggctggcatgcccgacgagaacatcacccgctgggacttgaacgagaccaaggaccgagatggcccttatgaggagattgcccaggccgatgtcttccttaacgccatctacctttccaagcccatccctcctttcatcaacgaggagcttctcgccaagtctggccgcaacttggctgttgttatcgatgtctcctgcgacagcaccaaccctcaccaagccatccccatctactctatcaacaacacattccacgagcccaccgcccccgtcgagatcgagaacgagcagaactctctccctctatcagctattatgatcgaccatcctcccctcaatgatgcccc

SEQ ID NO: 29156 - DNA, 945 bp, Triticum aestivum
  Clone ID: PAT_TA_29156
acactttgaaggggacactggctaaatgggcaaaatggggccaaatggcaatgcggtggagctattcaccaccacacattttttgtcctctcatcattgtacgtgttctctctcacactttgattgtctttttgcttcttctctcctaggatgattaaatccagcattgccttagcaactaggaagatgcataaataccatcacgcgggacagtgatgtcgagggcctcctgtatcttgtagtgaggaattctcctcttcgatctagggtctggcaaaaagatcaaatccccgatatgtgtccaattgcaaggtgacatggttgtcaacatgtgaaaaagaacaaacatatacactgcactggactcacctgtttttgttgggggtcggctagttctgcaacgacggggataggggagttcttgggtgccgccgagaactgggcgcggatagcccttgtccggctcaccgaggtcgttgttgtagttatagcggtacacacggtcccactcctcgtactttctggttgtgccgtcgcctcggagattgttgagttcatctttgacggttttgcaccaaaagtgcagcattttgctgggcagataggtctcttgcgtcttcgggccggtggatcttcacacagcagcagctaggatgagatggtgtgcaccttgcgagccggatcctcgtaagtaaccttcctcgagaaggtcgaggtggcctttgcgagaaggtcaaccaacaggggttagggaaagcagacgagttggggcatcgcgacggcgggcggacgcgatgtggagcagccgcagcgagaagaagacagggcgcggcgatggagtgcagggccggggttcggatgcctggtgttgacggcggcaggatccagcaaagatcacttgaggaagagaaggagaagaggaagggattgcccggcccggccggc

SEQ ID NO: 29157 - DNA, 653 bp, Triticum aestivum
  Clone ID: PAT_TA_29157
catcagcactcgccatattgcctggcagatcgatgagcttcaccatttccagaagacgttggatccgcacttgaacttctcckctcccctcgcactcgatctccaggtcgtcggtgatgaacgggactttcttctgcttggcgaggtcytggcagccggtgaagttgtaggggaacttgcagctgycgaactggacggtgtaggcgcgcgccaagttggcgccgctcgtcgccgccctcttcttgtcgttcagctccttgttgagcttgctcttctcgaggtacttctcggcctcggtggggctcttgatcttggctgcatggtcaagcccgtcgagggtggcgaagagctttccggtgaggtccttgaggtccttcttttcctccttggtggtcttggaggagatgacggtcttgaggtcgtagcgcaggtaggaggccctcaggcggaggtcgttcatgacgtacccatgctgttaaagatcccacgcatgtttgatccatggggtggatacagcatcataggctttggtgatatcctccttccaggactgctggttgcttttgcgctaaggtatgattgggctgcgaggaagaccttacaatctggttactttctgtggtcaatggttgcgtacctgcccgggcggccgc

SEQ ID NO: 29158 - DNA, 926 bp, Triticum aestivum
  unsure (1)..(926): unsure at all n locations
  Clone ID: PAT_TA_29158
tcggcacgaggatcctagcaaccggcggcggcaggcggaaggcgaacaagaaggcggcgacgatggggcactccaacgtctggaactcccaccccaagaactacgggcccggctcccgcgtctgccgggtctgtggaaactcccatggactgatcaggaagtatgggctgatgtgttgcaggcagtgtttccgcagcaacgccaaggacattggcttcatcaaggtatacaacaagaacattattgttgcaccaggaacaatctgaaattatattattattttgtcagccatgattcccttactatttatatatagtccttcagtaagcagcttcaaatgtcagttatgacttaatacattagatttgtgattccttattgccttctagtgtttgatgatacctattcctagtctacatccaaattagataaatgattggttaacaaattgatgtgctccattgttctctatggttggctcatttactttgcagtttctgtattgagatgttttttgctagaattttattacattgaagatgtatttccaagtctgacaattcactagtggtatgctgttattgtggccaggcaatttctgaaatgggttaatatgattcagataacataatagccaagctttggtacagttgtcttgatgttcttatgcagtgtcgtttcttctgcatctagccttctagtctagtataaagcatgtatatcaaaattttatcgtttgtgcagaactattgttataattatttgattattatcttttgttgcagtaccgttaattcacctgttcctggtaccctgaagtgaagctgatcagggatgaaggattggagcacttaatagaatgcttaatttcaattccagtaatgtttgctcgggttttatgttttgaggatacgaanatgtaattg

SEQ ID NO: 29159 - DNA, 904 bp, Triticum aestivum
  unsure (1)..(904): unsure at all n locations
  Clone ID: PAT_TA_29159
gcccacgcgcatcctagcaaccggcggcggcaggcggaaggcgaacaagaaggcggcgacgatggggcactccaacgtctggaactcccaccccaagaactacgggcccggctcccgcgtctggtaatacttctgccaccgcctcgatcccctccatctccttaaaatgcctagttcgttgttcgttcccgcggctagatatctcctgctagaccaactgttcgcccggatctgtgtgtcttacacgatttagttggcgacatatatcattcgatcgtggcgtgcttcatatggcgattaaaaccttgtttgctctgtgttatgtgttgtcagggacttattaaccggttaaattctcacatttgatgattgttatgccttgataaaggctttcccatcttcatatgatgtgtattttgttgatgtagttggcgacttgtatcatctgattctggcgtgcttcaaatggcgattaaaatcctccttgcttaactctgttagatgtggtcaggtaggtttcgggtttcgttgttaagtatgtcgctcaaaccattcagagcttgctgtgatgtgcaagtgggcttcacaagcgaccaaccaaggaaaatattgttaagaattgcctcaaaanttaatttggttacttaacaagcattcctccggtgctgtgcggtaacaaactgaaatacatgggttgctgggcttgtctggcgtacaatcaatcactgatgttatgtgatgaacaagtatgcttacgagtgantgtactgacccaagtttgtaatttgggaaccgggtcgtggaaactccaaggactgatangaagtatgggctgatgtgttcaagnagtgttccgancaacgcaagncattgntcacaggntcacaagacatatgttcacaga

SEQ ID NO: 29160 - DNA, 393 bp, Triticum aestivum
  Clone ID: PAT_TA_29160
tagcgtggtcgcggccgaggtccgaaggatgaggacgacagtggaggcgaggaagaagagggagaagaacatgaaaaggcattatgtggtgcgtgtaacgataactatggacaggatgaattctggatctgctgtgatgcttgtgagacatggttccacggtaagtgtgtgaagatcacccctgccaaagctgagcacatcaagcactacaaatgcccgaattgcagcagcagtagcaagagggccagagcatgatatcggattcctccacggctcatgtctgaagatccaaggatttgacttactgtaaagatgcatgtgggacggaatgcccaatggatgtgcattcagttgttgctttgagattagtacctgcccgggcggccgctcgaa

SEQ ID NO: 29161 - DNA, 798 bp, Triticum aestivum
  Clone ID: PAT_TA_29161
aaatgcaccgcgccggctggatgcgcgttcgcaacgcattcaagccggcggctgtgcgccggcagagcaccaaggcgagcgtcggcgacggcggcgccaaggcgggcatctgcgacggcggcggcggcgaggccgggaatggttctggcgagtccacggaaggcccacccgtcgtcatccccgtgaccctcgcgggcatcgccatgtggacctggcagaagcagtcggagatttcatcaaggacgcgccgtacgcaacggaggggatggttgggtacgttgctcccgcttcccttccacagaaggaggtccccgagccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacatcggcttcatcaagtaccgttaagaatggaaacctcaaaggaagcaagggctaggaaattatcaacgaactgtggtgcttcatcaagtctgatctttatcctataagctatgtaatgaactactattaatgtttgaatcctggtgacaaaaccatgaaaccatgttagtgactgctgtttgagcatgtgaaaccgataattctgttcctgtcgtgccattatggttagaaggttgctctgcatccttatatttttattattttgtgaaggccggccatgctttgttttgatgctctaattttatattcctcgttttcaaaaaaaaaaaa

SEQ ID NO: 29162 - DNA, 461 bp, Triticum aestivum
  Clone ID: PAT_TA_29162
aaaattacagaattccacttgatgataaaattacagcgacgataacttcacagtcgaaacacgtgcgcagctttgaacatctaggtacacgcggtgcgctggcgtacatcagcactcgccatattgcctggcagatcgatgagcttcaccatttccagaagacgttggatccgcacttgaacttctccttcccctcgcactcgatctccaggtcgtcggtgatgaacgggactttctgcgaccacacaagaagacatgatcgtcagccagccagagcttagagttcatccggccatggagagttaattaaacaggagagctaccttctgcttggcgaggtcctggcagccggtgaagttgtaggggaacttgcagctgccgaactggacggtgtaggcgcgcgcgaagttggcgccgctcgtcgccgccctcttcttgtcgttcagctcctgatcacgcgc

SEQ ID NO: 29163 - DNA, 1017 bp, Triticum aestivum
  Clone ID: PAT_TA_29163
agttcttggtatcgcactgattgttactgtgatccagattgtgaggataccaaatcttaaggtggggtctgttcttctcggctgttccttcttgtatgacatcttctgggttttcatatccaagatgttgtttcatgagagcgtgatgattgtggttgcacgtggtgataacactgacgaagatggtgtacccatgctgttaaagatcccacgcatgtttgatccatggggtggatacagtatcataggctttggtgatatccttcttccaggactgctggttgcttttgcgctaaggtatgattgggctgccaggaagaccttacaatctggttactttctgtggtcaatggttgcgtacggttctggtcttctgataacctacgtcgccttgaatctcatggatggtcacggccaaccggctcttctttacatcgtgcccttcacgctcggaactttcatatcactcggtaaaaagcggggcgagctcaggaacctatggatgaaaggacagcctccgagagtctgcacgcactcgcatcctcctccgaaggactctgcggactctgctgctcatgtaatctcatcgtagattgtagatagcggctcgccttatcgtagcgtaatggttccttggctggaggcgaaagtgcggctccgctgatctgttgtgtgaccctgttccgtgggtgtgtctaatatggacctgttgtcattagaaccaatcccattagttgtatatagatagagccttgtggtttgcttctcttgttgtggctgcatctacctgtgtacttggagagtagtacctcctttccggtttgtttgtaaggcccgtgcgtatccctagatcgacaatttgaccaacataatgaaagttctatattataaaaacatgccattaaaaacttcaaatgctctattttcccaatggtatatattttgtgatacccaattcatatcacatttgtaaaattaaccacgcgaggcccctatataaactgaaagggagggagt

SEQ ID NO: 29164 - DNA, 500 bp, Triticum aestivum
  Clone ID: PAT_TA_29164
ggtgctggtgatcgggtacatcgagttccagcgcaacgcggagaggaggctctaccccggtggctcctacttcgacccgctggggctcgcggcggacccggaaaaaaaggagactctgcagctggcggagatcaagcacgcccgcctcgccatggtcgccttcctcggcttcgccgtgcaggccgccgccaccggcaaggggcctctcaacaactgggccacccacctcagcgacccgctgcacaccaccatcttcgacaccttgggttcctcttaagtggtcggtggtcgagcaatttctgtcagctcagcagcaaaatggacgaacgcgcgtccgtgtaacgaacgtgctttggttttgtatgacgagtgatggatgagagggtatcgcacagatcctttgttgattaatgcaggtctgatcacataggagagctgctgggacttggtgatttgtaaaatatgaaccaatggtaacttaatgcatccacttgtacatc

SEQ ID NO: 29165 - DNA, 1061 bp, Triticum aestivum
  unsure (1)..(1061): unsure at all n locations
  Clone ID: PAT_TA_29165
tctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagttgctgagatgctccgtcaaccttggggttccctggtcattcttgggacactctgaaaggagagctctgctgggagaatcaaatgagtttgttggagacaaggttgcttatgcgctgtctcagggactaaaggtcattgcatgtgttggtgagacccttgagcagagggaggctgggtcaacaatggaagttgttgctgcacaaacaaaagcaattgctgagaagatcagtgactggagcaacgtagttgttgcctatgaaccagtatgggccattggaactggtaaagttgccaccccagctcaggctcaggaagtgcacgcantccctgagggattggctaaagatcaacgtcagccctgaggttgctgaatctacaaggatcatctacggaggttctgtaactgcagcgaactgcaaagagctaggagcacagcctgatgtcgatggtttccttgtcggtggagcttctttgaagcccgagttcatcgacatcatcaacgcggccaccgtgaagtccgcttaagatgttccaacccttcaccctgatgcagagatatgctgaagaggaaggaacatacatttttttgtttaactgtgctatgtaagctagtagtaactttgcgctggagcatatactgttttccctcccccccagctttttgggaggctacagcttgagcttgctaataatgtttacctctggacatatcaataatggtgtttatgtagacctttttttgtggcgaattatgatggat

SEQ ID NO: 29166 - DNA, 298 bp, Triticum aestivum
  Clone ID: PAT_TA_29166
gcaggtaccagccttaggggtcttgctgtgttgttatttggtgtatgtcggtgatgttctagatttacttgtagtcttagcaactaattgtaacagcttgtatgtcttggagccttgtcagtgcgcctgttctggactctcagtgtcctaggtccagtgatgtatcacgccatcatgtacaccgcgtcggaggagtgcttggacaggatctccatcagcgagatgcccaccagcgcctggaactggttggtgatggtgaggatgaatgccttctccggggcgcgctccagcagggcgt

SEQ ID NO: 29167 - DNA, 931 bp, Triticum aestivum
  Clone ID: PAT_TA_29167
aaaattacatggaagatgatacattggccagtggctacccatgcacataacacttgggtgtcaaatgagcactaatgtactagattattcaagcaaatgatcctagaagcacacaccccaacattttgcatgctggcgagcaacgaccttcctccaaatatctcatcagatggagatgctgttggggatgcccctggccgtgaggccctcggccttgcccgtgtggtcggaggtgttggggtagagcagcatgtaggggaactgggctggtccattgcggttcttgagctgggggtttccgttcaaggccaccacctggctctcgatgccctccagcctcgtgccgaaccgcttgaacgcctccagtgccttggcatccgacgtccactccggcgtgtcacgctgcccgaggtaaatctcatcggaggaatgcttggacaggatctccagcagagaaatgccaatgatggcctgcatttggttggtgatggtgcggatgaacaccttttccgggtcgcgggccagcaaggcgtactcctcggtgtccggctctggcatcggacggcggctcgctgacggcttgttggggtggtaacctgcgtacgggtactgcccgaagttgacggcggcgtgcagcgccgacccggtccagatgatggtggcgcaggccttgaccagctccgccaccgtcttcatcttgggccaccacgccgcatcctttgaggtcgccgtggccgacctcgcgtacctccttccaccacgcctgcagctccacgtcgctctgaagcacactgtcgctggtgtagtagatggccagatactctgtcacccactgctcgatggcggtccagatagcgagcccatccaccgcgtaagggtagtcctcaagtagcagccgcaccttgtgcgggctagatgggtcgcgccacgc

SEQ ID NO: 29168 - DNA, 1346 bp, Triticum aestivum
  Clone ID: PAT_TA_29168
cgtccgcggacgcgtgggtcagcatggagtgctcgagaagcacttattgaacaagagaaacttctaaaggatggccatgaaagttcagttaacattgaggccgaaggttctactggtatggtagatatcaccatgacgtcggcaatgctgtttattgtggttgcatcactgtttttggtaatgctttacaaattgatgtctcactggtttgtggagctcctggtggttatattttgcattggtggtgtagagggtttgcaaacgtgcttggtggctttattgtcaagatggttcaaacctgccgcaagatcatttgtaaaagtgccattttttggagctgtttcataccttacattggcagtttgtccattttgcattggctttgctgttttatgggctgtttatcgccggatgccctatgcatggattgggcaagatgttcttggtatcgcactgattgttactgtgatccagattgtgaggatacctaatcttaaggtggggtctgttcttctgggctgctccttcctgtatgacatcttctgggttttcatatccaagatgttgtttcatgagagcgtgatgattgtggttgcacgtggtgataacactgacgaagatggtgtacccatgctgttaaagatcccacgcatgtttgacccatggggtggatacagcatcataggctttggtgatatccttcttccaggactgctggttgcttttgcgctaaggtacgattgggctgccaggaagacattacaatctggttactttctgtggtcaatggttgcgtatggttctggtcttctgatcacgtatgttgccttgaatctcatggatgggcacgggcaaccggctcttctttacattgtgcccttcacgctcggaactttcatatcactcggtaaaaagcggggcgagctcaggaacctgtggatgaaaggacagcctccgagagtctgcacgcactcgcatcatcctctcaaggactctgcggactctgcctctcatgtaatctcatcgtaggtagcggctcgccgtatgccgtagcgcaatggttccttgcctggagacgaaagcgcggctccgcggatctgttgtgtgaccctgttcccgtgggtgtagtggtgtctaatatggacctgttgtcataccctagaaccaatcccattagttgtatatagatagagccttgttgtttgctcctcttgttgtggctgcttctacctgtgtacttggagagtagtacctcctttccggtttgtttgtaaggcttgcgcgtatccctagatcgacaatttgaccgagataatgaaagttatatgttataaaagaatatcatt

SEQ ID NO: 29169 - DNA, 895 bp, Triticum aestivum
  Clone ID: PAT_TA_29169
gaaatgatgagacgtgaagagggaatttctgtgagttaaaagaatgcacacacgactgcttattcatgcctcattgtcctctcactatgaacatcatctacgatcatcatttcccatcatccactaatccctgacaacaactaattaccgcaatcacccaaaagcgaatgaaaaggattaaaggaacacaatacaccctgcgagacacgaaccaaccaatctaggagtactgaagaaagatcacgcacgatcagatggagacgctgttggggatgcccatggcggtgagcccgagccctttctcgccgccggcgtccgacgtgttggggtacagcagcatgtagggcatcttcaccggcccgttccggttcttgagcgccgggtccttgttcatgtccaggatccgcttctcgatctccatcagccgggtgccgaacctcttgaacgcctccagggccttggcgtccgacgtccactccggcgtgtcgcgctgcccgaggtacacctcgtcggaggagtgcttcgacaggatctcgatgagcgtgatgcccaggatggtctggaactggctggtgatggtgtggatgaacaccttgtcagcctccttcccgcccttctgcagctgcttgtactcctcttcgccctcctccggcatcttccgacggctcaccgtcggccggttcgggaggtacccagcgtacgggtactgcccgaagttgaccgccgcgtggagcgccgacgccacccagatgatggtggtgcacgtcttggccagctcgtgcacggtcaccatgttgggccaccagtcggcatccttgaggtcaccgtgcccaacctcgcgcacctccttccaccactcctccagctcccttgtcggcccggagcacgccgtcgc

SEQ ID NO: 29170 - DNA, 1131 bp, Triticum aestivum
  Clone ID: PAT_TA_29170
taaaagaagcataacccatcactttattaatatataatttggaaggggaaaattacatggaacatacattgaccactgactacccacgcacataacacttgggtgtcaaatgagcactggtgtactagattattgaagcaatgatcctcgaagcacgcaccccaacatctttgcatgctggcgagcaacaatgctcctccaaatatctcattagatggagatgctgttggggatgcccctggccgtgagcccctcggcctcacccgtgtggtcggaggtgttggggtagagcagcatatacggaaactgggccggcccgttgcggttcttgagctgggggtttccgttcaaggccaccacctggctctcgatgccctccagcctcatgccgaaccgcttgaacgcctccagtgccttggcatctgacgtccactccggcgtgtcacgctgcccgaggtaaatctcatcggaggaatgcttggataggatctccagcagagaaatgccaatgatggcctgcatttggttggtgatggtgcggatgaacaccttttccgggtcgcgggccagcagtgagtactcctcgctgtccggctcaggcatcggacgacggctcgctgacggcttgttggggtggtaaccctgcgtacggggtactgcccgaagtttacggcggcatgcagcgccgacccggtccagatgatggtggcgcaggccttgaccagctccgccaccgtcttcatcttaggccaccacgccgcgtccttgaggtcgccgtgcccgacctcgcgaacctccttccaccacgcctgcagctccacatcgctctgaagcacactgtcgcttgtgtagtagatggcaagatactctgtcacccactgctcgatggcggtccagatagccagcccgtccaccgcataagggtagtcctcaagcagcaaccgcactttgtgcgggctagatgggtcacggaccgccatgcccctcttgattaggtcgtctggtagggcctgctcgttgaagttccagtccttgtaggtgacggaggacatctccatggcgtacttgcgcggaagacggtcagctcgatatcccgccggcgctacgagcagccctcgtgccgaattcctc

SEQ ID NO: 29171 - DNA, 866 bp, Triticum aestivum
  Clone ID: PAT_TA_29171
accatatatgaggttgtcacgggaactgcgaagaagcaggtcaaagaaaaacaccccaaaagcagcagcaagataagtaaatctggcactaagccatctcgccagccagaacccaactcaaggggtccaaagatgccaccacctccgaaggatgaggacgacagtggaggcgaggaagaagagggagaagaacatgaaaaggcattatgtggtgcgtgtaatgataactatggacaggatgaattctggatctgctgtgatgcttgtgagacatggttccacggtaagtgtgtgaagatcacccctgccaaagctgagcacatcaagcactacaaatgcccaaattgcagcagcagtagcaagagggccagagcatgatatcagattcctccacggctcatgtctgaagatccaaggatttgacttactgtaaagacgcatgtgggacggaatgcccaatggatgtgcattcagttgttgctttgagattagtaccagctttaggggtcttgctgtgttgttatttggtgtatgtcggtgatgttctagatttacttgtagtcgtagcaactaattgtaacagcttgtatgtcttggagccttgtcagggccctgttctggactctctgtgtcctaggttcagtgatgtatcacgtcatcatgtacccttgttgtaatttgttgaagaaccgcctgttatcttagcttttacagcctagttatatttggacatgttatctagcatctaccgattgttccactgttttagaacttggtaaatagtcgggtgtttgtcaacttgagaaattagggttgcgggtgcaatgtttaagacggtggtgcttgccacaattgtagggtgtatt

SEQ ID NO: 29172 - DNA, 928 bp, Triticum aestivum
  Clone ID: PAT_TA_29172
ttttttttttttttttttttttttttttttttttttttttttttttttttttttttttttttttttttttttttttttttttttttttttttccaagatagaatcatacttaagtgcttgttgacatattatcaacagggaagttacattgccggcttccaaatatgaacaaacataaaaggcctgaaagcaacacggccattatgccgatccatctagcctagcttggcgaggacatcgccgagaacagtcttggtctcgccgtagtacttctcggcctcggtggggctcttgatcttggctgcatggtcaagccgtccagggtggcgaagagcttgccggtgaggtccttgaggtccttcttctcctccttggtggtcttggaggagatgacggtcttgaggtcatagcgtaggtaggaggccctgaggcggaggtcgttcatgacgtacggccattgcttcttgtcgatgagcggcttgaggttgaggatgtcctgggccgactccttggcccggaccgccgcctccgccggtggcagcggctgcaggtagaaccggttcttcaggggcaggtcgaagtcccttgcctcgtcggagttgtccgtgccggctgaacacacacacccaaatcatccatcagatcaggcgtaaaattctactccttgctatactatattattattgtgtaaagcgagtatagatgatgtacgagcggctggaggcactcacggagtccaccggagagcggcggcggggggccaaccttgatggccgcgacggtgccggcgtgcaccacctgagcgaacgcgctcccgacgactctgctggccatgaggccaaggaccgcgcggcggccggcggcctcggcctccgcagacgacgccctcacggtgaacttgctggcgcgcctgccggccgggcctggg

SEQ ID NO: 29173 - DNA, 799 bp, Triticum aestivum
  Clone ID: PAT_TA_29173
gttttttttttttttttttaaacaaaatagagctcattttattgatataaattgaaagggaaatatacatggaagatacattgccagtggctagccaagcacacatcacttggatggcaaatgggcattgatgtacgtagattattcaagcaatgacccaggaagcatgcaccccaacatttccgcatgctagcgagcagcaaccattctccaaatatctcatcaaatggagatgctattggggatgcccctagccgtgagcccggtggcatcgccattgtggtcagaggtattggggtagagcaacatgtatgagaacttgactggcccattgcggttcttgagctgggggttcccgttcaaggcaaccacctcgctctcgatgccctccaacctcgtgccaaaccgcttgaacgcctctagagccttcgcgtctgatgtccactccggcgtgtcacgttgcccgaggtaaatctcgtcggaggagtgcttggataggatctcgagcagtgaaatgccaatgatggcctgcacctggttggtgatagtgtggatgaataccttttcgggctcgcgggccagcatggcatattcctcggtgcccggctccggcatcggacgacggctcgctgacggcttgttggggtggtaacctgcgtacgggtactgcccgaagtttacagcggcgtgcagggccgaccctgtccagataatggtggtgcatgccttgaccagctctgccaccgtcttcatctccggccaccacgccgcgtccttgaggtcgccgtggccgacgtcg

SEQ ID NO: 29174 - DNA, 554 bp, Triticum aestivum
  Clone ID: PAT_TA_29174
attcggcacgagagcaaaaggtagggtttccagttgcgcgccgccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacattggcttcatcaagtaccgttaagaatggaaacctcaaaggaagcaaggactaggaaattatcaacgaactgtggtgcttcatcgaggctgatctttatcctataagctatgtaatggactactattatgtttgaatcctggtgacaaaaccgtgaaaccatgttagcgactgctgtttgagcatgtgaaaccgataattctgttactgcgtgccattatggttagaaggttgctctgcatccttatatttttattatcttgcgaaggccggcccccaaaaaaaaaaaaaaaaaaacaaaaaaaaaaaaaaaaaaaaaaaaaaaaaaaaaaaaaaacaaaaaaaagggg

SEQ ID NO: 29175 - DNA, 977 bp, Triticum aestivum
  Clone ID: PAT_TA_29175
aagaaaagaaacgacaccaaatccaatctcgagcccccctctcccgtccgcccgtcccaacccgatccgatctcccccctcctcctccgtcgccatgggccgcaagttcttcgtcggcggcaactggaaatgcaatggaactgtcgaacaggtagagagtatcgtcaatactctgaacgctggacagatcgcctctacggatgttgtcgaggttgtcgtcagcccgccctatgtcttccttcccaccgtcaagggctaagctgcgcccagagatccaagttgctgctcagaactgctgggtgaagaagggcgggtgctttcaccggtgaagtcagtgctgagatgcttgtcaacctcgggcgttccctgggtcatccttggacactctgaaaggcggagcttgatggggagaaatcaagcgagtttgttggagagaaggttgcatatgcactcgctcaagggcttgaaggtcattgcatgtgttggtgagactctcgagcagcgagaagctggatcaaccatggcagttgtcgctgaacagacaaaagcaattgctgacaagatcaaggactggaccaatgtggttgtcgcttatgaaccagtgtgggccattggcaccggtaaagttgcgacaccggctcaggcgcaggaagttcatgccaatctgagggactggctgaagaccaatgtgagccccgaggttgctgaatccacgaggatcatctatggaggatctgtaactggcgccaagctgcaaggagttggccgcgcagcccgatgtcgatggtttccttgttggtggagcttctttgaagcctgagttcatcgacatcatcaacgccgccaccgtgaagtctgcctaagcaagatctcgacgtggctcctctcggcgtggaggaagacagcgaagatgaagagactccttttttttctctcctgtgtttattatgtgtgtacctgcccgggcggccgctcga

SEQ ID NO: 29176 - DNA, 643 bp, Triticum aestivum
  Clone ID: PAT_TA_29176
gcataattcatctttatgatgacacggtttccgtggaaacctaaatgctttatttattgctaattttttttataagcacatccagcctatgcataactaagatgcacacggccaacagcaacacacaaataaaaaacaccgtgatcgaacaattgctgacacaagctcacacacagtgtcacacacactgcactagtctctcgacacgttcccgtacgtggtgaacgagtcgcacgctctttattcggacgcgcacgcaccgtggttggcgtggacgagacgaagctccgatgtaccatgctcagatggagatgctgttggggatgcccttggcggtgaggccggcggcggcgcccttgtggtcggaggtgttggggtagagcagcatgtaggggagcttggccgggccgttgcggttcaacagctgcgggtcgtggttcatgcccaccaccttgctctcgatctccaccagccgctcgctgaaccgcttgaacacctccagggccttggggtccgaggtccactccggcgtgtcgcgctgccccaggtagagctcgtcagaggagtgtttggacagcacctccaacagcgagatgccgatgatggtctggatctggatggtgatggtgtggatgtaaggccc

SEQ ID NO: 29177 - DNA, 664 bp, Triticum aestivum
  unsure (1)..(664): unsure at all n locations
  Clone ID: PAT_TA_29177
aaaagaaacgccaccaaatccaatctcgacctccccctctcccgtccgcccgtcgttcccaacccgatccgatctcccccctcctccgtcgccatgggccgcaagttcttcgtcggcggcaactggaaatgcaatggaactgtggaacaggtagagagtatcgtcaacactctgaacgctggacagatcgcctctacggatgttgtcgaggttgtcgtcagcccgccctatgtcttccttcccaccgtcaagggtaagctgcgcccagagatccaagtcgctgctcagaactgctgggtgaagaagggcggtgctttcaccggtgaagtcagtgctgagatgcttgtcaacctcggcgttccctgggtcatccttgggacactctgaaaggaggagcttgatgggagaatcaagcgagtttgttggagagaaggttgcatatgcacttgctcaaggcttgaaggcattgcatgtgttgggtgagacccccgagcagcgagaactggatcaaccatggcagtgtccctgaacagacaaaacaattgccgggcaagtnaaggactggacaatgtggttgtcccctacaacaatgtgggccaatgnnccggtaaatnccanaccggtcaagccaagaatccatgcaatctganggacggtcaagaca

SEQ ID NO: 29178 - DNA, 930 bp, Triticum aestivum
  unsure (1)..(930): unsure at all n locations
  Clone ID: PAT_TA_29178
gctcgaaattaaccctcactaaagggaacaaaagctggagctccaccgcggtggcggccgctctagaactagtggatcccccgggctgcaggaattcggcacgaggcaaaaggtagggtttccagttgcaagccgcgccgccgccgccgccgccatgggacactcgaacgtctggaactcgcaccccaagaactacggccccggatcgagggtttgccgtgtctgcggcaactcgcatggcctgatccgcaagtacgggctgatgtgctgcaggcagtgcttccgcagcaacgccaaggacattggcttcatcaagtaccgttaagaatggaaacctcaaaggaagcaaggactaggaaattatcaacgaactgtgggtgcttcatccgaggctgatctttatcctataagctatgtaatgaactgctattatgtttgaatcctgggtgacaaaaccgtgaaacaaagttagtgactgctgtttgagcatgtgaaaccgataaaaaaaaaaaaaaaaaaaccgccaccaaatccaatctcgacctccccctctcccgtccgcccgtcgttcccaacccgatccgatctcccccctcctccgtcgccatgggccgcaagttcttcgtcggcggcaactggaaatgcaatggaactgtggaacaggtagagagtatcgtcaacactctgaacgctggacagatcgcctctacggatgttgtcgaggttgtcgtcaacccgccctatgtcttncctcccaccgtccaaggtaagcttgcgccaaagattcaagtcgttgctcaaaactgttggggtgaagagggccgggctttcaccggtgaaatcagtggctaaaagctgggcaccctggggttcccgtggtcatccttggacacttttaaagggagaagcctggtggggagaattaaccca

SEQ ID NO: 29179 - DNA, 1073 bp, Triticum aestivum
  Clone ID: PAT_TA_29179
taggcggtatacgactcatataggcgaattggtacgggccccctttttgaaacacaagtaacttcattattgaggaactgaatagagccttattacaacagtcctcacgtagcgacttccgtaaggagtacttggctatttgcacaataccgcgcaagtgagaaccacacttcacggaacggaacggggaaacgcaaacaactagtgcgacgaccgtacgtcctcagctcagacagaactcaaatggagatgctgtttggaatgcccttggcggtgatgccggcggcgtcgcccttcgtgtcggaggtgttggggtagagcagcgtgtaggggaactcggccggggccgttgcggttcttgaggcgagggtccgcgttcatggtgacgacgcgtttctcgatctcggtcagccgcgcgccgaaccgcttgaacgcctcctgcgccttggcgtccgacgtccactccttggtgtcgcgctggccgaggtacacctcgtcggaggagtggctggacaggatctccagcagcgagatgccgacgagggcctggaactggctggtgatggtgcgcacgaacaccttctccggcttgcgctccagctccgcgtactcgtcgctgcccggcgccggcatcggcttccggctgacggacgggcggttcgggaggtacccggcgtacgggtactgcccgaagttgacggccgcgtggagcgccgacgcgatccagatgatggtggtgcaggccttgaccagctcggccaccgtctgcatcttgggccaccagggcgcgtccttgaggtcggcgtgcccgacctcgcgcgcctccttccaccacgcctgcagctccacgtccgcccgcagcacgccgtcgttggggtagtagacggcgaggtactccgtcacccactgctcgatggcgtgccagatggccagcccgtccgacgcgtacgggtagtcctccaccagcagccgtaccttgtacgggctcgacgggtctgcgaccgccatgcctctcttgattaggtcgtcagggagagcctgctctgtgaagttccagtccttgtagatgacgg

SEQ ID NO: 29180 - DNA, 1239 bp, Triticum aestivum
  Clone ID: PAT_TA_29180
cagtggaacatatgtgcttcatttattgccaaatgcatgaggattaacgcttaggatcgaacagttgctgacatgaactcacacacatacagtgtcacatacacagcaccagtctatcaacatgttcccgttcccgtacgtgtcgacactctttattcgcactcatcactatgaacgtcggccgccgccttgccgtggttggcgccggtgcagtatgtagcaatgaatgctcagatggagatgctgttggggatgcccttagcggtgagcccggcggcggcgcccttgtgatcggaggtgttggggtagagcaacatgtaggggaacttggccggaccgttgcggttcaacagctgcgggtcgtggttcatgcccaccaccttgctctcgatctccactagccgctcgctgaaccgcttgaacacctccagggccttggggtccgaggtccactccggcgtgtcacgctgcccgaggtagagctcgtcggaggagtgcttcgacagcacctccagcagcgagatgccgatgatggtctggatctggctagtgatggtgtggatgaaggcccgctccgggtcgcgctccagctccgcgtactgctcggtccccggctccggcatgcggcgccggctcaccgtcggccggttcgggaggaaccccgcgtaggggtactgcccgaagttgaccgccgcatgcagcgccgacccgatccagatgatggtggtgcacgccttggccagctcgcccacggcttgcatcctcggccaccatggcgcgaccttgaggtcgccgtgccccacctcgcgcacctccttccaccacgcctgcagctccacgtcgccctgcaccacgccatcgttcgggtagtaaatggccaggtactcgctcacgtactgctcgatggcgtgccagatcgccagcccgtccgccgcgtacgggtagtcagacaccagcagcctcaccttgtacgggctcgacgggtcctccaccgccatgcccctcttgatgagatcgtcgggcaggccctgctccgtgaacttccagtccttgtacaccactgacgacatccccaacgcgaacttgcccgggaacaccgtcatctcgaagatgccgccggcgttgatgagcgtctgccgcgctagcgcgttgatggtcatcgtgtcgcggtagtgcgggctcagcagcttgtgcaccgggtgcgtcacgctgagctgccggttcgtcgagatcacaaac

SEQ ID NO: 29181 - DNA, 1763 bp, Triticum aestivum
  Clone ID: PAT_TA_29181
gtcgacccacgcgtccgcgcgaaccggacaggattactaatagcagacccttttgattgttgtacccctctcaaagaaaaggttgctggagaagttttgctagtgcaaagaggagattgtaagttcactacaaaagctaaggttgctgaagatgctggtgcttctgctattataatcctgaataatcggcatgagctatacaagatggtttgtgatcaaaatgaaacggatctggatataaatatacctgcagttcttctgccaaaagatgcaggcaccattttacagggtcttctctcacttggtaaagtgtcagtgcagttatactctccagatcgacccctagttgatacggctgaggtgtttctatggcttatggctgttggtactattcttggcgcatcatactggtcagcatggagtgctcgagaagcacttattgaacaagagaaacttctaaaggatggccatgaaagttcagttaacattgaggccgaaggttctagtggtatggtagatatcaccatgacgtcagcaatgctgtttattgtggttgcatcactctttttggtaatgctttacaaattgatgtctcactggtttgtggagctcctggtggttatattttgcattggtggtgtagagggtttgcaaacatgtttggtggctttattgtcaagatggtttaaacctgctgcaagatcatttgtaaaagtgccattttttggagctgtttcataccttacattggcagtttgtccattttgcatcgtctctgctgttttatgggctgtttatcgccggatgccctatgcatggattgggcaagatgttcttggtatcgcactgattgttactgtgatccagattgtgaggataccaaatcttaaggtggggtctgttcttctcggctgttccttcttgtatgacatcttctgggttttcatatccaagatgttgtttcatgagagcgtgatgattgtggttgcacgtggcgataatactgatgaagatggtgtacccatgctgttaaagatcccacgcatgtttgatccatggggtggatacagcatcataggctttggtgatatcctccttccaggactgctggttgcttttgcgctaaggtatgattgggctgcgaggaagaccttacaatctggttactttctgtggtcaatggttgcgtacggttctggccttctgataacctacgttgccttgaatctcatggatggtcacggccaaccagctcttctttacatcgtgcccttcacgcttggaactttcatatcactcggtaaaaagcggggcgagctcaggaacctgtggatgaaaggacaacctccgagagtctgcacgcactcgcatcatcctctgaaggactctgcggactccgcttctcatgtaatctcatcataggtagcggctcgccgtatcgtagcgcaatggttccttgcctggaggcggaagcgcggctccgcggatctgttgtgtgaccctgttccgtgggtgcagaggtgtctaatatgaacctcttgtcattagaaccaatcccattagttgtacatagatagagcctcgtggtttgcttctcttgttgtggctctgcatctacctgtatacttggagagtagtacctcctttccgtgtttgtttgtaaggcctgtgggtatccctagatcaacaatctgaccaacataatgaaagttctatattaatgccaaaaaaaaaaaaaaaaaaaacgcgagactagttctctc

SEQ ID NO: 29182 - DNA, 721 bp, Triticum aestivum
  Clone ID: PAT_TA_29182
ttttaactgatgaatgtttgtgttctggatgtgacaagcctgataagattacagaattccacttgatgataaaattacagcgacgataacttcacagtcgaaacacttgtgcagcttggacatctaggtaaacgcggtgcgctgacgtacatcagcactcgccatattgcctggcagatcgatccgcttcaccatttccagaagacgttggatccgcacttgaacttctccttcccctcgcactcgatctcgaggtcgtcggtgatgaacgggactttcttctgcttggcgaggtcctggcagccggtgaagttgtaggggaacttgcagctgccgaactggacggtgtaggcgcgcgcgaagttggcgccgctcgtcgccgccctcttcttgtcgttcagctccttgttgagcttgctcttctcgaggtactcgtcgaagacgcttgccctggccgacccggcggtggcggccgtgacggcgaagacggccgccaggccgagaagcgccgaccgccggtccttggccggggcgacctgcacgcgctttgccgccgccggcgacgcggactgtggcaccgccgcggcgggcttgaggccgaccacactggtgttcacgccggccatgatcctctcgaggtttcttgatgaatttggtggcgtgtgtgtgagagttcggttggtctcagggagaggagggtgtggtgatggttttgtttttg

SEQ ID NO: 29183 - DNA, 911 bp, Triticum aestivum
  Clone ID: PAT_TA_29183
gctgcggaagacgacagaaggggatgagaaagattggttgtcacttgttgcggtgcacagtgatgcctggttgctagcagtagccttctactttggagcaagattcgggtttgacaaagaatccaggaagcggctttttagcatgataaacaacctccccaccatatatgaggttgtcaccggaactgcgaagaagcaggtcaaagaaaaacaccccaaaagcagcagcaagataaataaatctggcactaagccatctcgccagccagaacctaactcaaggggtccaaagatgccaccacctccgaaggatgaggacgacagtggaggcgaggaagaagagggagaagaacatgaaaaggcattatgtggtgcgtgtaacgataactatggacaggatgaattctggatctgctgtgatgcttgtgagacatggttccacggtaagtgtgtgaagatcacccctgccaaagctgagcacatcaagcactacaaatgcccgaattgcagcagcagtagcaagagggccagagcatgatatcggattcctccacggctcatgtctgaagatccaaggatttgacttactgtaaagatgcatgtgggacggaatgcccaatggatgtgcattcagttgttgctttgagattagtaccagccttaggggtcttgctgtgttgttatttggtgtatgtcggtgatgttctagatttacttgtagtcttagcaactaattgtaacagcttgtatgtcttggagccttgtcagtgcgcctgttctggactctcagtgtcctaggtccagtgatgtatcacgccatcatgtacccttgttgtaatttgttgaagaatcgcctgttatcttagcttttacagcctagttattggacagcatctaccgatagttccact

SEQ ID NO: 29184 - DNA, 1169 bp, Triticum aestivum
  Clone ID: PAT_TA_29184
tttttttttgtgagataagaggaatgcacacacgactgcttattcatgcctcattgttctctccctatcaacatcatctacgatcatcatttgccatcatccactaatccctcgcaactaattaccgcaaccacccagaagcgaatgatgagaaggattaaaggaacacaatacaccctgcacgcgagacacgaaccaaccaatctactgaacgagacgctgttcagattaaaggacctcgctcagctcagatggagacgctgttggggatgcccatggcggtgaggcccagccctttctcgccgccggcgtccgacgtgttggggtacagcagcatgtagggcatcttcaccggcccgttccggttcttgagcgccgggtccttgttcatgtccaggatgcgcttctcgatctccatcagccgggtgccgaacctcttgaacgcctccagggccttggcgtccgacgtccactccggcgtgtcgcgctgcccgaggtacacctcgtcggaggagtgcttcgacaggatctcgatgagcgtgatgccgaggatggtctggaactggctggtgatggtgtggatgaacaccttgtcggcctccttcccgcccttctgcagctgcttgtactcctcttcgccctcctccggcatcttccgacggctcaccgtcggccggttcgggaggtacccagcgtacgggtactgcccgaagttgaccgccgcgtgtagcgccgatgccacccagatgatggtggtgcacgtcttggccagctcctgcacggtcaccatcttgggccaccagtcggcgtccttgaggtcgccgtgcccgacctcgcgcacctccttccaccactcctccagctccttgtcggcccggagcacgccgtcgttggggtagtagatggccaggtactcgttcacccaccgctcgatcgcccaccagatcaccagcccgtccaccgcgtacgggtagtccttgatcagcagccggacaccgtatgggctcgatgaatccggcacagccatgcctctcttgacgagatcgtcggggaggccctgctcggtgagcttccagttcttgtagacgatggaagacatctcaagcgcatatttctccgggaagacggtcatctcaaagacgccaccggcgttgatgagagcctcgtgc

SEQ ID NO: 29185 - DNA, 838 bp, Triticum aestivum
  unsure (1)..(838): unsure at all n locations
  Clone ID: PAT_TA_29185
cgggcccccaccgccgccaccgaccaaagacccaccggagaaaatgcaccgcgccggctggatgcgcgttcgcaacgcattcaagccggcggctgtgcgccggcagagcaccaaggcgagcgtcggcgacggcggcgccaaggcgggcatcggcgacggcggcgagcctctgcacaccaagggcggcggcggcggcggcggcgaggccgggaatggttctggcgagtccacggaaggcccacccgtcgtcatccccgtgaccctcgcgggcatcgccatgtggacctggcagaagcagtcggagatttcatcaaggacgcgccgtacgcaacggaggggatggttgggtacgttgctcccgcttcccttccacagaaggaggtccccgagccgccaaactgggccgacttctccgcctactatcttccggccgagactgctagtatcgtcgtagttatatgtatccatgttatccgtttaggttttcatatctgagcatctggtgtaagaaatgcagtagctatcgggtactatcttaccttatgcctatcttgaagaagtggtgttcgttgatgtgagcaaaatggatatcctggggactcaaatcattgtatccggcagaacttcttgaggaagcatatataatatattagtaaggttggattgggtgtgattctgtatttagctactgcattgtttttggtgttcggtgttccaatgatgactctgtttgcaaaatggatcttttggggatccaagcccctgtttttgggagaacctcttgatgaagcagacataataatgacataattcaaacaaanaaaaaaaaaaaaaaaaa

SEQ ID NO: 29186 - DNA, 846 bp, Triticum aestivum
  unsure (1)..(846): unsure at all n locations
  Clone ID: PAT_TA_29186
agaaacgccaccaaatccaatctcgagcccccctctcccgtccgcccgtcccaacccgatccgatcccctcctccgtcgccatgggccgcaagttcttcgtcggcggcaactggaaatgcaatggaactgtcgaacaggtagagagtatcgtcaatactctgaacgctggacagatcgcctctacggatgttgtccgaggttgttgtcaagcccaccctatgtcttccttcccaccgtcaaaggctaagctgcgcccaagagatccaagtttgctgctccagaactgctgggtgaagaaagggcggtgctttcaaccggtgaagtcagtgctgagatgcttgtcaacctccggcgttccctggggtcattcttgggacactctgaaaggaggagcttgatgggagaatcaagtgagtttgttggagagaaggttgcatatgcactcgctcaagggcttgaaggtcattgcatgtgttggtgagactcttgagcagcgagaagctggatcaaccatggaattgtcgctgaacagacaaaagcaattactggcaagatcaaagactggactaacgtggtcgtcgcgtatgaaccaatgtgggccatttgcaccggtaaagttggacacccgctcaagcgcaagaagccattgcaatctgagggaactgcttaaggaccatgtgaagccttgaggtgctgcatccacaccgatcatttattggaggatctggaactggcgccaggttgcaaggattgggcggggcaaccccaantccaaggtttcctttgttgggggagctttcttttaaacctggggttatatgacattattaacggcccccaccggg

SEQ ID NO: 29187 - DNA, 773 bp, Triticum aestivum
  unsure (1)..(773): unsure at all n locations
  Clone ID: PAT_TA_29187
cgtccgaaaagaaacgccaccaaatccaatctcgagcccccctctcccgtccgcccgtcccaacccgatccgatctgccccctcctcctccgtcgccatgggccgcaagttcttcgtcggcggcaactggaaatgcaatggaactgtcgaacaggtagagagcatcgtcaatactctgaacgctggacagatcgcctctacggatgttgtcgaggttgtcgttagcccgccctatgtcttccttcccaccgtcaagggtaagcttgcgcccagagatccaagttgctgctcagaactgctgggtgaagaagggcggtgctttcaccggtgaagtcagtgctgagatgcttgtcaacctcggcgttccctgggtcatcccttggacactctgaaaggaggagcttgatgggagaatcaagcgagtttgttggagagaaggttgcatatgcactcgctcaagggcttgaaggtcattgcatgtgttggtgagactcttgagcagcgagaagctggatcaaccatggcggttgtcgctgaacagacaaaagcaattgctgacaagatcaaggactggaccaacgtggtcgtcgcctatgaaccagtgtgggccattggcaccggtaaagttgcatcaccggctcaggcacaagaagtccatgccaatctgagggactggctcaagaccaatgtgaaccccgaggttgctgaaatcacgcggttcatctatggaggatctgtaacttggcgcaagctggcagggaattgccgngcca

SEQ ID NO: 29188 - DNA, 852 bp, Triticum aestivum
  Clone ID: PAT_TA_29188
ctcgagtttttttttttttttttttgcgttccacaatataaagcatttatgaacttcatcaactcttctgtaagaagtatgttggtaccatcaggtatcaactggcaaaaaatatttgaaaataactgctccttggagaaatgcttttgcagcagaggaagaaaacaaaagagattgtacccaaggtatgatgggagacaaccccagtagcaaaaatatacaacggaagtcattatttcgatcgcttctgcttaaagcctcaacgttgcaataaaaagaagaaacaatggtcatcagttgacgacgtccaggaccagcttgcgggacttgaggacggaccacctcatgcgacggtagtatgcggcttggagaagagcaagtgacagtaggaagatccatttgacacccatcagtttcctctcttccatttcaggctcagcagcccacgacaagaatgacacaacatccttgcccatctgagcttcagttgcaggagtaccatcttcatactcaatagctccatccataagcatcttaggcatggctatggcaccaccagggaagtagggattgtaatgcagaccctcacgaatctgaacaccagcaggtgggtcatggtaaccagtaagaagagcaaacacgtagttctggccatcgtgcccttgccttcgtgataaggctgagatctgggggatatgccccaccatttgcaaatcgggctgcttgttcatttggataaggctgcgggaagcgatcactcagcttgccaggacgtgtaacatttcaccctcatcattaggaccatcaaccacttcaatttcagcctcgtccgaattcctcagcccgggggac

SEQ ID NO: 29189 - DNA, 1243 bp, Triticum aestivum
  Clone ID: PAT_TA_29189
cgaattcgcggccgcgtcgacttttttttcggaacatcacaaacatcgactttattattgggcaaatgaagggaatttttctgtacacgacgacgcaccgcatgccgatcggacccgtcgtgcacacacgcattattgccttattattgtggtcatggcaaagcatatgcaccagcagaacacccacactagctagtatccggtgcaagcaagcaagcaagcagggatggagctcctcagatggagatgctgttggggatgcccctggccgtgagcccctcggcctggcccgtgtggtcggaggtgttggggtagagcagcatgtaggggaacttggccggcccggtgcggttcttgagccgcgggtccccgttcatggccaccacctgcttctcgatgccctccagcctcgccccgaaccgcctgaacgcctcctgcgccttggcgtccgacgtccacgccggcgtgtcgtgctgccccaggtacacctcgtcggaggagtgcttggacaggatctccatcagcgagatgcccaccagcgcctggaactggttggtgatggtgaggataaaggccttctccgggtcgcgctccagcagggcgtactcctcgctgcccggcgccggcatcggccgccggctcgccgacggcttgttgggggtggtaccccgagtaggggtactgcccgaagttgacggccgcgtggagcgccgacccggtccagatgatggtggcgcaggccttgatcagctccgccaccgtctgcatcttgggccaccacgccgcgtccttgaggtcgccgtgcccgacctcccgcacctccttccaccacgcctgcagctccacgtcgccctgcagcacgccgtcgtccgggtagtagatggtcaggtactctgtcacccactgctcgatggcgtgccacaccgccagcccgtccgccgcgtacgggtagtcctcgatcaggagccgcaccttgtgcgggctcgatgggtcctccactgccatgcccctcttgatcagatcgtcgggcagagcttgttcggtgaagttccagttcttgtagaccatggaggacatgggcatggcgtgcttgcgcgggaacacggtcatctcgatgacgccgccggcgttgatgagcagaccccgcgcccgcgcgttgatgttcatggtgtcgcggtagtgcgggtgcaggagcttgtacaccgggtggtcacgctcagctgcctgtggcctcgtgccgaat

SEQ ID NO: 29190 - DNA, 499 bp, Triticum aestivum
  Clone ID: PAT_TA_29190
gcaggcaattcggcacgagagcaaaaggtagggtttccagttgcaagccgcgccgccgccgccgccgccatgggacactcgaacgtctggaactcgcaccccaagaactacggcgccggatccagggtttgccgtgtctgcggcaactcgcatggcctgatccgcaagtacgggctgatgtgctgcaggcagtgcttccgcagcaacgccaaggacattggcttcatcaagtaccgttaagaatggaaacctcaaaggaagcaaggactaggaaattatcaacgaactgtggtgcttcatcgaggctgatctttatcctataagctatgtaatgaactactattatgtttgaatcctggtgacaaaaccgtgaaaccatgttagcgactgctgtttgagcatgtgaaaccgataattctgttactgcgtgccattatggttagaaggttgctctgcatccttatatttttatcaaaaaaaaaaaaaaaaaaggccccta

SEQ ID NO: 29191 - DNA, 2878 bp, Triticum aestivum
  Clone ID: PAT_TA_29191
tttaactagtactagaaagaatgcacgcagtgcttattcatgcctcattgtcctctccctatcaacacccctgacaaactaattaccgcagccagccggaagccaatgaaaagtaacacaatacaccctgcgagacaggaatcaaccaacggccggcggacgtccgtctactgagaaagaaagagtacactcagatggagacgctgttggggatgcccatggcggtgagccccagccctttctcgccgtcgacatccgacgtgttggggtacagcagcatgtacggcatcttcaccggcccgttccggttcttgagcgccgggtccttgttcatgtccaggatccgcttctcgatctccatcagccgggtgccgaacctcttgaacgcctccagggccttggcgtccgacgtccactccggcgtgtcacgctgccccaggtacacctcgtcggaggagtgcttggacaggatctcgatgagcgtgatgcccaggatggtctggaactggctggtgatggtgtggatgaacaccttgtcggcctccttcccgcccttctgcagctgcttgtactcctcttcgccctcctccggcatcttccgacggctcacagtcggccggttcgggaggtacccagcgtacgggtactgcccgaagttgaccgccgcgtgtagcgccgacgccacccagatgatggtggtgcacgtcttggccagctcctgcacggtcaccatcctgggccaccagtccgcgtccttgaggtcgccatgcccgacctcgcgcacctccttccaccactcctccagctccttgtcggcccggagcacgccgtcgttggggtagtagatggccaggtactcgttcacccaccgctcgatcgcccaccagatcaccagcccgtccaccgcatacgggtagtccttgatcagcagccggacaccgtatgggctcgatgaatccggcacagccatgcctctcttgacaagatcgtcggggaggccctgctcggtgagcttccagttcttgtagacgatggaagacatctcaagcgcatatttctccgggaagacggtcatctcaaagacgccaccggcgttgatgagagtggttcgcgccagggcattgatgttcaacgtgtcgcggtaatgcgggctcagcagcttgtgcaccgggtgcaccacactgagttgccggttcgtcgcaatcacgaacggctcgatcaccgcgtgcgtgttcagccagtggctgataagctgatgccatgcggagtcatcgaccgaggcgtaagccttggcaagctgccagatctggccatcaacaccagagtcaatatcagccggaaggtacaccgtgctcttcgcgccgtgctgtattccgtcagggtgcggcaggctcagctcgatggccaagggcttcagcgtgccatcggccttcaggaacagcagggtccttgaagcatagatgtagttgccttccagcttgttgatgcggtcaaggaatggcatgaagttatcgtggtgatctagaatgaagagcctgtttttctccattgcctgtttcactgtgaggccatcttccaggttctgctgaatttgatcttcagtgatggtgcttgactggtccccgtacacactgggatccagggtactttttacagggaactccgtcagacgtttgatgcaaaccgggttcacgcctgcgagcatctcccgcgcaaactcctcatctgacctccaagcataatcgtttgatctgataacatgtggaaggggcaggttcaggaggtcgtcgccagcaaccggtaaaagacttttaataaactgaagggggattttcttcttgagctcctttaggtgttggttatcgggcactttcagaagaccgtcgtagagatcatagatgtcttgaaacgaatcaaactccttgggtgtagtgtcaacataggtcctgattaccggaagaatggcctcggtgatggccttgagagagtacccaaggaagtcagacaacttgaggtgcccaaagcgctcatcacgcgggacatagatgttgagggcctcctgtatcttgtactgaggaattctgctctctgatctagggtctgtttttgttgggggtcggccagttctgcaacgacggggataggggagttcttgggtgccgccgagaaccgggcgcggatggcccttgtccggctcaccgaggtcgttgtagtagtcatagcggtacacacggtcccactcctcgtactttccggtcgtgccgtcgcctcggagattgttgagttcatcctgcctgtattgcaccaaaagtgcaggcattttgctgggcagataggtgtcgttggcgaagaagacgcggtcgacgttggggtagatccaggagttggcgacgaagacgacggtgcccttgccggggacgccctggagggtgagcgtcttgagcaggtattcggagcggtaggtgttgcggacgaggacggcgccggggatgccctgcgagtcgtcccactcgaaggtgaccttgaacaccgactcccccgccgccttggacttcatcgtcaccaccatctcctccaggtgcgccggcctccccaccttgccccgcctcggattctgggggtccggggcggtggcgctgacgaggtggaagatgacgccgtcgtccgtgccgaggatgtcgtggacgccgtcgaggagggaggcgtggaagtcgccgaggttgaggacgtcgctcttgaccagcacggccgtgccccggatcttgccctccttccacgcctgcttgttcttccccgtcagccggtccaccagcccgtgcagcagcatctctcctctcctctgctggtttcgttacttggggcagagcagagcacgagc

SEQ ID NO: 29192 - DNA, 717 bp, Triticum aestivum
  Clone ID: PAT_TA_29192
gtttttttgaagatgaatagaaattagattggaagttttttccctaaaaaaacaatctaaaccaaagatttagcttatcgcagatagtatagctccaaccttacacacacgcgcatcctagcaaccggcggcggcaggcggaaggcgaacaagaaggcggcaacgatggggcactccaacgtctggaactcccaccccaagaactacgggcccggctcccgcgtctgccgggtctgtggaaactcccatggactgatcaggaagtatgggctgatgtgctgcaggcagtgtttccgcagcaacgccaaggacattggcttcatcaagtaccgttaattcacctggtcctgctaccctgaagtgaagctaatcagggatgaagtaatggaactcttaatagaaggcttaatttcaattccagtaatgattgctcagtactctgagagtggctttatattttgatggatactgaatgatgtaattgttgaacatgagttaattacccatggggtagccttttatcattctgttgcctgtgtttgtctcctctcattgtcattggtagttttaagtacttgttttttattagaacgtattggctcaatttctgtagaagaccagcaacccagcgaatatgcttactttatttctatcagttgttgcatatatgggccttcaaaaggcttaggaagacgctcaaaaaattattaagcacat

SEQ ID NO: 29193 - DNA, 642 bp, Triticum aestivum
  unsure (1)..(642): unsure at all n locations
  Clone ID: PAT_TA_29193
ttaaccctcactaaagggaacaaaagctggagctccacccgcggtggcggccgctctagaactagtggatcccccgggctgcaggaattcggcacgaggagcaaaaggtagggtttccagttgcaagccgcgccgccgccgccgccgccatgggacactcgaacgtctggaactcgcaccccaagaactacggccccggatcgagggtttgccgtgtctgcggcaactcgcatggcctgatccgcaagtacgggctgatgtgctgcaggcagtgcttccgcagcaacgccaaggacattggcttcatcaagtaccgttaagaatggaaacctcaaaggaagcaaggactaggaaattatcaacgaactgtggtgcttcatcgaggctgatctttatcctataagctatgtaatgaactgctattatgtttgaatcctggtgacaaaaccgtgaaacaaagttagtgactgctgtttgagcatgtgaaaccgataattctgttactcttgtgccattctggttagaaagttgctctgcatccttatatttttattattttgcgaaggccgaccatgctttgttttgatgctctaattttatattcctcgttgcaaaaaaaaaaaaaaaaaaccccttnatgta

SEQ ID NO: 29194 - DNA, 592 bp, Triticum aestivum
  Clone ID: PAT_TA_29194
gcaggcaattcggcacgaggcaaaaggtagggtttccagttgcaagccgcgccgccgccgccgccgccatgggacactcgaacgtctggaactcgcaccccaagaactacggcgccggatccagggtttgccgtgtctgcggcaactcgcatggcctgatccgcaagtacgggctgatgtgctgcaggcagtgcttccgcagcaacgccaaggacattggcttcatcaagtaccgttaagaatggaaacctcaaaggaagcaaggactaggaaattatcaacgaactgtggtgcttcatcgaggctgatctttatcctataagctatgtaatgaactactattatgtttgaatcctggtgacaaaaccgtgaaaccatgttagcgactgctgtttgagcatgtgaaaccgataattctgttactgcgtgccattatggttagaaggttgctctgcatccttatatttttattatcttgcgaaggccggccatgcatttgttttgatgctctaattttatattcctcgtgtgttcatacctattcttgcctggcgtctgttcttaagaaaaaaaaaaaaaaaaaaggccccta

SEQ ID NO: 29195 - DNA, 1335 bp, Triticum aestivum
  Clone ID: PAT_TA_29195
ccgcgctccggtcccccgaactgggcattccgctccactatctcctcaaaatccatttcctcggctggtcgtcaatcccctcgctgttccaaagccttactactcgcctcggccagtcgcctccgccaccaaaaccctaaccctagccccggagctcaggcgacgctcgcgcctccaaatggacgggggaggcacgcatcgcacgccggaggacgtgttcagggatttccgcgcgcggcgggccggcatgattaaggcgctcaccaccgatgtggagaagttctaccagcagtgcgacccagagaaagagaatctatgtctgtatggtcttcccaatgaaacatgggaagtgaacttgcctgcagaggaggttcccccagaacttccagagccggcactgggaattaattttgctcgggatgggatggatgagaaagattggttgtcacttgttgcggtgcacagtgatgcctggttgctagcagtagccttctactttggagcaagattcgggtttgacaaagaatccaggaagcggctttttagcatgataaacaacctccccaccatatatgaggttgtcaccggaactgcgaagaagcaggtcaaagaaaaacaccccaaaagcagcagcaagataaataaatctggcactaagccatctcgccagccagaacctaactcaaggggtccaaagatgccaccacctccgaaggatgaggacgacagtggaggcgaggaagaagagggagaagaacatgaaaaggcattatgtggtgcgtgtaacgataactatggacaggatgaattctggatctgctgtgatgcttgtgagacatggttccacggtaagtgtgtgaagatcactcctgccaaagctgagcacatcaagcactacaaatgcccaaattgcagcagcagtagcaagagggccagagcatgatatcggattcctccatggctcatgtctgaagatccaaggatttgactcactgtaaagacgcatgtgggacggaatgcccaatggatgtgcattcagttgttgctttgagattaataccagctttaggggtcttgctgtgttgttatttggtgtatgtcggtgatgttctagatttacttgtagtcgtagcaactaattgtaacagcttgtatgtcttggagccttgtcagtgcgcctgttctggactctcagtgtcctaggtcccgtgatgtatcatgtcatcatgtacccttgttgtaatttgttgaagaatcgcctgttatcttagcttttacagcctagttatttggacatggtatctagcatctacacaggttccactgttttagaac

SEQ ID NO: 29196 - DNA, 3027 bp, Triticum aestivum
  unsure (1)..(3027): unsure at all n locations
  Clone ID: PAT_TA_29196
ttttttttttttcccgtctcaaaattaaaaaaacttgaacttgacccaaaaacggagcaaacggaggagttaccggaggtttgccaggaaaaaacaacggaggtttggatactatttttggcgaacagagggagcatcgcaacatcgacttcattattggacaaaaaagaagggaatttttctgtacacgacgatgcattaaccggtaggcagtagccagctgagcttccgcatgccgatcggacccgtcgtgcacacacgcattattgccttattactgagatcatggcaagcatatagctagtagctagtatccggtgcaagcaagcaagcagagatagaggtcctcagatggagatgctgttggggatgcccctggccgtgagcccctcggcctggccggtgtggtcggaggtgttggggtagagcagcatgtaggggaacttggccggcccggtgcggttcttgagccgcgggtcgccgttcatggccaccacctgcttctcgatgccctccagcctcgccccgaaccgcctgaacgcctcctgcgccttggcgtccgacgtccacgccggcgtctcgtgctgccccaggtacacctcgtccgaggagtgcttggacaggatctccatcagcgagatgcccaccagcgcctggaactggttggtgatggtgaggatgaaggccttctccgggtcgcgctccagcagggcgtactcctcgctgcccggcaccggcatcggcctccggctcgccgacggcttgttggggtggtagcctgagtacgggtactgcccgaagttgacggccgcgtgcagcgccgacccggtccagatgatggtggcgcaggccttgatcagctccgccaccgtctgcatcttgggccaccacgccgcgtccttgaggtcgccgtgcccgacctcccgcacctccttccaccacgcctgcagctccacgtcgccctgcagcacgccgtcgtccgggtagtagatggtcaggtactctgtcacccactgctcgatggcgtcccagatcgcaagcccgtccgccgcgtacgggtagtctgacacgagcagccgcaccttgtacgggctcgacgggtcctccaccgccatgcccctcttgatgagatcgtcgggcaggccctgctccgtgaacttccagtccttgtacaccacggacgacatccccagcgcgaacttgcccgggaacaccgtcatctcaaagatgccgccggcgttgatgagcgtctgccgcgccagcgcgttgatggtcatggtgtcgcggtagtgcgggctcagcagcttgtgcaccgggtgcgtcacgctgagctgccggttcgtcgagatcacgaacggctccatcaccgcgtgggtgttcagccagtggctgacgagctggtgccacccggagtcgttgacggcgacgtaggccttggcgaactcccacacccagccttcgacggagccgctcggcaccggcgtgtacaccttgctcttggcggtggtgaggccgccctggatgacaggcccgctgagctcgatggcgagcggcgtgagcctgccgtcgccgcgcaggaagaagagggtncctggtggcgtagatgaagttgccgggcaggttgttgacttcgatcaggaacggcatgaaccggtcgtggtgatcaagtatgtagagcctgttactttccagcgcctgctgcacggtgaggccctcgaggttcttctggatgtgtgccgccgtgatggtgctggtgtggtcaccaaacttgctagggtcaagactactttttggcgggaactccgtgagacgcgtgatcatgaccgggttgacgccggcgagcacctcgcgcgcgaactcctcgtcggtcctccacgcctgctggtccgcctggatgatatgtggcacagggagcttcagcagcgagtcgccgcccacggggagcaggtccttgatgagctggagcgggaactgcttgcgcagctcctcgagggcgggcaccatgggcagcttgatgccgccctcgtagaggttcatgatgtcctggaaggagtcgaactcgccgggggtggtgtcgacgtaggtgcgcaccgccggcaggatgccctgcgtgatggccttgatggagtagnnnnngaagtcggacgtcttgaggtggccgaacttctcgtcccgcggcacgtagatctgctccagcagcgacagccggctctccaggctcgggtcgctggcgttgggcttgcggcccgtgcggccgcgccgcgggtaagggtgctcggcgctgccgccgaggaccgggcggccctcgccgaggtcgttgtagacgtcgtagcggtagacgcggtcgtgctcctggtagggcccctgccgatcgtcgccccgcaggttccggaagctcgtcgtcgcggtacggcttcagcgccgccggcatctggctcggcaggtacgtatcgttggcgaagaagacgcggctgtaggtgtaggtggcggcggggtagatccaggagttggcgacgaaggagaggttgccgcggccggggacgtcgtggagggtgaccgtcttgagcaggaactcggagctgtggtagttgttgacgacgatggcgccgggcacccccagcttctccacctcccagtcgaaggtgaggccgaacttggactcccccgtcgtcagcgacggcaggctcgtcacccactgctccagctccgcctccgcgcccaccttcccgcgcccgccgttgtcgtggtcgatgagggtggagctgataagctggcaggtgacgcccttgccgaggaagtcgccgatgccgtccatgatggtggcgccgaagtcggtgaggtccagcacgttcttcctcatcagcaccgccgtgcccttgagacgtgcgttcttgttcgcgccggtcaggctgtcgatgagcccgcccagtatcatcttgctgctatttcagtaccgtcgctacttcaactgcactaccagtgcctttcggtggagagctgtgcggaaggagatgggtgtgtgttgtg

SEQ ID NO: 29197 - DNA, 765 bp, Triticum aestivum
  Clone ID: PAT_TA_29197
cggccgctcgaggcggcaggccggggtgttcagcttaaacatcatccgatactctaaagagacaaaagagttcctaatcgacagcttcagaagcttcagaaccgtcgcaaccatgtctcaatacccccacatcctcctgcgcgctgaggagaagcccctcgagcaccaaaaaaccctttcctcctcccacgcgcatcctagcaaccggcggcggcaggcggaaggcgaacaagaaggcggcgacgatggggcactccaacgtctggaactcccaccccaagaactacgggcccggctcccgcgtctgccgggtctgtggaaactcccatggactgatcaggaagtatgggctgatgtgttgcaggcagtgtttccgcagcaacgccaaggacattggcttcatcaagtaccgttaattcacctgttcctggtaccctgaagtgaagctgatcagggatgaaggattggagcacttaatagaatgcttaatttcaattccagtaatgtttgctcgtggttttatgttttgatggatactgaatgatgtaattgttgaacatgagttaattacccatggagaagtcttttatcgttctgttgtctgtgtttgtcccctctcattgtcattgttagttataagtacttgtttttttattagaacatattgggtcaatggctgtaacagaccagcaacctagcaaataagcttatttcatatctatctgtgcttgtatataagcacatgaatgactgaaaaaaaaaaaa

SEQ ID NO: 29198 - DNA, 1033 bp, Triticum aestivum
  Clone ID: PAT_TA_29198
gcctaagcagctttcttgaaagattctaactgatgaatgtttgtgttctgacaagcctgataaaattacagaattccacttgatgataaaattacagcgacgataacttcacagtcgaaacacgtgcgcagctttgaacatctaggtacacgcggtgcgctggcgtacatcagcactcgccatattgcctggcagatcgatgagcttcaccatttccagaagacgttggatccgcacttgaacttctccttcccctcgcactcgatctccaggtcgtcggtgatgaacgggactttcttctgcttggcgaggtcctggcagccggtgaagttgtaggggaacttgcagctgccgaactggacggtgtaggcgcgcgcgaagttggcgccgctcgtcgccgccctcttcttgtcgttcagctccttgttgagcttgctcttctcgaggtactcgtcgaagacgcttgccctggccgacccggcggaggcggccgtgacggcgaagaccgccgccaggccgagaagcgccgaccgccggtccttggccggggcgacctgcacgcgctttgccgccgccggcgaggcggactgcggcaccgccgcggcgggcttgaggccgaccacactggtgttcacgccggccatgatcctctcggggttttcctcgtgccgaattcggcacgaggaggatctgtaactggcgcaagctgcaaggagttggcagggcagcccgacgttgatggtttcctcgttggtggagcttctttgaagcctgagttcattgacatcatcaacgccgccaccgtgaagtccgcctaagaaaaatcttgatgtggctcctctcggtgcggaggaagacagcgaagatgaagagactccttttttctcctgtgtttattatgtgtgtactatgctagtaattttgtggtggagcagctgctactgttttcctccccccctgacttgagcttgcaagccaataatgataatgtttgctactgaacatatatcagcaataatctttagctcctatt

SEQ ID NO: 29199 - DNA, 800 bp, Triticum aestivum
  Clone ID: PAT_TA_29199
cctggaaaatgtatatatatacatatttttttgtgtatgtgtttccaactgattccgaatttgcctaagcagctttggttgaaagattctaactgatgaatgtttgtgttctggatgtgacaagcctggtaaaattacagaattccacttgatgataaaattacagcgacgataacttcacagtcgaaacacttgtgcagcttggacatcgatctaggtacacgcggtgcgctgaagtacatcagcactcgccatattgcctggcagatcgaccggcttcaccatttccagaagacgttggatccgcacttgaacttctccttcccctcgcactcgatctcgaggtcgtcggtgatgaacgggactttcttctgcttggcgaggtcctggcagccggtgaagttgtaggggaacttgcagctgccgaactggacggtgtaggcgcgcgcgaagttggcgccgctcgtcgccgccctcttcttgtcgttcagctccttgttgagcttgctcttctcgaggtactcgtcgaagacgcttgccctggccgacccggcggaggcggcggtgacggcgaagacggccgccaggccgagaagcgccgcccgccggtccttgggcggggcgacctgcacgcgctttgccgtcgccggcgaggcggactgcggcaccgccgcggcgggcttgaggccgaccacactggtgttcacgccggccatgatcctctccaggtttcttgatgaatttggtggcgtgtgtgtgtgtgttgggttggcctcagggagaggagggtgtgctcgtgc

SEQ ID NO: 29200 - DNA, 550 bp, Triticum aestivum
  Clone ID: PAT_TA_29200
gcaggaattcggcacgaggcaaaaggtagggtttccagttgcaagccgccccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacatcggcttcatcaagtaccgttaagaatggaaacctcaaaggaagcaagggctaggaaattatcaacgaactgtggtgcttcatcaagtctgatctttatcctataagctatgtaatgaactactattaatgtttgaatcctggtgacaaaaccatgaaaccatgttagtgactgctgtttgagcatgtgaaaccgataattctgttcctgtcgtgccattatggttagaaggttgctctgcatccttatatttttattattttgtgaaggccggccatgctttgttttgatgctctaattttatattcctcgttttcataaaaaaaaaaaaaaaaaaa

SEQ ID NO: 29201 - DNA, 990 bp, Triticum aestivum
  Clone ID: PAT_TA_29201
tagcgtggtcgcggccgaggtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtccagagctcgttagggttttctcctttttcgggggagaaatctcaagaggcggcaccatgctcgtgtaccaggacaagctttccggcgacgagcttctgtcggattcgttcccgtcgcgcatcctagcaaccggcggcggcaggcggaaggcgaacaagaaggcggcaacgatggggcactccaacgtctggaactcccaccccaagaactacgggcccggctcccgcgtctgccgggtctgtgggaactcccatggactgatcaggaagtatgggctgatgtgctgcaggcagtgtttccgcagcaacgccaaggacattggcttcatcaagtaccgttaattcacctggtcctgctaccctgaagtgaagctaatcagggttgaagtaatggaactcttaatagaaggcttaatttcaattccagtaatgattgctcagtactccgagagtggctttatattttgatggatactgaatgatgtaattgttgaacatgagttaattacccatggagaagtcttttatcattctgttgactgtgtttgtcccctctcattgccattggtagttataagtaacttgtttttttattagaacgtattgggtcaatggctgtaacagaccagcaacccagcaaatatgcttatttcatttcaaaaaaaaaaaaaaaaaaaaact

SEQ ID NO: 29202 - DNA, 1356 bp, Triticum aestivum
  Clone ID: PAT_TA_29202
gggcaagacaatagacaaccgcatgcaatataaagcatttatcaactcttctgttagaagtatgttggtaccatcaggtatcaactggcaaaaaatatttgaaaataactgctccttggagaaatgcttttgcagcagaggaagaaaacaaaagagattgtacccaaggtatgatgggagacaaccctagtagcaaaaatatacaacggaagccattatttcaatcgcttctgcttaaagcctcaacgttgcaataaaaagaagaaacaatggtcatcagttgacgacgtccaggaccagcttgcgggacttgaggacggaccacctcatgcgacggtagtatgcggcttggagaagagcaagtgacagtaggaagatccatttgacacccatcagtttcctctcttccatttcaggctcagcagcccacgacaagaatgacacaacatccttgcccatctgggcttcagttgcaggagtaccatcttcatactcaatagccccatccataagcatcttaggcatggctatggcaccaccagggaagtagggattgtaatgcagaccctcacgaatctgaacaccagcaggtgggtcatggtaaccagtaagaagagcaaacacgtagttctggccatcgtgccttgccttcgtgataaggctgagatctgggggatatgccccaccatttgcaaatcgggctgcttgttcatttggataaggctgcgggaagcgatcactcagcttgccaggacgtgtgaacatttcaccctcatcattaggaccatcaaccacttcaatttcagcagccattgccttagtttcctcctcagtataggccaccccaaccaaatcacggtatgaaatcaatgacatggagtggcaagatgcacacacttgctggtaaacttgatgtccacggcggattgatgcgtgatcatacaagctaaggatgccagcatgcggccaggggtactctgcagctgccaaaccatgctcagcttcatctgcagatgctatcgtaccaaaacttaaaagaccagaagcaccaactccaagaagagccaatgctctcagtccagcagaggactcttcatgctttccccgaaatgaagaaagcagagatgagccagcagactggctctgaagagttttcctcagaagctggttaatgcccctgccgacagccattcagggctcgattggttgcggacttgacacggcgaggcggggctccgacgagcggcggcgcggggggtggggagcgggtgggagggaggtggatggaggcgcaggctttgtggcgatctagaactagtccggacgcgtgggcggacgcgtgggcggacgcgtggg

SEQ ID NO: 29203 - DNA, 1173 bp, Triticum aestivum
  Clone ID: PAT_TA_29203
taaccctactaaagggaacaaaagctggagctccaccgcggtggcggccgctctagaactagtggatcccccgggctgcaggaattcggcaccaccaaatccaatctcgagcccccctctcccgtccgcccgtcccaacccgatccgatcccctcctccgtcgccatgggccgcaagttcttcgtcggcggcaactggaaatgcaatggaactgtcgaacaggtagagagtatcgtcaatactctgaacgctggacagatcgcctctacggatgttgtcgaggttgttgtcagcccaccctatgtcttccttcccaccgtcaaggctaagctgcgcccagagatccaagttgctgctcagaactgctgggtgaagaagggcggtgctttcaccggtgaagtcagtgctgagatgcttgtcaacctcggcgttccctgggtcattcttggacactctgaaaggaggagcttgatgggagaatcaagtgagtttgttggagagaaggttgcatatgcactcgctcagggcttgaaggtcattgcatgtgttggtgagactcttgagcagcgagaagctggatcaaccatggaagttgtcgctgaacagacaaaagcaattactggcaagatcaaggactggactaacgtggttgtcgcgtatgaaccagtgtgggccattggcaccggtaaagttgcgacaccggctcaggcgcaggaagtccatgccaatctgagggactggctcaagaccaatgtgagccctgaggttgctgcatccacacggatcatctatggaggatctgtaactggcgcaagctgcaaggagttggccgggcagcccgacgtcgatggtttcctcgttggtggagcttctttgaagcctgagttcatcgacatcatcaacgccgccaccgtgaagtctgcctaagcaagatctcgatgtgtggctcctctgggcgtggaggaagacagcaacgatgaagagaccccttttttctctcctgtgtttattatgtgtactatgctagtaattttgcggtggagcagctgctactgtgtttcctccccctgacttgagcttgcaagccaataatgataatgtttactaccgaacatatatcagctattatcgttagctcttgttgctgtttaatcatgtctgcttttctccccc

SEQ ID NO: 29204 - DNA, 2389 bp, Triticum aestivum
  Clone ID: PAT_TA_29204
cccacgcgtccgcaccacgcacgggaaaacctcgcaggcaaccggcctcctcctccaccgccgccgccgccgccgccgtcgaagcatcagaagcagcaagagtaagatgtcgttccgggcgcgggagatttacaagaaggtggtgcgccgcgtgggcggggaggggaagctgccggcggaggtgatggacacagtgaagaacatactcccgaatagcaaggtcgtcatgggccgggccaagcgcggcatcttcgccggccgccacatccagttcggcaacaaggtctcagaggacggcggcaacaagtcaaggcgaaactggaagccaaacgttcaggagaaacgtcttttcagttatattcatgacagacacattagagtcaaagtaaccactcatgcactacggtgcattgacaaagctggcgggatcgatgaatacctcctgaagacaccttacaacaaaatggatactgagatgggaatagcctggaaggcaaagattgagaagatgtattcagagctagctgggatggaagttggcttcttccctcccaaggaagaggctaagatagagcagggtttcgaggaggttcgatcggccaagagagagttccgcagcgaatcaagaagggctttgggtgtggcaaagcagagtcagctagaagcaactaaagctgatgatgacgaaacaactgaagtcgtggatacaaatgaagaggtgtctgatgtcgcagagaagtcttagcttggacctgcgtgccattgttaatgataaaaaaggaagagaaatattgatgtccttgacaaaacaatggaaggttttcatttcatataaacaggggagaatatcttgcaagtcaaatgacccctttttctcagaacactgcagtgtatcttaggcctaactgtcaaggctaccatctacccggagcacatctcggtgttgcaatgacttgttaatttcgtggaagttttgtacaagcactgaattcttaagtgtcaggattgaggtgttctcttctcaagtctttctagcccattcaactgaaatgtcgaaataatatattcgtgacaggataaacacttatgcagctggagttgtagcattgggtagctgatttctgttagatctcaaatacctggcacgtcattgttgtcattggtttggaacttgtagccctcttttggagatgttggtagctgtggttctagatttaagcctgtttagctggtctttgctgttcccgttgatcaagcagtttgggatatgtcccggatgactaggctgatgcttgtatgaacttctatatggtcttcttaacggaaatcatgcggaaaccagtcccaaaggaaaaagaccttggcatggtgtttacttagcactgagtgggaattaatattaataactaaaaaatcaaaagaagatttggatgaattattcagttggactaaactcatggctgttgggctctaactgtaagttactattcggatctgtgtggagtttgtcttaatgtttactcttcatatgactgaatctgcttgtgatttcacctgtgaaagactcaatatagaatcatacttagtgcttgttgacatattatcaacagggaagttacattgccggcttccaaatatgaacaaacataaaaggcctgaaagcaacacggccattatgcggatccatctagcctagcttggcgaggacatcgccaagaacggtcttggtctctccgtagtacttctcggcctcggtggggctcttgatcttggctgcatggtcaagcccgtcgagggtggcgaagagcttgccggtgaggtccttgaggtccttcttttcctccttggtggtcttggaggagatgacggtcttgaggtcgtagcgcaggtaggaggccctcaggcggaggtcgttcatgacgtacggccattgcttcttgtcgatgagcggcttgaggttgaggatgtcctgggccgactccttggcccggaccgccgcctccgccggtggcagcggctgcaggtagaaccggttcttcaggggcaggtcgaagtcccttgcctcgtcggagttgtccgttccggggagtccaccggagagcggcggcggcgggccaaccttgatggccgcgacggtgccggcgtgcaccacctgagcgaacgcgctgccgacgactccgctggccatgaggccaaggaccgcgcggcggccggcggcctccgcctccgccgacgacgccctcacgatgaacctgctggcgcgcctgccggccgggcctgggagacgcacgccctgcgacaggccggtcatggacgccatggtttgcgccatctcaagctttgcttctctcttctcttcttgctctgtgtttctctccggacgcgtggg

SEQ ID NO: 29205 - DNA, 1322 bp, Triticum aestivum
  Clone ID: PAT_TA_29205
cggcacgaggcagcacagcaccaccacccgccacctcaacgcacgcaaaggccgaggaggacaagctaggaggagcgagcagccatggcttcgtcggtggccgccgcggcgagcgcgttcctcgggacccggctggcggacccggcgccgcagaacgggcgcatcgtggcgcggttcggcttcggcaagaagaaggccccgccgaagaaggccaaggcgcccccgaccaccgaccggccgctgtggttccccggcgcgcaggcgcccgagtacctcgacgggacgctcgtcggcgactacggcttcgaccccttcggccttgggaagcccgcggagtacctgcagtacgacgtggactccctggaccagaacctggcccagaacctggcgggcgagatcatcggcacccggttcgaggacgccgacgtcaagtccaccccgttccagccctacgccgaggtgttcggcctccagaggttccgcgagtgcgagctcatccacggtcgctgggccatgctcgccaccctcggcgccctcaccgtcgagtggctcaccggcgtcacctggcaggacgccggcaaggtggagctggtggacgggtcgtcgtacctggggcagccgctgccgttcacgctcaccacgctgatctggatcgaggtgctggtgatcgggtacatcgagttccagcgcaacgcggagctggacccggagaggaggctctaccccggtggctcctacttcgacccgctggggctcgcggcggacccggagaagaaggagactctgcagctggcggagatcaagcacgcccgcctcgccatggtcgccttcctcggcttcgccgtgcaggccgccgccaccggcaaggggcctctcaacaactgggccacccacctcagcgacccgctgcacaccaccatcttcgacaccttgggttcctcttaagtggtcggtggtcgagcaatttctgtcagctcagcagcaaaatggacgaacgcgcgtccgtgtaacgaacgtgctttggttttgtatgacgagtgatggatgagagggtatcgcacagatcctttgttgattaatgcaggtctgatcacataggagagctgctgggacttggtgatttgtaaaatatgaaccaatggtaacttaatgcatccacttgtacatcaaacaaaaaaaaaaaaaaaaaaaaaaaaaaaaaaaaaaaaaaaaacccattaaaaaaaaaaaaaaaaaaaaaaataaaaaaaaaaaaataataaataaaaaaataaaaattatataaacaaaaaaaaacaaaaattggggggggctttttaaaa

SEQ ID NO: 29206 - DNA, 2567 bp, Triticum aestivum
  Clone ID: PAT_TA_29206
gagggaacatcacaacatcgactttattattgggcaaatgaagggaatttttctctacacgacgacgcacacgcaccgcatgccgatcggacccgtcgtgcacgcacgcattattgccttattattattgagatcatggcaagcatatgcaccggcagaacacccacagtagctagtagctagtatccggtgcaagcaagcaagcaagcagagatggaggtcctcagatggagatgctgttggggatgcccctggccgtgagcccctcggcctggcccgtgtggtcggaggtgttggggtagagcagcatgtaggggaacttggccggcccggtgcggttcttgagccgcgggtccccgttcatggccaccacctgcttctcgatgccctccagcctcgccccgaaccgcctgaacgcctcctgcgccttggcgtccgacgtccacgccggcgtgtcgtgctgccccaggtacacctcgtcggaggagtgcttggacaggatctccatcagcgagatgcccaccagcgcctggaactggttggtgatggtgaggatgaatgccttctccggggcgcgctccagcagggcgtactcctcgctgcccggcgacggcatcggccgccggctcgccgacggcttgttggggtggtaccccgagtaggggtactgcccgaagttgacggccgcgtgcagcgccgaccccgtccagatgatggtggcgcaggccttgatcagctccgccacggtgtgcatcttgggccaccacgccgcgtccttgaggtcgccgtgcccgacctcccgcacctccttccaccacgcctgcagctccacgtcgccctgcagcacgccgtcgttcgggtagtagatggtcaggtagtctgtcacccactgctcgatcgcgtgccagaccgccagcccgtccgccgcgtacgggtagtcctcgatcagcagccgcaccttgtgcgggctcgatgggtcctccaccgccatgcccctcttgattaggtcgtcgggcagagcttgttcggtgaagttccagttcttgtagaccatggaggacatgggcatggcgtgcttgcgcgggaacacggtcatctcgatgacgccgccggcgttgatgagcagcccccgcgcccgcgcgttgatgttcatggtgtcgcggtagtgcgggtgcaggagcttgtacaccgggtgggtcacgctgagctgcctgttggtggcgatgacgaagggctccatcaccgcgtgcgtgttgagccagtggctgatcagctggtgccagccgtagtcgttcacggaggcgtaggccttggcgagctgccatatccagccctccacgccggcgtgctgcggcgtgtacacggtgctcttcgccgtggtcaggtcgccctggatcagcggcgagctcagctcgatggcgaccggcgccagcgtgccgtcgcctcgcaggaagaacagagtccttgtggcatagaggaaggtgtcgtcgaggttattgagcctgacgaggtatggcatcatgttgtcgtggtggtcaaggatgtagagcctgttgctggccattgcctgctgcgcggtgaggccctcgaggctattcctgatatgcgcctcagtgatggtgctggtgtggtcaccgtactggcttggatccaaagtactcttgggaggaaactccgtgacacgtgtgatcatcatcgggttgaccccggcaagaatctcccttgcaaactcctcgtcggtcatccatgctatctcgtcctgtttgatgacttgtggcttggggggcttgaggaggtagtcgccgcccatggggatgaggtccttgacgagctggagcgggaagcgcttgcgcatctcctggaggagccgggatgtcgggcagcttgatgccgccctcgtagagcttgaggatgtcggcgaaggagtcgaactcgccgggggagaggtcgacgtaggtgcggatggctggtatgatcccgtccaccagcgccttgagcgtgtagcccaggaagtcggactgcttgaggtggccgaagagctcgtcgcgcggcacgtagacgttccccaccagcggcagcagccggctctcgtggtcgggcttggtggccgagggcttccggccggtgcggcagcggcgcgggtaggggaggtccttggagccgccgaggacgtcgcgggtgtcgccgaggtcgttgtagacgtcgtagcggtagacgcggtcgtggtcctcgtacggcccctgctggtcgtcgcccctcaggttccggagctcgtcgtcccggtacggcttcagcgccgccggcatctggtgcggcaggtacgtgtcgttggcgaagaagacgcggttgtagcggtacttggcctgcgggtagacccatgagttggcgacgaagacgacggtgccgcggccgggcacgttgtcgagggtgatggtcttgaggaagaactcggcggcgtggttgttcttgacgatgatggcgccgggcacgcccagcttgtccaccgaccagtcgaaggtgacggcgaacttgttctcgcccgtggtgatgaaggcagcctcgtgccg

SEQ ID NO: 29207 - DNA, 1245 bp, Triticum aestivum
  Clone ID: PAT_TA_29207
gcggggctccacaagaagaaaagaaacgccaccaaatccaatctcgacctccccctctcccgtccgcccgtcgttcccaacccgatccgatctcccccctcctccgtcgccatgggccgcaagttcttcgtcggcggcaactggaaatgcaatggaactgtggaacaggtagagagtatcgtcaacactctgaacgctggacagatcgcctctacggatgttgtcgaggttgtcgtcagcccgccctatgtcttccttcccaccgtcaagggtaagctgcgcccagagatccaagtcgctgctcagaactgctgggtgaagaagggcggtgctttcaccggtgaagtcagtgctgagatgcttgtcaacctcggcgttccctgggtcatccttggacactctgaaaggaggagcttgatgggagaatcaagcgagtttgttggagagaaggttgcatatgcacttgctcagggcttgaaggtcattgcatgtgttggtgagactctcgagcagcgagaagctggatcaaccatggcagttgtcgctgaacagacaaaagcaattgctggcaagatcaaggactggaccaatgtggttgtcgcttacgaaccagtgtgggccattggcaccggtaaagttgcgacaccggctcaggcgcaggaagtccatgccaatctgagggactggctcaagaccaatgtgagccccgaggttgctgaatccacgaggatcatctatggaggatctgtaactggcgcaagctgcaaggagttggcagggcagcccgacgttgatggtttcctcgttggtggagcttctttgaagcctgagttcattgacatcatcaacgccgccaccgtgaagtccgcctaagaaaaatcttgatgtggctcctctcggtgcggaggaagacagcgaagatgaagagactccttttttctcctgtgtttattatgtgtgtactatgctagtaattttgtggtggagcagctgctactgttttcctccccccctgacttgagcttgcaagccaataatgataatgtttgctactgaacatatatcagcaataatctttagctcctattaatgataataatgtgtatcggctgatcggttgtgtctttcgccggtcactccgttgtgtgccgcatgtcccgtaggggccgcatgcaactgctcgtccaccgcctaagggccttgaatcaagggatttgttccgaaggtaaaaaaaaaaaaaaaaaa

SEQ ID NO: 29208 - DNA, 1180 bp, Triticum aestivum
  Clone ID: PAT_TA_29208
gcccacgcgtccgaagaaaagaaacgccaccaaatccaatctcgagcccccctctcccgtccgcccgtcccaacccgatccgatctcccccctcctcctccgtcgccatgggccgcaagttcttcgtcggcggcaactggaaatgcaatggaactgtcgaacaggtagagagcatcgtcaatactctgaacgctggacagatcgcctctacggatgttgtcgaggttgtcgttagcccgccctatgtcttccttcccaccgtcaagggtaagctgcgcccagagatccaagttgctgctcagaactgctgggtgaagaagggcggtgctttcaccggtgaagtcagtgctgagatgcttgtcaacctcggcgttccctgggtcatccttggacactctgaaaggaggagcttgatgggagaatcaagcgagtttgttggagagaaggttgcatatgcactcgctcagggcttgaaggtcattgcatgtgttggtgagactcttgagcagcgagaagctggatcaaccatggcggttgtcgctgaacagacaaaagcaattgctgacaagatcaaggactggaccaacgtggtcgtcgcctatgaaccagtgtgggccattggcaccggtaaagttgcatcaccggctcaggcacaggaagtccatgccaatctgagggactggctcaagaccaatgtgagccccgaggttgctgaatccacgcggatcatctatggaggatctgtaactggcgcaagctgcaaggagttggccgcgcagcccgacgtcgatggtttcctcgttggtggagcttccttgaagcctgagttcatcgacatcatcaacgccgccaccgtgaagtctgcctaagcaagatctcgacgtggctcctttcggcgtggagtaagacagcgaagatgaagagactcctttttttctctcctgtgtttattatgtgtactatgctagtaattttgtggtggagcagctgctactgtgtttcctccccctgacttgagcttgcaagccaataatgataatgtttgctactgaacatatatcagcaataatctttagctcttgttgctgtttaatcatgtctgcttttctttcaaaaaaaaaaaaaaaaaaactcgaggggggggcccgggtacccaattcccccctaaaatggagttcgt

SEQ ID NO: 29209 - DNA, 1257 bp, Triticum aestivum
  unsure (1)..(1257): unsure at all n locations
  Clone ID: PAT_TA_29209
gcacgagcacagcacagcaccaccacccgccacctcaacgcacgcaaaggccgaggaggacaagctaggaggagcgagcagccatggcttcgtcggtggccgccgcggcgagcgcgttcctcgggacccggctggcggacccggcgccgcagaacgggcgcatcgtggcgcggttcggcttcggcaagaagaaggccccgccgaagaaggccaaggcgcccccgaccaccgaccggccgctgtggttccccggcgcgcaggcgcccgagtacctcgacggcacgctcgtcggcgactacggcttcgaccccttcggcctcgggaagcccgcggagtacctgcagtacgacgtggactccctggaccagaacctggcccagaacctggcgggcgagatcatcggcacccggttcgaggacgccgacgtcaagtccacccccttccagccctacgccgaggtgttcggcctccagaggttccgcgagtgcgagctcatccacggccgctgggccatgctcgccaccctcggcgccctcaccgtcgagtggctcaccggcgtcacctggcaggacgccggcaaggtggagctggtggacgggtcgtcgtacctggggcagccgctgccgttcacgctcaccacgctgatctggatcgaggtgctggtgatcgggtacatcgagttccagcgcaacgcggagctggacccggagaggaggctctaccccggtggctcctacttcgacccgctgggtctcgcggcggacccggagaagaaggagactctgcagctggcggagatcaagcacgcccgcctcgccatggtcgccttcctcggcttcgccgtgcaggccgccgccaccggcaaggggccgctcaacaactgggccacccacctcagcgacccgctgcacaccaccatcttcgacaccttgggctcctcttaagtggtcggtggtcgagcaatttctgtcagctcggctgcaaaatggacgaacgcgcgtccgtgtaacgaacgtgcttttcgttttgtatatgacgagtgatggatgagagggtatcgcaaagatcctttgttgagtaatgcaggtctgatcacataggagagctgctgggacttggtgatttgtaaaatatgaaccaatggtgacttaatgcatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaanngggggcg

SEQ ID NO: 29210 - DNA, 939 bp, Triticum aestivum
  Clone ID: PAT_TA_29210
tttttttaaaaaccccttccgtggctgttgagctctaactgcaagttactattcgttgttacatcggatttgtgcgcagtttgtcttaatgtttactcttcatatgactgaatctcaagatagaatcatacttaagtgcttgttgacatattatcaacagggaagttacattgccggcttccaaatatgaacaaacataaaaggcctgaaagcaacacggccattatgccgatccatctagcctagcttggcgaggacatcgccgagaacagtcttggtctcgccgtagtacttctcggcctcggtggggctcttgatcttggctgcatggtcaagcccgtcgagggtggcgaagagcttgccggtgaggtccttgaggtccttcttctcctccttggtggtcttggaggagatgacggtcttgaggtcgtagcgcaggtaggaggccctgaggcggaggtcgttcatgacgtacggccattgcttcttgtcgatgagcggcttgaggttgaggatgtcctgggccgactccttggcccgcaccgccgcctccgccggtggcagcggctgcaggtagaaccggttcttcaggggcaggtcgaagtcccttgcctcgtccgagttgtccgttccggggagtccaccggagagcggcggcggggggccaaccttgatggccgcgacggtgccggcgtgcaccacctgagcgaacgcgctcccgacgactccgctggccatgaggccaaggaccgcgcggcggccggcggcctcggcctccgccgacgacgccctcacggtgaacctgctggcgcgcctgccggccgggcctgggagacgcacgccctgcgacaggccggtcatggacgccatggtttgcgccatctcaagctttgcttctctcttatcttcttgctctgtgtttctctccggacgcgtggg

SEQ ID NO: 29211 - DNA, 1648 bp, Triticum aestivum
  Clone ID: PAT_TA_29211
acatcggatttgtgcgcagtttgtcttaatgtttactcttcatatgactgaatctgcttgtgatttcatctgtgaaagactcaagatagaatcatacttaagtgcttgttgacatattatcaacagggaagttacattgccggcttccaaatatgaacaaacataaaaggcctgaaagcagcacggccattatgtggatccatctagcctagcttggcgaggacatcgccgagaacagtcttggtctcgccgtagtacttctcggcctcggtggggctcttgatcttggctgcatggtcaagcccgtcgagggtggcgaagagcttgccggtgaggtccttgaggtccttcttctcctccttggtggtcttggaggagatgacggtcttgaggtcatagcgtaggtaggaggccctgaggcggaggtcgttcatgacgtacggccattgcttcttgtcgatgagcggcttgaggttgaggatgtcctgggccgactccttggcccggaccgccgcctccgccggtggcagcggctgcaggtagaaccggttcttcaggggcaggtcgaagtcccttgcctcgtcggagttgtccgtgccggggagtccaccggagagcggcggcggtgggccaaccttgatggccgcgacggtgccggcgtgcaccacctgagcgaacgcgctgccgacgactccgctggccatgagaccaaggaccgcgcggcggccggcggcctccgcctccgccgacgacgccctcacggtgaacctgctggcgcgcctgccggtcgggcctgggagacgcacgccctgcgacaggccggtcatggacgccatggtttgcgccatctcaagctttgcttctctcttctcttcttgccctgtgtttctctccggacgcgtgggcggacgcgtgggcggacgcgtgggcggacgcgtgggcgcacacacaccagattcatcaagaaaacctcgagaggatcatggccggcgtgaacaccagtgtggtcggcctcaagcccgccgcggcggtgccgcagtccgcctcgccggcggcggcaaagcgcgtgcaggtcgccccggccaaggaccggcggtcggcgcttctcggcctggcggccgtcttcgccgtcacggccgcctccgccgggtcggccagggcaagcgtcttcgacgagtacctcgagaagagcaagctcaacaaggagctgaacgacaagaagagggcggcgacgagcggcgccaacttcgcgcgcgcctacaccgtccagttcggcagctgcaagttcccctacaacttcaccggctgccaggacctcgccaagcagaagaaagtcccgttcatcaccgacgacctggagatcgagtgcgaggggaaggagaagttcaagtgcggatccaacgtcttctggaaatggtgaagctggtcgatctgccaggcaatatggcgagtgctgatgtatgtcagcgcaccgcgtgtacctagatgtccaaactgcgcaagtgtttcgactgtgaagttatcgtcgctgtaattttatcatcatcaagtggaattctgttttcacctggatatggatatatgcatgttagcatgtatcttgtcacatccagaacgcgaacattcatcagttagaatctttcaagcg

SEQ ID NO: 29212 - DNA, 782 bp, Triticum aestivum
  Clone ID: PAT_TA_29212
catgtcaaacaaagccggggcagggaaagtcctgaaaaacggcacaagacgcattctacaatactggttgaataaaagagtgatgatgataagaggtacagtgaagcctgcagctaccggggattctttaaggccaaagacaccaaggcagatgatctgggtgagcaccagagagaatattgttgcattgtatgcaattggccaatatagaccaccagtttcgtatcttgtgcaataaacattgatgaactgatttcggtacacaatgtaggcaagaaagaagtacagtagtaaaaagggcaagatcagaggtgctagcacagagcatgtgaagcccaatagtccaaacaacagaacttttggtagttcagtgtgatacggaaacgagaggataaaatcgctatcttctttcattctcagaatatatttccttacaaagttccaaattagaccaaagagttgcataacttccgacgacagactagcccatcctgaagtcagaacataggtggtaaagaaggtcggacgcgtgggcggacgcgtgggaagctccattggaatgtcctttggtcttgataaggcgttaagttggttaattgcagaacctgataggacgttgacgaagaagacattccaaatggagaagtataatactttacaacaggcacttttcttcctttcactgtgagaaataggtccctctagtgtcgcaaatagcatcatggtcggggggacagtatataaaaatatttcgaacgcgtgggcggacgcgtgggcgaacg

SEQ ID NO: 29213 - DNA, 526 bp, Triticum aestivum
  Clone ID: PAT_TA_29213
gtgcgcgcgtctcaagccggccgggctttcaagccacggactccatcgctccatccatccatcgatcgccaccggagagccagcagcagcagagcaatcggccgagcgcgaggatgtgctaccaggtgaagtgcggcacgtgcggcaagtccacgtgggcggggtgcggccgccacgtggcctccgtccaccgccagatccccgagggccagcactgcgcctgccgcgactggccgggcgtctccgccgccggcgacaaggccgccggctccacctccggcgccgtccaggagtcctccacctgcgccatcctgtgatgtggtgtgaggcgcgattcgccgtcggccgtggtcggcgaatcagcatcgatcggccttgccccggccgatcgttgacttcctcgtctgctagtactagtatctctttgtactccagtttgtatggtgtaataataattctggattggaactaataatcgatcgcgactcattcgttgctctgaaaaaaaaaaaaaaaaaggccccta

SEQ ID NO: 29214 - DNA, 1492 bp, Triticum aestivum
  unsure (1)..(1492): unsure at all n locations
  Clone ID: PAT_TA_29214
cgcgtgggcgcagagccggaagccacacacacacgccttcctcctctgctcgcatctcggatcggggaggagaaggatctgaggcttttggcaggccggggacgatggcgccgctgctcaaggacgagctggacatcgtcatcccgacgatccggaacctggacttcctcgagatgtggcggcccttcttccagccgtaccacctcatcatcgtgcaggacggcgaccccacgaggaccgtcatggtgcccgagggcttcgactacgagctctacaaccgcaacgacatcaaccgcatcctcggccccaaggcctcctgcatctccttcaaggactccgcctgccgctgcttcggctacatggtctccaagaagaagtacgtctacaccatcgacgacgattgcttcgtggccaaggaccccacggggaaggacatcgacgcgctggccaagcacatccagaacctgctctgcccgtccacgccgctcttcttcaacaccttgtacgacccctaccaggagggcgccgacttcgtgcgcggctacccgttcagcctccgggagggcgtgcccaccgccgtgtcgcatggcctctggctcaacatccccgactatgacgcgcccacgcagctggtcaagccgcgggagcgcaacggcaggtacgtcgacgccgtcatgaccatccccaagggctccctcttccccatgtgcggcatgaacctcgccttcgaccgcgagctcatcggcccggncatgtacttcggcctcatgggcgacggccagcccatcggacgctacgacgacatgtgggccggctggtgcgtcaaggtgatctgcgaccaccttgggctgggcgtcaagacggggctgccctacatctggcacagcaaggccagcaacccgttcgtgaacctgaagaaggagtacaagggcatcttctggcaggaggacatcatccccttcttccaggccgcgaagctgaccaaggaatgcgacaccgtgcagaagtgctacatctcgctctcgcagcaggtcaaggagaagctcggcaagatcgacccctacttcgtcaagctcgccgacgccatggtcacctggatcgaggcctgggacatgctcaactccaaggactccaaggaggccgatgccaacggcaagctcaaggggaggtagatcgagatcgagggagagaaccttttttgcactagcatactgagcaggcggtgaggcggcatataccggtttcttcagttcgtaggttcagtgcgtgcatcaggtattcaggttcaggctgttgtgtactacaaaacattagctgccgttctatcttacgtttacgttgagggtcgcgttaatttcccccttctttaatttcattattaagagatgatgtcgttttctcaagggtttagtactacggttatacttgtggctgctaatgtttccgtgtaatcttgtgtacactgaaatgtgagaataaaaagttgttcaat

SEQ ID NO: 29215 - DNA, 501 bp, Triticum aestivum
  Clone ID: PAT_TA_29215
aattttccggcctccatcgctccatccaccatccatccatcgccaccggagagccaacaacagcagagcaatccaccgagcgcgacgatgtgctaccaggtgaagtgcgccacttgcggcaagtccacgtgggcgggctgcggccgccacgtcgcctccgtgcaccggcagatccccgacggccagcactgcgcctgccgcgactggccgggcgtctccgccgacgccaacgccgccggctccacctccggcgccgtcaaggagtcctccacctgcgtcatcctgtgatgtgaggcgcgagtcgccgtccgccgtgcccgtggccgtccgttgacttgtgctctgcctctccggccggatccaagccgtggtggtgggcgcgtcgcgtgcagcagctagcgcatagatttgtcatctcttgtatactcttgtagtattactatcgtgaaataattctggattgtaaccaataatctcaagtctttcgttgtgtttccgtac

SEQ ID NO: 29216 - DNA, 2267 bp, Triticum aestivum
  Clone ID: PAT_TA_29216
acggacatccatcgctccatcatccatccatccatccatccatccatcggccatcgccaccggagagagcaaccgagcgagcgcgacgatgtgctaccaggtgaagtgcggcacgtgcggcaagtccacgtgggcggggtgcggccgccacgtcgcctccgtgcaccggcagatccccgagggccagcactgcgcctgccgcgactggccgggcgtctccgccgccggcgacaaggccgctggctccacctccggcgcagtcgaggagtcctccacctgcgctatcctgtgatgtgaggtgaggcgcgggccgtgctccggcccatcgttgacttcctcgtctactcttgtaataataattctggactggaactaataatcgatcgcaagtcattccttgtacttcgtttggcatcatacaattatgcttcctctgttggctgtccaaaattactcgtcgcagaaatggatgtattccccgctgtaaaaggatggtacatggttcagcccagggccaggggcacataacagtcgaacaaaacaaaggcacgcgtagacatggattggatggattgctttcttccacaacaacttgtttaactgaggctacaatgcagcaagcaattcaagggtccgtgcatggccaaaaatggcccgaaaagtccgcgcaggcgtcgatttaaacacaaaattgcacccttgcgaccaaacaggccaacacatcgactttcaaaagaaaagaaaaacaggtaacactcccgaatgcgcccgcgcacacgggtggccgcccgcgagcgccccccccccccaccaccacccccagcgccagcccctacccccacctccaggaaacacgcgagcatccagggctcgaggatcgaggatcccggccaggcagcaatggcagggacggtgactgtgcccggatcgtcggtgccatcgacgccgctgctcaaggacgagctggacatcgtgatcccgaccatccgcaatctcgacttcctcgagatgtggcgccccttcttccagccgtaccacctcatcatcgtccaggacggcgaccccagcaaggtcatcaaggttcccgagggcttcgactaccgagctctacaaccgcaacgacatcaaccgcattctcggccccaaggcctcatgcatctccttcaaggactccgcgtgccgctgcttcggctacatggtctccaagaagaagtacgtcttcaccatcgacgacgactgcttcgtggccaaggacccatctggcaaagacatcaatgctcttgagcagcacatcaagaacctcctcagcccgtccaccccgtttttcttcaacaccttgtatgacccctaccgtgaaggtgcggactttgtccgtggataccccttcagccttagggagggtgcccccaccgcggtctctcatggcctttggctgaacatccctgactatgatgcacccacacagatggtcaagcctcgtgagaggaacagcaggtatgttgatgccgtcctgactattcccaaggggacactgttccccatgtgtggcatgaacctcgcctttgaccgtcagctcattggccctgcaatgtactttggcctcatgggtgatggccagcctattggtcgctacgatgacatgtgggctggatggtgcgtcaaggtcatctgcgaccacttgagccttggagtgaagactggcctgccatacctgtggcacagcaaggctagcaacccatttgtcaacttgaagaaagagtacaagggcatcttctggcaggaggacatcatccccttcttccagaacgccaccctctccaaggagtgtgacacagtccagaagtgctacatctcactctcggagcaggtcaaggagaagcttggcaagattgacccttacttcgtgaagcttgctgatgccatggtcacctggatcgaggcctgggacgagctgaacccatctgataccgtcgttgctgctgggaacggcaaggcagcagccatgtaggctggctggggagccaagaagagtgtatggttggggcctagatatagctctttttgagaaagagattactgaagcagcttttataattctttcatgttatgctggtggttcttttgtagctggacaaggatttgttatcatttacataattcaagacaataatatttatcatgtaattttgagaaatcaagcaccgtttgttattatcgtgaaaatattttaattgagcaaaaaaaaaaaaaaaaaaaaaggcggcctt

SEQ ID NO: 29217 - DNA, 632 bp, Triticum aestivum
  unsure (1)..(632): unsure at all n locations
  Clone ID: PAT_TA_29217
cggacgcgtgggggagcgaacatcgacccggcggcctgggaggacaagaagtgcaacggcgagtctcgcttccctgcacaggtaacttcactcgccatggcatccgtgtcaaaaacgttcttatactatgcgacagagggggtattaagttgatatcaatataattctacgaacataagttgctagagatatgaactggcgaggcagttgcaaggctagcttgatccggaaggagatgagatcaatgactagtaaaagcaatcgatcaattagttttatctttatattgaacagatggatgttgttgtcttgtttagttggaacctagtagatcgtgggcataaaactttgctagtgactgtccaacaacctcacctcagattaggctggccggtcaatcctaggccaaccacctgttcttctagaacaagcacacttgtcaacgcacgctcggtcggttcttctagagggtgactcaaacaagatcactttttttaatgggctcaaacatgattactttttcgctttagggacccaaacaagatcactagcttaaagtatctgaagttacaatgcacatctaagtgactcagttaaactaggangaaaaaaannnaannnnnnnnnnnnnn

SEQ ID NO: 29218 - DNA, 739 bp, Triticum aestivum
  Clone ID: PAT_TA_29218
tccacgcgttcgcgacactatggaggagaacctcaagaggcagctcttcgggttgccatccagatacagagattcagtgagggcaatcaggccagggctgcccctcttcctctacaactactccacccaccagctccacggcatcttcgaggctgcgagctttggcggagcgaacatcgacccggcggcgtgggaggacaagaagtgcaacggcgagtcccgcttccctgcacaggtgagggtggccacaaggaagatctgcgacccgctggaggaggacgccttccgcccgatcctgcaccactacgacgggcccaagttccggctggagctcagcatcaccgaggccctctcccttctcgatatatttgaagacaaggacgaggcctgatcgaggctgcatgcctactgctgatcagggagggactgttgaggaaggaacaacgcaataagatcgatcggagcatatatatatacatacatacatacgattaatatcattatcaattaatggtgatatatacatacgtgagttttatgtattgggttttccatcccgcgggctatgaaattatgcgccccccgctgtgtatcatgcatgcgtggtgatggctgcacaagatgagccctcgtggacataactaatctattgtcacggctatgtatgtatgtataatattgagactttaagatgtttctcctgttgtgtaccttagcagaataaatctcttttttactg

SEQ ID NO: 29219 - DNA, 848 bp, Triticum aestivum
  Clone ID: PAT_TA_29219
gccggccggttcgactctacatgttcctttgtattccgtcttttattttgttcgtgcgaggggactttgttcggctgtgtgcatcttacttatgcagaggtcagcttaaaccttttaagtaatatgaatcgccccttttcgaaagcatggttactttttttaggaactcaaacaagatcactagcttgaagtgtttgaagttaatgctggtactaaaaaacaaacatgccttaaattaacaacaccgaattaatcttgcactggcattttgcgtgtaaacaaaattaaggatgatcaatcctaacttggagtactactgtatgtacttaatctctctgtatgtcttgctaattacaatttgcaacgatcgatgaattacaggtgagggtggccacaaggaagatctgcgacccactggaggaggacgccttccgccctatcctgcaccactacgacgggcccaagttccggctggagctcagcatcaccgaggctctctcccttcttgatatatttgaagacaaggacgatgcctgatcgagggctgatcagggattcttgaggaaggaatagcacaataagatcggatcggagaatatatacatacatatgattaatatcattatcaattaatggtgatatatacgtgagttttatgtattgggttttccatctcgcgggctatgaaattatgcgtcccccgttgtggtatcatgcgtggtgatggctgcacaagatgagccctcgtgaacataactaatctattgtcacggctatgtatgtataatattgagactttaagatgttttctcctgttgtgtcccttagcagaataaatcttttttttt

SEQ ID NO: 29220 - DNA, 1558 bp, Triticum aestivum
  Clone ID: PAT_TA_29220
gccggacggtcgtgggaacatcgtccctccccgcccgcaacccacgcagctcgactcgcagcagcagcggccggcggagaccgtatcatggcgatggagggctacgaccgcgagttctggcagttcggcgaccagctgcggctccagacggccagcttctccggcctctccctcggcgactccatctggtcccccgccgacgccgccccccgcgcccgcaacgccgacctcttctccccctccccggcgcccgacaacaacaacgccgccaagatgaacggcaacggcctcaacgggcccggcctcatcgggtccggcaagctcgccttcggcgccaccaccaccagcaaggccgaccgctacaacaacgtcagcctccccgccgccgccgacgccaacgccaagccctacggcaacgccaacggcctatacggtgccaagcccaacaacaccaacaacaacggcttcgggctcaacaagatggctgccggcggcgggggctacggcaacttcaacggcggcaacgacggggtgaagagctacttcaacaagtccatcggcaggccggccagcaacaacagcagcaacaacaacttcagcggctacggcggcaagaagggcgctgccgacggcaagaagaagcacgccaagaacgagcgaggggacaacaaccacggcgcggcctcggagaagcggttcaagacgctgccggcgtccgaggcgctgccccggaacgagcccatcggcggctacatcttcgtctgcaacaacgacaccatggaggagaacctcaagaggcagctcttcgggttgccatccagatacagagattcagtgagggcgatcaggccggggctgcccctcttcctctacaactactccacccatcagctccacggcatcttcgaggctgcgagctttggcggagcgaacatcgacccggcggcgtgggaggacaagaagtgcaacggccgagtctcgcttccctgcacaggtgcgggtggctacaaggaagatctgcgacccgctcggaggaggacgccttccgcccgatcctgcaccactacgacgggcccaagttccggctggagctcagcatcaccgagactctctcccttctcgatatatttgaagacaaggacgattgaggctgcctactgctgcatgctcaatgctgttcagggagggggtcgttgaggaaggaaaagcgcaataaggtcgattggagcatatataataacatacgattaatatcactatcaattaatgcattgatgttatatacatgagttttatatattgggttttccatctggcgggctatgaattatgcgccccccgttgtcgcgtcctgcgtggtgatggctgcacaagatgagccctcgtgaacagtactgacctcttgtcacgaccatgtatgtatgtatgtatgtatattactgaggctttaagatgtgtattacatttgttgtgtacgtatgtttctccttgttgtgtaaaaaaaaaaaataaatctctttttgttaactgaaaaaaacaaaaaaaaaaaaaaaaaaaa

SEQ ID NO: 29221 - DNA, 445 bp, Triticum aestivum
  Clone ID: PAT_TA_29221
ttcgccggtcgacggggtatgactgataatatcgatataggttattctacaagattactctatagatccatcagctctaagtaaactgcgtataaatcatgtatgtataaggtatgtgttactgatgttagaagttgattccttgtgtgagggtgcggatgtaacacaacatgtaattcttaatatccacatgcctcaccaaaacaatgtacggctaacccacaattatgacgttatcaagctcattataaatatgcatgtaataaaaaaaaaaaaaaaaaaaaaaaaaaaaaaaaaaaaaaaaaaaaaaaaaaaaaaaaaaattaaaaaaaaaaaaaaaaaaaaaaaaaaaaaagcggccgcccaaaaggttcaaaccttacttacccttgaatgcaacttcaaaccccttcaaaagtgtcaccaaaattcaattcaagggccg

SEQ ID NO: 29222 - DNA, 1015 bp, Triticum aestivum
  Clone ID: PAT_TA_29222
gcacgaggccatctccacgcacctcccccactcaggtaagaaacatggtcaccatggcggccacgaaggatcgccgtcctgccggccgcgacgccgctcttcgccgcggcaggggcggaggacccccaaccccccctacccggaaaagccacccattgaaggcagtgctactcctgctgcatcaactgcatcgacaacagcagcagcggcgacagcgaggacttccagcagtacaagaagtcatgcgtcgtcgtatatcctgaactgccaccaggaagtgtcgccggagatgtgcatcacccacgactcgcctcacccccccaccaggtaaacaggtggaatgatgcagggcaggtacaaggcctaatgtaccaaacgatccccccgtcaccccgggaccccaccccaagcccggatcccagccaccagcccccccccggcaccgccgaagcccattcccaccgcccgaagccctccggaccgccgaactgccaccggcgccgtaccccccgtagccaaccaaagcaaaggcccgcccgaaagcccactacaagcgccatacacgacgggcgatcccgccgtgccgtccacgagctgcaatacgagtcgaacaacaacagcactactggtgggactacgtgacgacgtctctgccaacataatttcaacttaactcccgatatatacagcaaaacaatatatgtagagacatcgaagtataagtgtatatgtggtgggggtatgattatcgatatagtttattctataagattactctatacgtgagtaaatccatcaacacaaaataaacggggtatgaatcatgcatgtataaggtatgtgttactgatgttagaagttgactgccttatcacaagatgcagatctaacacgacacgtacttctccatatccatgtacctcaccacaacaatttctacgtaatctagccccctgcaaatatgcatgtaataatcattgccttgcacacattgcaaagcctgataaaaaaaaaa

SEQ ID NO: 29223 - DNA, 744 bp, Triticum aestivum
  Clone ID: PAT_TA_29223
caagccatcgctctggatacattagcatgggataacatcataggattccggtcctattgtgttggccttcgggatcggagtaatgattaatagggacagtcgggggcattcgtatttcatagtcagaggtgaaattcttggatttatgaaagaccggggtcgtgctcttcgccggcctcggcgacgtctacgacctccgcttcttcgaccagctcaggcagatcaggacgttcggtgcgtggccggtcgcgacggtgtcggagcgcgagcggaaggcgacggtggaagggccggtgtgcggaggctcgccgtcggcggtcaccggctggttctccacggccgacgcgacgccgacggtgagggcggcgaggccgccggcgggcaccgtggacgtggcgcgcttcgcgttcggcagcgccctgctctggaacccgcaccggtgggaccgcttccccgtctccgagcccgacgcctcacaggattcggtaaagtttgtgcaacgattggccgcagaggagtacaacgagtcgagaggaatgcccgatcccgactgctcggagatcatggtgtggcgtggagatcagctcgtcgctacctagattgctctggataaatgataatcataatatacatatacctacccacatactccctccgttccaaactaccaacttcccacatatattgttcaaagtacgttatgacaccgtagctgtacatgtttatgcacgttgatcgcaacac

SEQ ID NO: 29224 - DNA, 926 bp, Triticum aestivum
  Clone ID: PAT_TA_29224
aaggccaactcacatattccatcaaccaaggattaggctattacactacaaagaatgccagagttaaactcacaactgcagtaaaagcaacccctggttcacccctgacatgttccaaccccctaatttgagtaacagttggaagatcaacatctgcagatacatatgatatgaggaaggatctaaaacgaacaaactagggccaaggctgggcatttttcttgggagtattatttttcgctgccttatctaaggggctcttcagtactatggaaaacacattccattcactatcactactgcataggtaccagttggcctcggggagtatggagttgacaagctcctcgtttatcttcacgggtagtggtggcatctgcttcatgatctcgtggcgcctcctccagctctcccggcgccccgtcttcgccttctccagcctggctcggcactcaggtgggctcctctatctgcttgccgccaacgcttggtgcaaggtggctgaaatcctgggcgttagtttcaaggagttctcctgttggacctccaattgctttggatgaaatttcgtcatcatcaacgggaagtgctgggagggagtatggcggaacactcggccttccagctatatgaacaggtggtttcgatgaagaatctgcaaccttctcctttttgtccttgcttttctttgatgagctgtggtcctctttctttcttttaccagctctcctttttactcatccatctacaccgcaaagccacatctcgaactgttttctctggcaacttcatggctatttttgcataccgaataacaggtgcatcagatgcatacttgacgagcagctcgtcgaggatggcctgctcctccggcgtccactcccgcgacaggcccgggtcgtgccggagcgccgccgccgcctgca

SEQ ID NO: 29225 - DNA, 793 bp, Triticum aestivum
  Clone ID: PAT_TA_29225
cgtccgcccagatgtcctcgtcggcgaccgctccggctccggcgccaccgccgtcacggccgccaaggtgtcccacctcctctgcttcgccacctgctggggcgctgcgctctgggctaccttcatcggcggaatcatcatgttcaagaatctgccgaggcaccagttcgggaacctgcaggggaagatgttcccggcctacttcacgctcatctccgcctgcgccgccgtctccgtcgccgccttcgcctacctccacccgtggaaggccgcctccgccgtggagcgctaccagcttggcttcctcatctccgcgctcggcttcaacctctccaacctgctggtcttcacccccatgaccattgagatgatgaagaaaaggcacaagatcgagagagagcttagcatcggtaacgaggtcgggtggtcaaagaacgtcaagacggcaaaaagcaaccctaccctcgctgcgatgaacaagaagtttgggatgatccacggtctctcatcgctggccaacatcttgtcgttcggcagccttgccatgcactcctggtactttgccagcaagcttgagctgtgaagtgtacaaacacccagcttgaccacgaacacggttgaatctagtatcatcgcaatatgcctatgctttgttctaaaaacagctacatgttatgagcttgcaaacagatttaattgtagacttgactttggattattgtacttgaagcaacttgctgggggaatcgttaccccgttactgctgccaaatgctaatagtatgttttgtgag

SEQ ID NO: 29226 - DNA, 975 bp, Triticum aestivum
  Clone ID: PAT_TA_29226
gccgggccggagggtcgactctccccgcgtcgactctccctccctctcctcctcccccctctctagcaatcggcgagcgatggcgtgggcgacacggttcctgtcagcagtgtgcttcttcgcggcgggcgtcctcttcgccccagatgtcctcatcggcgaccgctccggctccggcgccaccgccgtcacggccgccaaggtgtcccacctcctctgcttcgccacctgctggggcgctgcgctctgggctaccttcatcggtttgaatcatcatgttcaagaatctggtcgaggcaccagttcgggaagatgttcccggcctatttcacgctcatctccgtctgcgctgacctctccctgcgccgccgtctccgtcgctgccttcgcctacctccaccccgtggaaggccgcctccgccgtgggagcgctaccagctgggcttcgtcttcaccgcgcccagcttcctggtcttcaacccccatgaccactcccacaatgaccattaagatgatgaagaagagggacaagatcgagagagagctgagcatctggtgacaaagtcgggtgatcgaagaaagtcaagccggccaaaagcaaccctacactagctgtgaggaacgagacgttttctctgatccacggtcaatcttctctggctaacatcttgtcgttcgcacgccttgccatgcactcctggtaccttgcctgcaaggttgacatgcgcagtgtacaggcacccaccttggcttcaatctactatcatcgctgtatgtcttttcttcgtaataaaacctgctacatgttatgagcttgcaaacagatttagttgtaggacttgacttttggatgattgtacttgaaacaacttgctggaggaaacgttaccggttaccccgttactgctgccaaatgctaatagtatgtctcgtgtgtactcgcctcaaaaaaaaaaaaaaaaaaaaaaactcgag

SEQ ID NO: 29227 - DNA, 603 bp, Triticum aestivum
  Clone ID: PAT_TA_29227
gaacacctcgagagtcctcgccgccggagaagtcgcaagcaagatggccggaaggaagggcggcgacaggaagaaggcggtgacccgctccgtcaaggccgggctccagttccccgtcggccgcatcgggcgttacctcaagaagggccgctacgcccagcgcgtcggctccggcgcccccgtttacctcgccgccgtcctcgagtacctcgccgcggaggtcctggagcttgccggcaacgcggccaaggacaacaagaagacccgcatcatcccgcgccacctgctgctcgccgtccgcaacgaccaggagctcggtaggctgctcgccggcgtcaccatcgcccacggcggcgtgatccccaacatcaactccgtgctgctccccaagaagtcccccgccgccgccaagtcccccaagaagaaggtcgccgccaaggagtagccgcccgcacccatagcctagccagtgttgcttagatccatttctcatggactaagatgagatcctgtatgtaatgcctgctagtctgtagtgcccgtcagattcgtcgagcatgggtgacattgtacctgtgatttctgtgaccatggcgaaagatg

SEQ ID NO: 29228 - DNA, 569 bp, Triticum aestivum
  Clone ID: PAT_TA_29228
ccgtctcccgcacgcttttcctccgcctcgagcagctcaaggacgcgcgcagccatggcgacggagaccgagaccttcatcttgcaggccgagatcaaccagctcctctcgctcatcatcaacaccttctactccaacaaggagatcttcctccgccagctgatatccaactccgtcgaagcgctaggacaaaatcaaggtccagagcctcacagacaagagcaagctcgatgcgcaacccgagctcttcatccacatcatccccgacaaggcgaccagcacgctcacgatcgtcgacagcggcattggcatgaccaagtcggacctcgtcaacaacctcgggacctatcgcagggcggggaccaaggagttcatggaggcactcgctgccggcgctgacgtgtccatgattgggcagttcggtgttgggttctactccgcctacctcgtcgacgagagggtcgtcgttaccaccaagcacaacgacgactagcagtacgtgtgggagtcttatgccggaggctccgtcaccgtcactcgtgatacgtttggggagcagctccggacgg

SEQ ID NO: 29229 - DNA, 822 bp, Triticum aestivum
  Clone ID: PAT_TA_29229
tgcaggctccggccgacggcagcgctacgcgtccagcgaggctgccaccactttgttcccctctttctcgcacccctccgtcgtcatccccacacggctgccattttcccacgccgaggtgggcttgtgccgccgccgccatcacacaggtgccaacagtggcgctttttgttcatacgcaagtgcccgctgatgccacctctcacctctctctcatggctccactgccgcatcccagaccagctagatctatgtgggtcaatgtcccttcactcccattcgtcaggtccaaggcgcccaacccctgcttcctctgcttccggtgattaggagcttggtggtgggtgcccccatctctccccaattcaggagaacaggagctagccatccatggaagaaacgacatcgtaaggggaaataaatctttagtaagtttgggcaaaaaggccaccggacgatgtccatagtcatatgcatatgcatcacatcgacttgatgctactactatttactctcaagaacatcattcccagaagtagtacttggtttcaactttgaaagaccagatgaattcttctatggggcgtctgaacaaaaggggcattttcgtcatcccgtcactaaggtagtggagcaagatgtcttatatctaggtaatggcatcaatcaatgttgggacaaggaatctcatcattgcaatatatagctaccacattggaccaggaagcaaacaaaaggactgcactcaacggaaccatgaagccaacgatctacgccaactagatgttttagatttcatcttgtacctgcccgggcggccaa

SEQ ID NO: 29230 - DNA, 551 bp, Triticum aestivum
  Clone ID: PAT_TA_29230
gatgattgggcgtaaagcgtctgtaggtggcttttcaagtccgccgtcaaatcccagggctcaaccctggacaggcggtggaaactaccaagctggagtacggtaggggcagagggaatttccggtggagcggtgaaatgcattgagatcggaaagaacaccaacggcggcgtgaagaagccgcaccgcttccgcccgggcaccgtggcgctgcgcgagatccgcaagtaccagaagagcacggagctgctcatccgcaagctgcccttccagcgcctggtccgcgagatcgcgcaggacttcaagaccgacctccgcttccagagctccgccgtctccgccctgcaggaggccgccgaggcctacctcgtcggcctcttcgaggacaccaacctctgcgccatccacgccaagcgcgtcaccatcatgcccaaggacatccagctcgcccgccgcatccgcggggagcgcgcctaggcgcctcgctcgccgcactgctaggtgttttaggctccctgttcccgtcgtgttccatgtgtgcgtcgctccta

SEQ ID NO: 29231 - DNA, 539 bp, Triticum aestivum
  unsure (1)..(539): unsure at all n locations
  Clone ID: PAT_TA_29231
acgaggtgctcttcatggtggacgccatcgacgagtacgccgtggggcagctcaaggagtacgacggcaagaagctggtgtccgccaccaaggagggcctcaagctcgacgaagaaaccgaagaagaaaagaagcgcagggaggagaagaaggcggcgttcgagggcctctgcaagaccatcaaggacatcctcggcgacaaggtggagaaggtcgttgtatccgaccgcatcgtggactcgccgtgctgcctggtgaccggcgagtacgggtggacggccaacatggagcggatcatgaaggcgcaggccctgcgggacagcagcatgggcgcctacatgtcgagcaagaagacgatggagatcaacccggagaacggcatcatggaggagctccgcaagcgcgccgacgccgacaggaacgacaagtccgtcaaggactggtgatgctgctgttcgagacggcgctgctcactccgggntcaacctgacgacccaacaacttcgcgccaagatcaacgatgtcaactcggntcaaat

SEQ ID NO: 29232 - DNA, 711 bp, Triticum aestivum
  Clone ID: PAT_TA_29232
gctgacaagcctgaaggactatgtgaccaggatgaaggagggacagaacgagatctactacatcactggtgagagcaagaaggctgtggagaactctcccttccttgagaagctgaagaagaagggctatgaggtcatctacatggttgacgccattgatgagtatgccattgggtcagctcaaggagtttgaggggaaagaaagcttgtctctgccaccaaaggagggtctgaacttgatgaagagcgaggacgagctccgtaagcgtgccgatgccgacaagaacgacaagtctgtcaaggacctcgtgatgctgctcttcgagacctccctgctcacctccggcttcagcctggaggaccccaacaccttcggcaccaggatccaccgcatgctcaagcttggcctgagcattgatgaggatgacgaggcgccagagaacgacaccgacatgccgcccctggaggacgacgccggcgagagcaagatggaggaggtcgactaagcgccaaggctgcctgtcggctgtcgtcgtcagatgtccatgccctgcaccgcctagttgtttttatcttagtgtcgacgttggatggttttggcacgttttagctgtatcggttttgtcttttggctggccaaacattaagcgcggttagctgtttgtggtactcgtggaacagttcgttattgttggttctacaatatgtgtt

SEQ ID NO: 29233 - DNA, 504 bp, Triticum aestivum
  Clone ID: PAT_TA_29233
gaggcactggctgctggtgctgatgtatccatgattggtcagtttggtgtcggtttctactctgcttaccttgttgctgagagagtcattgtgaccagcaagcacaacgatgacgagcagtatgtgtgggagtcccaggctggtggttccttcactgtgacacgtgatactactggagagccccttgggaggggtactaagatcaccctctacctcaaggatgatcagttggagtaccttgaggagcgtcgccttaaggatctggtgaagaagcactctgagttcatcagcaagatggaggaggtcgactaggcgtgtgcgttcgcttgctatccgagtcgtagagctagcttatcttttgggttactgtcgcgtggtcggtttgtcttttatggtttactgtgcctagcctgctgtaatggggctaggggagtggtctgtggagtccccggaactgcgtatcgtaatcgttgcttatatatatcgtctttactaaaaaaaaaa

SEQ ID NO: 29234 - DNA, 644 bp, Triticum aestivum
  Clone ID: PAT_TA_29234
ctgagtggccattgttctggggaaattccttactctgcaattacaaaagcccttgagatcaatgatgatgaggtggaatattggattgtgaaagcaatttcatcaaagattttggactgcaaagttgaccagcttaatcaattggtcattgtcagccgacatactgtgagggtctttgggatgccacaatggcagagtctacgttcaaagcttggagtgtggaggggaaacattgcaaatgctatcaacacaatccaagctaacaaggtgactgaagatggcgggcaggggatgcaaggattgatgatccgctgatcggaggggactccccaaattgagactatagtctctgagattaagatgagcaatcttaatttaattaagacatccttgtaatcccgaaatactcctaacatatgatcatgctggctttatcctggtttgcagcggcgtgctaagcaatctcatgttgcatgaattttgtagtcaaaaccatgcttgaagtcagctgttactcgtttacacacattcctgattgttcatactggatgcctgtttatcatgataattgtttcttctcccaagtttttggctttggaattatggagaatttgtatcatgttttttaaaaaaaaaaaaaaaaa

SEQ ID NO: 29235 - DNA, 648 bp, Triticum aestivum
  unsure (1)..(648): unsure at all n locations
  Clone ID: PAT_TA_29235
ttgaggatcttcccctcaacatctctcgtgagacactccagcagaacaagatcctcaaggtcatcaggaagaaccttgtgaagaagtgcatcgagctcttctttgagattgctgagaacaaggaggactacaacaagttctatgaggctttctccaagaacctcaagctcggcgtccatgaggactccaccaacaggaccaagcttgctgagctcctgaggtaccactccaccaagagtggcgatgagcttaccagcctcaaggactatgtgacgaggatgaaggagggccagaacgacatctactacatcaccggtgagagcaagaaggctgtggagaactctcccttccttgagaagctgggcctgagcatcgacgaggacgaggaggctgctgaggctgacacggacatgccgccgctggaggaggacgccggcgagagcaagatggaggaggtcgactaggcgtgtgcatttgcttgctatccgagtactagagctagcttatcttttgggttactgtcgcgtggtcggtttgtcttttgtggtttactgtgcctagcctgccctaatggggctaggggagggtctgtgagtccccggaactgcgtatcgaatcgtgcttatatatatcatctttaggctncga

SEQ ID NO: 29236 - DNA, 893 bp, Triticum aestivum
  unsure (1)..(893): unsure at all n locations
  Clone ID: PAT_TA_29236
tagcgtggtcgcggccgaggtcctggagcttgccggcaacgcggccaaggacaacaagaagacccgcatcatcccgcgccacctgctgctcgctgtccgcaacgaccaggagctcggcaggctgctcgccggcgtcaccatcgcccacggcggcgtgatccccaacatcaactctgtgctgctccccaagaagtcccccgccgcggccgagaaagaggccaagtcgcccaagaagaagacctccaccaagtcccccgagaagaaggtcgccgccaaggagtagaattccccatagcctagccagtgttgcttagatccatttctcatggactaagatgagatcatgtatgtaatgcctgctagtctgtagcgcccgtcagattcgtcgagcaaggatgacattgtatctgtgatttctatgacaacggcgaaagatgcaatcatttcaatcttgtagtaaaaaaaaaaaaaaacctcggccgaggtgggcgggcgaaattacgtgagagaaagaacctcagattgatggagtccgccgtcggacagaatagctgcttagtgactaggagcggagcgcccctttcttgttcttggtggcgtctatagcgaagaagaccttcccgaacgagggccgtccagtccctggccggctctcggttcttgagcaagctcctccactgcaggtaggatgctcatagatgaagaaaagagactttaggcaagtggttctggtagctcagctggttagagcaaaacaagcaacggattgagcaactagcgcgaaagccgttgcgcgttagcgcatccgttttcttgctggactgcaaatccttttttttcttgtttcagtgggaagagcaaggggcattgccctggaaatcctnnnnnnggtc

SEQ ID NO: 29237 - DNA, 575 bp, Triticum aestivum
  Clone ID: PAT_TA_29237
cgccggagcccgcaccaggccgctgggagttctaccctcggtaacgaaattccttccccgcatccattccccccgattttactctctcgaatcggctgctgcgtcgcgttgcgctgggattctggcgtggggggaggcgagattcggtctcgcggtctccccgtagccgcgttaattcgcgcgggatcggtcgtcggcgcgggcatttcgtggcggggagaggtgaattcgggcggaggtttcggtgaattcgacgcgatagcggtcgattgtggcgctggggctccgcgattggggattcggagtctgtcaaaaggtggacctctaatattgggtgcctattatgtctcaccaaggacgctggtccctcattgcggaaataagaaaatttcttcatccgcttcataattgttgaattgacgctaagatttatttagcaatcagattccggactctgagcagatctaacaggatctttaaaagagttcttttgtttgaaaatttgttacttaatagaaatggtgaaggatcatctaatgctcaatgttgatcgcctaatggtgcctgaacccatt

SEQ ID NO: 29238 - DNA, 575 bp, Triticum aestivum
  Clone ID: PAT_TA_29238
ttcggcacgaggcggagaagcagcaagcaagatggccggaaggaagggaggcgacaggaagaaggcggtgaccaggtccgtcaaggccgggctccagttccccgtcggccgcatcgggcgctacctcaagaagggccgctacgcgcagcgcgtcggctccggcgcccccgtctacctcgccgccgtcctcgagtacctcgccgctgaggtacgcacctatctttcccgtccttcattgttcttcttccatgttcttctcgtgctcgacgggtaactgacagatttggtttctgaatatgcaggttctggagcttgccggcaacgcggccaaggacaacaagaagaagaccaccgccaagtcccccaagaagaaggtcgccgccaccaaggagtagccgcccccatagcctagccagtgttgcttagatccattcctcatggactaagatgagatcctgtatgtaatgctctgtagtgcccgactgcccgttagtttcgtcgagcaaggatgacattgtatctgtgatttctatgacaatggcgaaagatgcaatcatttcaatctaaaaaaaaaa

SEQ ID NO: 29239 - DNA, 500 bp, Triticum aestivum
  Clone ID: PAT_TA_29239
gggatgcaagtcgttatccggtaatgattgggcgtaaagcgtctgtaggtggcttttcaagtccgccgtcaaatcccagggctcaaccctggacaggcggtggaaactaccaagctggagtacggtaggggcagagggaatttccggtggagctcggcaagctgctcgccggcgtcaccatcgcccacggcggcgtcatccccaacatcaacgccgtgctgctccccaagaagtcccccgccgccgccgagaaggaggccaagtcgcccaagaagaagacctccaccaagtcccccaagaagaagaccgccgccaccaaggagtaaccgcccccatagcctggccagtgttgcttagatccatttctcatggactaagatgagaccctgtatgtaatgcctgctagtctgtagtgcccgtcagattcgtcgagcaaggatgatattgtatctgtgatttctgtgacaatggcgaaagatgcaatcatctcaaaaaaaaaa

SEQ ID NO: 29240 - DNA, 950 bp, Triticum aestivum
  Clone ID: PAT_TA_29240
cgcacgaggccacacgggcggcgcacgctgccatgccgtttgggtgcagccagaccgccgcccctaccctcgcgctccgggcagaggctcgttcttcttggtggtgactacacgttcctccctggtggtggcactctgccgctgtcttgcgttactcccagtggctgcgcccttcgacccctacctcgaatcaatcgatccggcaatagagagatgaaactgcaaagaagcatgataaggaaaaagcgggtttcgacgctggacatttgaacaaaatcatatactagagactgcttgtattataatagaaggtaaacttaccaatcgaatagagtgaacaatacttgtattagtgttttccattgtattgcatgtgcattgtgggtctactatcaatccatagaaattacactgtataatggatggatgaaacgaatggaacctatatcctgacttgccactactatattgtagcttctaaaacacttgtatgcacatatagtttctcctgggtattataactgaaacattattgagataaatctcgctcagtttttctagtgcggaaggaaagcttcaagatgttccatttaaagccctgatatctatttgaaaattaattcatgtgcatacctcctcgatcctaacattatcatgtctccatttctcttattcaagagaagcgtgaaacaaagcactcattcagaattctatgctatcagaaataaggtcattaatattcagatatatgcatgtaaacttggcctgtgatgtaagaaattaggagatagtttcctgtagaataatggttcatgtatgtgcagcaattcaattgccttgtgatgtaatagttgatgccatgcttgtaagtgggttggtttcatgaccttaacagtgcaaagctatgcacgtaacattcacattttattttgaaaaaaaaaaaaaaaaaa

SEQ ID NO: 29241 - DNA, 683 bp, Triticum aestivum
  Clone ID: PAT_TA_29241
cgtccgctccactccccgtcacgcgacccggcgacgaacggccgcgcccgtcgagcgcaccgccggcgcccccccctcccctctgccgggccttgttgccgtgctgtgcaacgtccccgtgtgacgagccaatgatggccagagctgcacttcttcctgttgcgctgctgctgtgccttgcactggctggcggcgccaatgctgcacggaagtcgacggccggattctatgaactcaagaacaagaagggggatttctccatcaaggtcaccaattggggcgctgccctcgtgtctgccatcgtccctgatggcaaagggaacttggctgatgttgtccttgggtacgacactgtcgctgaatatgctaatggctctgcttcattcggagcgacggttgggcgcgtagccaacagaatcgcaaacgcccgctttgttcttgacggcaaaacctatcaccttctccgtaacgacggcaacaacacgattcacggaggccccaaggggttcggcaaggtcatttggacggtgaaggagcatgtgagccatggtgactccccatacatcaccttctactaccacagcttggacggagagcaaggattcccaggcgccctcgacgtgtacgtgaagtaccagctgtcccgcccgtacgacctgagtatccgcatgaacgtgactgcg

SEQ ID NO: 29242 - DNA, 441 bp, Triticum aestivum
  Clone ID: PAT_TA_29242
aggagaactttcaaccaagattagagctagcatacagtttgtagtttatagtcgtactcatactcaatgagtccctacctcggcttctaggcaagatattctttaattttagttgattagcaaccagtattgttcaggaattttgagtggcacacatcctggtctggcgagccgatgaccagacatcatttgtcaaggaagcaaaaaggactacactcacaaggaaccatgaagccaatgatccacgtcaactagatgttttagctttcattttgtacaactgatgtctcatacttgcatcttttggttgtccttttgtaaacctgatgtatggtttcttggtggttttgtttagaacaggttgaagtgtatgtatgtgccaattagttaatggaataaaaaatgtttggtgctccaaaaaaaaaaaaaaaaaaaaaaaaa

SEQ ID NO: 29243 - DNA, 744 bp, Triticum aestivum
  Clone ID: PAT_TA_29243
gccggccggtccgggataaaactcagagcatttccatccagcgcaaccgccgccaacaccactcctagagagtcctcgccgccggagaagcagcaagcaagatggccggaaggaagggcggcgacaggaagaaggcggtgacccgctccgtgaaggccgggctccagttccccgtcggccgcatcgggcgttacctcaagaagggccgctacgcccagcgtgtcggctccggcgcccccgtctacctcgccgccgtcctcgagtacctcgctgccgaggtcctggagctcgccggcaacgcggccaaggacaacaagaagacccgcatcatcccgcgccacctgctgcttgccgtccgcaacgaccaggagctcggcaagctgctcgccggcgtcaccatcgcccacggtggcgtgatccccaacatcaactccgtgctgctccccaagaagtcccccgccgccgccgagaaggaggccaagtcgcccaagaagaagaccaccaccaagtcccccaagaagaagaccgccgccaccaaggagtagccgtcgtccccatagcccagccattgttgcttagatccatttctcatggactaagatgggatcctgtatgtagtgcctgctagtctgtagtgcccgtcagattcgtcgagcaagggtgacattgtacctgtgatttctgtgagaatggcgaaagatccaatcatttcagtgttcaaaaaaaaaaaaaaaaaggccccta

SEQ ID NO: 29244 - DNA, 1178 bp, Triticum aestivum
  Clone ID: PAT_TA_29244
caaatcgagcaagcagccggcgacgcgacgcggccgaatcggagcaggcagtctcgccggccggcccatcgatcccctgctcggccccccgaggaaccgatagggtccatctccctgccggcgatggcgtcgtccgcggatccgtgggtgcgggagtacggcgaggcggcgcgcctggcggacgacgtcgccgccatggtcgccgaccgggcggcgctcccgcagtccgggccggaggtcatgcgccacacctccgccatccgccggaagatcaccatcctcgggaccaggttggacagcctcgaggggatgctcgccaggcttccccccaaatccatcacggacaaggagctgcataagcgccgagacacgctttcaaatttgaaatctagagcaaaacagatggcagaaagtttcaacatgtcgacctttgccaacagggaggatttgcttggtcagagcaagaaagctgctgatgacatgagcagagtagccgggttggataaccaagggattgttggccttcagaggcaaatcatgaaagaacaagatgagggtcttgagaagctggaacagacagtgctgagcacaaaacacattgcgctagcagtcaatgaggagcttgacctgcatgcaagactgattgttagtttcttactgcaaagccacttgtttctttgctctctagactctgtgttcactgccctctcttcatgattgcaggatgacctagacgaccatgtggatggtacgaactcgcgtctccaggttttatttcaaacccttgtttccgttccttatccttagaccttaaagaaagtttctttgctctttgataccaatagttctcaagctttgcacgaattgaattttgacgcaaatacctttctcatgcagcgtgtgcaaaagaggcttgcggttttgaacaagcgcgccaagggcggctgctcctgcatgtccctgctgctgtccaccgtcggtatagtgatgcttgtggttattgtttggctcctcatcaagtatctgtaacctctgcccaactcaaatcagtttcaagtgtgcagctctttcaaagatagtatggttacttccgcttcgccatcattttggcgagaaatggaaaatatgtatgccacatgtgcccttatcgggctgaaatgtgaagttcagacttttgt

SEQ ID NO: 29245 - DNA, 910 bp, Triticum aestivum
  unsure (1)..(910): unsure at all n locations
  Clone ID: PAT_TA_29245
cccgagaaccccccgctccaaagccctaaccctagccatctcctctccccccagccctcgtcgagcgcgcgttttccaggagcttcaggtgccggcggcgccatggcttcggagaccgagaccttcgccttccaggccgagatcaaccagctgctctcgctcatcatcaacaccttctactccaacaaggagtttgagggaaagaagctggtctccgccaccaaggagggcctgaagcttgatgacagcgaggaagagaagaagaggaatgatgagctcaaggagaagttcgaggggctctgcaaggtgatcaaggaggtgctgggcgacagggttgagaaggtgatcgtctctgaccgcgtcgtcgactcaccgtgctgcctcgtcaccggcgagtacggctggaccgccaacatggagaggatcatgaaggcccaggccctgagggacacgagcatgggcggctacatgtcgagcaagaagacgatggagatcaacccatagaacgccatcatggaggagctgcgcaagcgcgccgacgtggacaagaacgacaagtctgtcaaggacctggtgatgctgctgttcgagacctccctgctcacctcgggcttcagccttgacgacccaacaccttcggcacaaggattcaacgcatgctcaaactgggctgaacatcgacgangacgaagaagctgctgaagctgacacggacatccccttggangaagacccggcgaaacaagatggangagtcnacaagctgtgcaattgctnctatccgatccaaaactanttanctttgggtactgcccctggncgnttgcctttgtggttacgtnctanctgccnatgggccagggaattgctgtgatcccgaatgctncgtaacngngctaaaaacccctat

SEQ ID NO: 29246 - DNA, 760 bp, Triticum aestivum
  unsure (1)..(760): unsure at all n locations
  Clone ID: PAT_TA_29246
ttcccatccagcgcaaccgccgccaacaccactcctcgagagtcctcgccgccggagaagcagcaagcaagatggccggaaggaagggcggcgacaggaagaaggcggtgaccaggtccgtcaaggccgggctccagttcccggtcggccgcatcgggcgctacctcaagaagggccgctacgcgcagcgcgtcggctccggcgcccccgtctacctcgccgccgtcctcgagtacctcgccgccgaggtatgcgccgatctatcctctcctagagcctctgatcttccctcctcttgtcccgattgactgatttcgttggcttttgaatgcgcaggtcctggagctcgccggcaacgcggccaaggacaacaagaagacccgcatcatcccgcgccacctgctgctcgctgtccgcaacgatcaggagctcggcaagctgctcgccggcgtcaccatcgcccacggcggtgtgatccccaacatcaactccgtgctgctccccaagaagtcccctgccgccgccgagaaggaggccaagtcgcccaagaagaagacggccgccaagtcccccaagaagaagacggccgccacgaaagagtagccgtcgtccccatagcctagccattgttgcttagatccatttctcatggactaagatgggatcctgtatgtagtgcctgctagtctgtagtgcccgtcagattcgtcgagcaagggtgacattgtacctgnatttctgtagaaggcgaaagatccaa

SEQ ID NO: 29247 - DNA, 919 bp, Triticum aestivum
  Clone ID: PAT_TA_29247
gcgagaaagagcactcgcaccctcgctcgtcagccgtcacccaggagccgccaccaccgccgccacgccaggggcttcctccgatctgcgctcactggtttgtttgaagaaggatctagccgttgactgttggtgcttcccctccccgggcgcaagcaacgttttggatgtgagctccagctcaagcagagcatcaaaaacaggggctctatctgctaatggggcagccgacaatgcagtctaagagctacatctcatgtgatttctggatatgaaaacttgagaagaacaagcttgatgctattattgaaaaaaataatctatgctacaggattcttctttgcatcccatacacttagacggagtgggaggctgccgcagcggtgctggactcggagcccaagccatccgccgccgccaacaagttgcacctcttcgcggaaatcaccacaactgtgatgtgctgacagtcggatgccttcagaattggctcttaaaactttcaaccaagattagagctagcatacagtttgcagtttatagtcatactcatactcaatgagtccctacctcggcttctgggcaagatattctttaattttagttgattaggaaccactattgttcaggaattttgagtggcgcacatcctggtctggcgagccgatgatcggacatcatttgtcaaggaagcaaaaaggactactcgcaaggaaccatgaagccaacgatccacgtcaagtagatgttttagttttcattttgtacagctgatgtctcatacttgcatcttttggttgtccttttgtaaacctgatgtatggtttctcggtggttttgtttagaacagattgaagtatatgtatgtgccaattagttaatggaataaaaaatgtttggtgctcccgatttgagcctg

SEQ ID NO: 29248 - DNA, 594 bp, Triticum aestivum
  unsure (1)..(594): unsure at all n locations
  Clone ID: PAT_TA_29248
ccggttggtactccgcaagttcgttttttttacgccggcggaaatcaacctgcgccgctgccttctccgttctcgccgtcgcctccgcctccgctgccgccgcgcaggtcagggtcatgtcgatcttcgagtacaacgggagcgccgtggtggcgatggtggggaagaactgcttcgcgatcgccagcgaccgccgcctcggcgtgcagctgcagacgatcgccaccgacttccgacgggtgttcaaggtccacgacaagctctacatcgggctctcggggctcgccaccgacgcccagacgctgtatcagcggctggtgttcaaggcacaagttgtaccaactgatggaggaagaagggacatgaaagcccgaaactttgccaccttgtttaaccctcctctatgagaaaagtttggaccatactctgccaaccattattgctggcctangagacaacgatgaccgtttatatttccatggactgcattggtgccaaggaactacaaaaatttgtggctccggtatgctcaaatcacttaagggcttgtgatcatttnaccaacatggaaccgaanantttcagaaactccaa

SEQ ID NO: 29249 - DNA, 1165 bp, Triticum aestivum
  Clone ID: PAT_TA_29249
gtcaaatcccgcatttgcggccactgccgttggtcgccgccggcagccggacgacctgctccgtccaccccccagcaatatccacgccagagccttcccccagctcaagtctccgtcaacccgccgaccgccacccatggcagagaccaccgagaacgagtaccacacaggtgaagaggaagacctggtcggagaggaggaaggaggcgtcggggccgaaggcgagaagggtggaggggccggaaagaagaggaagcggcctctgaacaagaagagtctgggcggcttcagcaagcgcggggtgtgctacctcagccgcgtccctccccacatgaacccgtcgcacgtccgccagatcttctccaagcacggcgaggtgcagaggatctacctcgtccccgaaggtcaaggtcatcgcaagcatagtaacgtaaaagcgaaggcttactccgaagggtgggttgagtttgcaaagaaaagtgtcgccaagagggtggctaatctgcttaatggtgaacaaataggtgggaagaagaggtcgtcattttattatgacatctggaacataaagtatctcaggaagttcaaatgggatgatctggttggtgaaatagctgagaagactcatatcagggaacagaaattaacattggagataacagctgcgaagaaacaacgtgatcattatctctctaatggctgaaaagtctcgtacacagaaatttattcgtgagcgcataaaaaagaagcaaaagccggaaggaaaagaatccaatgatgttggtgagacgaataacgattgtccaattcctcgacagaatagagcagttgaggagagaggccctaataaaaaggcaaagctctcaaaaaatattctggccggagtgttcggtggttcatcatgatcgattttgattcctggtggattggagcattgcaaactgaatgttctagcacaagaccattgctgtcttcaccatctgctccgcctttgtagattagtctgtcatttttttgtaatggagggtgaatggtttggtcgtttggtgattgcgaattgccaaatatatattgcttctgctgtaatactgggatactgggaggatgtacactgttgttaatttgaaacagtgaagtaatattaccctgtattggccaaaaaaaa

SEQ ID NO: 29250 - DNA, 693 bp, Triticum aestivum
  Clone ID: PAT_TA_29250
cgagtttttttttttttttttttttttttttttttttttttgaaactgcatctcgatgccatagatagatggtacaccatcagtatgaatgctttaatattctttggcgcttcaatgcacgttacatattcaaatatacacaaatgacctatataacaccactctgaacttgtgcgagtgaaatccccacaagaaaacatttgattcagagtgaccttttggacaaacgacactcttattatgtacgttaaaacaatgtatctgaagggcagcctttgcttacaggcggaaaggcatttaattgctctagtataatctactaaacatggaaccaacggatccaaaaacaagaagaaaaacagagaaccagaagacctgtaacctacatgagcctagtcagttatcattagatcgtttgggagttgtccgaaaatgtctgggcagccttcccagctgctcttttctctggattcccagtaaccaccaaggtagcggtatgtgtcgctacctttatccttcgcaaaccaccggggtttccacccactctcctgcatctttcgtgcctgccgttgtctctgctcaagcctcaacttctcagcatttgctctttcatattcaccattctctaggcacctctggtccggtcgcaatcttgagtctgttggtggaagtttttcctgccgaacgcgtggg

SEQ ID NO: 29251 - DNA, 1047 bp, Triticum aestivum
  Clone ID: PAT_TA_29251
acaaatcacacgccaaaggccaaaagcggggaagaaagaggacgaaagaaagcgtcgccgccgcggagcaaatcgagcaagcagccggcgacgcgacgcggccgaatcggagcaggcagtctcgccggccggccgtcccatcgaccgaccccccgctcggccccccgaggaaccgatagggtccatctccctgccggcgatggcgtcgtccgcggatccgtgggtgcgggagtacggcgaggcggcgcgcctggcggacgacgtcgccgccatggtcgccgaccgggcggcgctcccgcagtccggcccggaggtcatgcgccacacctccgccattcgccggaagatcaccatcctcgggaccaggctggacagcctcgaggggatgctcgccaggcttccccccaaatccatcacggacaaggagctgaataagcaccgagacacgctttcaaatttgaaatctagagcaaaacagatggcagaaagtttcaacatgtcgacctttgccaacagggaggatttgcttggtcagagcaagaaagctgctgatgacatgaacagagtagccgggttggataaccaagggattgttggccttcagaggcaaatcatgaaagaacaagatgagggtcttgagaagctggaacagaccgtgctgagcacaaaacatattgcgttagcagtcaatgaggaacttgacctgcacgcaagactgattgatgacctagatgatcatgtggatggtacaaactcgcgccttcagcgtgtgcaaaagaggcttgcggttctgaacaagcgcgccaagggcggctgctcctgcatgtccctgctgctgtccaccgtcggtatagtgatgcttgtggttattgtctggctcctcatcaagtatctgtaacctctgcccaactcaaatcagtttcaagtgtgcagttctttcaaagacagtatggttacttccgcttcgccatcattttggcgagaaatggaaaatatgtatgccacatgtccccttatcgggttgaaatgtgaagttcagacttttgt

SEQ ID NO: 29252 - DNA, 1473 bp, Triticum aestivum
  Clone ID: PAT_TA_29252
gcaaaatgaaactgcatctcgatgccatagatagatggcacaccatcagtatgcatgctttaatactctttggcgcttcaatgcacgttacatattcaaatatacacaaatggcctatatgacacacactctgaacttgtgcagagtgaaatccacacaagaaaaacatttgattcagagagaccttttggacaaacgacactcttattatgtacgttaaaacaatgtatctgaagggcagcctttgcttacaggtggaaaggcgtttaattgctctagtataaaccactaaaaatggagccaacggatccagaaacaagaagaaaaacagagaaccagaagacctgtaacctacttgaacctagtcagtgatcattagatcgtttggaagttgtccgaaaatgtcagggcagccttcccagttgctcttttctctggattcccagtagccaccgaggtagcggtatgtgtcgctacctttatccttcgcaaaccaccggggtttccacccactctcctgcatctttcgtgcctgccgttgtctctgctcaagcctcaacttctcagcatttgctctttcatattcaccattctctaggcacctctggtccggtcgcaatcttgagtctgttggtggaagtttttccttcaatccaggggtaagttcatttaatgtgatcgcaaagctagtgaaattgtatcgagtgggaaactttggtggtttactccttttccacaacaaatgggcctctgaaaaattctcagatcttttgccttttccaaagcagtcacccatcacgtagtgcatactttcatcccatttaccaaagagtgtagcaacagttcgaccacttcggtcttgaataacaccttggacctgatgagggttgcgatcaataattgagtgctccttgaacttcagcttacatgaatattcgcgattaccttgaatgcgcatagtaccatagtgatcacagtacagtttacccaatatgagattgtaaatggaagtggtcaccttgctccactggaaaacttcaccatcatcaaactccagtgttaacacaccaacaggatcaagttgaatggagcgaccccagaactcgctctttaggttgctatatgcccaaaacctccagccatttccctcacagtggcatgcaacaaccattggatgatgactaaccttttctgagaaaaaaacgaagacctttatctggataatctgcttcataggtctccccaagaagagggttgaagggcttacaactccttccatccgtagaggcataaccagaaacagcaaatgctgcaacgcttagaatcctcatcagactatccccccttttgccccattcatatgcacgatcaataaggtaggaatactcaagatcctcgaaacatttttgtaatgatgaaagaggttcattgaagtaaacaggcagacagatttggtaagatctttctatgttg

SEQ ID NO: 29253 - DNA, 735 bp, Triticum aestivum
  Clone ID: PAT_TA_29253
acatctcagagcatttccatccagcgcaaccgccgccaacaccactcctagagagtcctcgccgccggagaagcagcaagcaagatggccggaaggaaggccggcgacaggaagaaggcggtgacccgctccgtgaaggccgggctccagttccccgtcggccgcatcgggcgttacctcaagaagggccgctacgcccagcgtgtcggctccggcgcccccgtctacctcgccgccgtcctcgagtacctcgctgccgaggtcctggagctcgccggcaacgcggccaaggacaacaagaagacccgcatcatcccgcgccacctgctgcttgccgtccgcaacgaccaggagctcggcaagctgctcgccggcgtcaccatcgcccacggcggtgtgatccccaacatcaactccgtgctgcttcccaagaagtcccccgccgccgccgagaaggaggccaagtcgcccaagaagaagaccaccaccaagtcccccaagaagaagaccgccgccaccaaggagtagccgtcgtccccatagcccagccattgttgcttagatccatttctcatggactaagatgggatcctgtatgtagtgcctgctagtctgtagtgcccgtcagattcgtcgagcaagggtgacattgtacctgtgatttctgtgagaatggcgaaagatccaatcatttcagtgtgttgttctatctatggctgcaatgattttcattcc

SEQ ID NO: 29254 - DNA, 637 bp, Triticum aestivum
  Clone ID: PAT_TA_29254
ctcccccgctcccttcaaaacacccgagcagcctctccgatctcccatcccagcgcccccagcaccccccgcgatggcccgcacgaagcagacggcgcgcaagtccaccggcggcaaggccccgcggaagcagctggcgaccaaggcggcgcgcaagtcggccccggcgaccggcggcgtgaagaagccgcaccgcttccgcccgggcaccgtggcgctgcgcgagatccgcaagtaccagaagagcacggagctgctcatccgcaagctgcccttccagcgcctggtccgcgagatcgcgcaggacttcaagaccgacctccgcttccagagctccgccgtctccgccctgcaggaggccgccgaggcctacctcgtcggcctcttcgaggacaccaacctctgcgccatccacgccaagcgcgtcaccatcatgcccaaggacatccagctcgcccgccgcatccgcggggagcgcgcctaggcgcctcgctcgccgcactgctaggtgttttaggctccctgttcccgtcgtgttccatgtgtgcgtcgctcctatgtaactggcttgttgctgtgcttcgatgtactacttatatcgatgaaatatggctaccaggatgagataaaaaaaaaa

SEQ ID NO: 29255 - DNA, 1103 bp, Triticum aestivum
  Clone ID: PAT_TA_29255
cgcagatcaacaagcagaagcccatctggctgcgcaagccggaggagatcagcaaggaggagtacgcgtccttctacaagagcatcaccaacgactgggaggatcacctggccgtgaagcacttctcggtggaggggcagctggagttcaaggcggtgctcttcgtgccccgccgcgcgcccttcgacctcttcgacacccgcaagaagatgaacaacatcaagctctacgtgcgccgcgtcttcatcatggacaactgcgaggagctcatcccggagtggctgggcttcgtcaagggcgtcgtcgactcggacgacctccccctcaacatctcccgggagacgctgcagcagaacaagatcctcaaggtcatccgcaagaacctcgtcaagaagtgcatcgagctcttcttcgagatcgccgagaataaagaggactacgccaagttctacgaggccttctccaagaacctcaagctgggcgtgcacgaggactcgcagaaccgcgccaagctcgccgacctcctccgctaccactccaccaagagcggcgacgacctcaccagcctcaaggactacgtcacccggatgaaggagggccagaaggacatctactacatcaccggcgagagccgcaaggccgtcgagaactcgcccttcctcgagcgcctcaagaagcgcggctacgaggtgctcttcatggtggacgccatcgacgagtacgccgtcgggcagctcaaggagtacgacggcaagaagctcgtctccgccaccaaggaggggctcaagctcgacgaagaaactgaagaagaaaagaagcgcaaggaagagaagaaggccgccttcgagggactctgcaagaccatcaaggacatcctcggcgacaaggtggagaaagtcgtcgtctcggaccgcatcgtggactcgccgtgctgcctggtgaccggcgagtacgggtggacggccaacatggagcggatcatgaaggcgcaggcgctgagggacagcaacatgggcgcatacatgtcctccaaaaagaccatggagatcaacccggagaacggcatcatggaggagctccgcaagcgcgccgacgccgacaag

SEQ ID NO: 29256 - DNA, 626 bp, Triticum aestivum
  Clone ID: PAT_TA_29256
ctcccccgctccacttcaaaacacccgagcaaacctctccgatctcccatcccagcgcccccgctcctcccgcgatggcccgtacgaagcagacggcgcgcaagtccaccggcggcaaggccccgcggaagcagctggcgaccaaggcggcgcgcaagtcggcccccgccaccggcggcgtgaagaagccgcaccgcttccgcccgggcaccgtcgcgctgcgcgagatccgcaagtatcagaagagcacggagctgctcatccgcaagctccccttccagcgcctggtccgcgagatcgcgcaggacttcaagaccgacctccgcttccagagctccgccgtctctgccctgcaggaggccgccgaggcctacctcatcggcctcttcgaggacaccaacctctgcgccatccatgccaagcgcgtcaccatcatgcccaaggacatccagctcgcccgccgcatccgcggggagcgcgcctaggcgcctcgcttgtcgttgctaggtgttttagattctctgttcccgtcgtgttctatgtgtgcgtcgttcctatgtaactggcttgttgctgtgcttcgatgtactgcttatatcaatgaaatatggctaccaggatgagat

SEQ ID NO: 29257 - DNA, 1180 bp, Triticum aestivum
  unsure (1)..(1180): unsure at all n locations
  Clone ID: PAT_TA_29257
gcaatgtggatctggtgatacactatgaattgccaaacaattcagagatatttgttcacaggtctggccgtactggccgtgctgggaagaaaggcactgcaattgtgatgtacagctacaaccaaagtagagctgtcaggggcatcgagaatgacgttggaggcaagtttacggagcttccaaagatcaatgttgaaggttctgacttgacaatggctagtggttatgattcgttcggaggtggaggtggaggtgggcgctcacgtggtggtggttttggtggccgcggtggtggttttggcaactcttccagcagaggtggcgggtttggtgattccggttttggtcgttcaggtggtgggtttggtcggtcaggcggcggcggaggtggtggatttggcgattcagggtttggccgatcaggtggtggtggtggattcggtgattcagggtttggccgatcaggtggtggtggaggtggattcggctcaagtggtgggtttgggagttctggttcagggcggtctggcgggtttggtagcaactctggtagctctggctctagctggggtggattcggcagctttggaggcaaaagctcttgattgatcaaccccccatagcccagcaaatttttggttggagcggaaggcaaccgggttaaccggttcagcttgatggttcttatatatggaaagccctctgtcagaagaggtaaattaacatggtctgattcttgttgggtagtacaaggttgaatttctagcgtggacaacatacgcttatattgcctggagccgccaactttgaaggcagctggaaataatcacgaggctttcttctttttccgtttcctggtgcaagctatttgcagcagggttccttgtaaaatatatgcagtgtgccttgtcttctgcggatcacaatatatatctgtttctttagtagtagtttttgtattgtattatcaagctttttgtggaccttatctaatggccagaactagtctctagaagcaaatgttaagatctatgcatctgataccatgactaattattgctaatcgctaaggcttggggcgtgtaaaccatctctgctctgttggctataggacttatgctatacattgcatccgagttaaaaccaagaataaagatgttgtgtggcttgnaaaaaaaaa

SEQ ID NO: 29258 - DNA, 833 bp, Triticum aestivum
  unsure (1)..(833): unsure at all n locations
  Clone ID: PAT_TA_29258
ggccccctttgacctcttcgacaacaagaagaaggccaacaacatcaagctgtatgtgcgccgtgtcttcatcatggacaactgtgaggagttgatccctgagtacctgagctttgtcaagggcattgttgattcagaggaccttcccctgaacatctcccgtgagaccctccagcagaacaagatcctcaaggtcatcaggaagaaccttgtcaagaagtgcattgagctcttctttgagattgctgagaacaaggaggactacaacaagttctacgaggccttctccaagaacctcaagcttggcatccacgaggactcccagaacaggaccaagattgctgagcttctgaggtaccactccaccaagagtgggtgatgagctgacgagcctcaaggactatgtgactaggatgaaggagggacagaacgagatctactacatcaccggtgagagcaagaaggctgtggagaactctcccttccttgagaagctgaagaagaagggctatgaggtcatctacatggttgacgccattgatgagtatgccattggtcagctcaaggaagttgagggcaagaagcttgtctctgcaccaaggagggtctgaagctcgatgagagcgaggacgagaagaagaagcangaggagctcaaggagaagttcgaggggctgtgcaaggtcattaaagaagtgcttggccgacaaggtggagaaaggcattggcttctgaccgtgttgtggacctcccttggttgcttgtgaactggcgaatatgggttgaccccccacatggaaaggatcatgaagggcccaggcttgaagggactca

SEQ ID NO: 29259 - DNA, 1076 bp, Triticum aestivum
  Clone ID: PAT_TA_29259
tttcttgctcgccacagcttcgtcaaagacacgcggaaaagaagaggaagggggaggcgactcgaccgaggcccggtttcgatctctggtcctccgattgcgtccagatctaccagcaatggcatcatcttcggacccatggatgaaggaatacaatgaagcatccagacttgctgatgacatcagttccatgattgccgacagagggtctcttccacaatcaggcccagaaattatgcggcatacttcagccattcggagaaaaataactattcttggtactagactggatagcttgggagtcattgtttgggcaagaattcctccaaagtcaatcactgacaaggagatgcataaacgccaagacatgctttctagtttgaagtctaaagccaagcagatggcgacaatttcaacatgtcaaacttcgctaacaaggaagatctgcttggtcaaagttaaaaggcagatgacatgagcagagttgccgggttagataaccaaggaattgttggccttcagaggcaaattatgaaagagcaagatgagggtcttgagaagctggaagagacagtgctgagcacaaagcatattgcgttagcagtcaatggaagaacttaccctgcacacaagattgatagatgacccttgaagatcatgttgatattacaaattcacgtcttcagcgtgtgcaaaagaggcttgcaattctgaacaagcgcaccaaaggtggctgctcatgcatgtgcctgcttctatctgttgtcgccatcgtgattcttgcagtcatagtttggcttctcgtcaagtatctgtaaaggaaagaaagaagcagccggcctaccctgcagacctcactcgaaatgacccttatgtgtgtgcagccttcgcttaaaaagtcccttctgtgttactaccattgaaatgtgcatccctttgaaaataatatatatacggtggtttcatcttccctttcgtgagtggaatggttatggagtaatgtacattacatcgaatttgacacatacatgatcatcatctgcatcttgtgtaaaaaaaaaaaaaaaaaaaactcg

SEQ ID NO: 29260 - DNA, 1330 bp, Triticum aestivum
  Clone ID: PAT_TA_29260
ttttttttttttttttttttttttttttttatatgaacatcaatacatatattcaccactcaccagtatacagaacacagagtagtttcactaccttcagagtttagtacctttgcagcctgcgaggcatgcacatatgtcaggtatgcaacagccagtgttcgttactatacataaaggccctgctttggtgtgaatctccgggccacacggcatccacacatctggccgcctcgctgggcaagcgggcatctggttattcgagcactctagacttgcagtgcttcgtaccgccgatgtctgaacttgaagagctagagctagaaacctctgaagagtgcatggttccctttcaagttcaaccctgtgcctgtgagaacgctcaccaaggctttgtcacatcttcctggagttcagaaatggtgccaatccgagctgctgtcctaggccgcatgacactgcgcctctagccaccatgtcttctgccatttttaccttgattcttaaggtctctacatctgatttgaggatcctgttgtcagtgaccgcggtggtgaactgctgatttgcctctgtcagttgcttgaagagggttgcactttcacttttaagttgctcgacctgcaactcaaggtcagtcagctgcgcatgcttcctcctcctggaccgtcgagctgactccctgttggacaccatccttcttattcgcctggtatctgatgatttgccgctccgcttgcatcggccgccctgaatctcgaccaatgactcgctgtcagagtccgactcggtttcgagagcctggttccctgagattgtttctttagtgtcgaagttcgatggttttggcacgtttagctgtatcggttttgtcttttggctggccaaacattaagcgcggttagctgtttgtggtactcgtggaacagttcgttattgttggttctacaatatgtgttagctatatttttatattcaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaggggggggccgttttaaagaacccaattttactacccggggctggcaaggaaaaattttttttttggggcccccaaaataaaatccctgggccgggttttaaaaacgtgggaatgggaaaaccctgggggttcccaaattaaatcgcttggaaaaaaatccccttttccccagtgggggaaaaaccaaaaaggccccaccgaatcccctttccaaaaattggcccaccctaatgggaaaagggaccccccct

SEQ ID NO: 29261 - DNA, 689 bp, Triticum aestivum
  Clone ID: PAT_TA_29261
ctcgaggggatgctcgccaggcttccccccaaatccatcacggacaaggagctgcataagcgccgagacacgctttcaaatttgaaatctagagcaaaacagatggcagaaagtttcaacatgtcgacctttgccaacagggaggatttgcttggtcagagcaagaaagctgctgatgacatgagcagagtagccgggttggataaccaagggattgttggccttcagaggcaaatcatgaaagaacaagatgagggtcttgagaagctggaacagacggtgctgagcacaaaacacattgcgctagcagtcaatgaggagcttgacctgcatgcaagactgattgatgacctagacgaccatgtggatggtacgaactcgcgtctccagcgtgtgcaaaagaggcttgcggttctgaacaagcgcgccaagggcggctgctcctgcatgtccctgctgctgtccaccgtcggtatagtgatgcttgtggttattgtttggctcctcatcaagtatctgtaacctctgcccaactcaaatcagtttcaagtgtgcagctctttcaaagatagtatggttacttccgcttcgccatcattttggcgagaaatggaaaatatgtatgccacatgtgcccttatcgggctgaaatgtgaagttcaaacttttgtaaaaaaaaaaaaaaaaaa

SEQ ID NO: 29262 - DNA, 763 bp, Triticum aestivum
  Clone ID: PAT_TA_29262
ggtttcgtcaactcttcaagcagaggtggcgggtttggtgattccgggttcggtcgttcaggtggtgggtttggtcgttcaggcggcggcggcggatttggcgattcagggtttggccgatcaggtggtggtggaggatttggctcaagtggtgggtttggggattctggttcagggcggtctggtgggtttggtagcggctctggtagctctggctctagctggggtggattcggcagctttggaggcaaaagctcttgattgatcaaccccccatagcccagcaaatttttgattggagcggaaggcaacccgggtaaccggttcggcttgatggttcttatatatgggaagtcctcttgtcacaagaggtaaattaacatgtctgattcttgttgggtagtacaaggtcgaatttctagcgtggacaacatcggcttatattgcctggagctgccaactttgaaggcagctggaaataatcacgaggctttcttctttttccgtttcctgctgcaagctatctgtagcagggttccttgtaaaatatatgcagtgtgtcttgtcttctgcggatcacaatatatatctgttttttagcagtagtttttgtattgtattgtcaagccttttgtggaccttatctaatggaccagaacaatagtctctagaagcaaatgttgagatctatgcatcagataccatgactagttattgctaagaggtaatagcaccccaggtccttatacttgcatgtcaggtg

SEQ ID NO: 29263 - DNA, 882 bp, Triticum aestivum
  unsure (1)..(882): unsure at all n locations
  Clone ID: PAT_TA_29263
ctgccccctttcgctgatcgctggggcctcacaatcaatcggctactcccctctcctctcgcgcgtggcgaattcccctctccctctctcacgctgcagcgaccccggaggcgacgtcggcggccacagcttgccgaaatggcatcatcttcggacccatggatgaaagagtacactgaagcatctaagcttgttgatgatataagctccatgattgccgatagaagttctcttccacaatcaggccccgaaattatgcgccacacatcagccatccggagaaaaataaccattcttgggactagactggatagcttggtgacattgttgtccaggattcctccaaagtcactcactgacaaggagatgcataagcgccaagatgcactttccaatttgaaatctaaagcaaaacagatggggacaagtttcaacgtgtcaaactttgccaacagggaggatttgcttggtcagagtaagaaagcagctgatgatatgagcagagttgctgggttagacaaccaaggaattgttggccttcagaggcaagttatgagagaacaagatgagggcctcgaaaggctggaggagacagtcctgagcacaaaacatattgcattagcagtcaatgaagaacttactctgcatacaagattgattgatgacttggaagacatgttgaccgtacaactccctcttaagctgtgcaaagagcttgcaanctgaaaagcgcccaaaggggctgctatgctgtcctaagcttttgtgttgctatgctgtccggtatcgtggctttaatagaccttaaaacgcctgcaacgtgtcaccattttggttatccttgtaatgggatccttagatttcaaggtcatgggcttttta

SEQ ID NO: 29264 - DNA, 866 bp, Triticum aestivum
  Clone ID: PAT_TA_29264
ctcgtgccgaattcggcacgagctgatcgctggggcctcacaatcaatcggctactcccctctcctctcgcgcgtggcgaattcccccctccctcccgcacgcggcagcgaccccggaggcgacgtcggcggccacagcaggcttctcgccgcaatggcatcatcttcggacccatggatgaaagagtacactgaagcatctaagcttgttgacgatataagttccatgattgccgatagaagttctcttccacaatcaggccctgaaattatgcgccacacatcagccattcggagaaaaataactattcttgggactagactggatagcttggtgacattgttgtccaggattccgccaaagtcactcactgacaaggagatgcataagcgccaagatgcactttccaacttgaaatctaaagcaaaacagatggggacaagtttcaacgtgtcaaactttgccaacagggaggatttgcttggtcagagtaagaaagcagctgatgatatgagcagagttgctgggttagacaaccaagggattgttggcctccagaggcaagttatgagagaacaagatgagggtctcgaaaggctggaggagacagtcctgagcacaaaacatattgcattagcagtcaatgaagaacttactctgcatacaagattgattgatgacttggaagatcacgtcgacgttacaaactcccgtcttcagcgtgtgcaaaagaggcttgcaattctgaacaagcgcgccaaaggtggctgctcatgcatgtgcctaatgctctctgttgctgccatagtgctgctcgcggttatcgtttggcttctcatcaagtacctcggccgcgaccacgcta

SEQ ID NO: 29265 - DNA, 1127 bp, Triticum aestivum
  Clone ID: PAT_TA_29265
ggcgctttaatactttgattgccactgatgttgctgtcgtggtggatttccaaatgttgatctggatcctatgaattgcaaacaattagagatattcgttcacaggtctggccgtactggccgtgctgggaagaagggcactgcaattgtgatgtacagctacaaccaaagtagagctgtcaggggcattgagaatgacgttggaggcaagtttaaggagcttccaaagatcaacgttgaaggttctgacttgacaatggctagtggttatgattcattcggaggtggaggcggaggtgggcgctcacgcggtggcggtttcggtggccgcgattctgggtttggtcgttcaggtggtgggtttggtcgttcaggcggcggcggcggatttggcgattcagggtttggccgatcaggtggtggtggtggattcggcgattcagggtttggccgatcaggtggtggtggaggtggatttggctcaagtggtgggtttggggattctggttcagggcggtctggtgggtttggtggcggctctggtagctctggctctagctggggtggattcggcagctttggaggcaaaagctcttgattgatcaaccccccatagcccagcaaatttttggttggagcggaaggcaaccgggttaaccggttcagcttgatggttcttatatatggaaagccctctgtcagaagaggtaaattaacatggtctgattcttgttgggtatttcaaggtcgaatttctagcgtggacaacatacgcttatattgcctggagccgccaactttgaaggcagatggaaataatcacgaggctttcttctttttacgtttcctgccgcaagctatctgcagcagggttccttgtaaaatatatgcaatgtgtcttgtcttctgcggatcacaatatatctgtttttttagcagtagtttttgtattgtattgtcaagccttttgtggaccttatctaatggccagaactttagtctctagaagcaaatgttaagatctatgcatcagataccatgactagttattgctaaaaaaaaaaaaaaaaaactcgagactagttctctcacctcggccgcgactacgctaatccgaattcccgcgg

SEQ ID NO: 29266 - DNA, 2109 bp, Triticum aestivum
  Clone ID: PAT_TA_29266
cagttgggcgtcggtttatactcggcctacctggtcgccgatagagttgtcgtgaccaccaagcccaactatgacgagcagtacgtgtgggagtcccaagcgggcgggtcgttcactgtaactcgtgacacgtcaggggagcagcttggcaggggcactaagatcacactgttccttaaggacgatcagctggagtaccttgaggagcgtcgcctcaaggatctggtcaagaagcactctgagttcatcagctaccccatctccctgtggaccgagaagaccaccgagaaggagatcagcgacgacgaagacgatgattctgcagaaaagaaggagggcgaggtcgaggaggtcgacgatgacaaggacaaggacgagagcaagaagaagacgaagaaggtgaaggaggtgagccacgagtgggcgcagatcaacaagcagaagcccatctggctgcgcaagccggaggagatcagcaaggaggagtacgcgtccttctacaagagcatcaccaacgactgggaggaccacctcgccgtgaagcacttctcggtggaggggcagctggagttcaaggcggtgctcttcgtgccccgccgcgcccccttcgacctcttcgacacccgcaagaagatgaacaacatcaagctctacgtgcgccgcgtcttcatcatggacaactgcgaggagctcatcccggagtggctgggcttcgtcaagggcgtcgtcgactcggacgacctccccctcaacatctcccgcgagacgctgcagcagaacaagatcctcaaggtcatccgcaagaacctcgtcaagaagtgcatcgagctcttcttcgagatcgccgagaacaaggaggactacgccaagttctacgaggcattctccaagaacctcaagctgggcgtgcacgaggactcccagaaccgagccaagctcgccgacctgctccggtatcactcgaccaagagcggcgacgagctcaccagcctcaaggactacgtcacccggatgaaggagggccagaaggacatctactacatcaccggcgagagccgcaaggccgtggagaactcgcccttcctggagcgcctcaagaagcgcggctacgaggtgctcttcatggtggacgccatcgacgagtacgccgtggggcagctcaaggagtacgacggcaagaagctcgtctccgccaccaaggagggcctcaagctcgacgaggagaccgaggaggagaagaagcgcaaggaagaaaaaaaggcggcgttcgagggcctctgcaagatcatcaaggacatcctgggcgacaaggtggagaaggtggtcgtatccgaccgcatcgtggactcgccgtgctgcctggtgaccggcgagtacgggtggacggccaacatggagcggatcatgaaggcgcaggcgctgagggacagcagcatgggcgcatacatgtcctccaagaagacgatggagatcaacccggagaacggcatcatggaggagctccgcaagcgcgccgacgccgacaagaacgacaagtccgtcaaggacctcgtgatgctgctcttcgagacggcgctgctcacctccggcttcagcctcgacgaccccaacaccttcgccgccaggatccaccgcatgctcaagctcggcctcaacatcgatgatcaggatgccgaggaggaggatgccgacatgcccgcgctggaggaggagggcgccgaggagagcaagatggaggaggtcgactgaagattgaagaagagtctcatttccttgcaacccaggagaagaagatgagcagtgtcgtgtctgtccatgggtgagtgagttctagtggttgttggtcgctgcgtgtctagctggagtgtcagtgtcgttcttgtttcattctcgggtcaaatatcagtgtcactttgtgtgttttggggatgtatgagatgtgagaaccggagggagttcgtccccctgtggtcgaattttgaaggaaaaacaggagtttaaaagtctgcaaatgttttgccttcttttctgatgctttagaactgaaactgcctctgataaaattcggagataattaatcaaaaaaaaaaaaaaaaaactcgagactag

SEQ ID NO: 29267 - DNA, 917 bp, Triticum aestivum
  Clone ID: PAT_TA_29267
aagcccactccccccgaccagcagcggcggcgaccccctcccctcctccttccccaaatcgaacccggcgccccccgtccccggcgaccccgcgactccggccggccatgtcgatcttcgagtacaacggctccgcggtggtggcgatggtggggaagaactgcttcgccatcgccagcgaccgccgcctcggcgtgcagctgcagaccgtcgccaccgacttccagcgggtcttcaagatccacggcaagctctacatcggcctctccggcctcgcctccgacgcccagacgctgtaccagcggctcgtgttcaagcacaagctgtaccagctgcgggaggagcgcgacatgaagcccgagaccttcgccagcctcgtctcctccatgctctacgagaagagatttgggccgtacttctgccagccaattattgctggacttggacaggatgacgagccatttatttgtaccatggactgcattggtgcaaaggaacttgctaaggattttgttgtctcagggacagcatcagagtccctatatggtgcttgtgaatccatgtacaaacccaacatggaacccgaggaactcttcgagaccatatcacaagccctgttgtcttcagttgatcgcgattgcctcagtgggtggggaggctatgttctaattgtgacaccgaccgaagttcaagagcgggtgctcaagggcaggatggactagattatgcatggcctagaattcgtcagccgctttccgatgcttctacgcatgctgtttcagcatccctgttgtgccctggttccagagtaaccttgtactgtcaaactgatggtgttatatttgcccgtagaaaagaacatttgttgtcttcttatttctgctttctatcaatggtgagacatctctgtcacgtgc

SEQ ID NO: 29268 - DNA, 1596 bp, Triticum aestivum
  Clone ID: PAT_TA_29268
tcccttctctgaaacatgtacggtcgctgatgcttgacgtgctaccattcttgtagttgctagcagaagcagagcagcccactggtcatggtggtgctattcttgtagtcatagtttcacttgtactaaggccgagtttagtcaatgccactatgccagttaatctttgtcatgatgattagttgatgaaccacccaggattatccatgatgagccgcagatgtctggatgaagcgcgtaatgatggaataccttgaggagcaccccatctccctgtggactgagaagagcaccgagaaagagcagttcggtgtcggtttctactccgcctacctcgtcgccgagagggttgtcgtcaccaccaagcacaacgacgacgagcagtacgtgtgggagtcccaggccggtggctccttcaccgtcactcgtgatacgtctggggagcagctcggcaggggtaccaagatggtcctctacctcaaggacgaccagatggaataccttgaggagcgccgcatcaaggatctagttaagaagcactctgagtttatcagctaccccatctccctgtggactgagaagaccaccgagaaggaaatttctgatgatgaagatgaggaggagaagaaggatactgaggagttcaaggttgaggatgttgatgaggagaaggaagagaaggaaaagaagaaaaagaagatcaaggaagtctctcacgagtggaacttggtcaacaagcagaagccgatctggatgaggaagccagaggagatcaacaaggaagagtacgctgctttctacaagagcttgaccaatgactgggaggagcatttggctgtcaagcacttctctgttgagggtcagcttgagttcaaggctgtcctgtttgtgcccaagaaggcccccttcgacctcttcgacaacaagaagaaggccaacaacatcaagctgtacgtgcgccgtgtcttcatcatggataactgtgaggagttgatccctgagtacctgagctttgtcaagggcattgttgattcagaggaccttcccctgaacatctcccgtgagactctccaacagaacaagatcctcaaggtcatcaggaagaaccttgtcaagaagtgcattgagctcttctttgagattgctgagaacaaggaggactacaacaagttctacgaggccttctccaagaacctcaagcttggcatccacgaggactcccagaacaggaccaagattgctgagcttctgaggtaccactccaccaagagtggtgatgagctgacgagcctcaaggactatgtgaccaggatgaaggagggacagaacgagatctactacatcactggcgagagcaagatggaggaggtcgactaagcgccaaggctgcctgtcggctgtcgtcgtcagatgtccatgccctgcaccgcctagttgtttttatcttagtgtcgacgttggatggttttggcacgttttagctgtatcggttttgtcttttggctggccaaacattaagcgcggttagctgtttgtggtactcgtggaacagttcgttattgttggttctacaatatgtgttagttattatatttc

SEQ ID NO: 29269 - DNA, 750 bp, Triticum aestivum
  Clone ID: PAT_TA_29269
acttcaagaggggccgatccccaccgccgtcgcacagaccacaacatctcgagtagtttccagctcgccggaaagcagcaagcaagatggccggcaggaagggcggcgacaggaagaaggcggtgacccgctccgtgaaggccgggctccagttccccgtcggccgcatcgggcgctacctcaagaagggccgctacgcccagcgcgtcggctccggcgcccccgtctacctcgccgccgtcctcgagtacctcgccgccgaggtgctggagctcgccggcaacgcggccaaggataacaagaagacccgcatcatcccgcgccacctgctgctcgccgtccgcaacgaccaggagctcggcaggctgctcgccggcgtgaccatcgcccacggcggcgtgatccccaacatcaactccgtgctgctccccaagaagtcccccgccgccgccgagaaggaggccaagtcgcccaagaagaagagcaccaccaagtccccaaagaagaaggtcgccgccaaggagtagccgtccccatagcctagccagtgttgcttagatccaattctcatggactaagatgagatcctgtatgtaatgcctggtagtctgtagttcccgtcagattcgtcgagcaagtatgacattgtatctgtgatttctgtgacaatgtcgaaagatgcaatcatttcaatcttgtactgcgaaattctctcttccagcatccgaaattttccgttgaaaaaaaaaa

SEQ ID NO: 29270 - DNA, 787 bp, Triticum aestivum
  Clone ID: PAT_TA_29270
agggaagaatggtggtggctgaacaaactcagagcattcccatccagcgcaaccgccgccaacaccactcctcgagagtcctcgccgccggagaagtagcacgcaggatggccggaaggaagggcggcgacaggaagaaggcggtgacccgctccgtgaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagctcgccggcaacgcggccaaggacaacaagaagacccgcatcatcccgcgccacctgctgctcgccgtccgcaacgaccaggagctcggcaggctgctcgccggcgtcaccatcgcccatggcggcgtgatccccaacatcaactccgtgctgctccccaagaagtcccccgccgccgccgagaaggaggccaagtcgcccaagaagaagacgtccaccaagtcccccaagaagaagaccgccgccaccaaggagtaaccgcccccatagcctagccagtgttgcttagatccatttctcatggactaagatgagaccctgtatgtaatgcctgctagtctgtgatttcgtcgagcatgggtgacattgtacctgctagtcatggactaagatgagatccaatcatttcagtctgttgttctatctatggctgcagtcattccaatctcttgttctacctatggctgcaattgatcttgcgaatgcttgctccc

SEQ ID NO: 29271 - DNA, 770 bp, Triticum aestivum
  Clone ID: PAT_TA_29271
gctccgatccagcgcaaccgccgccaacaccacaccccgacaatccccgtcgccgaagaagtagcaagcaagatggccggaaggaagggcggcgacaggaagaaggcggtgacacgctccgtcaaggccgggctccagttccccgtcggccgcatcgggcggtacctcaagaagggccgatacgcccagcgcgtcggatccggcgcccccgtctacctcgccgctgtcctcgagtacctcgccgccgaggtcctggagctcgccggcaacgcggccaaggacaacaagaagacccgcatcatcccgcgccacctgctgctcgccgtccgcaacgaccaggagctcggcaagctgctcgccggcgtcaccatcgcccacggcggcgtcatccccaacatcaacgccgtgctgctccccaagaagtcccccgccgccgccgagaaggaggccaagtcgcccaagaagaagacctccaccaagtcccccaagaagaagaccgccgccaccaaggagtaaccgcccccatagcctggccagtgttgcttagatccatttctcatggactaagatgagaccctgtatgtaatgcctgctagtctgtagtgcccgtcagattcgtcgagcaaggatgatattgtatctgtgatttctgtgacaatggcgaaagatgcaatcatctcaatcttgtactacgaaattctctcttctagcatctgtaatttgagccatttatctaatcaagctgcgagaaattgaatctaaaaaaaaaa

SEQ ID NO: 29272 - DNA, 1421 bp, Triticum aestivum
  Clone ID: PAT_TA_29272
cgtccgcgccgcttttcttttcgtcgccggatacacaaccgaagccgccgcgctccgccgcctcctctcgctccgcctccgcctccgccgtctgttgcatccctgccggccatgtcgatcttcgagtacaacgggagcgccgtggtggcgatggtggggaagaactgcttcgcgatcgccagcgaccggcgcctgggcgtgcagctgcagaccgtcgccaccgacttccagagggtgttcaagatccacggcaagctgtacatcggcctctccggcctcgccacggacgcccagacgctgtaccagcggctggtgtttaagcacaaactgtaccagcttcgggaggagagggacatgaagcccgagaccttcgccagcctcgtctccgccctcctttacgagaaaaggtttgggccatacttctgccaaccaattattgccgggctaggtgaaaaggatcagccatttatatgtaccatggactgcattggtgctaaggaactggcaaaagattttgtggtttctggtactgcttcggaatcactatatggtgcttgtgagtccatgtacaaaccagacatggaacccgaagaactatttgagaccatctcacaagcattgctgtcttctgttgatcgtgattgcttgagtggttggggaggttatgttcttattgtaacgcccactgaagttcaggagagagtgcttaaggggagaatggactgatttcgcaacacctacagtcctagttcacacatgagattgttcaacctaaaacccgtgtgatctactctttctgtctgtgctcaagcacttctttgttcgatgctacaacttggaatttaacatgccactgaaatctgaaattgagatcatgtgtgcctgtgcactttgttccagaattgcagcctccagtctgagcaggcttttgttttgcctgttgaaactggatatgatatgtctctgtgccttttttttttagatcagtactgcgcctattcttctgacgacctatattatgcattttgacttgtattgcggcagcgccttgtataggaatgaaacatgctctgacatatttcccatttttgcatcacaccggtgcacactaatatagtattgccatatcctaatcccatgtacccatcacttgccttatctcctcaagatatactagtagaaaatgagatctcccacacgaacggcgatcttccgttgcgtcagccgaccagtgttttcgccggcgcgccggaagcaaagcacgtaaagaaaccactgcctgcatgcatgtcaacttaagggacttttgtaagatgacatgtagcggtacgtcgcggtcacctgacatgtacagccatccgctcaaatcatgtcattgcctgatcaattcctacaagaattttttacacggcacacataac

SEQ ID NO: 29273 - DNA, 953 bp, Triticum aestivum
  Clone ID: PAT_TA_29273
gcttttctttccgtcgccggatacacaaccgaagccgccgcgctccgccgcctcctctcgctccgcctccgccgtctgttgcatgccctgccagccatgtcgatcttcgagtacaacgggagcgccgtggtggcgatggtggggaagaactgcttcgcgatcgccagcgaccggcgcctgggcgtgcagctgcagaccgtcgccaccgacttccagagggtgttcaagatccacggcaagctgtacatcggcctctccggcctcgccaccgacgcccagacgctgtaccagcggctggtgtttaagcataaactgtaccagcttcgggaggagagggacatgaagcctgagaccttcgccagcctcgtctccgccctcctctacgagaaaaggtttgggccatacttctgccaaccgatcattgccgggctaggtgaaaaagatcagccatttatatgtaccatggactgcattggtgccaaggaactggcaaaagattttgtggtttctggtactgcttcagaatcattatatggtgcttgtgagtccatgtacaaaccagacatggaacctgaagaactatttgagacaatctcgcaagcattgctgtcttctgttgatcgcgattgcctgagtggttggggaggttatgttcttattgtaacgcccactgaagttcaggagagagtgctaaagggaagaatggactgatttcgcaacacctgtagtcctagatcacctaggagattgttccttcatattcgacctgaaacctgtgtgagtctactctttatgtgctcaagcacttctgtgttctaccataccacttggattttaacatgccactgaaatctgaaattgaaatcatgtgtgcctgtgcactttgtttcagaattacaacctctagtctgggcaggcttttgtatggcctgttgacactgggtgccgaatcg

SEQ ID NO: 29274 - DNA, 762 bp, Triticum aestivum
  Clone ID: PAT_TA_29274
gccggccgggttgcggaaactcagagcattcccatccagcgcaaccgccgccaacaccactcctagcgagtcctcgccgccggagaagcagcaagcaagatggccggaaggaagggaggcgacaggaagaaggcggtgaccaggtccgtcaaggccgggctccagttccccgtcggccgcatcgggcgctacctcaagaagggccgctacgcgcagcgcgtcggctccggcgcccccgtctacctcgccgccgtcctcgagtacctcgccgctgaggttctggagcttgccggcaacgcggccaaggacaacaagaagacccggatcatcccgcgacacctgctgctcgccgtccgcaacgaccaggagctcggaaggctgctcgccggcgtcaccatcgcccacggcggcgtgatccccaacatcaactccgtgctgctcccaaagaagtcccccgccgccgccgagaaggaggccaagtcgcccaagaagaagaccaccgccaagtcccccaagaagaaggtcgccgccaccaaggagtagccgcccccatagcctagccagtgttgcttagatccattcctcatggactaagatgagatcctgtatgtaatgctctgtagtgcccgactgcccgttagtttcgtcgagcaaggatgacattgtatctgtgatttctatgacaatggcgaaagatgcaatcatttcaatctcgtactgcaaaattctctcttctacaaaaaaaaaaaaaaaaaggcccta

SEQ ID NO: 29275 - DNA, 701 bp, Triticum aestivum
  Clone ID: PAT_TA_29275
gcgatctagcaccgccgccgcaaacaccacacctcgagagtcctcgtcgccggagaagtagcagcaagcaagatggccggaaggaagggcggcgacaggaagaaggcggtgaccaggtccgtcaaggccgggctccagttccccgtcggccgcatcgggcgctacctcaagaagggccgctacgcgcagcgcgtcggctccggcgcccccgtctacctcgccgccgtcctcgagtacctcgccgcagaggtcctggagctcgccggcaatgctgccaaggacaacaagaagacccgcatcatcccgcgccacctgctcctcgccgtccgcaatgaccaggagctccgcaggctgctcgccggcgtcaccatcgcccacggtgggcgtgatccccaacatcaactccgtgctgctccccaagaagtcccccgccgccgccgagaaggaggccaagtcgcccaagaagaagacggccgccaagtcccccaagaagaagaccgccgccaccaaggagtagcccgtcgtccccatagcctagccattgttgcttagatccatttctcatggactacgatgagatcctgtatgtagtgtcttgtagtcttctgtgcccatcagattcgtcgagcatgggtgacattgtacctgtgatttctgtgacaatggcgaaagatgcaatcacttcaatcttaaaaaaaaaa

SEQ ID NO: 29276 - DNA, 747 bp, Triticum aestivum
  Clone ID: PAT_TA_29276
cacgcgtccgcccatccagtgcaaccgccgccaacaccactcctcgagagtcctcgccgccggagaagcagcaagcaagatggccggaaggaagggcggcgacaggaagaaggcggtgaccaggtccgtcaaggccgggctccagttcccggtcggccgcatcgggcgctacctcaagaagggccgctacgcgcagcgcgtcggctccggcgcccccgtctacctcgccgccgtcctcgagtacctcgccgccgaggtcctggagctcgccggcaacgcggccaaggacaacaagaagacccgcatcatcccgcgccacctgctgctcgctgtccgcaacgatcaggagctcggcaagctgctcgccggcgtcaccatcgcccacggcggtgtgatccccaacatcaactccgtgctgctccccaagaagtcccctgccgccgccgagaaggaggccaagtcgcccaagaagaagacggccgccaagtcccccaagaagaagacggccgccacgaaggagtagccgtcgtccccatagcctagccattgttgcttagatccatttctcatggactaagatgggatcctgtatgtagtgcctgctagtctgtagtgcccgtcagattcgtcgagcaagggtgacattgtacctgtgatttctgtgagaatggcgaaagatccaatcatttcagtgtgttgttctatctatggctgcaatgatttcaatcccttgttctaaaaaaaaaa

SEQ ID NO: 29277 - DNA, 973 bp, Triticum aestivum
  Clone ID: PAT_TA_29277
cccacttcccccgatcagcagcagcggcgaccccctcccctcctccttcccccaatcgaactcggcggcccccgttccggcgactccggccatgtcgatcttcgagtacaacggctccgcggtggtggcgatggtggggaagaactgcttcgccatcgccagcgaccgccgcctcggcgtgcagctgcagaccgtcgccaccgacttccagcgggtcttcaagatccacggcaagctctacatcggcctctccggcctcgcctccgacgcccagacgctgtaccagcggctcgtgttcaagcacaagctgtaccagctgcgggaggagcgagacatgaagccagagaccttcgccagcctcgtctcctccatgctctacgagaagagatttgggccatacttctgccagccgattattgctggacttggacaggacgacgagccatttatttgtaccatggactgcattggtgcaaaggaacttgctaaggattttgttgtctcagggacagcttcagagtctctatatggtgcttgtgaatccatgtacaaaccaaacatggaacctgaggaactcttcgagaccatatcacaagctctgttgtcgtcagttgaccgtgactgcctcagtgggtggggaggctatgttctgattgtgacaccgaccgaagttcaagagcgagtgctcaagggcaggatggactagattatgcatggcctagagttcgtcagctgctttccgatgcctgtacgattgctgtttgaatatccctgttgtgccctggttccgaagcgaccttgtactgtgaaaatcgatgatatttgtccgtagaaggaacatttgttttcttttatttatactgtctatgcttttatattatatcaatggcgagacatctctgtcgtgtcgtccgtcagaccctacggcgaaacacatgggatcgtcattttctctaaaaaaaaaaaaaaaaaa

SEQ ID NO: 29278 - DNA, 710 bp, Triticum aestivum
  Clone ID: PAT_TA_29278
acgaattcagagcgctccgatccaccgccgccgccgcgtacaccacacctcgagagtcctcgtcgccggagaagtagcaagcaagatggccggaaggaagggcggtgacaggaagaaggcggtgacccgctccgtcaaggccgggctccagttccccgtaggccgcatcgggcgttacctcaagaagggccgctacgcccagcgcgtcggctccggcgcccccgtctaccttgccgccgtcctcgagtacctggccgccgaggtcctggagcttgccggcaacgcggccaaggacaacaagaagacccgcatcatcccgcgccacctgcttctcgccgtccgcaacgaccaggagctcggcaagctgctcgccggcgtgaccatcgcccacggcggcgtcatccccaacatcaactctgtgctgctccccaagaagtccccggccgccgccgagaaggaggccaagtcgcccaagaagaagacggccaccaagtcccccaagaagaaggtcgctgccaccaaggaatagccgcccccataacctagttggtgttgcttagatccatttctcatggactaagatgagatcctgcatgtaatgcctgctagtctttagtgtctgtcagattcgtcgagcaaggatgacattgtacctgtgatttctgtgaggatggctaaagatgcaatcatttcagtctaaaaaaaaaaaa

SEQ ID NO: 29279 - DNA, 1173 bp, Triticum aestivum
  Clone ID: PAT_TA_29279
gtgactaaagggaacaaaagctggagctccaccgcggtggcggccgctctagaactagtggatcccccgggctgcaggaattcggcacgagccgcacccgggtcgaacagcaggggactccggtccggcggcaccgaaccgaacgcctcttcttcatcttgctccgcaagaagcccaccccggccgcataagcccacttcccccgaccagcagcggcggcgaccccctcccctcctcctccttcccccaatcgaactcggcggcccccgttccggcgactccggccatgtcgatcttcgagtacaacggctccgcggtggtggcgatggtggggaagaactgcttcgccatcgccagcgaccgccgcctcggcgtgcagctgcagaccgtcgccaccgacttccagcgggtcttcaagatccacggcaagctctacatcggcctctccggcctcgcctccgacgcccagacgctgtaccagcggctcgtgttcaagcacaagctgtaccagctgcgggaggagcgcgacatgaagcccgagaccttcgccagcctcgtctcctccatgctctacgagaagagatttgggccgtatttctgccagccaattattgctggacttggacaggatgacgagccatttatttgtaccatggactgcattggtgcaaaggaacttgctaaggattttgttgtctcagggacagcatcagaatctctgtatggtgcttgtgaatccatgtacaaaccgaacatggaacccgaggaactcttcgagaccatatcacaagccctgttgtcgtcagttgatcgcgattgcctcagtgggtggggaggctatgttctaattgtgacaccgaccgaagttcaagagcgaattctcaagggcaggatggactagattatgcatggcctagaattcgtcagccgctttccgatgcttctacgcatgctgtttcgacatccctgttgtgccctggttccgaagtaaccttgtactgtcaaactgatgatgttaatatttgcccgttagaaagaacatttgttgtcctcctaattctgctttcctatcaaatggtgagacatctccgtcacgtgctccgtcgccccttgacggtgaaacatatggaattgtcattttctctaaaaaaaaaaaaaaaaaaaaaaaaaaac

SEQ ID NO: 29280 - DNA, 1579 bp, Triticum aestivum
  unsure (1)..(1579): unsure at all n locations
  Clone ID: PAT_TA_29280
aactaatggacagaggacaattcacttggttatacatgaacgtcaatacatatattcaccactcgccagtatacagaacacagagtagttccactaccttcagagtttagtacctttgcagcctgcgaggcatgcacgtatgtcaggtatgcaacagccagtgttcgttactatacataaaggccatgttttggtgtgaatctccgagtcacacgacatccacacatctggccgcctcgctgggcaagcgggcatccggttattcggagcactctagacttgcagtgcttcgtgccgtctatgtctgaacttgaagagatagagctagaaacctctgaagagtgcatggttccctttcaagttcaaccctgtgcctgtgagaacgctcaccgaggctttgtcacatcttcctggagttcagaaatggtgccaatccgagctgctgtcctaagccgcaggacaccgctcctctagctaccatgtcttctgccatttttaccttgattcgtaaggtctctacatctgatttgaggattctgttgtccgtgactgcggtggtgaactgctggttggcctctgtcagttgcttgaagagggttgcactttcgcttttaagttgctcgacctgcaactcaaggtcagttagctgcgcgtgcttcctcctcctggaccgtcgagctgactccctgttggacaccatccttcttattcgccttgtatctgatgatttgccgctccgcttgcatcggccgccccctatctcgaccaatgactcgctgtcagagtccgactcggtttcgagagcctggttccctgagattgtttccctcgggctagcggagacggcgggcgtttgcgactgggttggcgccggggcagcgtggtgcggcggcgcccggaggccttcggaccaccacaagtggccggggttgctcccttccagctccagggcgttctgcgagtcgcccaaagcagaggccccggcaggccgctgccgggggagaacacgtccgctctggcgccggggtcgcagacagaacccgccgtcgtcgtttccatgcccgggcctgccccgctgggcctcggcctcggcggcggcgatgtgctgccgaatgaaggcctcgaactccagctccgacgcgcacttcttcatctctgacggctgcctgcctctccgtctgttcgtcacggtggtggtgttgtcgtcactctgtgcgtctgtctgtctgtctttcttggcgaggcctccgttgcggggggtgacagcgtcgccggcgacggcttttatggggcgcgggaaggggacgtggaaagctccgttgggggagatgaatatgatagcggctgcgtgaatggacagtgacgcgggctgactcggatcctcgtaaggccgagagggaggcagcgtgcaaggctgggtaggggcgtgcttgcgtgtccgtcggcgacttttcattgggttcgggacttcagatctgctgcaagtatacttaaataatagtattacgatcggatgaatcggattgcattcagttatcttattggtacaagattatgttatccggtggcaaaanaaaaa

SEQ ID NO: 29281 - DNA, 1118 bp, Triticum aestivum
  Clone ID: PAT_TA_29281
ttctctttccccctttcgctgatcgctggggcctcacaatcaatcggctactctcctctcctctcgcgcgtggcgaattcccctctccctctctcacgcggcagcgaccccggaggcgacgtcggcggccacagcaggcttctcgccgaaatggcatcatcttcggacccatggatgaaagagtacactgaagcatctaagcttgttgatgatataagttccatgattgccgatagaagttcacttccacaatcaggccccgaaattatgcgccacacatcagccatccggagaaaaataaccattcttgggactagactggatagcttggtgacattgttgtccaggattccgccaaagtcactcactgacaaggagatgcataagcgccaagatgcactttccaacttgaaatctaaagcaaaacagatggggacaagtttcaacgtgtcaaactttgccaacagggaggatttgcttggtcagagtaagaaagctgctgatgatatgagcagagttgctgggttagacaaccaaggaattgttggccttcagaggcaagttatgagagaacaagatgagggtctcgaaaggctggaggagacagtcctgagcacaaaacatattgcattagcagtcaatgaagaacttactctgcatacaagattgattgatgacttggaagatcatgtcgacgttacaaactcccgtcttcagcgtgtgcaaaagaggcttgccaattctgaacaagcgcgccaaaggtggctgctcatgcatgtgcctaatgctctctgttgctgccatagtgctgctcgcggttatcgtttggcttctcatcaagtacctgtaaagaagtgtccttgcggccgttgttcaacgcatcgcttgtttgatactccgttgaagtgtgcagtctctttaaagatatatacgatggtttccatggtggtcctttttatagtgtttggaacggttgtatcaatatgtacaaggcgtgaggctctggcgtatgcctacaaatatctgtgtgtggacatttgtggcctttgtaagtctggaggaaaaaatatatacattttgtgagggtttatgtgttttacctacccaaaaaaaaaaaa

SEQ ID NO: 29282 - DNA, 772 bp, Triticum aestivum
  Clone ID: PAT_TA_29282
aatcacagatacaatgtcatccttgctcgacgaatctgacgagcgctcccatccagcacaaccgccgccaacacaacacctcgagagtcctcgccgccggagaagtcgcaagcaagatggccggaaggaagggcggcgacaggaagaaggcggtgacccgctccgtcaaggccgggctccagttccccgtcggccgcatcgggcgttacctcaagaagggccgctacgcccagcgcgtcggctccggcgcccccgtttacctcgccgccgtcctcgagtacctcgccgcggaggtcctggagcttgccggcaacgcgggccaaggacaacaagaagacccgcatcatcccgcgccacctgctgctcgccgtccgcaacgaccaggagctcggtaggctgctcgccggcgtcaccatcgcccacggcggcgtgatccccaacatcaactccgtgctgctccccaagaagtcccccgccgccgccgagaaggaggccaagtcgcccaagaagaagaccaccgccaagtcccccaagaagaaggtcgccgccaaggagtagccgcccgcacccatagcctagccagtgttgcttagatccatttctcatggactaagatgagatcctgtatgtaatgcctgctagtctgtagtgcccgtcagattcgtcgagcatgggtgacattgtacctgtgatttctgtgaccatggcgaaagatgcaatcatttcagtctgttgttctatctatggctgcaatcatttcaatctcttgttc

SEQ ID NO: 29283 - DNA, 1127 bp, Triticum aestivum
  Clone ID: PAT_TA_29283
cgtccgcggacgcgtgggcggacgcgtgggccagaacccgagaacccctgctccagagccctaaccctaaggcatgtcctctcctcccaaccccagcgcgcgcgttccaggagcttccggtgccggcggcgccatggcttcggagaccgagaccttcgccttccaggccgagatcaaccagctgctctcgctcatcatcaacaccttctactccaacaaggagatcttcctccgcgagctcatctccaacgcctcggatgcgttggataagatcaggtttgagagcctgactgacaagagcaagctggatgctcagccagagctgttcatccacataatccctgacaaggccacgaacacactcacgcttattgacagtggtattggtatgaccaagtcagaccttgtgaaacaaccttggtaccattgcaaggtctgggcacccaaggatttcatggaggcactggctgctggtgctgatgtgtccatgattggtcagtttggtgtcggtttctactctgcttacctcgttgctgagagagtcgttgtgaccagcaagcacaacgatgacgagcagtatgtgtgggagtcccaggctggtggttccttcactgtgacacgtgatactactggagagccccttggaaggggtactaagatcaccctctacctcaaggatgatcagttggagtaccttgaggagcgtcgcctcaaggatctggtgaagaagcactctgagttcatcagctatcccatctctctctggacggagaagaccactgagaaggaaatttctgacgatgaagatgaggatgagaagaaggatactgaggagggcaaggttgaggaaattgatgaagagaaggaagaaaaggagaagaaaaagaagaagatcaaggaggtttctcacgagtggaacctgatcaacaagcagaagcccatctggatgaggaagcctgaggagatcaccaaggatgagtatgctgccttctacaagagcctgacaaacgactgggaggagcaccttgccgtcaagcactttttggtggagggtcaatttgagttcaaggccgtcctctttggtttcaagaaggccctctttgaccttttttgacaccaggaagaag

SEQ ID NO: 29284 - DNA, 2373 bp, Triticum aestivum
  Clone ID: PAT_TA_29284
ctagccgcctcccgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccagcacgctcacgatcgtcgacagcggcattggcatgaccaagtcggacctcgtcaacaacctcgggaccatcgccaggtcggggaccaaggagttcatggaggcactcgctgcaggcgctgacgtgtccatgattgggcagttcggtgttgggttctactccgcctacctcgtcgccgagagggtcgtcgtcaccaccaagcacaacgacgacgagcagtacgtgtgggagtcccaggccggtggctccttcaccgtcactcgtgatacgtctggggagcagctcggcaggggtaccaagatggtcctctacctcaaggacgaccagatggaataccttgaggagcgccgcatcaaggatctagttaagaagcactctgagtttatcagctaccccatctccctgtggactgagaagaccactgagaaggaaatttctgatgatgaagatgaggaggagaagaaggatactgaggagggcaaggttgaggatgttgatgaggagaaggaagagaaggaaaagaagaaaaagaagatcaaggaagtctctcatgagtggaacttggtcaacaagcagaagcctatctggatgaggaagccagaggagatcaacaaggaagagtatgctgctttctacaagagcttgaccaatgactgggaggagcatttggctgtcaagcacttctctgttgagggccagcttgagttcaaggctgtcctgtttgtgcccaagagggcccccttcgacctctttgacaacaagaagaaggccaacaacatcaagctgtatgtgcgccgtgtcttcatcatggataactgtgaggagttgatccctgagtacctgagctttgtcaagggcattgttgattcagaggacctccccctgaacatctcccgtgagaccctccagcagaacaagatcctcaaggtcatccgcaagaaccttgtcaagaagtgcattgagctcttctttgagattgctgagaacaaggaggactacaacaagttctacgaggccttctccaagaacctcaagcttggcatccacgaggactcccagaacaggaccaagattgctgagcttctgaggtaccactccaccaagagtggtgatgagctgacgagcctcaaggactatgtgactaggatgaaggagggacagaacgagatctactacatcaccggtgagagcaagaaggctgtggagaactctcccttccttgagaagctgaagaagaagggctatgaggtcatctacatggttgacgccattgatgagtatgccattggtcagctcaaggagtttgagggcaagaagcttgtctctgccaccaaggagggtctgaagctcgatgagagcgaggacgagaagaagaagcaggaggagctcaaggagaagttcgaggggctgtgcaaggtcatcaaggaggtgctgggcgacaaggtggagaaggtcatcgtctctgaccgtgttgtggactccccttgctgtctggtgactggcgagtatgggtggaccgccaacatggagaggatcatgaaggcccaggccttgagggactcgagcatggctggctacatgtcaagcaagaagaccatggagatcaaccctgagaacgccatcatggacgagctccgcaagcgcgccgacgccgacaagaacgacaagtcagtcaaggacctggtgatgctgctcttcgagacctccctgctcacctccggcttcagcctggaggaccccaacaccttcggcaccaggatccaccgcatgctcaagcttggcctgagcattgacgaggacgatgaggcgcctgagaacgacaccgacatgccgcccctggaggacgacgctggtgagagcaagatggaggaggtcgactaagcgcaagtctgcctgtcgtcggatgttcatgccctgcaccgcctagttgtttttatctttagtgtcgacgttggatggttttggcacgtttagctgtatcggttttgtcttttggctggccaaacattaagcgcggctagctgtttgtggtactcgtggaacagttcgttattgttggttctattatatgttagctatatttctataattct

SEQ ID NO: 29285 - DNA, 2103 bp, Triticum aestivum
  Clone ID: PAT_TA_29285
gtcgacccacgcgtccgggtttcctcctccgctgcaagcgccttccaatcccaatcccctcctcgccctctcccactccggcggcggcagcagcagcatcagcgaggaagagagaagaatccgagcatggcgacgatagtgaacacgacggaggaggagccgatgctggcggtggtgcgctccaccgcgcagctcgcctgggccgacgcgggccaggaggtcgccgacccggaggtggcccgcctctgcgccgaggcgcagcagcacctcctcgccgcccgctggctcgacatggccaccctcatgctcgcctccgccgacctcctcctcctctcccccagcgcccccgacaaagccgcagatctcgagtgctccctcaccgtcgtctgcaacctcgtcaccaaggccggatccgaggacgaggccctggagatcgccaagctcatctgcgccaagctcacccaccagccgggcgagaagcccacgctgcgcatcaaagtcctcttcagcctgtacaacctgcttccgagcctctccggcaaggccttggtctacaggaaggcgctcgagctcgccgccgccgccgggaaggccgccgccgactgcgtcgtccccaccttcaagaacatcgacgcctttgtcgcctactggggcatcggcaagccggagcagagggacctgttccttgccgtcaccaggattcttaaagaccagaagggcatgaccaaggagtacttcaagtttctgaacaagtacctggccacgttcgatggatcggctgatgaggccgacgcaatcggtgctgcaaaggaagaagctgctgcagcaatcattgagtttgtcaagtcatctgatctctatcagtgtgacctgctcgacatgccagctgttgcacagcttgagaaagatgagaagtatcagccagtttacgagctactgaagatattccttactctgaggctcgattcctatttagcgtttcagactgctaactctagcttgctgcaaggatatggactggttcatgaggagtgcataaccaaaatgcgtctgatgtccctgcttgatctgagcggccattgttctggggaaattccttactctgcaattacaaaagcccttgagatcaatgatgatgaggtggaatattggattgtgaaagcaatttcgtccaagattctggactgcaaagttgaccagcttaatcaattggtcattgtcagccggcatactgcatgggcttcctccgatctacgctcactggtttgtttgaagaaggatctagccgttgactgttggtgcttcccctccccgggcgccatgacttgggatagtacttctatccagcaagcaacgttttggatgtgagctccagctcaagcagagcatcaaaaacaggggctctatctgctaatggggcagccgacaatgcagtctaagagctacatctcatgtgatttctggatatgagaacttgagaagaacaagcttgatgctattattgaaaaaaataatctatgctacaggattcttctttgcatcccatacacttagacggagtgggaggctgccgcagcggtgctggactcggagcccaagccatccgccgccgccaacaagttgcacctcttcgcggaaatcaccacaactgtgatgtgctgacagtcggatgccttcagaattggctcttaaaactttcaaccaagattagagctagcatacagtttgcagtttatagtcgtactcatactcaatgagtccctacctcggcttctgggcaagatattctttaattttagttgattagcaaccactattgttcaggaattttgagtagcgcgcatcttggtctggcgagccggtgaccggacatcatttgtcaaggaagcaaaaaggactacactcacaaggaaccatgaagccaacgaaccacgtcaactagatgttttagctttcattttgtacaactgatgtctcatacttgcaccttttgactatccttttgtaaacctgatgtatggttcctcggtggttttgtttagaacagattgaagtgtatgtatgtgccaattagttaatggaataaaaaatgtttggtgctcc

SEQ ID NO: 29286 - DNA, 1334 bp, Triticum aestivum
  Clone ID: PAT_TA_29286
gcaccgccggcgccctcccatcccctctgccgggccttgttgccgtgctgtgcaacgtctccctgcgacaagccaatgatggccagagctgcacttcttcctgttgcgttgctgctgtgccttgcactggccggcaatgttaatgctacacggaagtcaacggccggattctatgaactcaagaacaagaagggcgatttctccatcaaggtcaccaactggggcgctgccctcgtgtctgccattgtccctgatggcaaagggaacttggctgatgttgtccttgggtatgacactgttgctgaatatgttaatggctctgcttcattcggagcgacggttgggcgcgtagccaacagaatcgccaacacccgctttgttcttgacgggaaaacctatcacctcctccgtaacgacggcaacaacacgattcacggaggccccaaggggttcggcaaggtcatttggacggtgaaggagcatgtgagccatggtgactccccatacatcaccttctactaccacagcttggatggagagcaaggattcccaggtgctctcgacgtgtacgtgaagtaccagctctcccgcccgtacgacctgagcatccgcatgaacgtgactgcgaggaacaaggcgacgccggtgaacctcgcgaaccacgcgtactggaacctggccggtcacggcagcggcgacatcctcaagcacgagctccagatgttcgcctcacactacacgcccgtcgactcatccatgataccgacgggcgaggtcgcgcccgtggccggcacgatgtacgacttcggcaggcggatccccgtgggcaccaacatgaagatcgtccctggcggcggcggcgggtacgacatgaactacgccgtggacgggcagcacgggcagcagaacgcgatgcggccggtggcgcgcgtccgggaccccaagtccgggcgggcgttcgagctgtgggcgaaccagcccggggtgcagttctacaccgccagctggctcatcaacgagaaggggaaggccgggaaggtgtacgggcagtacggcgcgctgtgcctggagacgcaggcgtaccccgacgccgtcaaccaccccaacttcccgtcctccatcgtgaggcccggccaggtgtacaagcacgacatggtcttcaggttctcctaccaggccacctacgacgcgtgagatgcttgatcgtccgtcgtttcttgtggactgtgcggtaacattttggtagcttgtgtaataagatgtggcattgggacgaagacatgaggttgctgtcatttgaccgcgtaataaagaaaaaatgccgcttcaactgg

SEQ ID NO: 29287 - DNA, 1552 bp, Triticum aestivum
  Clone ID: PAT_TA_29287
ctcgtgccgaattcggcacgagctcgtgccgaattcggtacgagcggagcccgcaccaggccgctgggagttctaccctcgaaaggtggacctcgaatatttggtgcctcttatctctcaccaaggacgctggtccctcattgtggaaataggaaaatttcttcatccgcttcataattgttgaattgacgctaagatttatttagcaatcagattccggactctgagcagatctaacaggatctttaaaagagttcttttgtttgaaaatttgttacttagtagaaatggtgaaggatcatctaatgctcaatgttgatcgcctaatggtgcctgaacccattgagatcactggagcacccaagagctcctcatcgagggacaccactgcactgcccattacagggcattccttttttgcagttggagacagcatggttcctgaagaagaacctcttctgcagattacggagtgccgtatttgtcaggaggaagatgacattaagaacctgggagagcccctgtgcttgcaccggcagtgtaaagtatgcgcatagggccttgtgtacaaagatggtgcaatgagaaaggagatgtcacatgtgaaatctgccatgagccgtatgaacatgggtacactgcacctcccagaccccatcctgacgaaactaccatcgatataagtggtggctggaccattactggtacagcatttgacttgcgtgatcctaggatcctggcagtagcacaaaaccacattatggaagctgaatatgatgattattcagccacgaacgccagcactgctgccttttgccgatctgctgctcttgtcttaatggctctcctactactgaggcatgcattgactctaactgatgaagacgatgatgacacttcagcaatgttttcacttttcttactgcgtgcggctggttttcttctcccattctatataatggcttgggcaattagtatattgcagcgtcgcagacatcgacaggaggcagctgcgttggcagcaactgaggtggcattcatccttcagtctgggcaaggaagaggagtgcatttcaccatagcaccagattctcctgccacgccccagcacgaaccacaaccttgaagatgtcgtgccgatgagcgaccggctggcggctgcggctacattggattgctggcttgcgcgaatcaccaaaggagttatggtctgctgccactgcagagccatgttatttacgtactttacgtcattgcccagagtgtaacgttctgagacgtgtcccagtttgtgcttccggattctgttagggttggcgttggccagggagtctcggtgagtggtgtgtataaagtaagaaagccatttggaccgtgtatgtcggtcccaactgttaacttaaaaatatatagccgacaggcggcttttctgaaggccactgttttgcctatagtctttacatgcttgttgtttttacaagaaaaatatgtactcttgctagaattgtattattaatgtcccgagtaacatgaattggtagtgcttctgcgc

SEQ ID NO: 29288 - DNA, 2447 bp, Triticum aestivum
  Clone ID: PAT_TA_29288
gcacgaggcctcgtgccgaattcggcacgaggagaacccgagaatcccccgctccaatagccatctcctctcgccccagccctcgtcgagcgcgcgcgttccaggagcttccggtgccggcggcgccatggcttcggagaccgagaccttcgccttccaggccgagatcaaccagctgctctcgctcatcatcaacaccttctactccaacaaggagatcttcctccgtgagctcatctccaacgcctccgatgcgttggataaaatcaggtttgagagcctgactgacaagagcaagctggatgctcagccagagctgttcatccgtataatccctgacaaggccacgaacacactcacacttattgacagcggtattggtatgaccaagtcagacctcgtgaacaaccttgctaccattgggaggtctggcaccaaggatttcatggaggcactggctgctggtgctgatgtatccatgattggccagtttggtgtcggtttctactctgcttacctcgttgctgagagagtcattgtgaccagcaagcacaacgatgacgagcagcatgtgtgggagtcccaggctggtggttccttcactgtgacacgtgatactactggagagccccttgggaggggtactaagatcaccctctacctcaaggatgatcagttggagtaccttgaggagcgtcgccttaaggatctggtgaagaagcactctgagttcatcagctatcccatctctctctggacggagaagaccactgagaaggaaatttctgacgatgaagatgaggatgagaagaaggatactgaggagggcaaggttgaggaaattgatgaagagaaggaagaaaaggagaagaaaaagaagaagatcaaggaggtttctcacgagtggaacctgatcaacaagcagaagcccatctggatgaggaagcctgaggagatcacaaaggatgagtatgctgccttctacaagagcctgacaaacgactgggaggagcaccttgccgtcaagcacttctctgtggagggtcagcttgagttcaaggccgtcctcttcgttcccaagagggccccctttgacctttttgacaccaggaagaagctcaacaacatcaagctctatgtgcgccgtgtcttcatcatggacaactgtgaggagctgatcccagagtggctgagctttgtcaagggcattgttgactctgaggatcttcccctgaacatctctcgtgagacactccagcagaacaagatcctcaaggtcatccggaagaaccttgtgaagaagtgcatcgagctcttctttgagattgccgagaacaaggaggactacaacaagttctatgaggctttctccaagaacctcaagcttggcgtccacgaggactccaccaacaggaccaagcttgctgagctcctgaggtaccactccaccaagagcggtgatgagcttaccagcctcaaggactacgtgacgaggatgaaggagggccagaacgacatctactacatcaccggtgagagcaagaaggctgtggagaattctcccttccttgagaagctgaagaagaagggctatgaggtgctgtacatggttgacgccattgatgagtactccattggccagctcaaggagtttgagggaaagaagctggtctctgccactaaggagggcctgaagcttgatgacagcgaggaagagaagaagaggaaggaggagctcaaggagaagtttgaggggctctgcaaggtgatcaaggaggtgctgggcgacagggtcgagaaggtgattgtctctgaccgcgtcgtcgactcgccgtgctgcctggtgaccggcgagtatggctggactgccaacatggagaggatcatgaaggcccaggccctgagggacacgagcatgggcggctacatgtcgagcaagaagacgatggagatcaacccggagaacgccatcatggaggagttgcgcaagcgcgccgacgctgacaagaacgacaagtctgtcaaggacctggtgatgctgctgttcgagacctccctgctcacctctggattcagcctcgacgaccccaacaccttcggcaccaggatccaccgcatgctcaagctgggcctgagcatcgacgaggacgaggaggctgctgaggctgacacggacatgccgccgctggaggaggacgccggcgagagcaagatggaggaggtcgactaggcgtgtgcgttcgcttgctatccgagtcgtagagctagcttatcttttgggttactgtcgcgtggtcggtttgtcttttatggtttactgtgcctagcctgctgtaatggggctaggggagtggtctgtggagtccccggaactgcgtatcgtaatcgttgcttatatatatcgtctttagtaaaaaaaaaaaaaacacctcggccgcgaccacgct

SEQ ID NO: 29289 - DNA, 2454 bp, Triticum aestivum
  Clone ID: PAT_TA_29289
tccacgcgtccgcagaacccgagaaccccccgctccaaagccctaaccctagccatctcctctccccccagccctcgtcgagcgcgcgttttccaggagcttcaggtgccggcggcgccatggcttcggagaccgagaccttcgccttccaggccgagatcaaccagctgctctcgctcatcatcaacaccttctactccaacaaggagatcttcctccgcgagctcatctccaacgcctccgatgcgttggataagatcaggtttgagagcctgactgacaagagcaagctggatgctcagccagagctgtttatccatattatccctgacaaggccacgaacacactcactcttatcgacagtggtattggtatgacaaagtcagacctcgtgaacaaccttggtaccattgcaaggtctggcaccaaggatttcatggaggcactggctgctggtgctgatgtgtccatgattggtcagtttggtgtcggtttctactctgcttaccttgttgctgagagagtcgttgtgaccagcaagcacaacgacgacgagcagtatgtgtgggagtcccaggctggtggttccttcactgtgacacgtgatactactggagagccccttggaaggggtactaagatcaccctctacctcaaggatgatcagttggagtaccttgaggagcgtcgccttaaggatctggtgaagaagcactctgagttcatcagctaccccatctctctctggacggagaagaccactgagaaggaaatttctgatgatgaagatgaggatgagaagaaggatactgaggagggcaagtttgaggaaattgatgaagagaaggaagaaaaggagaagaaaaagaagaagatcaaggaggtttctcacgagtggaacctgatcaacaagcagaagcccatctggatgaggaagcctgaggagatcaccaaggatgagtatgctgccttctacaagagcctgacaaacgactgggaggagcaccttgccgtcaagcacttctcggtggagggtcagcttgagttcaaggccgtcctcttcgttcccaagagggccccctttgacctctttgacaccaggaagaagctcaacaacatcaagctctatgtgcgccgtgtcttcatcatggacaactgtgaggagctgatcccagagtggctgagcttcgtcaagggcattgttgactctgaggatctccccctcaacatctctcgtgagacactccagcagaacaagatcctcaaggtcatcaggaagaaccttgtgaagaagtgcatcgagctcttctttgagattgctgagaacaaggaggactacaacaagttctatgaggctttctccaagaacctcaagctcggcgtccacgaggactccaccaacaggaccaagcttgctgagctcctgaggtaccactccaccaagagcggcgatgagcttaccagcctcaaggactatgtgacgaggatgaaggagggccagagtgacatctactacatcaccggtgagagcaagaaggccgtggagaactctcccttccttgagaagctgaagaagaagggctatgaggtgctgtacatggttgacgccattgatgagtactccattggccagctcaaggagtttgagggaaagaagctggtctccgccaccaaggagggcctgaagcttgatgacagcgaggaagagaagaagaggaaggaggagctcaaggagaagttcgaggggctctgcaaggtgatcaaggaggtgctgggcgacagggttgagaaggtgatcgtctctgaccgcgtcgtcgactcaccgtgctgcctcgtcaccggcgagtacggctggaccgccaacatggagaggatcatgaaggcccaggccctgagggacacgagcatgggcggctacatgtcgagcaagaagacgatggagatcaacccagagaacgccatcatggaggagctgcgcaagcgcgccgacgtggacaagaacgacaagtctgtcaaggacctggtgatgctgctgttcgagacctccctgctcacctcgggcttcagccttgacgaccccaacaccttcggcaccaggatccaccgcatgctcaagctgggcctgagcatcgacgaggacgaggaggctgctgaggctgacacggacatgccgccgttggaggaggacgccggcgagagcaagatggaggaggtcgactaggcgtgtgcatttgcttgctatccgagtcctagagctagtttatcttttgggttactgtcgcgtggtcggtttgtcttttgtggtttactgtgcctagcctgccctaatggggctaggggagtggtctgtggagtccccggaactgcgtaccgtaatcgttgcttatatatatcgtctttagtaccttccgagttaaaaaaaaaaaaaaaaaaaaaaaaaaaaaaaaaaaaaa

SEQ ID NO: 29290 - DNA, 2451 bp, Triticum aestivum
  Clone ID: PAT_TA_29290
gcacgaggcctaaccctagccgcctcctgcacgcttctcctccgctccccgccccgcctcgagcagctcaggaacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccaacacgctcacgatcgtcgacagcggcattggcatgaccaagtcggacctcgtcaacaacctcgggaccatcgccaggtcggggaccaaggagttcatggaggccctcgccgccggcgccgacgtgtccatgattgggcagtttggtgtcggtttctactccgcctacctcgtcgccgagagggttgtcgtcaccaccaagcacaacgacgacgagcagtacgtgtgggagtcccaggccggtggctccttcaccgtcactcgtgatacgtctggggagcagctcggcaggggtaccaagatggtcctctacctcaaggacgaccagatggaataccttgaggagcgccgcatcaaggatctagttaagaagcactctgagtttatcagctaccccatctccctgtggactgagaagaccactgagaaggaaatttctgatgatgaagatgaggaggagaagaaggatactgaggagggcaaggttgaggatgttgatgaggagaaggaagagaaggaaaagaagaaaaagaagatcaaggaagtctctcatgagtggaacttggtcaacaagcagaagcctatctggatgaggaaaccagaggagatcaacaaggaagagtacgcagctttttacaagagcttgaccaatgactgggaggagcatttggctgtcaagcacttctctgttgagggtcagcttgagttcaaggctgtcctgtttgtgcccaagagggcccccttcgacctcttcgacaacaagaagaaggccaacaacatcaagctgtacgtgcgccgtgtcttcatcatggacaactgtgaggagttgatccctgagtacctgagctttgtcaagggtattgttgattcagaggaccttcccctgaacatctcccgtgagactctccagcagaacaagatcctcaaggtcatcaggaagaaccttgtcaagaagtgcattgagctcttctttgagattgctgagaacaaggaggactacaacaagttctacgaggccttctccaagaacctcaagcttggcatccacgaggactcccagaacaggaccaagattgccgagcttctgaggtaccactccaccaagagtggcgatgagctgacaagcctgaaggactatgtgaccaggatgaaggagggacagaacgagatctactacatcactggtgagagcaagaaggctgtggagaactctcccttccttgagaagctgaagaagaagggctatgaggtcatctacatggttgacgccattgatgagtatgccattggtcagctcaaggagtttgaggggaagaagcttgtctctgccaccaaggagggtctgaagcttgatgagagcgaggacgagaagaagaagcaggaggagctcaaggagaagttcgagggtctgtgcaaggtcatcaaggaggtgctgggtgacaaggtggagaaggtcatcgtctctgaccgtgttgtggactctccttgctgtctggtgactggtgagtatgggtggactgccaacatggagaggatcatgaaggcccaggccttgagggactcgagcatggctggctacatgtcgagcaagaagaccatggagatcaaccctgagaacgccatcatggacgagcttcgcaagcgcgccgacgccgacaagaacgacaagtctgtcaaggaccttgtgatgctgctcttcgagacctccctgctcacctccggcttcagcctggaggaccccaacaccttcggcaccaggatccaccgcatgctcaagcttggcctgagcattgacgaggacgacgaggcgcctgagaacgacaccgacatgccacccctggaggatgacgctggtgagagcaagatggaggaggtcgactaagcgcaaggccgtcggctgtcgtcgttggatgtccatgccctgcgttgtttttatctttagtgtcgaagttcgatggttttggcacgtttagctgtatcggttttgtcttttggctggccaaacattaagcgcggttagctgtttgtggtactcgtggaacagttcgttattgttggttctacaatatgtgttagctatatttttatattccctgctattgcttgcatctgctttccttaaaaaaaaaaaaaaaaaaaaaaaaa

SEQ ID NO: 29291 - DNA, 2889 bp, Triticum aestivum
  Clone ID: PAT_TA_29291
ttttttttttttttttgcagcgaatatagaaatataataactaacacatattgtagaaccaacaataacgaactgttccacgagtaccacaaacagctaaccgcgcttaatgtttggccagccaaaagacaaaaccgatacagctaaaacgtgccaaaaccatccaacgtcgacactaagataaaaacaactaggcggtgcagggcatggacatctgacgacgacagccgacaggcagccttggcgcttagtcgacctcctccatcttgctctcgccggcgtcgtcctccaggggcggcatgtcggtgtcgttctctggcgcctcgtcatcctcatcaatgctcaggccaagcttgagcatgcggtggatcctggtgccgaaggtgttggggtcctccaggctgaagccggaggtgagcagggaggtctcgaagagcagcatcacgaggtccttgacagacttgtcgttcttgtcggcatcggcacgcttacggagctcgtccatgatggcgttctcagggttgatctccatggtcttcttgctcgacatgtagccagccatgctcgagtcccttaaggcctgggccttcatgatcctctccatgttggcggtccacccatattcgccagtcaccagacagcaaggggagtccaccacacggtcagagacgataaccttctcaaccttgtcgcccagcacctccttgatgaccttgcacagcccctcaaacttctccttgagctcctcctgcttcttcttctcgtcctcgctctcatcaagcttcagaccctccttggtggcagagacaagcttcttgccctcaaactccttgagctgaccaatggcatactcatcaatggcgtcaaccatgtagatgacctcatagcccttcttcttcagcttctcaaggaagggagagttctccacagccttcttgctctcaccagtgatgtagtagatctcgttctgtccctccttcatcctggtcacatagtccttgaggctcgtcagctcatcaccactcttggtggagtggtacctcagaagctcagcaatcttggtcctgttctgggagtcctcgtggatgccaagcttgaggttcttggagaaggcctcgtagaacttgttgtagtcctccttgttctcagcaatctcaaagaagagctcaatgcacttcttgacaaggttcttcctgatgaccttgaggatcttgttctgttggagagtctcacgggagatgttcaggggaaggtcctctgaatcaacaatgcccttgacaaagctcaggtactcagggatcaactcctcacagttatccatgatgaagacacggcgcacgtacagcttgatgttgttggccttcttcttgttgtcgaagaggtcgaagggggccctcttgggcacaaacaggacagccttgaactcaagctgaccctcaacagagaagtgcttgacagccaaatgctcctcccagtcattggtcaagctcttgtagaaagcagcgtactcttccttgttgatctcctctggcttcctcatccagatcggcttctgcttgttgaccaagttccactcgtgagagacttccttgatcttctttttcttcttttccttctcttccttctcctcatcaacatcctcaaccttgccctcctcagtatccttcttctcctcctcatcttcatcatcagaaatttccttctcggtggtcttctcagtccacagggagatggggtagctgataaactcagagtgcttcttaactagatccttgatgcggcgctcctcaaggtattccatctggtcgtccttgaggtagaggaccatcttggtacccctgccgagctgctccccagacgtatcacgagtgacggtgaaggagccaccggcctgggactcccacacgtactgctcgtcgtcgttgtgcttggtggtgacgacaaccctctcggcgacgaggtaggcggagtagaaaccgacaccgaactgcccaatcatggacacgtcggcgccggcggcgagggcctccatgaactccttggtccccgacctggcgatggtcccgaggttgttgacgaggtcggacttggtcatcccaatgccgctgtcaacgatcgtgagcgtgttggtcgccttgtcggggatgatgtggatgaagagctcgggctgcgcgtctagcttgctcttgtccgtgaggctctcgaacctgatcttgtccaaggcatcggaggagttggagatgagctcgcggaggaagatctccttgttggagtagaaggtgttgatgatgagcgagaggagctggttgatctcggcctggaaggcgaaggtctcggtctccgtcgccatggctgtgcgcgtccctgagctgctcgaggcggggcggggagcggaggagaagcgtgcgggaggcggcaatggaggtccagatgagacggggcggcgcgacgtgcctggtccaggtggcggcggcggtctcctacgtggtgctgatggcgtcggcgggggtgcgcgcgcagctgcgggtggggttctacgacagctcgtgcccggccgcggagatcatcgtgcagcaggaggtgagcaaggcggtgtccgccaacccgggcctcgccgcgggcctcctccgcctccacttccacgactgcttcgtcggcggctgcgaggcgtcggtgctggtcgactccacaaagggcaacacggcggagaaggacgccgggcccaacacgagcctgcgcgggttcgaggtcatcgaccggatcaaggcccgggtggagcaggcgtgcttcggcgtcgtctcctgcgccgacatcctcgccttcgctgccagggacagcgtcgcgctgactggcgggaacgcgtaccaggtgccggcggggcggagggac

SEQ ID NO: 29292 - DNA, 1344 bp, Triticum aestivum
  Clone ID: PAT_TA_29292
acggacgggtcgtacggattccacctccacggacggaacgctggtcgtcagccagccagaccgtcttgtggtcaccagtacatctctgtacgaacgtcgcttgttcttggacgcccttgcgaggcactcgcacatttgctctctgccgacgtgccatgggacatgcggtaatttgagcctgaagtaaatcaaacccacgcgtcacgcacatcacacattcgcggccgagggagcgagcagcgccggccgcgccgcggcaccgccggtagctctcgcctcccgccgataccatggccaacgccgcggtcgaccccgagagcaaaagggcgcggttgacttcgtccatgtcgtccgtggacaccatcctccgtctcccgccctcgctgccgtcgacgtccgcgacgcgcgccccggcgggccacccgctggaggagccgcccgcgcgtcggaggccggcgcggagatccaagcccgtgaggattttccagagcatgttccggtctctgccggtgctgacggtgccgcgctgcggggggattctgacggcagctccgaccgccgcgtcagcgtcggcgtcgccggcgcggtcggactccctcctgtcgcaaatcatctcgccctcgaccacgttgaatggcggcggaggcgtcggtgcgtcgtcccggcggcacatgactggcacgctcttcggctgccgcgagggccgcgtgtcgctcgcgctgcaggagaacccgcggtgccgcccggcgctcgtggtggagctggcgctcccgacgcacaccctgctccgcgagctcggcggcacggccggtacgcgcatcgtgctggaggccgagaagaagcacgtggaggagcacagcagctccggcggcggcgaacacggcgacgccgcggcgaggcagcacgacgacgacgggtggctgctccatgagccgatctggaccatgttctgcaacggcaagagggtgggctacgcggtgcggcgggagccgacggacggcgacatcgcggtgctggagacgctctgggccgtgtccatgggcggcggcgtgctccccgggagggcaggctcggccgcgtctgacggggagctggcgtacatgcggggttgcttcgataacatcatcgggtccgaggactctgagtcgctgtacatgctcgggccgcatggcggcgatagcccggagctcgccgtcttcttcgttaggctttgagccgatcaatcgtctgtctctccctctctctcggtcgaacacttcgatgtacgtacacattgcctccatacataatataacagtacgcgtgaatgcttggacgttgacgaccaaaaaaaagtttggttag

SEQ ID NO: 29293 - DNA, 259 bp, Triticum aestivum
  Clone ID: PAT_TA_29293
gggatgaaaaaaatatatttattaaacaagtgtttcataacgtgcgttatgttcaagacgattgctaaagaggaagtagagaatcaaaccaacgataggaaagaaaaagactaaaagggaccaacctagtttaccagagatagcacgatttgagttcatgacttcaaagataacaatcaggtcaagtatcaagatgataagaccaacaataccaccactgtaagaaagcatattatcgagcattttgcggacgcgtggg

SEQ ID NO: 29294 - DNA, 1707 bp, Triticum aestivum
  Clone ID: PAT_TA_29294
ggctggggcccggcggtgttgcctccccaagaccccgagatggaggtagacccctggaccttgcttgaggacggcaccagctgcccctccacatcatcaggaagcaacagcgccagcggcatcgcccccgaccactccaacctgaaggcgtgcagctggctcaagggcggtggcaggggatctaatataaataaatatgtaactgagaaggcctttgctgaattaatgttgccatgcatcgacaggagttcgcctgaatttcgcagtatatttgctggtgaattaatcaaacagatgggaactgtcagtgaacacatcaaagcaatatcacgaaatggtgccaaacatgttggtttagttccttcaggaaatgatgtttcatcgaacaaatccagtggtcgtaaaggaattcgaggtggaagtccaaatattggcaggcgagtcacggttggtaatgatccaactcctccttcagcatctgctctgcaggcaatagtgtggctgcgcctccaatttatcatcaggctgcttcaagtaatcctggcagataggggcatgaggcatacacttgctcctgcgatactaagcctgcttgcggcacgcataatctatgaagatgcagattcgccccttcctcctgccagtttgattgcctcgagacgggaagtggactctttgctggaacctcccatggatgtcctgcttgatcgcccaagcgagagtcttttcgagaggcttttatgtgttttccatgcgctgcttggcaattgcaaaccaagttggatgaagtcgaagccagtttccaagccaaccgtcagagcctcacgagatatccctgcatttgataatgaagcggctgtggccttgcagtctgcgttggaccatatggagttgcctggagcaatcaggcgaaggatccaggcggcgatgccgattctcccagcagctcggcaccctagtatacaatgccagccttcccagctgtccctggctgcactgtcaccactccagagcactccatctacatcaggtcctcaacagaaaagcacttctcacagttgggttcccaccaacatctcgggcagaagcgaaggcggtgttgcctccccaagaccccgagatggaggtagacccctggaccttgctcgaggacggcaccagctgcccctccacatcatcaggaagcaacagcgccagcggcatcgcccccgaccactccaacctgaaggcgtgcagctggctcaagggcgcggtcagggtgcggagggcggagctgacatacatcgggtctctggacgacgacagctgacgcacagccacgccggcgcagcgagggcgacctgtcctcgcaccggaccgaactcttctccagtgtacaagagggtggaaaccgccgccttatgtggcggccccgtgtagaataccgaccgaccttgcccctgttttgttgctagggcgcctcgcaggagcgacggtgtacatagtgggggacattagtccgctccgcgagcagcgggccctgcctgtgtagcttaattaattatccaggtttaggagggatgatgttggtgatgcaccttagctgattcgccgaaaaggctcatatattctttggtctggttgtggtgcaagtgcccccgctgctgcttttaactgagatggttttgacctgttgatatatgattgttggctggcttcctgcctgtg

SEQ ID NO: 29295 - DNA, 798 bp, Triticum aestivum
  Clone ID: PAT_TA_29295
cggccccgctgccctgccgcctccacaccacccgacgtgcatagtacaaccaccatggccatggcgccatccgcgcgcgtgtcgctgatgctcgccgtggtgctcgtgtgcgcgctgctcgccgccaggcctgcagaggcgaccggcggcttggtgtgcaatccgctccaggacaagacgtgcaagtcgggggaccccaaggcgtctgagaacacggaggaggggggcgggttcggcgcgaagctgccatcgccgcccgttccgggccacggtatgatcgacggagacatcgacgatgagttgccgtcgttcagcacccacaagaccatcctcggtcactgggaggatccggtgctcgaagtctgacatctacgtgcatggttgtgtcttcttgcattcgcattgcttgtgtagttgtgttgttgtccagaagaaagaatgagacaaaggaagagatgagagagtgagcgtgccacgataaatgatttgccacttgtccctgttaatatcgtggacgctcaggaagaagttatagattctagtaattgatatggcctagttttggtcttcttattgttggccttgggatttttggagtgggaggtaccgactcactgattcgccctgggccctcctttcctccggtttattttgtttctttttaggtttttacttggtttttctttttacttttttattcaacacatgtctatgttttttcaaacacgtagttttttgtatacatcaagaactaatttttgtatatgtttaatatttttttaatacgcgattaacatt

SEQ ID NO: 29296 - DNA, 541 bp, Triticum aestivum
  Clone ID: PAT_TA_29296
ttagtacaaaaaatacttcattgattaattaaccggacaatcagatccatcgacacagacaaaacaacacaaccaattcttcagaaaaaaggtaacatggtcacgaaaactttaaacaaaacaacacatcccccgcggcccacagaagtgtacaataatgcaccgctcctccgtcacggccaccataaaaaagaatcataagctatagatgtatacctgcaaatgaatccttagcttaactctatttgttcctcgtcttgtccttcttgtactatttcatcttaaaaatcaacggagtatacgtagaaattaagtgatgatcatgtacgtgaagttgctgggccggatcacaaggcgctcatgtccttgacgaagccgtacttctccatgaatgggttcctgatctccttgggcgggtactcgtggatgcagtccgcccacacgccggcgtcggcggagggcctctccaccgtccagacgcagctgttgcacttgaaccccgcgccgaaagtgagcatgagcacgcggtcgcccttgttga

SEQ ID NO: 29297 - DNA, 651 bp, Triticum aestivum
  unsure (1)..(651): unsure at all n locations
  Clone ID: PAT_TA_29297
taagtatttgggcngtcccgttncagtgaccatttcctttgcaataaaaacatcagtctcgggtttggtccattcnttggttcttcccggcagcttgcttaccaaggcgcggcaactcctttgtcgtccttcntgaagttcttcttaccnttgcctttcttgaacttagtggttttattcaccatcaacacttgatggtcctttttgacttctacctctgctgatttcaccattggggtcgacgggggaatggtcttttccatccccttacatattgaagttcatcacaaagctcttgtagctcgatggaagcgactgaaggattctgtcaatgaccgcgtcatccgggagattaactcccagctgagttaagcggttatgtaatccagacatagtgagtatgtgctcactgacagaactattttcctccatcttacagctgaagaacttgtcggaggcttcatatctctcgacccgggcatgagcttgaaaaaccattttcagctcttcgaacatctcatatgctccgtgtctctcaaaacgcttttggagccccggttctaagctgtaaagcatgccgcactgaacgaaggagtactcatcagcatgtgtctcccaagcgttcataacatcatgttctgcaagggaaac

SEQ ID NO: 29298 - DNA, 668 bp, Triticum aestivum
  Clone ID: PAT_TA_29298
taaaacaaaacatgtacaaccctaaggacataagcggcgcagcaaagcgcgcactgcctttcttgtaagatatgacgcgcgacacccagccaggaggggaaaaatacatttttttgagcaggggagaatctatgagagataattgagactatttttctcgtccaatctctgatattcctaggcactacacagccaactaacaaacttggaggccaagtcgaaataataaaccttaggaactaaccaacttaagaatcaagaaatatctctgaaagatttaaaatgctaagggtaagccctgatacaccctggataaccattgttgcagaggcactaatgttcatcccgcacagtttatcagcaagcatggtccgcttccgcttctacaaaatgaatttccaggcaagctgcatcacattgtcatcaatatacggccgcaagtcccacattagacaatagccatctagctccgacgatggtgttttaaggcacagtgccttgactatcttctcctgcatcgaataatccaactttaacatattctgaaccagaatcataacgctcgagtaagatactgcgctgtccagcggatccacagactgcccttcatcctcacaagaatctgctggcaggctatcatcatcatcaaagcaatctgaagcttctaa

SEQ ID NO: 29299 - DNA, 729 bp, Triticum aestivum
  Clone ID: PAT_TA_29299
ccttgcagttccgcgacttgtcgtcccattcgagggtatcggtgaaccctcacttctgcttcaagggtcatcaagctcaccaaatgaaaactcgggagtgtctatatggccagtgactttcttcttctcttccttgactacccattcacctttaaatctcaagctcagctcataattataacctactctcttcttattacggcccgttactagaaatgcatcgcctgagcatttggacacttcatcaatagatgccttccccgtggagaaatccagtgaacctaaagaacccagcaaatcctttatcctaccattagcccatgaattgagattcttttcctcccatgttccagcctgattccagacggagccgagggcgttggggttgccgccgccgccgttggcggcggaggggtcgagcttgcgcgggacagggggaggcgccgcctcgcccgtggcctgccgcacccagtacctgtacgacgacttctccggcgtccccgtctccgccgccgtcacggtctccgtcgccgccgccacggccgccgtctcctccatcggcggatcgagctacagatctctcggcgagcgaaggagggaggacggccgggcgggtgggagatccgcgaggtcgcgcgccccttctcgggggatcgagaggcttcttccccggaggaggagaggattgccaccagaattttctgtgcgcgtcgcggatcgtatggagat

SEQ ID NO: 29300 - DNA, 1081 bp, Triticum aestivum
  Clone ID: PAT_TA_29300
gcgccgtctggtcggcataccatcattattctcggtgagacatcgtaatcatcatcatcatctgtgtttctgttgggttcatgacactaaacgtgcacagcaacacagaatctaagccatcaacggacatgtggcaaccgtgtaatcttacactgaccggagaaacaagaataacatgaccacgagagtcttagacagcatcgcttaatccgacacaacagagagtcccagctacaagaatgggtaacaacaccgaaaacagcacctagcacctgccggcactcgtagacattcactacctatctttcagctctagctcgaacgtccgcagcttctcctttataggtgaaaggaacaacttcacatccttgcagatccgcgacttgtcgtcccattcgagggtatcggtgaacctcacttctgcctcgaggtcatcaagctcaccaaatgaaaactcggggatgtctatatggccagtgaccttcttcttctcttccttgactagccattcacctttaaatctcaagctcagttcataattataacctactctcttcttattacggaccgttactagaaatgcatcgcctgagcatttggacacttcatcaatggatgccttccccgtggagaaatccagtgaacccaaagaacccagcaaatcctttatcctaccattagcccatgaattgaggttcttttcctcccatgttccagcctgattccagacggagccgagggcgttggggttgccgccgccgccgttggcggcggaggggtcgagcttgcgcgggacggggggaggcgccgcctcgcccgtggcctgccgcacccagtacctgtacgacgacttctccggcgtccccgtctccgtcgccgtcacggtctccgtcgccgccgccacggccgccgtctcctccatcggcggattgagctggggccctcgctcgctgtagatctctcggcgggggagggagatcggcgagggcgcgcgccccttctcgggggatcgagaggcttcttccccgggcggaggggaggagaggatgccaccagaaatttctgcgcgcgtcgcggcctc

SEQ ID NO: 29301 - DNA, 830 bp, Triticum aestivum
  Clone ID: PAT_TA_29301
cgggtcgaaggtcaatgccccttccttcagcaacagtcagaggaacctttgctccccctcggatgcagagggttcgacgatgagccgcaaacgcgcaggacttggcaggctatgtcgagcccaactagccagatcggagtctgtgcgatatgcccggccattgctgttaagatagctcctcaagagacacaagcaagtggatggtttatcccactctgggttgcatttgcaattctgattggtggtctattattggatgtgctgatatctgtttctcttggtgtttccgcacctcctgtgaacataataattggtgttctgattgttctcggcttgggcactgcccttccgactagctctcgagtgctgccaggagtttggctcgaggagaagcatgccaaggatggaaaacatggcacccagtgggtacctacccccggagtatagcttaggcctgtaaatagtatagaggtcaatgtttggattctccttttgacagctggtagttcttacacactgctccatgaaaacaagctcaaattcaaagcctgctgattacaatcaaatcacgtccttccgatgtaaatatgcagccctgatattgatctttcttgacgtgtttcttctgacactattagagagagctgcctgtcccagatctcttggttaaaccttactcaagatttctggtctagccctacctgggggccaagattagcgttaatgtgggtgtgagtttgtaaagggctgaaagccacttgttgctatctatggaatgcatgcagaagcctttgttgtgctttcaaaaaaaaaaaaaaaaaaaaaaaaaa

SEQ ID NO: 29302 - DNA, 1120 bp, Triticum aestivum
  Clone ID: PAT_TA_29302
gtgcggccccccctttttttgttcgcgagctatgttaacatctcagcaatggctagaacacgtacaatgctatgaaaaattcaagtcatttcaaaaattcaattcatttcatccaatcacctggaaaacacaacattctcaacaaaacgaaacataaccctctgcacgaagtcgacgcgtcgaagagttcgtccaattgttatacactaccccggtgcactagacgcgactcgaggcgagaagcagagcagccgcggctcaaagcgccttgagcatctcctcggcgctgctggtggtgaaggcgccgccctgctcgaggttgagcaccttgacgacgccgtcgtcggcgaggagcgcgtagcggcgggaccgcacgccgagccccatgggcttgtcggagaggtccatctccacgccgagcgcgcgggtgagctcgaggttgccgtccgacagcagctgcacgtcttcgccgaggccgaggctctccttccacgccttcatcacgaaggcgtcgttcaccgagacgcacgccacggtgtccacccccttggcgcggagctcgcccgcattcgcgatgaaccctggcaggtgcttctgcgagcagcccccggtgaaggcgcccgggaccgcgaagaccacttcttgatccatgcattcggctgcccgaccgtccgcagctagagctgggcttaagcgcggcccagggaccagcgaggagcacgacgctgcttcccggcagtcagcttccccgacagtaaccttcttgagcttcgccgtcggccggggtcgaagtaggagagcgtggcgtcgggcagcttgtcgccgaccgcgatggtggccacgaccgtggatgccgatgccgcggaagccgcgaatctcctcgcccccgggacggcggcggcgcggaggcgggctggggcggcgatgcggcgggaggcgaaggagagcgacggggaggagatgacgaagcgcttgccggcggcggcggccgccgaggacagagcggagagcgacgcggtggccatggaggaggggcgaggcgatgtgttcgaggaaatgccgtctgttcggccttggaaagagcgtggggtgtggagtttgggttttggattgaaggaac

SEQ ID NO: 29303 - DNA, 1883 bp, Triticum aestivum
  unsure (1)..(1883): unsure at all n locations
  Clone ID: PAT_TA_29303
gtggtgtccattgagcttctagtttactagtacgctagtactccgtacttggttattgtctccgacgcccgcgccgtcgtcttcctcttcctccccttccccttcccttgattcttcgtcgcttccgcctgccgccccgcgccgccgcacagataactaaacgggtggcgagacatgacggcgacgcctgccttgatcgggctgagcgcaggcaaccgccttctcagcacgtccttcgggccgcccaacgacctgctctccgacaaggtcaactgccacatgagcagcgcggcgggagacgcccacggctcctcctcgctgcagttcgcgccaccggccgcgtccaagctcaccgtcgccgcgcacaggctcaagctctccccacatggccgcgcgcaggtcatgcgggccctcaggcagagcgcgcctgcgctcgcgccgcagcctcctccgttgttgcccgccgacgagttctccctcgatgccattatcctgctgcagaggtccatgctcgagaagcagtggcagctccccttcgaggaggaggacgacgacgacggcggcggcgatggccaccatgtggaggccattggttcggccgaggacgatgacggcaagggcaggagcagctccgtcgtcgtggcgcgctccggcgtctcggcgaggcagcggcggatgagcggccggaggcgtgggaggtccaagaaaggcagcggcgccgtgcacctgagcatcagccccgagctgctgcagagcagaaaccgcatctaccttcgcggtaccgtcagcaaggagctcctcacgcacaagcaggttgtccacctctccaagaagatcaaggacgggatatggctgcagcagcaaagatcaaagctgaaagaaaaactggggaatgagccgtcgtacaagcagatggcgcaatcacttcggatatcgacgccggagctacggtcaagaatgcgcgagtcgttcctcgcgagggaggtgctaacgatgagcaacatccgtttggtcatatccatcgcccagaagtatgacaagctgggggttgagctgtccgacctgattcagggtggtctcatagggctactccgcgggatcgaaaagttcgatgcatccaggggcttcagaatttccacttacgtatactggtggattcgtcagggtgtttcaagagcactggccgacaactcgaaaacattcaggctccctacttacctgcatgagaggctgattgcgattcgtggcgcaaagtacgcattggaggaccaaggggtttctccgacaacgcaaaacatcgcaaagttgctcaatatatcggagaagaaagtgcacaatgctacagaggctgtcaataaggctctttcgttggatcaacaggcattcccctccttaaatggcctacccggagatacactccacagctatatagaggatcaaaatgttgcgaatgacccatggcatggatttgaggagtggtatctaaaggaggaagtcaacaaacttctaaactcaaatctcactgaacgtgagagagacattattcagttataccatggtatagggaaacaatgccatacatgggaggatattagcagacagttcgggttatccagggagagggtgaggcaagtagggcttatcgcaatggagaagctgaagcaacgcgcgaggcggaaaaagctggatgcgttgctccaggattactgagctgaggtgtttttcatgttgtgctgggaccggattcatacacacagtgggtgtatatactcnaaaaagagagagcgacaacataggttacaacaattgaaagggttgtactggcactcacctgcaaataatcatacctgttcattttgtgacaataggcatgccaatggatn

SEQ ID NO: 29304 - DNA, 1318 bp, Triticum aestivum
  Clone ID: PAT_TA_29304
cgacaagctcagccccgctctttcgcttacgtcggcttctattaggtcgcagatcgagagccgaagacaggttatcttgatagcattagaaggcttgagccagacaactcttgtcagcaactgagtggcatatttcgctaggtttcaccaccaagaatatcaagatgacattctatggtacacaggacaagtgcaaggcttgtgacaagaccgttcatttcattgacctccttactgcggatggcattccctaccacaagtattgcttcaaatgcagccattgcaaaggcactctttcgatgtgcagctactcctccatggatggagttcttttctgcaagactcattttgagcagcttttcaaggaaacaggcagcttcaagaaaaacttccccacatgcgcaaaggcaaataatgagcagtctaaggtcccaaacaagtatggctctgtgttctgtggaactcaggacaagtgtgctgcctgcaagaagactgtgtacccattggagaagatgaccttggagggcgagccctaccacaagacctgcttcaagtgcgctcacggcggctgcatcctgacgactgcctcctatgcctcccttaacgggatcctatactgccagaaccacttctggcagctgttcaaggagacgggcagctacagcaacctgctcaagcccgcctccaagaacgccgacgagccagaggcggccaaggaagaggagcaggcgccagaagccgtcgaggaccaggtgccagaagccgtcgaggaccaggagcactcataagaaactacactacacgtaaacagttacaagaacctacatacatgttcgttccccacgctgatgttgctcttgtgtattgctgctgctgcccatcttttttctcatcccacagaggcacgcagtggctgttatgcatcttatcgccttggctatcgcaatcctgaattctgtatctcattgcccatgccatcatcacgtgaatggtagcagaatttgcacaagtttgttctattcttggtcttgcaattccaaggatattcgaaagagggggagggaagcattgatcaaacactgttcttgctcttttttctcctctataaatggtactattagaagacaattcaaactctaaaaaaaaaaaaaaaaaaaaaaaaaaaaaagtaaaataaaaaaaaaaaaaaaaaaataaaagaaaaaaataaaaaagaataaaaaaaaaaaaataaaataaaatataaaattataattaatttaattaaaaattaaaattaaattataatgaattaaaaaaaaaaagggggcccccaaaa

SEQ ID NO: 29305 - DNA, 833 bp, Triticum aestivum
  unsure (1)..(833): unsure at all n locations
  Clone ID: PAT_TA_29305
acatggttgcctatgcacttaagagcgaaggaggctatgtttgggcttgcaagaactatgacggagatgtgcagagtgatttcttagctcaaggttttggctctttgggcttgatgacgtcagtattggtatgtattttctcattactaatgttcttgaatcttgactaaatcttgggtgttatctctagtgtgaaaagcctttactttggtcatatccatgtcagtacttctaaatatatattgagaatatttgttaggttgtgctaattccttttgatatttatagatgtgccctgatggtaaaaccatcgaagctgaagctgcccatggcacagttacccgccatttccgtgttcaccagaaaggtggtgaaaccagcacaaacagcattgcttcaatctttgcttggacaagaggacttgcacacagggcaaagctagacgagaatgctagacttcttgaatttgcacagaaacttgaggaagcgtgcgtccggaactgtggagtctgggaagatgaccaaggacctttgcaccccttgtccatgggttcctccaaaanttacaagaagcgattacctggaacactgaagantcaattgacgctgttgctgctgactcaaatcaaagactgtgaaaactccttccacttnnaatgctccaatancattacccacgattccanccatttgggtaagtccgccatacctgcnagctttcctccctgaacaagacacttttacgnacnacccatattatgtcaaacatcaangatccngtaatccgatntatgttaatggggccaacataaaggcatatggaccattatcac

SEQ ID NO: 29306 - DNA, 713 bp, Triticum aestivum
  Clone ID: PAT_TA_29306
gaggcatcccccacccaatcgaaggagcggcggcggcggcggcggcgaccggagaagatggtgcgcaaggcgaaggttgagttcgacgagcagccgccggataacttcgacccgaagaacccgtatggggacccggtggcgatgctggagtaccgggagcacctggtgcgggagaagtggatccagatcgagaccgccaagatcatccgggagcgcctccgctggtgctaccgcatcgagggcatcaaccaccaccagaagtgccgccacctcgtcgaccagtacctagagtctacccgcggcgtgggttggggcaaggatgctcgcccgcccgagttccacgagcccaagaagaccgtcgaggcggagtagcggcgctgctgcacggcttctcgtgctgctgttcctggatcggagaggtgatctgatccttccattgaatcgaaagaagtaacttggaactgttgcagtttgtcttttacatctgaagctgctgatagacttcaaataaaatgttgtccaagaaaacattcttatgcccgtacctgttgttcttgtcgagctgtgtaattgagcgaattgtggcttgaaccttggtgcctaccttgttcttaaaatcctaatgttcgagtttatccagacggtgtttttttgtgtgttttttcactgtaaactgcatctttgatctgcaaggatacgaaaggcaccattga

SEQ ID NO: 29307 - DNA, 800 bp, Triticum aestivum
  unsure (1)..(800): unsure at all n locations
  Clone ID: PAT_TA_29307
tttttttttttttttttttaatctaccactgacatactttatttcacggattataacactatgatcgaccgatacagacttcgatatgaccatgaacaactcttacctaacataactcagttgctaaatcaactacacatagcctagctgatgcaactagacacacttctcagtcgctacaccaactacacatagctcagctgatgatgcaactacctccatacttttcagtatatataatttacctcataactcataccttcgacccacacacgcacacataaacttcaattattaacatcactgcaaccaaacctgagacccactccctagctaccagattatcgccacctaaaccaagaaccaacccttaatcattctgactgaccgacaattaacaagctacctaacgacatcaaggcgaaccaaacacctgtgcagcagcagcagcaccgcgcgaacctaaagcaaccaccaccaaaccctaccgccggccatggcgatgaacatcgccagtgccagtaggctgctaagccctagaggcaaggaattgcatactccacaagaacaattcccccaacaacaacaattcccccaaccacaacaattcccccaacaacaaatcccccaacaacatcaaatcccccagcaaccacaacaatttnccccaacaacaacaattccttcaacaacaacaaaatcccgcaacaacaaatnccccaacaacatcaaatcccccagcaaccacaacaatttccccagcaacagcaattncccaacaacaccaattcccccaacaa

SEQ ID NO: 29308 - DNA, 700 bp, Triticum aestivum
  Clone ID: PAT_TA_29308
ccattccccaatccccacgacgagatccatccaccccagaggccaagaagagaagggaggagagagagaggccggcggcggcggaggatcagacgatcggagatggtgcggaaggcgaaggttgagttcgacgagaggccgccggatgacttcgacccgaagaacccgtacggggacccggtggcgatgctggagtacagggagcacctggtgcgggagaagtggatccagatcgagaccgccaagatcatccgcgaccgcctccgctggtgctaccggatcgagggcgtcaaccaccaccagaagtgccgccacctcgtcgaccagtaccccgagtccacccgcggcgtcggatggggcaaggaccaccgcccggcggacctgcacgagcccaagaaggtggttgaggtcgaggagtagctctgcttccgctgccgttcctggaatggagaggtcagggtgcttcttgttattatgtcatctttccattcgaagtgaaggaagtaacttgaattgccgcagctcatctcttacctctgaagctgctgataggcatttaataaatgatgatgcgaaggaaacattgttgtgtggtgtctgtattttttcttttgtcaaattcaaggagttaagcaaatcgttgcttggacttgcctaccttgtttcgagtttcatttatacaaatgatgtttagttgctc

SEQ ID NO: 29309 - DNA, 580 bp, Triticum aestivum
  unsure (1)..(580): unsure at all n locations
  Clone ID: PAT_TA_29309
gcacgagggccatccgactcaattcttatcgaaatttggacaatggccgaaggcaagaaggacaatccgaagctgaaccagcgggtcgtatcatctctctcgaagcgaactgtggcggcacattcttggcatgatctcgagataggacctgaagcccctcaaatcttcaatgttgttgttgagatcacaaaggggagcaaagtcaagtatgaacttgacaagaagactgggatgataaaggttgacaggattttgtactcgtccgtagtctacccacacaactacggtttcgtaccacggacgctgtgtgaagatggggatccactcgacgtcttggtcctgatgcaggaacccgtcattcctggttgctttcttcgagctaaggctattgggcttatgcccatgattgatcagggtgagaaagatgataagatcattgcagtctgcgttgatgatcccgagtaccgtcatttcaatgaccttaaggagctctctccccaccgccttgctgaaatccgtcgcttcttcgaagattacaagaagaatgagaacannnnnnnnngctgtgaatgacttcttg

SEQ ID NO: 29310 - DNA, 413 bp, Triticum aestivum
  Clone ID: PAT_TA_29310
ttggttcggggaaggttgctttgcgggcaggcttcgccggcggggaccgacggcccggccgcgggggcttgctttcgtcgccggcgacgccaaaagagccggctttggcggcgaagagccagcaaccaccgcgaccaccttgggcggcggcgaggccggcttggggtggcgccggcggcgctgcttggcggcctggggggacgcggcgaaggcgtcgagatgcatcctgttggcgagcgcgtcgtgggatctgagcaccgccgtcgccataggctcgtcggcgcgggactagatcgactggatccgctcgctgcttggcgccgtcgtcgagatttgcggattgggccgcgccgggggagacctaaccctaacgagcgagaagagggaatctgcgggaggaagaaaacaatggg

SEQ ID NO: 29311 - DNA, 962 bp, Triticum aestivum
  Clone ID: PAT_TA_29311
cccacgcgtccgcggacgcgtgggcggacgcgtgggtttatatccgtcatccgactcgatccttatcgaaatttggacaatggcggaaggcaagaaggatgctccgaagctgaaccagcggatggtatcatctctctcgaagcgaactgctgcggcacattcttggcatgatctggagataggacctgaagcccctctaatcttcaatgccgttgttgagatcacaaaggggagcaaagtcaagtatgaacttgacaagaagactgggatgataaaggttgacaggattctgtactcgtccgtagtctacccacataactacggtttcgtaccacggacgctgtgtgaagatggagatccaattgacgtcttggtcctgatgcaggaaccagtcatacctggttgctttcttcgagctaaggctattgggcttatgcccatgattgatcagggtgagaaagatgataagctcattgctgtttgcgttgatgatcccgagtaccgtcatctcaacgaccttaaggagctctctccccaccgccttgctgaaatccgtcgcttcttcgaagattacaagaagaatgagaacaaggaggttgctgtgaacgacttcttgccaccggagactgcacaggccgccattaagcactccatggacctatatgcagaatatatactgcagagtctgaagaactaatcgtggtagcaaacttgcaaggctgcagaaaccacccacatggtctcgtaagaggacaataatcgactacatggcttttatttaagggcccattttttctatatatttaaataatgggaaatgctattcccatacgtatttttctgcagaacattgtaatcaaggactaatgttatacttgtgcatagtgtttcataatatttgaatcaacacttgaaacatttagtcttgccctgttggcctgaatttcaaaataattatttgg

SEQ ID NO: 29312 - DNA, 895 bp, Triticum aestivum
  Clone ID: PAT_TA_29312
taagagtgaaggaggctatgtgtgggcttgcaagaattacgatggagatgtgcagagtgatttcttagctcaaggttttggctctttgggtttgatgacatcagtgttggtgtgccctgatggaaaaaccattgaagctgaagctgcccacggcacagttacccgtcatttccgtgttcaccagaaaggaggtgaaaccagtacgaacagcattgcttcaatctttgcatggacaagaggacttgcacacagggcaaagctggatgacaatgctaggctactcgacttcgctctcaaactcgaggctgcttgcgtcggaactgtggagtctgggaagatgactaaagatcttgcacttcttgttcatgggtccgccagcgtcacaagaagccattacctgaacactgaagagttcatcgatgcagttgctactgagctccgatcaagattgggagccaattgagcttacaagaaactttgtggcatggcgacttgaatgcttcatcaccgatctgctccagtcatttctgttacattggtactgccagtcatgcttccgtgatgaattgaatgtgcgtcatcgcaatgcaatttcgatcgaagctgattaaagatgatggtgtcacgtgagcgcccataataaaggatatatagaacaactgtggcagatgattaaaatacttttatgtttgctaagttcagtcattccctgggtattttcttgttttctccttttctgtagttcacaaatcacgcagttcgttcggtttggtttgcccattccgtagttcgccgataaccgtatgcactcggtttttccatcatcatcaagtaaacagatgccttccgttaaaaaaaaacccaaaaaactatgtatatgctaactctttcgatg

SEQ ID NO: 29313 - DNA, 997 bp, Triticum aestivum
  Clone ID: PAT_TA_29313
atggctatacaaacaataataagattggattacaatgtcgtgatgacaataagattttccatgcggcttgcatcactgagtctaaaactcatatgaaatggaaactaagatttgattactatctcgaacacaacacccagtgtacacatacaacacgagaaaatacaaaccatgaaggcactatccaaatcgtatgttttcgatgttcatcactacacgctttgcgcactttcacacagttacagtacactatttgggcaaagatttgataaaattgacaatgagatctaccatctgggcatcaaaagcaggaccttccatttggaagtgaccggctccttcaatcaagtgtgtatcaacccgtccagcagccgacctgagcttgttttgcagctgctttacgctcgtaaagccatctttggttcccatgatgaataactttggtttctcagacttgaggatagcatcatgatgtctgccgaataggattgaggccattaaaccaaatgggtagccgatgctgacatagccaaccacctggtcaactttatcaactgcagatcccgcaattggtgctccggcggaggagccgatgaggaggacggcgcgcggcttgagggtgtaggcgacccagcggcagacggcgacgacgtccccgacctcgctggagcccgtgagcgaggcgcggccggtggagcgcccggcgccgcgcatgtcgaaggtgacggcgcggtggccccgctccgcgaggccctgggccatgccgcgcagcaggccctgcacgccgccgaggatcgtgtaggggtgcacgagcaccaccgacacgtcctccgcgccctccaccggcgccgccggcttgaagacccgcacgctcagcttggccccgtccgccgcctccaccgtcgtccactccatcctgctcccgtccggctccggccagtccactccggggggttgagctacttcctgccccgatttgatctgccccgtaccattt

SEQ ID NO: 29314 - DNA, 935 bp, Triticum aestivum
  Clone ID: PAT_TA_29314
gctcaattcttatcgaaattcggacaatggcggaaggcaagaaggattctccgaagctgaaccagcggatggtatcatctctctcgaagcgaactgccgcggcacattcttggcatgatctggagataggacctgaagcccctctgatcttcaacgccgttgttgagatcacaaaggggagcaaagtcaagtatgaacttgacaagaagactgggatgataaaggttgacaggattctgtactcgtccgtagtctatccacataactacggtttcgtaccacggacgctgtgtgaagatggagatccaattgacgtcttggtcctgatgcaggaaccagtcatacctggttgctttcttcgagctaaggctattgggctgatgcccatgattgatcagggtgagaaagatgataaactcattgctgtttgcgttgatgatcccgagtaccgtcatctcaacgaccttaaggagctctctccccaccgccttgctgaaatccgtcgcttcttcgaagattacaagaagaatgagaacaaggaggttgctgtcaacgacttcttgccaccggagactgcacaggctgccattaagcactcgatggacctatacgcagaatatatcctgcagagtctgaggaactaatcatagttgcaaactcgcaaggctgcagaaaccaccaacatggtctcgtaaaaggacaataatcgactgcgtggattttatttaaggacccattttttctatatatttaaataatgggacaatgctattcccatacatatttttctgcagaacattgtaatcaaggactaatgttatacttgtgtatagtgtttcataatatttgaatcaacacttggaacatttagtcttgccctgttggcctgaatttcaaaataactatttggaaaagacgattgccagtcttgaagc

SEQ ID NO: 29315 - DNA, 1075 bp, Triticum aestivum
  Clone ID: PAT_TA_29315
ttttttttttaatctaccactgacatttttatttcacgaattatagctctatgatcgaccgatacagacacagacttagatatatcttacaaaggaccatgaacaactcttgaaatacctaagataactcagctgctaaatcaactacacatagcctagctgatgcaactagacacacctctcagttgccacaccaactacacatagctcagctgatgcaaccaccatactaatttacttacctctcagtatataataacttgtaataactcataccttaaccttaatcttcaacccccacacacgcacacacgcataaacttcaattattaccaaacctgagacccactccctagctaccagatcatcatcgtcacctacaccaagattaacaacctacctaacgacatcaaggcgaaccaaacagcagcaacgcgcgaacctaaagcaaccaccaccaaaccctaccgccggacctccgctcccccggatgacccttcctctgaaaaaataccggaagggttcgatcggaacggagcttccgggatctgatccgccggatcgaaccacacaccaaccatccgcagataaaatccttccgtccttcagtcagggagagttattaccacctcttcttcttcttgctgttgcttccagaggagatgaggcgagacgagggggaggagggaggagagcagaacggcgcagccacggaggaggcgcacacgctgctgctggagggggagccgtcatcatgagagctcgccgatgcggagcaggcaccggaggccgcgggtggcctcttcctctgcgcgccggaagaagaatcccggcaggggcagggagctcggctctggggccgcggcagagaacgccgggccggcgtagcttggttgcgatggcgactggcaccatctttttagtcgggacgacggaaggttgctgcgggccgatccggctggtggtccggagcgccctcttgtcggccggcggggcttgcgcccgggccgacgcgataggtgccgaggctgggggaggagaccgtacgcgcctgtccgctggcggggtctggggc

SEQ ID NO: 29316 - DNA, 1049 bp, Triticum aestivum
  Clone ID: PAT_TA_29316
gcacgagggttaatatcgcggcatcgggtcctgcgctgcgcgcttgctgctgctccctcgccctcgcctccgctgccgtcgcgccagatcaaccccgccgccatgtctggagaagctgatgggaagacctaccaggtatcaaggatgccccctgctgctctcaatgagcgcatcctttcttccatgtctcaaaagcacgttgctgctcacccatggcatgacctggagataggtccaggagcccctgcagttttcaactgtgtggttgagattcctagaggcagcaaggttaagtatgagttggacaaagcaactggtcttatcaaggttgatcgtgttctgtactcctcagttgtgtacccacacaattatggcttcattccacgcacactctgcgaggataatgacccgatggacgtccttgtcctgatgcaggaacaagttgttcctggttgcttcctgcgtgcccgtgctattgggcttatgcctatgattgatcagggtgagaaagatgacaagatcatagctgtctgtgctgatgatcctgagtaccgtcacttcagagacatcagtgaacttcccccgcatcgcctacaggagatccgtcgcttctttgaagactacaagaagaatgaaaacaaggaggttgcagtgaatgatttcctcccagcagaagatgccatcaacgcaatcaagtactcaatggacctctacggttcgtacatcatggagggcttaaggaagtgatctccagctggtggactgcagatgctacgcgatccgccctacggcttattaatagtacggcagacatttatgttgacatgatgatcgaaaaccatcagtctgtcggggatctatatataccttctgtccatgctgagccaagcatgggtacattttccttccgtatatgccatgtcaggtccaagtatttgacctcttgctggaaccttttttgtcaaaccgtctcttaacagagcggctgcttaataggaaatcagcgttacgtgaaggcgcgtatgcgtgcctccagtccgtttaaccgt

SEQ ID NO: 29317 - DNA, 1262 bp, Triticum aestivum
  Clone ID: PAT_TA_29317
tcccagtatatgctctctcgcctcgtctcgtgggtggtgcgagggaatccggtgcggctcggccccccaaccgcggcttccatcccactcctgcttccactaaagcgttatcccccgcgtggccgcctctccgccgtccagccaccgatccgacggccacggaagcccgagcgaccggccccggacgcacggcgctttccccccatatatctttcgcgtcgccagaaaggaaggccacgcctcaaagttaatatcgcggcatcgggtcctgcgctgcgcgcctgctgctgctccctcgcccgcctccgctgccgtcccgcgagatcaaccccgccgccatggctggagaagctgatgggaagacctaccaggtatcaaggatgccccctgctgctctcaatgagcgcatcctttcttccatgtctcaaaagcatgttgctgctcacccatggcacgacttggagataggtccaggggctcctgcagttttcaactgtgtggttgagattcctagaggcagcaaggttaagtatgagttggacaaagcaactggtcttatcaaggttgatcgtgttctttactcctcagttgtgtacccacacaactatggcttcattccgcgcacgctctgtgaggataatgacccaatggacgtccttgtcctgatgcaggaacaagttgttcctggttgcttcctgcgtgcccgtgctattgggcttatgcctatgattgaccagggtgagaaagatgacaagatcatagctgtgtgtgctgatgatcctgagtaccgtcacttcagagacatcagtgaacttcccccgcatcgccttcaggagatccgtcgcttctttgaagactacaagaagaatgagaacaaggaggttgcagtgaatgatttcctcccagcagaagatgccatcaacgcaatcaagtactcgatggacctctacggttcgtacatcatggagggcttaaggaagtgatctccagttggtggactgcagatgctacgctatccgccctacggcttatcaatagtacggcagacatttatgttaacatgatgatcgaaaaccatcagtctgtcggggatatatatatataccttctgtccatgctgagccaagcatgggtacattttccttccgtatatgccatgtcaggtccaagtatttgacctcttgctggaaccttttttgtcaaaccgtctcttaactgagcggctgcttaataggaaatcagcgttacgccgaaaaaaaaaa

SEQ ID NO: 29318 - DNA, 1680 bp, Triticum aestivum
  Clone ID: PAT_TA_29318
ttttttttttttaatctaccactgatatattttatttcacgaattataacactatgatcgaccaatacagacacagacttttggatatcttacaaaggaccatgaacaactcttggaactaacattaactcagttgctaaaccaactacacatagcctagcggatgcaactagacacacttctcagtcgctacaccaactacacatagctcagctgatgcaactaccatactcatctctcagcatatataacttgttgcactcataataactcataccttacccttaatcttcgacccgcacacacgcacacataaacttcaattattatcatcactgtaaccaaacctgagacccactccctagctaccagatcatcgtcacctaaaccaagaaccaacccttaatcgttctgactgaccgacaattaacaacctacctaacaacatcaaggcgaaccaaacagctgtgcagcagcagcaacgcgcgaacctaaagcaaccaccaccaaaccctaccgccggacctccgctccctcgacgacccttcctctgaaaaaataccggaagggttcgatcggaacggagccgggatctgatccggcaagctcgccgccggatccatccgcacaccaaccatccacagataaaatccttccgtccttcagtcagggagagttattaccaccaccacctcttcttcttgttgcttccgacgagatgaggcgagacgagggggaggagggagcagagcagaacggcgcggccgcggagggggcgcacacgacgctgctggagggggagccgtcatcatgagagctcgccgatgcggagcaggcagcggaggccgcgggtggcctcttcctcggcgcggcggaagaagaacccagggagggggagagagctcggctccggggccgcggccgagaacgccgggccggcgtagctggctgcgacggcgagcggcaccatcttcttggttggcacgacggcgggttgctgcgggccgatcccggctggtggtccggagcgccctcttgtcggccggcggggcttgcgcccgggccgacgcgataggtgccgaggctgggggaggagaccgtacgcgcctgtccgctggcggggcttggggccgggccttgacgacgggcggtgaggcaggggagggagaccgcagacgcctgtccgcgggcggggcttgcgcccgggcctggacaggtgcaggggcgggtgaggggaccgggggctcctcgccacgcttgaggatccggacggcctccatcacgatgggttgctgccggggcttctccttggtcggggacggctgcttgcgggcaggcttcgccggcggggaccgacggccggccgcgggggcctgcttcaacgctggagacgccaaaagagccggctttggcggcgaagagccggcgaccaccttgggcggcggcgaggccggcttggggtggcgccggcggcgctgcttggcggcctggggggaggcggcgaaggcgtcgagatgcatcctgttggcgagcgcgtcgtgggatctgagcaccgccgtggccatgggactagatcgagtggatccgctcgctgcttggctcaggggggcgccgtcgtcgggatttgcggattgcgccgcgccgcgccggagacctaaccctagcgagaagaagcggacg

SEQ ID NO: 29319 - DNA, 854 bp, Triticum aestivum
  unsure (1)..(854): unsure at all n locations
  Clone ID: PAT_TA_29319
cccacgcgtccgatccgctcgtctctctcccccattccccaatccccacgacgagatccatccaccccagaggccaagaagagaagggaggagagagagaggccggcggcggcggaggatcagacgatcggagatggtgcggaaggcgaaggttgagttcgacgagaggccgccggatgacttcgacccgaagaacccgtacggggacccggtggcgatgctggagtacagggagcacctggtgcgggagaagtggatccagatcgagaccgccaagatcatccgcgaccgcctccgctggtgctaccggatcgagggcgtcaaccaccaccagaagtgccgccacctcgtcgaccagtacctcgagtccacccgcggcgtcggatggggcaaggaccaccgcccggcggacctgcacgagcccaagaaggtggttgaggtcgaggagtagctctgcttccgctgccgttcctggaatggagaggtcatctttccattcgaagtgaaggaagtaacttgaattgccgcagctcatctcttacctctgaagttgctgataggcatttaataaatgatgatgcgaaggaaacattgttgtgtggtgtctgtattttttcttttgtcaaattcaaggagttaagcaaatcgttgcttggacttgcctaccttgtttcgagtttcatttatacaaatgatgtttagttgcccttttgcctttgcatcttgagtttacaagtgtgtaggaaagacggctcttgctgtgccgtacaagttctttctattatgtcactgctgccttttttgtatgaaatgagctgcacattgccgtactgnaatgaatgggggagcagccg

SEQ ID NO: 29320 - DNA, 2947 bp, Triticum aestivum
  Clone ID: PAT_TA_29320
gtcgacccacgcgtccgcgcaggtctcgaggaagctcgtacagagcctcaaggagatcgtcaaccgcccggacgccgagatctacgccgcgctgcgcgagtgctccatggaccccgacgaggccgtcagccgcctcctctcccaagatacctttcaagaggtaaagagcaagcgtgacaagaaaaaagaggttaaagagactcctgagccaaggtctcgagcggcaaataatgctaccagtcgaggtgtaagaggcggtccagatcgaggtgggcgaaacaactctgcttacaacagctccattgataacatgacctcaaggtcatctgtctcaggatctggtatgccatcaaccaattccacccagaagcaaacagtttcaagttcctccgtgaacaaaaatctggttgctgatgcaccgtcagtaccaccacaaacatcatctgggtttcagcatggctggtctgggacgccaggtcagttgtcaatggctgatattgtgaaaatgggtggcaggccacaggctcaggggaagccttctaccaagactgtggtcacagcggacaaaggatatgctggacaatacccatctttgcccaccactgtaaaccagaatgcaaaacaatctgcgagcacagttgcaccaacagagcttgaccaggggttaccttctgcgcaagattctgttctggttaaggaccacagtcatacagctgctgataacaagcaagaaatatgataatgattggtctccacaagatgacccgccagcagggaatcaatcctccatccctgagacatctggggacccatcgttatttgaggcaccattacatccatcgacgcatgttgctgatgcggtttacttgcatgaaaattcttatttggatgataacatctctgctgcaatgagatcaggaaatgcttctgagagacacttggatcactatggagggaattctgaatataatgatggattattgcagaactcgagtacctatctggctcagacgcattctcacatagaggaccaagctgaggagtccaatgctgatgtatcagcagcagcaaacttccagggtctgagcctacatgatgaagagctagctgccacaaagtttgccgaagataacccagcagttataattccggaccatctgcaagttgccaacacaggctgtgccggattgagctttggcagtttcggatctggtgcattttctgggctcctcccgccgccaaagagcactgaaaacaatgtggagttgcctattgtggaggaatctgaacctatagatcatactgatacgagggatcaagatttctatgaaattcctccgaattcgccaccaaatgagaaccttgaggaaattatgggagctaacactgagaatcttgatgtaccttctgttcaacagcctgatgtcctgagacaagaaatactggatgacccttcaggtgttcaatataatctgccatcagtctcgagccacgcgtatgcgaacccagcacagccaaatgcaatggatgccatgcaaggaagtaaccaagcgcacactctttcacacctgtcaagcttgctgcaatcaaatacgttacaacaacacaacctgttgggctcaaatatggcacctcttcgggacttggacttcggtttatcacctttgttggcagcacaagcacaatcaatgggtgcaagatataactcagctgcaccaactactactggcatgcaggagccaatgaagccaggagttttctcgaacactcaatccacacaaaatcttccgagtaccagcattcagatggccccctctcttcctcagcaattagtccatccttactcacagcccactttacctattgcacctttcgcaaatatgattggcgcaaatatgattggctataatccatacttggcacaaaactaccctgcttacttaccatcaaccgccttccagcaagcttactcgagtaatggacagttccatcagtctgccgctgctgtacctggagctggcatgaagtactcgatgccacaatacaagaacaacatgtcagctgcaaacttacaacaacaacaacaagcttcgtcggttatatctggttatgcaggctttggtagctcaagtaaccttccaggaaattttgccctcaaccagaatgctgcccctccgtcggccaatcttgggtttgatgaagcattgagcgctcagtacaaagaggccaatcaatacatggctctccagcagcagggcgacaactctgcgatgtggcttcatggggctggttcaagaacagcgtcagcacttcctcctacccagttctacggctaccagggacagagccagcagcagggcgccttccggcaggcgcagcagccccagcagccttctcaatacgggggccatggatacccggcgttctaccattcccagggcggcatggcgcaggagcaccacccccagaacccggccgatggagccctgaatggctaccaggcgggcaccgcagcagcagcagcagcagcagcagccatctcaccagagctggcagcagcacgccaactattgagcccccccgcactcttgttgcggtgctggctcactgtggcaggactcgctgcggagtaaagcagctcagagtagctgagcttgtggctcgctgaggagagggtccgcgtctcggcagagcgttttaacgtgttgcgtgtgtcatgtcggtgttgtcggactgatgtgtttgtttttcggtcgagttatatgcgcggagcacaacagtcttgtaactctttggagacatagtttacctaacaggtgcctttttctgaaaaaaaaaaaaaaaaggtttgatgaagaatcccttggtcagccatgaaagccccaaacctgttgttcacatactctgtgccattgtcagtcctgagcacctcgaccccacgcgtccg

SEQ ID NO: 29321 - DNA, 792 bp, Triticum aestivum
  Clone ID: PAT_TA_29321
cccacgcgtccgcccacgcgtccgatccgttcgtctctctcccccattccccaatccccacgacgagatccatccaccccagaggccaagaagagaggagagagagagagaggccggcggcggcggcggaggagcaggcgatcggagatggtgcggaaggcgaaggtcgagttcgacgagaggccgccggatgacttcgacccgaagaacccgtacggggacccggtggcgatgctggagtacagggagcacctggtgcgggagaagtggatccagattgagaccgccaagatcatccgcgaccgcctccgctggtgctaccggatcgagggcgtcaaccaccaccagaagtgccgccacctcgtcgaccagtacctcgagtccacccgcggcgtcgggtggggcaaggaccaccgcccggcggacctccacgagcccaagaaggtggtcgaggtcgaggagtagcacggtcgcttccgtcgccgttcctggaatggagaggtcatctttccattcgaagtgaaggaagttacttgaactgccacagctcctctcttacctctgaagttgctgataggcatttaataaatgatgatgcgaagcaaacattgttgtgtggtgtctgtatttttttttgttaacttcaaggagttaagcaaatcgttgcttggacttacctaccctgtttccaatttcatttatacaaatgatgtttagttgcctttgccctttgcatcttgagtttacaagtgtgtatgaaagcacggctcttgctgtgctgtacaagttctt

SEQ ID NO: 29322 - DNA, 787 bp, Triticum aestivum
  Clone ID: PAT_TA_29322
cgtttgtctctctcccccattctccaatccccacgacgagatccatccaccctagaggccaagaagagaagggaggagagagagaggccggcggcggcggcggagcaggcgatcggagatggtgcggaaggccaaggtcgagttcgacgagaggccgccggatgacttcgacccgaagaacccgtacggggacccggtggcgatgctggagtacagggagcacctggtgcgggagaagtggatccagatcgagaccgccaagatcatccgcgaccgcctccgctggtgctaccggatcgagggcgtcaaccaccaccagaagtgccgccacctcgtcgaccagtacctcgagtccacccgcggcgtcgggtggggcaaggaccaccgcccggcggacctccacgagcccaagaaggtggtcgaggtcgaggactagcacggttgcttccgccgccattcctggaatggagaggtcatctttccattcgaagtgaagtaacttgaactgccgcagctcctctcttacctctgaagttgctgataggcatttaataaatgatgatgcgaagcaaacattgttgtgtggtgtctgtatttttttttgttaacttgaaggagttaagcaaatcgttgcttggacttacctaccttgtttccagtttcatttatacaaatgatgtttagctgcccttgcctttgcatcttgagtttacaactgtacgaaagacggctcttgctgtgctgtacgagttctttctattttgtccctgtgctgcttttttgtatg

SEQ ID NO: 29323 - DNA, 2940 bp, Triticum aestivum
  Clone ID: PAT_TA_29323
ctcgtgccgaattcggcacgagctcgtgccgaattcggcacgagcacagccgccgcctaccccaccaacctgccccgacccgctcccgacctccgaggcaatcagcgtccgccgcggccgccatggcgttcgagaagatcaaggtcgccaaccctatcgtcgagatggacggcgatgagatgaccagagtattctggcagtctatcaaggacaagcttatcttcccatttttgggacttggacattaagtactttttgacttgggagttctacaccgtgatgcaactgatgacaaggttacagtggaggctgcagaggctactctcaagtacaatgtggctattaaatgtgcaaccattactccagatgaagatcgggttaaggagttcaacctaaaacaaatgtggaggagcccaaatggcacaattaggaacattataaatggcaccgtgttcagagagccaattatatgcaagaatgtcccaaagcttgttccaggatggactaagcccatctgcattggaaggcatgctttcggtgatcagtacagagcaactgatgccgttctcaagggacctggcaaactcagactagttttcgagggaaaagacgagacggttgaccttgaggtttttaacttcactggtgctggaggagtcgccatggctatgtacaacacagatgagtcaattcgaggttttgctgaagcttctatggcaatcgcttatgagaagaaatggccattgtaccttagcacaaaaaacacaatccttaagaaatatgatggcaggttcaaggacattttccaggagatctatgaagctggctggaaatccaaatatgaggctgctggaatatggtatgaacatcgtctcatcgatgacatggttgcctatgcacttaagagcgaaggaggctatgtttgggcttgcaagaactatgacggagatgtgcagagtgatttcttagctcaaggttttggctctttgggcttgatgacgtcagtattgatgtgccctgatggtaaaaccatcgaagctgaagctgcccatggcacagttacccgccatttccgtgttcaccagaaaggtggtgaaaccagcacaaacagcattgcttcaatctttgcttggacaagaggacttgcacacagggcaaagctagacgagaatgctagacttcttgaatttgcacagaaacttgaggaagcgtgcgtcggaactgtggagtctgggaagatgaccaaggaccttgcactccttgtccatggatcctcaaaagttacaagaagcgattacctgaacactgaagagttcattgacgctgttgctgctgagctcaaatcaagactgtgaaagacctcttccacttcaatgcttgaatagtcattactcatcgattcaagtcattttggttatgtcgccattacctgtcatgctttcattgtgaacagaacgagcttttactgcaccatcgcatattattgtcaaacatgcaagcgattctgtagatgctgatgttatgtaagtggggctcacaataaaggacatatagaaccattattcacatcaaaaaaaaaaaaaaaaaactcgagacctcgtgccgaattcggcacgagagtaccgtcacttcagagacatcagtgaacttcccccgcatcgcctacaggaaatccgtcgcttctttgaagactacaagaagaatgaaaacaaggaggttgcagtgaatgatttcctcccagcagaagatgccatcaacgcaatcaagtactcgatggacctctacggttcgtacatcatggagggcttaaggaagtgatctccagttggcggactgcggatgctacgcgatccgccctacggcttatcaatagtacgacaaacatctatgttaacatgatgatcgaaaaccatcagtctgttggggatctatatataccttctgtccatgctgagtcaagcatgggtacattttccttccgtatatgccatgtcaggtccaagtatttgacctcttgctggaaccttttttgtcaaaccgtctcttgacagagcggctgcttaataggaaatcagcgttacgcgaaggcgcgtatgcgtgcctcgcagtccgtttaaaaaaaaaaaaaaaaaactcgccttccctctcttctctctcctcctcttcttggcccacatctctccccacgcgtcgtcggcggcggagacggttctggcgggtgacctcctggacgcggcccgcgcttcggggttcgccgcgtggctgcgcagcgtgcggcggcgcatccaccagcaccccgagctggccttccacgagtaccgcacaagcgagctcgtccgcgccgagctggacacgatcggcgtgtccgactcctggcccgtcacccagaccggtgtggtagccacgatcgtcggcggcggcggggctggacccgttgtcgcgctccgggcggacatggacgcgctccccttgcaggaactggtagattgggaatacaaaagccaggagagtgggaaaatgcatgcttgtggacatgatgctcacacatcaatgcttctcggagctgctaagctacttcattcttggaaggattacatcaagggtaccgtcaagcttgtctttcagccagcagaagaaggatatgctggggcttaccatgtcctagaagaaggtattctagatgatgtgtccgccatttttggtctgcatgtcgacccaagtcttccagtgggtaccgtcgtctccaggccagggccattcatggcagcatcgggacggtttttgataacggtcattgggaaaggcggtcacgcagcaatgccacacaatgctgtcgaccccatcgtcatggtatcctctgccatcatcagcctccaacaaatcgtagctcgggagatcgatcccctcgaagccgcggtcgtctcagtaacattcatgaaa

SEQ ID NO: 29324 - DNA, 1817 bp, Triticum aestivum
  Clone ID: PAT_TA_29324
gccgttagctcgaaattaaccctactaaagggaacaaaagctggagctccaccgcggtggcggccgctctagaactagtggatcccccgggctgcaggaattcggcacgaggcagccgccgcctcccccaccaacctgccccgatccgctcccgacctccgaggcaagcagcgccgcggccgcggccgccatggcgttcgagaagatcaaggtcgccaaccccatcgtcgagatggacggcgatgagatgaccagagtattctggcagtctatcaaggacaagcttatcttcccatttttggacttggacattaagtactttgacttgggagttctacaccgcgatgcaactgatgacaaggttacagtggaggctgcagaggctactctcaagtacaatgtggctattaaatgtgcaactattactccagatgaagatcgggttaaggagttcaacctaaaacaaatgtggaggagcccaaatggcacaattaggaacattataaacggcaccgtgttcagagagccaattatatgcaagaatgtcccaaagcttgttccaggatggactaagcccatctgcattggaaggcatgctttcggtgatcagtacagagcaactgatgcagttctcaagggacctggcaaactcagactagtgttcgagggaaaagacgagacggttgaccttgaggtttttaacttcactggtgctggaggagtcgccatggctatgtacaacacagatgagtcaattcgaggttttgctgaagcttctatggcaatcgcttatgagaagaaatggccattgtaccttagcacaaaaaacacaatccttaagaaatatgatggcaggttcaaggacattttccaggagatctatgaagctggctggaaatccaaatatgaggctgctggaatatggtatgaacatcgtctcattgatgacatggttgcctatgcacttaagagcgaaggaggctatgtttgggcttgcaagaactatgacggagatgtgcagagtgatttcttagctcaaggttttggctctttgggcttgatgacgtcagtattgatgtgccctgatggtaaaaccatcgaagctgaagctgcccatggcacagttacccgccatttccgtgttcaccagaaaggtggtgaaaccagcacaaacagcattgcttcaatctttgcttggacaagaggacttgcacacagggcaaagctagacgagaatgctagacttcttgaatttgcacagaaacttgaggaagcgtgcgtcggaactgtggagtctgggaagatgaccaaggaccttgcactccttgtccatggatcctcaaaagttacaagaagcgattacctgaacactgaagagttcattgacgctgttgctgctgagctcaaatcaagactgtgaaagacctctccctcttcaatgcttgaatagtcattactcatcgattcaagtcattttggttatgtcgccattatctgtcatgctttcatcctgaacagaacgagcttttactgcacaatcgcatattattgtcaaaaatgcaagtgattctgtagatgctgatgttatctaagtggggctcacaataaaggacatatagaaccgttattcccatctgatgattgtgtcatgtctaaccagcagcttttacatttgaatggagatgcttatagtttgttcttttaatttgcttggtagtttgccccttttttaggagagcaggaaaaatcctgctacttactagtagaaaacagttctggctgccagcgttttttttaaacaagtcgagtttccaacc

SEQ ID NO: 29325 - DNA, 508 bp, Triticum aestivum
  Clone ID: PAT_TA_29325
ttttctcttatgaaaacagttaaaagtcacgttttatttaagcagcattaacgttctcttcattctctctcttcttgagaactaaagcttcaccagtgatacgacgccagatatcgtgtacatcttcacagacagtttcaaaatgtgaagtggcgtcataagaacgagaaatgtagaccttatccttggggccatcttcaataggttcttccaaaggtgacacatgaacaaacatgtcttttactgggcctaataactttaagccttcatcaatttctttagcaggatcttgtgtttcaacaatagtggatacgatagccaagtaatgacccttaggacaaaccatgtgggcatcactgacacaagcaatgtaaatatcatgcttgcgaccgacttgactttgagggattacaatttggcatgaatcactatcatttgtgcttggaataggatgagttaacaaacagatagctctgacaacggagccaacatttttgactttggctgg

SEQ ID NO: 29326 - DNA, 560 bp, Triticum aestivum
  Clone ID: PAT_TA_29326
tccatcatgtagctactgccgtagttgtagctgttgtacatcggcatccccggaggtggcggcggcggtggaggcgcccactgctggtgcatcatggcgtaggggttgtggtggtggtggtgcggcggcggcggcataggtggcggcatggcgtgcatggccatcctcctggccatcatggcgtcctcggcgtcggccggatgcagcttgtagtggatgccgccgccgggtgcgccgccgtagggccagtagaccatccgcttcatcatctcctccggcgggaagccgtccaccgccacaccttcttgcttccccggcttctggtcctcctcgccggcaccttccttcttctcctccccggcctctgcagctcctttgccgtcttcagccgccttgttgtcgccggcctcttctttcttgccgtcggctggtgcttcatcctttggtggctcagcatcagcagcaggagctggtggttcctcctccttgggcggctccggaggcggcggcggcacgacggaggcgatcttcccagtccgtcggtggatgtactccacaaa

SEQ ID NO: 29327 - DNA, 659 bp, Triticum aestivum
  Clone ID: PAT_TA_29327
ttttttttttttttttttgagtatgtaacaacatcttgtattctgtaatgaaaatcaaggactgtaacaacattctgtcttttattcaccactttgttcccgcattatcccaaaatcccattaaaaacggattgacatatgcatgtgtacaattgagtatatattgaatacataattcttccgttgaaagttttgtgtactttgaagctaaggatcacttatcactctgatttttgttcccaattgctgtttaaaactattctacagtcctgctccatggacataacagctctcttttgtctcagttttttgaactttgtgctaatggtgttgacatctgcctgccaattgtagcaatgaactccactgccactttgagtgcattaatagatgccaggttcatcaagcttgttgatgaccatgttggttcccctccagccagatccgatactccccggaacacaatcacaggtacgccaggagatgttgttgtcatcaccactgctgcgctttcctcatctattgttgacactgcaaattctctgaaaaggaacttccggtattctgcattgtctagaaacatgtcagctgatgctccttttagcccatgaaccacttgtggcgttttaggtaaacaaaaagtatcattacacctttca

SEQ ID NO: 29328 - DNA, 556 bp, Triticum aestivum
  Clone ID: PAT_TA_29328
aaaatctgaatctttcaacgctatgtatgccaccaatatcacaaaaaataagaaaacgaaagcaaagtcggcaacagatttcaacagaaattcttccctttcaaaaaaaaaatccatattcttcagcggtgcgtgctccgtgcgcgcgcatgagctgctgcttcttccacgaagatcacatggcgccatggcgggtactcctctacgtacgtcgacagtgacgagcccgcggcatctcattttcaaagcctcgtcgcgcattgattcctgatgagacccgctaattaatgcggtatgtgccgcgcgttgacgtttggtggtgctccgatgcgaccatcgaccgagagtggacggcggcgcaccgagaccgacgatcgaatcccgccgcgcgcgcgttcaggctcgccggacgatcgccttctcctcctccggctcctcctcgctgtcgccgtccaccctgccgccgaggcagtcgaaccgcacgctccccttgttggtggccgagcccacgacgggcccgtccggcgccttctcacggacggttcttggcagcggc

SEQ ID NO: 29329 - DNA, 886 bp, Triticum aestivum
  unsure (1)..(886): unsure at all n locations
  Clone ID: PAT_TA_29329
cccacgggcccggccgcgcccggaaaccgcgcagaccgcaccaccaccgctccccatctcgatctaaaaccgagggtttcgtccagctccgtcgccgcgacccaacccagagccagccccaccccagccagccagccatgccgaagaacaagggtaagggaggcaagaaccgcaagaggggcaagaacgaggccgacgacgacaagcgcgagctggtgttcaaggaggacgggcaggagtacgcgcaggtgacgcggatgctcggcaacgggcgctgcgaggccatctgcgtcgacggcaccaagcgcctctgccacatccggggcaagatgcacaagaaggtctggatcgccgccggggacatcgtcctcgtcggcctccgcgactaccaggacgacaaggccgacgtcatcctcaaggtacatgaacgacgaggcccgcctgctcaaggcctacggggagctccccgacacgctccggcctcaacgagggcgtgggacgtgcaacggccccgaggagggcgtagggcgacacagcgactacatccagttcgaggtacgaggtacatcgacaagatctaagcttttttcctctcctcctccctcgctcggatatactttggtgttctattctgttctaatagcgtccgtgtctgtctgtgtcggtcggtcggtgggctgttgtggattgatggatttggtaacgagaaatcgttgtgatttgaggtgcttaaataattgtcggattatagtgttcgtcgtattattatgctttgcaacaagccatctgatgattattatgctgttgatattgttttgttctccttgattggattagcgtaattttggcaacttcccccgtttctgagtcaaattaaacncgctca

SEQ ID NO: 29330 - DNA, 665 bp, Triticum aestivum
  unsure (1)..(665): unsure at all n locations
  Clone ID: PAT_TA_29330
cgatttcaatgctatgactgcacctgctgaggataagtcagttataattggggaaaggaacagagttgcaactgagaagataaagggcgcgataaaccgagggtacaagagaatagcagttctgtacggaggtgggcatatgccagaccttggaagacgtcttcgagaagagctaaatatggtcccatccaatgtgcaatgggtcacagcatggtcaataagaagccgggagctagataaaaaatcgcttccatttttgaagacgatggctgaggtttcagggtggcctttgaatagatatgaaacacttgctttgctaatcttttcttcagttcttgcagtggatctatggttttgggagtttctcgtggaaagcagtctgaattgggcatctttggctggttcctggattgatcaatgtagtgctccattttgacaaagagtttgtctgaaaaaggtggggaaatgaagtttaacaacacagaagtgtataagcgacggtccaaataaaaaaacaaaaccatttactgttgcagcttgttaaaaacgttcttatattatgggacggagggagtagattacaatttattgnatcaacttggaatganattanaaaagttgaagccaatttccccgganantntgtccaaaaaacnggaatcnaa

SEQ ID NO: 29331 - DNA, 546 bp, Triticum aestivum
  unsure (1)..(546): unsure at all n locations
  Clone ID: PAT_TA_29331
gtattagtctcccccccccccacaagaagacgaatgcaatattgaagaagaagagattcattggatagatgattgtgaatgtcaagaaaatttggctactctattacctctgagtcctgaagaatgtatcattgatcaagaaaatcatattcaaacaacagatcattatttattttttgaagaattgggatgttttacagaagaacctgagcctattgatccaaatcgagattatgaagcagaagctaaagccttacttgaagaacgtgaaaagacaagaaagaagcacatcgatctccaaataccctcactcgatcaagatacccaaccctcaggcatttcttccacttgttcatcattccatgcgcatgacttgtatacacctcatcatcccatttacacaactgaaaaagtgcaaagctatatttatgcacatcctcttcctatttaatcaccactgcattttctctatttatttaattgttcttcttttggtaaataaataacagggtcatctgactctctttgattatttcaaaccccnna

SEQ ID NO: 29332 - DNA, 1510 bp, Triticum aestivum
  unsure (1)..(1510): unsure at all n locations
  Clone ID: PAT_TA_29332
ggatgacccgccttgccggcaaacccctcggcggcgcacagaacgcgtacctgcgcgacacgaaaccgggctagggctagaagcacatcacggagcagcagatgccctagggggggctggacctcctcccccattggggacccgggctgccgcagattacttgcacgctgcccactgatcaccagcggacgggcgagctccccggaggcgtcacgcatcacacgggggcagctcttgggttggccagaaacaattcgaatgtgggtcaacttgatgatttgactaccctgaaggagactctccgagtgaaagatgaggagttgcagcattggacataggacattcgtcctcgtgacgccacaattcaggaaattgcagagaagttaacagacaccgcagatggctgcagaagcagcagcttctgcagctcatacaatcgatgaacagagacgacttctatgttcagagattgagcgtctgaaaaaagcaatggaaacacaaatggaacaatccatgcttaagctacggcaatctgaagagaaggtaattagcctgagcaaagagaacgaccagttgctgaaggaaagagacgccgcatttcaggaagcatatatgtggcgcactgaactaggaaaagctagagagcaagcagtgatacaggaagcagcaattgcccgagcagaggaaaaggtaagggtgtctgaagcggatgccgcggttcggatcaaggaagctgctgaaaatttgcatgctgctgagaaagaaaaagaagaacttctagcccttattggtgttctccaatcacaagtgcagagagaacaaagcagcacgaagcaagtatgcgaggagagatccgagtcatgctccggcgccgacaactcccctccgctgacgaagcacgtcgacgcatcggacgacgacgtggacaaggcgtgcgtgagcgattcgagatcggtcctggtctcgagcgagagcacggaggtccagctggccgtggacggggtggacatccgccccatcggcgacccggagtggggcggcttccagcagccggaagcgctgatcgccgacgtgcgggaggtctccccggaggcggaaggcagcagcctggatatcccggtggtcaacccggcaccggccaatgatcatatgcagggaggggcaacacatccctgaaggcctggaggtcctggagctgtccattgctttcttgggtggtttgtgattattgaggagaccggcagggatttgaatcctctcgagaattactgtcgcttttttttttgctgcttccaggttgtgtgtcctttgtatttaagtatgcagctcaataaaagatgagagcagtttgtcgtgtgattgtaaattattattcacgtcatctccttttgccattgatttgaattatgaattgtccggccttgattcaattgtcgtgagaaaggggcccgtgcattcccagttgtcgctcccccaagctctttantcnacggaaactggtacantancc

SEQ ID NO: 29333 - DNA, 420 bp, Triticum aestivum
  Clone ID: PAT_TA_29333
gccggccggttctctcgggggcgtcctcatctaccagagctttgccgcgaacgaagaggttgctgtctctgccgggtcgcccaggtccgtcttccactgcttcgaggccgagagtgtgcagagccaccctctggtcaaggaaggcaagctcgccaacctcctcgcatggcgggcggaggaggattccctggaggagggcgcggtgctgtgcgagtgattggctgtcgctgttccgtctgtggactttgttctgactaagtttgtcgtttggttactgtgaagcagctggccaggctattgctactccgaataaactattagctctaggtggtttgctgcgtctgccacaatgagcgtacttctggggagaagttgtctcaaactgataaataagaaaaaaaaaaaaaaaaaaggccccta

SEQ ID NO: 29334 - DNA, 672 bp, Triticum aestivum
  Clone ID: PAT_TA_29334
ttaggatttcttttctgacctttgattccgaccaatccctctggcctgctgcttcctgataatcgaccagttccccagtcttgctccctgcactcctccctccaccgtcttcatctccagcattgtgttctgattcacctgctccaatggctgttctttctgctgctgatgctcccccggtctcagctatcgggtttgagggctatgagaagcgccttgagatcacattctctgaggcacctgtctttgccgaccctcatgggcgtggtttgcgtgccctctccagggcccagattgactctgttctggatcttgcacggtgcacaattgtgtccgagctctccaacaaggattttgactcctatgtcctctctgagtcaagcttgtttatctatcctctgaagattgtcatcaagacctgtggcactaccaagctcctgctcaccattccaaggatacttgagcttgctgaagagctgtctatgccacttgctgctgtgaagtactcccgtgggacgttcatctttcccggtgcacaaccagctcctcacaggagcttctctgaggaagttgctgcacttaaccgctactttggtggcctgaaatctggtggtaatgcttatgtgattggagatccagcaagacctggacagaagtggcacatctactacg

SEQ ID NO: 29335 - DNA, 618 bp, Triticum aestivum
  Clone ID: PAT_TA_29335
gcgcacggcgcccaaatcggacgatgtgtacctcaagctgctcgtcaagctctaccgcttcctggtccggaggaccaagagccagttcaacgccgtgatcctgaagcgcctcttcatgagcaagaccaaccgccccccgctctcgatgcgccgcctcgtcaggttcatggaggggaaggaggacaagatcgctgtgatagtgggcaccatcaccgatgaccagagggtctacgagataccggcaatgaaggtggcgagtgccttacctttgaccagctcgcgctccgtgctccgcttggacagaacacgcttctcctgaggggtcccaagaacgccagggaggctgttaggcactttggcaaggctccaggagtgccacacagccacaccaagccatatgtccgctccaagggcaggaaattcgagaaggcaagaggaaggaggaacagcaggggcttcaaggtttaagccgtggagttttcggcacccttgtcacatttgctgttatcggtcaatcttcacttttttgggtaccagaatcatactgctttagatgtcagagtcttgtgtcgatgagtattcagaaccagttcattcttgtttcagtattttgcaact

SEQ ID NO: 29336 - DNA, 902 bp, Triticum aestivum
  unsure (1)..(902): unsure at all n locations
  Clone ID: PAT_TA_29336
gccggcgctggcggtgacgccctgaccctcgccgctgcagcagccaccaccgcgcaaccatgggtatcgacctcgtcgccggcggccgcaacaagaggaccaagcgcacggcgcccaagtcggacgatgtgtacctcaagctgctcgtcaagctctaccgcttcctggtgcggaggaccaagagccagttcaacgccgtgatcctgaagcgcctcttcatgagcaagaccaaccgcccgccgctctcgatgcgccgcctcgtcaggttcatggaggggaaggcggacaagatcgccgtgatcgtgggcaccatcaccgatgaccagagggtctactagataccggcaatgaaggtggccgcgctcaagttcaccgagacggcgagggccaaggattgtaatgccggtggcgagtgccttacctttgaccagctcgcccttcgtgcttcggttggacagaacacgcttcttctgaagggccccaagaacgcccaggaaactgttaggcactttggaaaagctctagaagtgccacacaaccacaccaagccatatgttccggtcaaaggggcggaaaattcttaagggctagaggaaggagggaacaggccgggccttcaaggtttaagctggggaaattctgggcgcacctggtgtaaatatttgggttttattaatcgggttaataacaccctttttggtgtccccgaaattaataccgggtataaaaatctacgatgtttttggtgcaaaggaataattaaaaaacacctgtgatttgtttggctttatgatattggggaaacttcgaaaaaccattctctatgacncacctcataattaagaatatatttttggtagcactccaaaaatcttcttctcaaatcataaaataataaaaag

SEQ ID NO: 29337 - DNA, 601 bp, Triticum aestivum
  Clone ID: PAT_TA_29337
gcaaactcgttgcacaagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcggggcgcgctcgggattgggggttaccatacaatttttcccaggaacctttagtgaatgtgctaatggagtcaaagggtggcaaaaatctagcaagtagtagttccctgatgtacgaagcaccctccggctacagcattgaagacgttcgactcctatgtgctatctgagtcgagcctgttcatctactctcagaagattgtgatcaagacctgtgggactaccatgctcctgctcaccattcctaggattcttgagcttgctgaagagctgtgcatgccgcttgctgccgtgaagtactctcgtgggatgttcatcttccccggcgcacagcctgctccccacaggagcttctctgaggaggttgatgtcctgaaccgctacttcggccacctgaagtctggcggcaatgcttatgtgatcggagacccagcgaagcc

SEQ ID NO: 29338 - DNA, 408 bp, Triticum aestivum
  Clone ID: PAT_TA_29338
tagcgtggtcgcggccgaggtcaaggacctcctgctagtaattagatcaacaaatacactccacagacaagatggcgaaagtgctaatcatttttcgcagaactatataattatataatttatcagcggttgcttgtaagtaagtagatgggtaggaaatcacggcgaaatcatcacgccccgacgcccttaggctttgttcggttaatcctctccccaagaggattggaggggattggcagggattggttcatattttgacttagaagaggtttaaatccccctcaaaccccttcaatccactcggattcacccgcaaccgaacaaggccttagatatgtactgggagtagtaacatgcatactttgaataaattgtccattcttgggattgtgcgtgtgcacatgg

SEQ ID NO: 29339 - DNA, 564 bp, Triticum aestivum
  Clone ID: PAT_TA_29339
gtgcggcgctcaggcggcggtttcaaaaaagtagaaccacccctacgtcgccgccgccgccgccatgggtatcgacctcgtcgccggcggccgtaacaagaggaccaagcgcaccgcgccaaagtcggacgatgtctacctcaagcttctggtgaagctctaccgcttcctggtgaggaggaccaagagccagttcaatgctgtgatcctgaagcgcctcttcatgagcaagaccaaccgcccgccgctctcgcttcgtcgcctcgtcaagttcatggacggcaaggacaaccaaatcgctgtgatcgtgggtaccataaccgacgacaagagagtttacgaggtgccggcgatcaaggtggcagcgctcaggttcactgagacggcaagggcccgcattgtgaatgccggtggagaatgcctcacctgaccagctggcccttcgtgctcctcttggccagtacacggttctcctgaggggccctaagaacgcccgtgaggcagtgaggcacttcggtaaggctcctggtgtgccgcacagccataccaagccttatgtccgct

SEQ ID NO: 29340 - DNA, 529 bp, Triticum aestivum
  Clone ID: PAT_TA_29340
gttgcacaagaattcctcccaccctcgccgtctcgccgccgtcaccaccgcagctagataagagaaaaaaagagagagaagaactcgtcgggagggctcgagatctgtgttgggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgccggaggattctctggaggagggcgtggtgctgtgcgagtgatttgctgtccgaatgttcagtctgtggaattagctctgactgtatgtcttttgtcgtttggttactgtgaagcagccggccaggctattgctctctgaataaactattagctctaggtggtttgctgcgtctgccacaatgagcatactgtttgggaaaagtgtctcaacttataaataagcatt

SEQ ID NO: 29341 - DNA, 671 bp, Triticum aestivum
  Clone ID: PAT_TA_29341
agaaggctgtggtggctgcacagaactggaaagtcggagacccgttcgacgtcgccaccaacatgggtccccaggttgataaggagcaatttgaaagggtcctaaggtacattgagcatggcaagagcgagggggcgactctgctgaccggcggcaaacgtgccggcgacaaaggatactacattgagcctaccatatttgcagatgtcaaggaggacatgaagatcgctcaagatgagatctttggccctgtgatgtccctcatgaagttcaagacggtcgatgaggcgatagagaaggccaactgcacgaagtacgggctggccgccgggataatcaccaagaacttggacatcgccaaccgggtgtcgaggtcggttcgagcgggtaccgtgtgggtgaattgttacttcgccttcgatcccgaggcgccctttggcgggtacaagatgagcggcttcggccgggaccaggggatgatggccatcgacaagtacatgcaggtcaagagcgtcatcaccgcagtccctgactcgccttggtattagatagtagccaagacaatgcaagtttctgtatttgtgcactgtacatgcgtgttgagttgcctggtgcttgtgtcgtagtcctttgtttgtgcctggtatgttgcatgcgtgccaaaaacttgt

SEQ ID NO: 29342 - DNA, 777 bp, Triticum aestivum
  Clone ID: PAT_TA_29342
ttgagcctaccatatttgcagatgtcaaggaggacatgaagatcgcccaagatgagatcttcggccctgtgatgtccctcatgaagttcaagacggtcgatgaggcgatagagaaggccaactgcaccaagtacgggctggccgccgggatcatcaccaagaacttggacatcgccaacaaggtgtcgaggtcggttcgcgcggggaccgtgtgggtgaactgctacttcgccttcgaccccgaggcgcccttcggcgggtacaagatgagcgggttcggccggcggccagcccgtacttggtgcagttggccttctctatcgcctcatcgaccgtcttgaacttcatgagggacatcacggggccaaagatctcatcttgagcgatcttcatgtcctccttgacatctgcaaatatggtaggctcaatgtagtatcctttgtcgctggcaggtttgccgccggtgagaagtgtcgctccctcgctcttgccatgctcaatgtaccttaggaccctctcaaattgctccttatcaacctgggcagaagttgatgcgcttgcggtgtatgtcaaaaatctgcccttacatgccacacctagccaattagaagaggagttcaaaagatttggtactattaaacatgatggtatccaagttagaagccacaagattcaagggttctgctatggcttcatagagtttgaggatgccagctcagttcaaagtgcactagcggcttctcctgtgacgattgatgaccgaccatgccacgtcga

SEQ ID NO: 29343 - DNA, 598 bp, Triticum aestivum
  Clone ID: PAT_TA_29343
cgatcgcatagtctggtctgatcagtcgcgccagaccgagctctagcttcagctcgtcggagttcgcaccggtcgactcagaactcctcgccgatggccgccgtccaggtacaagccgcaacccacgcgatgcccgtcgaggaggctccggctccggcgccggcggtggtggaggcagtcgagccggccgtcgtcgttgtcgaggagactacagtggcggtggaggctgtcgagccggccgtcgtcgcggttgaggaaactacggtggcggtggaggctgtcgagccggccgtcgtcgcggttgaggagactacggtggcagcggtggagattgtcgagccggctgtcgccacggtcgaggtggcagcggttgaggctgtcgagccggccgttgtcgctgccgaggaggccgcgaaggaggaggctgctgcaccggccgtgaccgagctggcgaaagagcctgaggcagttccagcggagaccaaggaggccgagacagaggccaaagtggccgagcccgaggctgtccagccggccgccgccgccgaggaggctcctgctgtgccagcagtgaccgggagcaaagagccggaagctg

SEQ ID NO: 29344 - DNA, 939 bp, Triticum aestivum
  Clone ID: PAT_TA_29344
gcaacctgaagacggtatcgcttgagctcggtggcaagtcgcctctgataatcttcgacgacgctgatgtcgacatggcggtcgagctctcaaggcttgccatcttcttcaacaagggagaggtttgcgtcgcggggtcccgtgtttatgttcaggaagggatctacgacgagtttgtgaagagggctgtggtggctgcccagaactgggaaagtccggagacccgtttgatgtcgccaccaacatgggtccccaggttgataaggagcaatttgagagggtcctaaggtacattgagcatggcaagagcgagggagcgacacttctcaccggcggcaaacctgccagcgacaaaggatactacattgagcctaccatatttgcagatgtcaaaggaggacatgaagatcgctcaagatgagatctttggccccgtgatgtccctcatgaagttcaagacggtcgatgaggcgatagagaaggccaactgcaccaagtacgggctggccgccggcataatcaccaagaatttggacatcgccaacagggtgtcgagatcggtgccgcgcggggaccgtgtgggtcaactgctacttcgccttcgaccccgaggcgcccttcggcgggtacaagatgagccgggttcggccgggaccaggggatgatggccatcgacaagtacatgcaggtcaagagcgtcatcaccgcagtccctgactcgccttggtattagcagaatagccaagacaatgcaagttcttaattctctgcagtactgtacatgcttgttgagttggctggtgcttgtgaagcatcctttgtttgcgttgcctgggtgccaattgttggtgtgtgtgatataggaaaaatccaaaacaaaccttgaacttgtagaccaaagctaaatcaaaccctgaacttcaaatcaaaaaaaaaaaa

SEQ ID NO: 29345 - DNA, 970 bp, Triticum aestivum
  Clone ID: PAT_TA_29345
ctgtcgttggccctaacgaaggtggaaagcgtccaggacgagcaggatttgtacatacagcagctggagcgggagaaggccttgatgctgcaaaagatacatgaccttggttctgaaatcgtcaggacatcctccggtcctgcaaggacctcctgctagtaattagaccaacaattactgcccacaaactagatggcaagagtgctaatcatttttcgcagaactatataattatataatttatcagcggttgcttgtaagtaagtagatgggtaggaaatcatggcgaaattatcacgccccgacgcccttaaagttgtacaaaaaccctggaaaacgagttgtaaattttcagagagagtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagaaccaaagttaacgaccccgggctggcaaggtaaaagtttttttatagggcccccaaaattaaatccccgggccggggtttaaaaacgtgggaacgggaaaaacccgggggtacccaaattaaatcgcttggaaaaaaatccccttttccccagtgggggaaaaaccaaaaaggccccccccaatcgcctttccaaaaatttgcccaccctaaagggaaaagggaaccccccctgaaggggcccataaaccccggggggggggggggttccccccaggggaaccgttacatttgcaaggccctaagcccccgttcttttggtttttttcctttcttttttggcaaggttcgcgggtttcccccgtaaagcttaaaatggggggcccctttaagggtcccaattaagggtttaacggcccctgaccccaaaaaaatttgataggggggagggtccacgaagggg

SEQ ID NO: 29346 - DNA, 844 bp, Triticum aestivum
  Clone ID: PAT_TA_29346
ttcggcacgagggccgctgccgctgacgccctgaccctcgccgctgcagcagccaccaccgcgcaaccatgggtatcgacctcgtcgccggcggccgcaacaagaggaccaagcgcacggcgcccaagtcggacgatgtgtacctcaagctgctcgtcaagctctaccgcttcctggtgcggaggaccaagagccagttcaacgccgtgatcctgaagcgcctcttcatgagcaagaccaaccgcccgccgctctcgatgcgccgcctcgtcaggttcatggaggggaaggcggacaagatcgccgtgatcgtgggcaccatcaccgatgaccagagggtctacgaagataccggcaatgaaggtggccgcgctcaggttcaccgagacggcgagggccaggattgtcaatgccggtggcgagtgccttacctttgaccagctcgccctccgtgctccgcttggacagaacacgcttctcctgaggggccccaagaacgccagggaagctgttaggcactttggcaaagctccaggagtgccacacagccacaccaagccatatgtccgctcaaagggcaggaaattcgagaaggcaagaggaaggaagaacagcacgggcttcaaggtttaagctgtggaatttctggcgcacttgtgtcatatttcgctatattaacggttcaccatcacctttttggggtaccaaaatcataccgctttagaatgtagtgtcttggggtcaatgagtatttccaaaccagttaattcttgggttagtattgtgcaccttgagaccatgcttgccaggccagttattaaatatcatttggaacacccaaaat

SEQ ID NO: 29347 - DNA, 823 bp, Triticum aestivum
  Clone ID: PAT_TA_29347
attcggcacgaggcccacccctacgccgccgccgccgccgccgccatgggtatcgacctcgtcgccggcggccgtaacaagaggaccaagcgcaccgcgccaaagtcggacgatgtctacctcaagcttctggtgaagctctaccgcttcctggtgaggaggaccaagagccagttcaatgccgtgatcctgaagcgcctcttcatgagcaagaccaaccgcccgccgctctcgctttgtcgcctcgtcaagttcatggacggcaaggataaccaaatcgctgtggtcgtgggcaccataacagatgacaagagagtttacgaggtgccggcgatcaaggtggcagcgctcaggttcactgagacggcaagggcccgcattgtgaatgccggtggagaatgcctcacctttgaccagctggcccttcgtgctcctcttggtcagaacacggttctcctgaggggccctaagaacgcccgtgaggcagtgaggcacttcgtaaggctcctggtgtgccgcgcagccataccaagccttatgtccgctcgaagggaaggaagtttgagaaggcaagaggaaggaggaacagcagaggcttcaaggtctaggttgctgcttgttcatgtgctacacagctcttgtttgagtctgagttatgttataattaagtgctaggatcatctaaattttgttcgaacgtcatgcactgtgtaagaaatttacatctgttttaaaaaaaaaaaaaaaaaaaaaaaaaaaaaaaaaagaaggagggtaaaaaaaaaacaaaatataaatacaattgcatgcgacgtaataggtg

SEQ ID NO: 29348 - DNA, 769 bp, Triticum aestivum
  Clone ID: PAT_TA_29348
gaagtggcacatctactatgccaccgagcaacctgagcagcccatggtcaccctggagatgtgcatgactgggctggacaagaagaaggcctctgtcttcttcaagactcaagctgatggccacgtttccctgtgccaaggagatgaccaagctctctggaatctctgacattatccctgagatggaggtctgtgacttcgacttcgagccctgcggctactccatgaacgccatcaacggatctgccgtctccaccatcttcggtggccgtggccacgccgccacctggggcaagaagctcgaagctgaggcatacgactgcaacaacgttgtggagcaggagctcccctgcgggggcgtcctcatctaccagagctttgccgcgaacgaagaggttgctgtctctgccgggtcgcccaggtccgtcttccactgcttcgaggccgagagtgtgcagagccaccctctggtcaaggaaggcaagctcgccaacctcctcgcatggcgggcggaggaggattccctggaggagggcgcggtgctgtgcgagtgattggctgtcgctgttccgtctgtggactttgttctgactaagtttgtcgtttggttactgtgaagcagctggccaggctattgctactccgaataaactattagctctaggtggtttgctgcgtctgccacaatgagcgtacttctggggagaagttgtctcaaactgataaataagcattttttttcgaaaaaaaaaaaaaaaaaaggccccta

SEQ ID NO: 29349 - DNA, 1291 bp, Triticum aestivum
  Clone ID: PAT_TA_29349
aagtggcacatctactatgccaccgagcaacctgagcagcccatggtcaccctggagatgtgcatgactgggctggacaagaagaaggcctctgtcttcttcaagactcaagctgatagccacgtttcctgcgccaaggagatgaccaagctctctggtatctccgacatcattcccgagatggaggtctgtgacttcgacttcgagccctgcggctactccatgaccgccatcaacggatctgccgtctccaccatccatgtgacccccgaggacggcttcagctatgcgagctacgaggtcatgggcatggacgcctccgccctggcctacggcgacatcgtcaagagggtcctccggtgctttgggcccttcagagttctctgcggcggtcaccatctttggtggccgcggccacgccgccacctggggcaagaagctcgacgccgaggcatacgactgcaacaacgttgtggagcaggagctcccctgtggaggcgtcctcatctaccaagagctttaccgttaacgaagagttgctgtctctgccgggtcgcccaggtccgtcttccactgcttccgaggccgagactgtgcccaccccccctctggtcaaggaaggcaagctcgccaacctcctcgcatgggggggggaggaagattctctggaaaagggcccggtcctgtgcgagtaaaaacatgatttgctgtcgctattccatctgtggaatttgttctgactgtcagtttgtcgtttggttactgtgaaccacccggccaggctattgctctctgaataaactattagctctaggtggtttgcggggtctgccccaatgagggtacttttggggaaaagctgtctcgaacttataaataagcattatttttcctataacgagtgtcattttgttataattagtgttactctgtgccaagttgcagtgtgttgacaagcgaccagtgtgctcatttcccctggcctatcttctgatcatctcgtacgcgcaggaataaactactgcgcgaggaatacaagcacgaattgattcttttcttcgattgaagagaactatttgattcttcatccttatcttccttgtttctgatcctatcttctgcatttctgattcgtgcaaccactccaataattcattcaaggtgtcagtgccggcctcgtgagttattgggtgtagtagtaacgtttttcgtttcgttcttttgacaacggaggttcggtcgtatgtaatcttgggcgtaaaaagtgaaagagcaatccaagttgttgcgt

SEQ ID NO: 29350 - DNA, 852 bp, Triticum aestivum
  Clone ID: PAT_TA_29350
acctatatatccctcactctttcggctcgcccgcaaaacctagaacccacccctacgccgccgccgccgccgccatgggtatcgacctcgtcgccggcggccgtaacaagaggaccaagcgcaccgcgccaaagtcggacgatgtctacctcaagcttctggtgaagctctaccgcttcctggcgaggaggaccaagagccagttcaatgccgtgatcctgaagcgcctcttcatgagcaagaccaaccgcccgccgctctcgcttcgtcgcctcgtcaagttcatggatggcaaggataaccaaatcgctgtggtcgtgggcaccataaccgacgacaagagagtttacgaggtgccggcgatcaaggtggcagctctcaggttcactgagacggcaagggcccgcattgtgaatgccggtggagaatgcctcacctttgaccagctggcccttcgtgctcctcttggccagaacacggttctcctgaggggtccaaagaatgcccgtgaggcagtgaggcacttcggtaaggctcctggtgtgccgcacagccataccaagccttatgtccgctcgaagggaaggaagtttgagaaggcaagaggaaggaggaacagcagaggcttcaaggtctaggttcttgcttggtgttcatgtgctacacagctcttgtttgagtctgagttatgttattattaagtgctaggatcatctaaattttgttcgaatgtcacgcactgtgctgtgtatccgttttaccggaaactgtattgtttaacctctctcaactggaaatctttcaagtatctgatcctcttgaatgaaaaaaaaaaaaaaaaaaaaaaaaaaa

SEQ ID NO: 29351 - DNA, 897 bp, Triticum aestivum
  Clone ID: PAT_TA_29351
attcggcacgaggctaactcgttgcacaagaattcctcccaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaatttttcccaaggaacctttagtgaatgtgctaatgggagtcaaagggtgggcaaaaagtctagcagtagtagttccctgatgtacgaagctcccctcggctacagcattgaagacgttcgacctgctgggaggcgccaagaagttctctgctgcatactcgaactgcgcgaagaagccatcctgatatcgtttttggcatccccttcccgtagtttaggatttttatgcaattttattctgactcttttctcccaccaatctctctggcttgctgcttcatctgttcctctctgctctgctttctgactcaaaactgcaacaatggctgcccctcatctaccagagctttgccgcgaacgaagaggttgctgtctctgccgggtcgcccaggtccgtcttccactgcttcgaggccgagactgtggagagccacccgctggtcaaggaaggcaagctcgccaacctcctcgcatggcgagcggaggattctctggaggagggcgtggtgctgtgcgagtgatttgctgtcgaatgttcagtctgtggaatttgctctgactgtatgtcttttgtcgtttggttactgtgaagcagccggccaggctattgctctctgaataaactattagctctaggtggtttgctgcgtctgccacaatgagcatactgtttggggaaaaaaaaaaaaaaaaaaaa

SEQ ID NO: 29352 - DNA, 870 bp, Triticum aestivum
  Clone ID: PAT_TA_29352
cttcacccgtcccgccgccgccgctgccgctgacgccctgaccctcgccgctgcagcagccaccaccgcgcaaccatgggtatcgacctcgtcgccggcggccgcaacaagaggaccaagcgcacggcgcccaagtcggacgatgtgtacctcaagctgctcgtcaagctctaccgcttcctggtgcggaggaccaagagccagttcaacgccgtgatcctgaagcgcctcttcatgagcaagaccaaccgcccgccgctctcgatgcgccgcctcgtcaggttcatggaggggaaggcggacaagatcgccgtgatcgtgggcaccatcaccgatgaccagagggtctacgagataccggcaatgaaggtggccgcgctcaggttcaccgagacggcgagggccaggattgtcaatgccggtggcgagtgccttacctttgaccagctcgccctccgtgctccgcttggacagaacacgcttctcctgaggggccccaagaacgccagggaagctgttaggcactttggcaaagctccaggagtgtcacacagccacaccaagccatatgtccgctcaaagggcaggaaattcgagaaggcaagaggaaggaggaacagcaggggcttcaaggtttaagctgtggaatttctggcgcacttgtgtcatattttgctattattatcggttcatcatcacctttttgggtaccagaatcataccgctttagatgtcagtgtcttgtgtcaatgagtattcagaaccagttaattcttgtttcagtattgtgcaacttgagaccatgcttgcaagccagttattaatatcatttgtagcaccaaaatttctctcaaaaaaaaaaaaaaaact

SEQ ID NO: 29353 - DNA, 996 bp, Triticum aestivum
  unsure (1)..(996): unsure at all n locations
  Clone ID: PAT_TA_29353
ctcgtgccgaattcggcacgagcaaactcgttgcacaagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaaggaacctttagtgaatgtgctaatggagtcaaagggtgggcaaaaagtctaagcagtagtagttccctgatgtacgaagcacccctcgggctacagcattgaagacgttcgacctgctgggaggcgccaagaagttctctgctgcatactccgaactgcgcgaagaagccatcctggatatcgtttttggcatccccttctccgtaatttaaggatttttaatgcaattttattctgactcttttctcccacaatctttggtggccgcggccacgccgccacctggggcaagaagctcgacgccgaggcatacgactgcaacaacgttgtggagcaggagctcccctgtggaggcgtcctcatctaccagagctttaccgtgaacgaagaggttgctgtctctgccgggtcgcccaggtccgtcttccactgcttcgaggccgagagtgtgcacagccaccctctggtcaaggaaggcaagctcgccaacctcctccgcatgggcgggcggaggaggattctctgggaaagagggcgcggtgctgtgcgagttgaagacatgatttgctgtcgctattccatctgtgggaattttgttcctgactgtcagttttgtccctttgggttactggtggaagcaacccggccaaggctattgctcctccctgaataaactattagctcctaagtgggtttgctgcgttctgccacaatggagcgtacttcctggggaaaagtgtctccgaactttttnaataacattattttcccc

SEQ ID NO: 29354 - DNA, 1512 bp, Triticum aestivum
  Clone ID: PAT_TA_29354
caggtccttcctcgttatctttcaccatgccttcagcagcttcccgactcgtgcggatcggccgtgccgctcgctcagctgcggcgaccacatctcgcttcgcccaattcgttgaagcagcgaccctctccacgaaggcggtggcgaccaaacctcacgctatcttaggttcagatcgtgccgcctccgtagatctgcgtatgaaccaatccactgtccatgctcctccacgcgccatggcacctgcctccctgacactcagtcacccagaagaacaaaggcaggaaggtaaggtgaagtttgtggtagaggagaaagaccttgagtcagaagcagccctttgggccttgtatgagcgctggtgcaaagatttcaaccaaaagcgtgatcatgatgagatggttcactggttcaacacattcaaggagactgtcctgcttgtccaccgtcggaacaatgctaatctgccctacaaattgggaataaacaaattcgcggatgggaagctaaggaagctctgtcgctgtcatgatcctattcttaaaaagattgatgaggagtttggcgacaaaccaggtgaatttattctaggtgatggtgacaaacttctcaagcgagtcttcgctgattataaggtggttcatggcagactgtatgttcatttaccaaagggagttgatgtggaaaccatcaccaccaatcctgaatgggtcgagctggaagcgaccaccaaccctccataccgataccctacttacatctagtggtgctatcattactgctactaagctgtgcttctgccaacggttgcatactaggacttggatgttgtccttcttgctaataaaacatactccttccgtccggaaatacttgtcatcgaaatggataaaagagatgtatctagacgtattttagttctagatacatctcttttgatccattttgatgacaagtattttaggacggagggcgtatgcataataagctaaccgtgagcatatgaggattacgttaatgcttttgtaagatattttaaactttgactaaggtgttgtaatattccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttaaaaggaccaaagttaacgaacgggggaagggaaggaaaaagtttttttaaagggccaccaaaataaaattaaggggcgggggtttaaaaagggggggaggggaaaaaccggggggtaaccaaattaaatggcttggaaaaaaatccccttttcccaagggggggaaaaaaaaaaaaggcccgaaccaatcgcctttccaaaaattggcccaccctaaagggaaaagggaaccccccctgaaggggccaataaaggggggggggggggggggttacgccaaggggaaccgttacattggcaagggcc

SEQ ID NO: 29355 - DNA, 825 bp, Triticum aestivum
  unsure (1)..(825): unsure at all n locations
  Clone ID: PAT_TA_29355
gagaccgaagtggtggagcgtgaggcagcaccggccgaggtcgagaccaaggaaccagagcaagaagctgctccggccgagaccgagaccaaagtggcagagccagccgctgccgaggccgaggccaaagagccggtggcagaggagaccccggccgtggaggaggcagctgcccccgaggccgttgtggcagtgcaggaggaagcagcaactgccgaggcacctgtggaggttgccgtcgccgtcgaggcagcaccggtagagacagaagcaccatctgctgctggcgaggcagaggcggaggtcaaagagccggcagcagaggcaccggccgaggcacctgtggaggcacccacggccgccgaggcggtgccggcagaggcaccagctgctgccgccgccgccaacaaggccaccgagtgagttgatgcgcgcgggtccgatcgtgcttcctcagctggcctttgactggcttccgtgcgcgtgccctggcatgccatggcaccgtacctagttcgtttattattgggtccgtatgtgtgggcgtatttcgtgagtggccgatcgtcgtcgtctgggcgcgtattgtacgcgacgtagctgcgtacaatgtctagctagcagtcgtatgggtgtcgttctcgggtggcttcaataatgtgtccgtggcgttccgggtcccactgtcagtgatgccatggcgtcactggctttggaccctctttttcgtctctttttttcttggtgtttccgttggttaatatatatgtgtagctatttatttgtgcaaaaaaagggggggcccggtancccaattcgccctat

SEQ ID NO: 29356 - DNA, 875 bp, Triticum aestivum
  Clone ID: PAT_TA_29356
atttccgtcccgccgccgccgctgccgctgccgccctgaccctcgccgctgcagcagccaccaccgcgcaaccatgggtatcgacctcgtcgccggcggccgcaacaagaggaccaagcgcacggcgcccaaatccgacgatgtgtacctcaagctgctcgtcaagctctaccgcttcctggtgcggaggaccaagagccagttcaacgccgtgatcctcaagcgtctcttcatgagcaagaccaaccgcccgccgctctcgatgcgccgcctcgtcaggttcatggaggggaaggcggacaagatcgccgtgatcgtgggcaccatcaccgatgaccagagggtctacgagataccggcaatgaaggtggccgcgctcaggttcaccgagacggcgagggccaggatcgtcaatgctggtggcgagtgccttacctttgaccagctcgccctccgtgctccgcttggacagaacacgcttctcctgaggggtcccaagaacgccagggaagctgttaggcactttggcaaagctccaggagtgccacacagccacaccaagccatatgtccgctcaaagggcaggaaattcgagaaggcgagaggaaggaggaacagcaggggattcaaggtctaagatgtggaatttctggcgcacttgtgtcatattttgctatcttcggtttatcgtcatctttttggataccagaatattaccgctttagatgtcagtgtcttgtgtcaacgagtattcagaaccagttaatttgtgtttcatcattttgcaacttgagagaccatgcttgcaagccagttatgaatatcatttctagtatcaaaaagttgtctccgttggcactgtggttgggtgttaa

SEQ ID NO: 29357 - DNA, 1377 bp, Triticum aestivum
  Clone ID: PAT_TA_29357
cgcaaactcgttgcacaagaattcctcccacccccaccgtctcgccgccgccaccacagctagataagaaaaaaagagagagcagaactcgttgggagtgctcgagatctgtgtccgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcgggctacagcattgaagacgttcgacctggctgggaggcgccaagaagttctctgctgcatactccgaactgcgcgaagaagccatcctgatatcgtttttgggcatccccttcccgtagtttaaggatttttatgcaattttattctgactccttttctcccaccaatctctctggcttgctgcttcatctgttcctctctgctctgctttctgactcaaaactgcaacaatggctgccccgacctctgcgatcggatttgagggctacgagaagcgccttgagatcaccttctctgaggcatcaatctttgctgaccctcatggtcgtggcctgcgcgccctctccagggcccagattgactctgttcttgatcttgcacggtgcaccattgtgtccgagctctccaacaaggactttgactcgtacgtgctatccgagtcgagcttgtttatctactctcagaagattgactctgttcttgatctttggcccttcagagttctcagtggcggtcaccatcttcggtggccgcggccatgccgccacctggggcaagaagctcgacgccgaggcatacgactgcaacaacgttgtggagcaggagctcccctgtggaggcgtcctcatctaccagagctttgccgcgaacgaagaggttgctgtctctgccgggtcgcccaggtccgtcttccactgcttcgaggccgagactgtggagagccacccgctggtcaaggaaggcaagctcgccaacctcctcgcatggcgagcggaggattctctggaggagggcgtggtgctgtgcgagtgatttgctgtcgaatgttcagtctgtggaatttgctctgactgtttgtcttttgtcgtttggttactgtgaagcagccggccaggctattgctctctgaataaactattagctctaggtggtttgctgcgtctgccacaatgagcatactgtttggggaaaagttgtctcaacttataaataagcattttttttttaggacgagtgtcactttgttattactactgaattcctttctgcctgtatcatattcatattctgtaattggagttattagatgcccccc

SEQ ID NO: 29358 - DNA, 842 bp, Triticum aestivum
  Clone ID: PAT_TA_29358
ttttatgccaaaacttactaggactgcatctgaatagattgtaatattctacaattagtaacgcaatatcaccattgctttccttgccacaaaacaaggagagcatcaatttatgacctgaatacgctgacaacgaccgcacatgaacccagctcacgacacaccatttttgtgaatcttagtacgttcaacgacaatgaaatagcaaacttctaccaacgcatagctaccaaactcactttgcagctgcccgggcaccaccacgcccaccggtgccagagtgatcaacccgctggtagccaacatcacctccacgacctgagccgcctctaccaccgcctctgcctccaaaatcagatcgatagttgttgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgca

SEQ ID NO: 29359 - DNA, 1584 bp, Triticum aestivum
  Clone ID: PAT_TA_29359
acacagccgatcgcatagtgtgatctgatcagtcgcgccaaaccgagctctagcttcaggttgtcggagttcgcaccgatcgactcagaactcttcaccaatggccgccgtccaggtccaagccgcaacccacgcgatgcccgtcgaggaggctccggctccggcgccggcggtggtggaggcagtcgagccggccgtcgtcgttgtcgaggagactacggtggcggtggaggttgtcgagccggccatcgtcacggtcgaggagactacggtggcagcggtggcgattgtcgagccggccgtcgacacagttgaggtggcaacggctgaggctgtggagccggccgttgtcgccgccgaggaggccgcgaaggaggaagctgttgcaccggccgtgaccgagctggcgaaagaaccggaggcagctccagcggagaccaaggaggccgagacagaggccaaagagaccgagcccgaggctgtccaaccggcggcagccgccgaggaggcgcctgctgtgccggcagtgactgagaccaaagagccggaagctgcccctgccgagggaacagagaccaaagtagtggagcgtgaggcagcaccggctgaggtcgagaccaaggaatcagagcaagaagctgctccagctgagactgagaccaaagaggcagagccagccgctgccgaggccgaggccaaagagccggtggcagaggagacaccggccgaggaggaggcagctgccccggaggccgttgtggcagtgcaggaggaagcagcaactgccgaggcaccagtggagcctgccgtcgccgtcgaggcagcaccggtagagacagaagcaccagctgctgctgctgccgaggcagaggcggaggtcaaagagcccgtagcagaggcaccggtccaggaggaggcagcgcccgcagccaccgccgccgaagcgtcgtcagtgcaggaggaggcagcaccggccgaggcacctgtggaggcacccgcggccgccgaggcggtgccggcagaggcaccagctgctgccgccgccgccgacaaggccactgagtgagttgatgcgcgcgggtgcgatcgtgccccgtgagctagcctttgcctggctggctggcttccgtgcgcgtgccgtgacatgccatggcacgctacctagttcgtttattattggatccgtatgtgtgggcgtatttcgtgagtggtcgtcgtcgttgtcgtctgggtgcattgtacgtgatgtagtagctgcgtattaagtaggactgctgcgtataatgtctatcaatattgtgtcgtatgctagtcgtatgtgtgtcgttctcggcgtgatctcaataagggcttgttcggctaattctctccccaagaggattggaggggattggcaaagattggtttgtattttgatttacaagaggtttaaatccccctcaaaccccttcaatccactcggtttggcacgcaaccgagtggattggaggggattggcaaagattggtttgtattttgatttacaagaggtttaaatccccctcaaaccccttcaatccactcggtttggcacgcaacccgaac

SEQ ID NO: 29360 - DNA, 905 bp, Triticum aestivum
  Clone ID: PAT_TA_29360
aggaattcggcacgaggcgccgctgccgccctgaccctcgccgctgctgcagcctccaccgcgcaaccatgggtatcgacctcgtcgccggcggccgcaacaagaggaccaagcgcacggcggcccaaatcggacgatgtgtacctcaagctgctcgtcaagctctaccgcttcctggtccggaggaccaagagccagttcaacgccgtgatcctgaagcgcctcttcatgagcaagaccaaccgccccccgctctcgatgcgccgcctcgtcaggttcatggaggggaaggaggacaagatcgctgtgatagtgggcaccatcaccgatgaccagagggtctacgagataccggcaatgaaggtggccgcgctcaggttcaccgagacggcgagggccaggattgtcaatgcccggtggcgagtgccttacctttgaccagctcgcgctccgtgctccgcttggacagaacacgcttctcctgaggggtcccaagaacgccagggaggctgttaggcactttggcaaggctccaggagtgccacacagccacaccaagccatatgtccgctccaagggcaggaaattcgagaaggcaagaggaaggaggaacagcaggggcttcaaggtttaagccgtggagttttcggcacccttgtcacatttgctgttatcggtcaatcttcacttttttgggtacccagaatcatactgctttagatgtcagagtcttgtgtcgatgagtattcagaaccagttcattcttgtttcagtattttgcaacttgagaccatgcttgcaatccagttatgaatatcatttctagtatcagaagttgtctccgtttgcaaaaaaaaaaaaaaaaaaaacctcggccgcgaccacgctaatcacttagtgaattc

SEQ ID NO: 29361 - DNA, 1465 bp, Triticum aestivum
  Clone ID: PAT_TA_29361
cgatcgcgtactctgatctgaccggtcgcgccaaaccgagctctagcatcagctcgtcggagttcgcaccggtcgactcagaactcttcaccaatggccgccgtccaggtccaagccgcaacccacgccatgcccgtcgaggaggctccggcgccggcggcggtggaggctgtcgagacggccgcggtggcggtggaggctgtcgagccggccgtcgtcgttgtcgaggagactacggtggcagcggtggagattgtcgagccggctgtcgccacagtcgaggtggcagcggtggaggctgtcgagccggccgttgtcgctccccaggaggccgtgaaggaggaagctgctgcaccggccgtgaccgagctggcgaaagagccggaggcagttccagcagagaccaaagaggccgagcccgaggcagtccagccggtcgtcgccgctgaggaggcccctgctgcgccggcagtggtcgagaccaaagagccggaagctgcccctgccgagggaacagagaccgaagtggtggagcgtgaggcggcaccagctgaggtcgagaccaaggaaccagagcaagaagctgctccagctgagaccgagaccaaagaggcagagccagccgctgccgaggctgaggccaaagagccggtggcagaggagacaccggccgaggaggaggccgctgccccagaggccgttgtggcagtgcaggaggaagcagcaactgccgaggcaccagtggaggctgccgtcgccgtcgaggcagcaccggaagagacagaagcaccagctgctgctgctgccgaggcagaggctgaggccaaagagccggtggcagaggcgccggtccaggaggaggcagcgcccgcagccaccgccgccgaagcgtcgtcagtgcaggaggaggcagcaccggccgaggcacctgcggatgcgcccgcggccgccgaggcggtgccggcagaggcaccagctgctgccgccgacgccgacaaggccaccgagtgagttgatgcgcgcgggtgcgatcgtgccccgtgagctagcctttggcctggcttccgtgcgcgtgtcctggcatgcccatggcaccgtacccagttcgtttattattggatccgtatgtgtaggcgtatttcgtgagtggtcgtcgtcgtcgtcgcctgggtgcattgtacgtgacgtagctgcgtacaaggtctagctagcagtcgtatgtgtgtcgtactcaggtggtctcaataatgagtctgtgtcttgcgttccgggtcccactgtcagtgatgtcatggcgtcactggctttggagcctatttttcgtctcctttttcttggtatttccgttggttaatatatatgtgtagctatttgtttgtgtactgtgttggtactaaagaaagcgtgtgatttgtgtaaaaaaaaaaaaaaaaaaaaaaactcgagactagttctctcacctcgg

SEQ ID NO: 29362 - DNA, 1188 bp, Triticum aestivum
  Clone ID: PAT_TA_29362
ttcggcacgaggctaactcgttgcacaagcaattcctcccaccctcgccgtctcgccgccgtgcaccaccgcagctagataagagaaaaaaagagagagaagaactcgtgcgggagggctcgagatctgtgttgggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcttgctgcttcatctgttcctctctgctctgctttctgactcaaaactgcaacaatggctgccccgacctctgcgatcggatttgagggctacgagaagcgccttgagatcaccttctctgaggcatcaatctttgctgaccctcatggtcgtggcctgcgcgccctctccagggcccagattgactctgttcttgatcttgcacggtgcaccattgtgtccgagctctccaacaaggactttgactcgtacgtgctatccgagtcgagcttgtttatctactctcagaagattgtgatcaagacctgtgggactaccatgctcctgctcaccattccaaggattctcgagctggctgaagagctgtgcatgccgcttgctgctgtgaagtactcccgtggggatgttcatcttccccggtgcacagcctgctccccacaggagcttctctgaggaggttgatgtcctgaaccgctactttggccacctgaagtctggtggcaatgcctatgtgattggagacccagcgaagcctggccagaagtggcacatctactatgccaccgagcaacctgagcagcccatggtcaccctggagatgtgcatgactgggctcgactcgggtagaacgtacgagtcaaagtccttgttggagagctcggacacaatggtgcaccgtgcaagatcaagaacagagtcaatctgggccctggagagggcgc

SEQ ID NO: 29363 - DNA, 2031 bp, Triticum aestivum
  Clone ID: PAT_TA_29363
gcacgaggctaactcgttgcacaagaattcctcccaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcttgctgcttcacgataatcgaccagttctctagtctttctccctctgttcctctctgctctgctttctgactcaaaactgcaacaatggctgccccgacctctgcgatcggatttgagggctacgagaagcgccttgatatcaccttctctgaggcatcaatctttgctgaccctcatggtcgtggcctgcgcgccctctccagggcccagattgactctgttcttgatcttgcacggtgcaccattgtgtccgagctctccaacaaggactttgactcgtacgtgctatccgagtcgagcttgtttatctactctcagaagattgtgatcaagacctgtgggactaccatgctcctgctcaccattccaaggattctcgagctggctgaagagctgtgcatgtcgcttgctgctgtgaagtactcccgtgggatgttcatcttccccggtgcacagcctgctccccacaggagcttctctgaggaggttgatgtcctgaaccgctactttggccacctgaagtctggtggcaatgcctatgtgattggagacccagcgaagcctggccagaagtggcacatctactatgccaccgagcaacctgagcagcccatggtcaccctggagatgtgcatgactgggctcgacaagaagaaggcctctgtgttcttcaagacttctgctgatggccatgtctcctgtgctaaggagatgaccaagctctctggtatctctgacatcatccctgagatggaggtctgtgacttcgacttcgagccctgcggctactccatgaacgccatcaacggatctgccttctccaccatccatgtgacccccgaggacggcttcagttacgcgagctacgaggtcatgggcatggacgcttcggccctggcctatggcgacatcgtcaagagggtcctccggtgctttggcccttcagagttctcagtggcggtcaccatcttcggtggccgcggccatgccgccacctggggcaagaagctcgacgccgaggcatacgactgcaacaacgttgtggagcaggagctcccctgtggaggcgtcctcatctaccagagctttgccgcgaacgaagaggttgctgtctctgccgggtcgcccaggtccgtcttccactgcttcgaggccgagactgtggagagccacccgctggtcaaggaaggcaagctcgccaacctcctcgcatggcgagcggaggattctctggaggagggcgtggtgctgtgcgagtgatttgctgtcgaatgttcagtctgtggaatttgctctgactgtttgtcttttgtcgtttggttactgtgaagcagccggccaggctattgctctctgaataaactattagctctaggtggtttgctgcgtctgccacaatgagcatactgtttggggaaaagttgtctcaacttataaataagcattttttttctaggacgagtgtcactttgttattactactgaattcctttctgcctgtatcatattcatattctgtaattggagttactagatgccaagttttgctccattatcgacgcggccgcga

SEQ ID NO: 29364 - DNA, 2313 bp, Triticum aestivum
  Clone ID: PAT_TA_29364
gccctagctcgacttaccctactaaagggaacaaaagctggagctccaccgcggtggcggccgctctagaactagtggatcccccgggctgcaggaattcggcacgagccgaaactaactgtagtagcgacttgcggcatgatgcttcccaaatcacaagtcgtcaatgcaggggaggcagcaaactcgttgcacaagaattcctcccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcctgcttcacgataatcgaccagttctctagtcttactccctctgttcctctctgctctgctttctgactcaaactgcaacaatggctgccccgacctctgcaatcgggttcgagggctacgagaagcgcctcgagatcaccttctccgaggcatcgatctttgccgaccctcatggtcgtggcctgcgcgccctctctagggcccagattgactctgttcttgatcttgcacggtgcaccattgtgtccgagctctccaacaaggacttcgactcgtatgtgctatctgagtccagcctgttcatctattctcagaagattgtgatcaagacctgtgggactaccatgctcctgctcaccattcctaggattcttgagcttgctgaagagctgtgcatgccgcttgctgccgtcaagtactctcgtgggatgttcatcttccccggcgcacagcctgctccccacaggagcttctctgaggaggttgatgtcctgaaccgctacttcggccacctgaagtctggtggcaatgcttatgtgatcggagacccagcgaagcctggccagaagtggcacatctactatgccaccgagcaacctgagcagcccatggtcaccctggagatgtgcatgactgggctggacaagaagaaggcctctgtcttcttcaagactcaagctgatggccacgtttcctgtgccaaggagatgaccaagctctctggaatctctgacattatccctgagatggaggtctgtgacttcgacttcgagccctgcggctactccatgaacgccatcaacggatctgccgtctccaccatccatgtgaccccccgaggacggcttcagctacgcgagctacgaggtcatgggcatggacgcctccgccctggcctacggcgacatcgtcaagagggtcctccggtgctttggcccttcagagttctctgtggcggtcaccatcttcggtggccgtggccacgccgccacctggggcaagaagctcgaagctgaggcatacgactgcaacaacgttgtggagcaggagctcccctgcgggggcgtcctcatctaccagagctttgccgcgaacgaagaggttgctgtctctgccgggtcgcccaggtccgtcttccactgcttcgaggccgagagtgtgcagagccaccctctggtcaaggaaggcaagctcgccaacctcctcgcatggcgggcggaggaggattccctggaggagggcgcggtgctgtgcgagtgattggctgtcgctgttccgtctgtggactttgttctgactaagtttgtcgtttggttactgtgaagcagctggccaggctattgctactccgaataaactattagctctaggtggtttgctgcgtctgccacaatgagcgtacttctggggagaagttgtctcaaactgataaataagcattttttttctaagacgagtgtcactttgttatcatattcatgttctgtaatcgaaactacttcacagccgatagctgttggacgattcaagcacgattcttaatctagtggctgtgttgcacctagtactaggtatcgatggcctgaattgcagtatcgtccaacaatcggctggaacatgtgcgtgtgcatagcagcactcttctgtaattggtgttactctgtgccaagttgcagtgtgttg

SEQ ID NO: 29365 - DNA, 3872 bp, Triticum aestivum
  unsure (1)..(3872): unsure at all n locations
  Clone ID: PAT_TA_29365
gaatgccaaaacttactaggactgcatctgaatagattgtaatattctacaattagtaaccaatatcaccattgctttccttgccacaaaacaaggagagcatcaatttatgacctgaatacgctgacaacgaccgcacatgaacccagctcacgacacaccatttttgtgaatcttagtacgttcaacgacaatgaaatagcaaacttctaccaacgcatagctaccaaactcactttgcagctgcccgggcaccaccacgcccgccggtgccagagtgatcaacccgctggtagccaacatcacctccacgacctgagccgcctctaccaccgcctctgcctccaaaatcagatcgatagttgttgtactcgccccttgcatagcctctccctccagtgtaactaccacggcctctcatgccttcacctcggaaattaccacctctacccggtggaaaccttcccctgctactaccacgtgaaccaggagttcttttttcttcgacgtggcatggtcggtcatcaatcgtcacaggagaagccgctagtgcactttgaactgagctggcatcctcaaactctatgaagccatagcagaacccttgaatcttgtggcttctaacttggataccatcgtgtttaatagtaccaaatcttttgaactcctcttctaattggctaggtgtggcatgtaagggcagattttttacatacaccgcaagcgcatcaacttctgggtcttgaatgttgctgctctcaggattaggactgaaagttggagcatcaacagcgacagatggggcaggagcaggagcttgcttctccagttttggtggtgcaggcctgtaaggaactgcggaatttggtggcagaactgctttcatgactttgacaattgaagcgtacgacttcttaggggcctcgtcatgtggtacagggggagccgaaaccggtatggaggctgctacattatttggcacttcatctatgacctcaggaaccggtgtttcctccacaacaggcacttccacgtcattcggtgggttgtaaacctcctccttgggatcctcatcctcgttggtatgaggaacagactcagagagatccggctctggctgcggcgaagcctcctgctcgcgaggcacactctccacaagggcaacagtaccatttgccagggcggcagcaggggcaaccactgcatccaactccggtgccggcggctgctgctgaggtggcggcaatgactggtcggcctcaccctgcccgacataacatagtatgtcgttgagcacgaagtaacccttctcctgcggcgcgaggaagaaggactgcgcgaactcgcggcagacgtcgtccttccctgtgaggtggcccgtgacgagcacggtcacaccgccacatagcgactcctgcgcgtccacccccctgatctccgcccgcgcgatgtccatggacatgatcttctcgttaatcgcctccatggtggtgacggtgtccatgtcggcgccggtggtggcggggcggccgatgcggctggcctcctggtagaagcggaagacgagctccggtgactggtggaggatgttgtagtactgctgcacgaaggcgttgcccaccacttgcgccggcggcgtcggtcctggcgccgcggcgggggcggcggcgggcggaggcgtcggcgcggccatcgtaggaggaggaggaggaggaggggcgagggttttggcagggtgggaggcgaggtgcgggaggagggtttctccgggtggcgtcgcgtttcccgcagctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccctctccagggcccagattgactctgttcttgatcttgcacggtgcaccattgtgtccgagctctccaacaaggacttcgactcctatgtgctatctgagtcgagcctgttcatctactctcagaagattgtgatcaagacctgtgggactaccatgctcctgctcaccattcctaggattcttgagcttgctgaagagctgtgcatgccgcttgctgccgtgaagtactctcgtgggatgttcatcttccccggcgcacagcctgctccccacaggagcttctctgaggaggttgatgtcctgaaccgctacttcggccacctgaagtctggcggcaatgcttatgtgatcggagacccagcgaagcctggccagaagtggcacatctactatgccaccgagcaacctgagcagcccatggtcaccctggagatgtgcatgactgggctggacaagaagaaggcctctgtcttcttcaagactcaagctgatagccacgtttcctgcgccaaggagatgaccaagctctctggtatctccgacatcattcccgagatggaggtctgtgacttcgacttcgagccctgcggctactccatgaacgccatcaacggatctgccgtctccaccatccatgtgacccccgaggacggcttcagctatgcgagctacgaggtcatgggcatggacgcctccgccctggcctacggcgacatcgtcaagagggtcctccggtgctttggcccttcagagttctctgcggcggtcaccatctttggtggccgcggccacgccgccacctggggcaagaagctcgacgccgaggcatacgactgcaacaacgttgtggagcaggagctcccctgtggaggcgtcctcatctaccagagctttaccgtgaacgaagaggttgctgtctctgccgggtcgcccaggtccgtcttccactgcttcgaggccgagagtgtgcacagccaccctctggtcaaggaaggcaagctcgccaacctcctcgcatggcgggcggaggaggattctctggaagagggcgcggtgctgtgcgagtgaagacatgatttgctgtcgctattccatctgtggaatttgttctgactgtcagtttgtcgtttggttactgtgaagcagccggccaggctattgctctctgaataaactattagctctaggtggtttgctgcgtctgccacaatgagcgtacttctggggaaaagctgtctcgaacttataaataagcattatttttcctataacgagtgtcattttgttataattagtgttactctgtgccaagttgtagtgtgttgacaagcgaccagtgtgctcatttcccctggcctatcttctgatcatctcgtacgcgcaggaataaactactgcgcgaggaatacaagcacgaattgattcttttcttcgattgaagagaactatttgattcttcatccttatcttccttgtttctgatcctatcttctgcatttctgattcgtgcaaccactccaataattcattcaaggtgtcagtgccggcctcgtgagttattgggtgtagtagtaacgtttttcgtttcgttnctttgacaacggaggttncggtcgtatgtannctgggcgnaaaaaggaaagagcaac

SEQ ID NO: 29366 - DNA, 865 bp, Triticum aestivum
  Clone ID: PAT_TA_29366
gccggccggagcggaagggaatctgaaaccgaaatccgatcccgatcaggggagagcaaacaaggcgagacggaccgccaggctagaatcgtctccggtcgtccgatccgggtcagatggcccgggttgcgtccagctgtgccaccctcgtggcgcaaaggaggtgggtatcctccgcgataaccgccatcggagtgtccgcgaagaaggttgaggagaaggcggtgaagctgggcacggtggcgacggaggacaccacggaggacaagacggcgttctggaagccggaccccaagacaggcgactaccggcccgtgaccagcaccaaggaggtggatccggccgacctgcgcgccgagatgctcaagcggaggttgctgcagcagcaatgatgcgcgtgctgcaaacacgctaccggcccaggctcataccgccatgtacagcaaaacgttgacgggcgtgctaaactatatttactaggcgccatgtcggacaacgacttgtcgggaaattgcttcctgtatcactgtatgtaagtctttagcaaacacttacacatttgcgtgttctacgcaaatcgtctaaaatttcagtgactttgcgcatcatgacaaaatttcagcagttcaattgcgggaattgccattgtagcaacttctgagagctcgcgcatggggtgctttccatctgacagccttgtaactgaattcaatccaaattcattttttatgaaaaaaaaaaataaaaattgagttgtaagaaaaaagataagtgtgatgatcatcattaatagagacattgtcacaatgaggaaaagatgatggagactaggagtcacccacaagtcgggacgagactccagaaa

SEQ ID NO: 29367 - DNA, 542 bp, Triticum aestivum
  Clone ID: PAT_TA_29367
ggcttcctgtatggttttcaactaaaagaacaagtgcacataacattgatatgttcagctgaaagactgctatagctagatcttgtcagaataatttctttttgagaaactttcagactaatgtcataaccttataagacaagtaatttttctcgttctttttttccagagtagaatattttctgttaatttctgatttttttaccttgtgaagtatttgtgttgcaccgtgtaacatgcattgtcattggtggcagacatatatcgctgccgccactgctccagagacgaggtgggagacggatggagtgacattgcgttcggctgctgtatctatgtctctcacatgatctacactagtgtcaaaaatgctcttatattatgggacagagagagtactatttatatattatagaactacggtattacaacatcttgagtagagttatccgggttttttcttctaaattgaaccccagatgtctgaccttcagcttgaagtcgatcaagaatattaaatttacaaaaaaaaaaaaaaaaaa

SEQ ID NO: 29368 - DNA, 931 bp, Triticum aestivum
  unsure (1)..(931): unsure at all n locations
  Clone ID: PAT_TA_29368
ggagcagccaatcgctccctccgcgttatctcgttgcctccacccctccgccccattcccgctgctgctgctcctctctcctcttagcccaaacacacctcacctcgctccccgtcccgccgatctcttctcttctagggtcgtccgcgatggcggctccggtggtggacgccgagtacctgcgccaggtcgacagggggcgccgcgctctccgcgccctcatcgcctccaagggatgcgcccccatcatgctccgcctcgcatggcatgatgctggcacgtatgatgtgaacacaagaactggtggtgcaaatggttcaattagatacgaggaagagtacacccatggttcaaatgctggcttaaaaattgctattgatctcctcgagcctattaaagcgaagcatccaaagattacatatgcagacctttatcagcttgctggagtagttgcagttgaagtcaccgggggtccaaccgttgagttcatccctggaagacgtgattcgtcagtttgtccccgtgaagggcgccttcctgatgctaagaaaggcgcaccacatctgagggacatcttttatcgaatgggcttaacagacaaagatattgtagcactatctgggggccacagtctgggaaaggcacatcctgaaaggtctgggtttgacggtgcatggactcgtgatcctctgaagtttgacaactcatactttcttgagctactgaaaggggaatcagaaggtcttctgaagctccctactgataaggcattgttggatgatcctgaatttagacgctatgtggagctttatgcaaaggacgaggatgctttcttcaaggactacgctgaatcacacaagaaactttctgaacttggcttcacaccacggatcagtggcgcagcatctacannatcagatgtttcaactgc

SEQ ID NO: 29369 - DNA, 1375 bp, Triticum aestivum
  Clone ID: PAT_TA_29369
cacgccttgccggctaggaggaggcctccgctcgctccgcgttatctcgtcgcctccaccgctcctcctctctcccgctactcctaacccaccccagtcccaccccacgcacccctcacctcacctcgctcctcgccccgccgctctcttgtcgtctacttccttagtgtcctccgagatgccggccccggtggtcgacgccgactatctcctcccggccgacagtgcgccaccgcggcgcccgcgccggatgccccgccccggagcgcgcgccactggggcctccgctctcaacgcacgatcctggcgtgcaagaggtgcacccagatactggtgacgccactcctttgattatgatgctaggtagaatatacccaaaagaactatgctggcttaaaaagtgtaaattatctatactaaaaactgaacaccgctgaatcaaatccagactgttacatgatagcaatctcctttatcactcttggagcgaagcaacgtaagaatgtatgagcatccctgtagggggtccaatgtggtattaggatcataacccaggcagggatccagacttcgtcagttttgtccccaatgcgaagttacgcatttccatgaacttcgaaacgcaagtccgcgccacatacagaggggcatcatatatacaagtggacttaataagacaaatgtattgtagcactatcgtgggggccaaagtctgggaaaggcgcatcctgaaaggtctgggtttgacggtgcatggactcgtgatcctctgaagtttgacaactcatactttcttgagctactgaaaggggaatcagagggtcttctgaagctccctactgataaggcattgttggatgatgctgaatttagacgctatgtggagctttatgcaaaggacgaggatgctttcttcaaggactacgctgaatcacacaagaaactttttgaacttggcttcacaccacggatcagtggcctagcttctacaaaatcagatgtttcaactgctgttgtacttgcacagagtgcagtgggggtagcagttgcggcagctgtagtcatcgccgggcatacctgtacgaggcttccaaagaggagcaagtaaggggtttcatgagttcgttggcatggcatatgccttgttttagtaaagaatcaaggtttattcttaaaaaaataagtgccaagttcaaataacagaacgctagtgatgaacaaccaatagcagtcttaaaatatttcaaacattcttgaggacatctccttcatgtatacatcatacttgaatatttcagtgacaatgaatgcttactattaaaagcatttttgggcatgtatcttttgcaatacaaaagaacttgtttgtgccctg

SEQ ID NO: 29370 - DNA, 1305 bp, Triticum aestivum
  unsure (1)..(1305): unsure at all n locations
  Clone ID: PAT_TA_29370
gcggctgcgaatcattccgctcctcgacatggcgacggaacctgtagagtttcaggttgtggtgctcagggtgtccatccattgtgaagggtgcaaaaagaaggtgaagaaggtgctcctacatattgatggcgtatacagatgtgacatcgacgcccgaagaaacagggtggcggtcacagtctctccaaagatcgacgccgggatcctcgtcgcgaggctgcgcaagtccggcaaactggcggagccttggccggaggagcccaagcagcagcaggagccgcctcctcctgcagagagccaaagccaagaagccaagaaccaagcagatgatgccagcaagcctaacgaggccgccgagtacggagcgcccccgccaagcaccgcccagcctccggcgccggaacccgagaagaccgccgaagagaccccaccgccggccgaagaaagcaaagggcccgacgaggccaaggcggagacagggccgcatcaacaacccagcgaggcgaacgggaaagccaagcagcagcagcagcaccaggagcagcatgatcatcatgataagccgatggacgccagggtgacgatggagtacgacgacgcccgcagcagaggcgtctacggctacgggggcccccaccagtacatgccagcgacacggcagccgccggtgcacgtcatgagctacaacgtggcacggccgatggcgagctcgtcatactacgccgccgcgccaacgccggcggcgatgcccacgcccatggcgaggccagggccgtcgcacggcggctacatagacgagtacgcgcctccgaactactacagccggccggcgccatcggcgtacgagccctactactaccccgatccccagccgtcgccgtaccagcatcagcgttctgcggccgaggactactactacggagcaccgccgccgcctccgcagaggagcgccttctcgccgccgcgggaggcttacggcgacatgttcaacgacgagaatgccaattcttgcagcgtgatgtgaagggaatcgattcggcaggtttagctagcttaatgttctttaacggatgaccactccatttgttagagccgagattttagtagtactagttgttaccgatgtattagcagtattgctcaagttccatgctagtactatagaataaaaccagatgagcttggtgcatgcatgcaggaagaacgggatgggaagagctctgattgatgcttactggagcaattttgtaatatatacttcctctatatttaaactgcaaaaacatcttacactatttagan

SEQ ID NO: 29371 - DNA, 744 bp, Triticum aestivum
  Clone ID: PAT_TA_29371
cggacgcgtgggtttgtaaatggcgattggaacactggtggaagttgtggtaatagcgttcccttttctaatggaagcgaggtcttgcaggatcattcaagtgacttgcctgcagagcgtgctgtaaatggaactcaggttaagcttttggatattacttctacgtcacaactacgagatgaggggcacatctcaaatcgtactttcagagctccaacaggcattcatgattgcttgcactggtgccttcctggtataccagatatgtggaatgagctcctctttgcacagatttagtacctgtatactgcacttgagtaagggcatttttctcccagaggcccaagaatctattaatgttcccgctggtgatctgtacagggtgaactgctttgtaccagtgttatttgtgaaccatccatgcgcaggcggtgtttttggtcatccatccatgcgttggtggttaacagtgtcaagatgatagcattctttacactgtattacagttggtttcagattcctagccccgtctcagaccagatacggtattagttgctacagagcaatatatgtagtgctccccaggcacgtcaaaccttccttttctttactgtaaaatgccattatccagttcacaatgtgcagcatatattctgtaaaaaatgttcatacaaattgaccaaagtgacatatgtttttcagattataaagtggaacttctggttgaaaaaaaaaaaaaaaaaa

SEQ ID NO: 29372 - DNA, 437 bp, Triticum aestivum
  Clone ID: PAT_TA_29372
agcggaagcgttcgggtaaacggggttgatggagtcgtactcgtcgtgattcaaatcaccggagatccagtgccgaacggacggcacctccgcgttcaacacacgtgcagcccggtgacgtctcccatgccttgatccagcaaggagagagggagaggttgaggaagactccgtccagcagcagcacaacggcgtggtggtggtggaggagcgtggcaatccagcagggcttcgccaagcaccgggggagaggaggagtagggagagaggtagggctataccaagagggagagaactcatgtgtatggcagccccaaacctcaagtatatatagggggaaggggggctgcgccccctttagggtttcccacccccaaggggtgcggccagccctagatgggaaaggggcggcggccaagggaggattctctcccccc

SEQ ID NO: 29373 - DNA, 1682 bp, Triticum aestivum
  unsure (1)..(1682): unsure at all n locations
  Clone ID: PAT_TA_29373
agggtttttttttttttttttttggagcaaaatgcttatcattaccattgatcatcgtcatagctccgcattttccttttgagttaatacacctgaattatcgtggtcgcggccgacgtacacttttacacgctaaaatgctaccactttgaaataaagcctacccttgcaattacaaggaaaggaaaaaggcgaaaaagagcaataagaaggtttagtcccactaccctccacaaactccttatcggcgagcgagatgggacagaggcgaaaggcttcaccccgacgacggcgacgaggggaagacgtccttgacggcagacgcggcggtaaggtagttgagagtgttgcggagcgacctcgccccgctcccgaccgctgctcgatttcgcttccttgacatcgcccgcgcggccagctcgagcagtcgctgatgaccaccgcgccgttcgtctccccatcgctcccccgactacactccgcgcgggcctctccgttccccaaaccctccgttgggtccgggggtggggtcgcgttccccgcccggacgtacgggtcatcgcttcgctgaggtctgccgtcatgtctgcagcggcgtcggggggaacggctctccgatggcgcctgaggagtccacagtgtcttctaggtggggggaggtcaagcgggtaaccaaggaaacaaatgtgcatgtcaagatcaacctggacggcactggtgttgcaaactccagcacagggataccgttcttggatcacatgcttgatcaactggcatctcatggactgtttgatgtatacgtgaaggcgacgggtgacacacacattgatgatcatcactcaaatgaggatattgctttagcaattggaacggcattacttcaagcacttggtgaccgaaaaggaattaaccggtttgggcattttacagcaccacttgatgaggcagcagttgaggttatactggatctatctggtcgacctcatttgagctgcggcttaagcattcctaccgaaagagttggcacatatgacacacagctagttgagcatttcttccagtcccttgtgaatacatctggcatgacgcttcacatccgtcagcttgcgggaaacaactcacaccatattatcgaggcaactttcaaagcatttgccagggcgcttcgacaagcaacggaatatgacttacgccgccagggcactatcccaagctcaaaaggtgttctgtcaaggtcttagtgttgcaatgcaagatcgaaaactggacgcacgctattcgccctcaaagaaacacatgggcggtcgcctgctatgtctctgctgctacttggacttgcagtccgcggggtttggaacaagaacagcatggaaattgcttgttatcctgttgtcagggtttgtttatcttactaccattggcatactgtatctgctcgctactgcagttttgctggacaacacttacatctgaagatgtaaaagctgcagacggcttgacattctgaaagttattacctctgatatggcccccatgcattggtttgcgccctgtaataatggtttggccattcaaaagagtgaaatgaaatagaataataatctccatcaaanatgaatgatnnataaaaaaaaagggggccgtacaatcccaaaaggtcttaccccnaggctctttaatct

SEQ ID NO: 29374 - DNA, 859 bp, Triticum aestivum
  Clone ID: PAT_TA_29374
aagaccggaggaagaggtgcccatggtggaatcgccgtaccgtcttcggcatcgccggctgatggacaccgcgcccgcaacggcgggcggtgatccagcgccagggcatggctccagtgggatgccgatcatggtctccatcctggtggtggtcatcatctgcaccctcttctactgcgtctactgctggagatggaggaaacgcaacgctgtgaagaaggctcatctagagaggctgaggccgctctccaactcggacctgccggtgatggacctgcccaccatcgccgccgccaccaacggtttctccaaggagaacaagctcggcgaaggcggcttcggccccgtctacaggggcgtgctggacggcggcgcggagatcgcggtgaagcggctgtcggctcggtcgcggcagggggcggcggagttccggaacgaggtggagctgatcgccaagctgcagcaccggaacctggtgaggctgctggggtgctgcgtggacatggacgagaagatgctcgtctacgagtacctccccaaccggagcctcgacgccttcctcttcggcaccagaaagacggcgcacttggactggaagatgaggcagagcatcgtggtggggatcgcgcgcgggctgctgtacctccacgaggactcgtgcctcaagatcgtccacagggacctcaaggccagcaacgtgctcctcgacaacaagatgaaccccaagatctccgacttcggcatggccatgatcttcgaggacgaaggagatcgaggtcgtcaacaccggccacgtcgtcggaacatatgggtacatggcgcccgagtacgcgatggggggcatcttctcggtgaagtc

SEQ ID NO: 29375 - DNA, 739 bp, Triticum aestivum
  Clone ID: PAT_TA_29375
aggcataatctccctctccaaaggattcgatctttcgggcctatttgagaaggaccaagagcagaagtcgaactcgcggttcatgacccaaaaacccgcatcagcaatagtgtcaaagctggagcaaatagccgagacagagtccttcaaggtgaagaagcaggacggactggtgacgctgcagggatccaaagaagggaggaaggggcagcttgcgattgatgcggagatctttgaagtgactccatccttctatgttgttgaggtgaagaagtcggcaggagacacattggagtacgaacggttctgcaaaatgggcctacggccttctctcaaggacatctgctggaacggtccgtcagaggaaaagcttccatcagtatcggagtcagtacctccaactccgtcctccaagtcgaccaaaagaaatgtcatttaagtgtgatatcttccgagctgcaattacaatctattctcctctctctttcttccctcctcaaagagctgagactttgctcacttgagtatcaagctttagggctctttgttaatcctttttgcagtttcccttttgtggtagcaattgtagtatatggatttcctgttttgttcaccaatagaagcacaaaaggtgacagtaacactcttacagttgttgaactgggacaagcataccatcacctgcaaaaaagatcttgtaagaaccaaagctagtataggatgattaagtagtttcaag

SEQ ID NO: 29376 - DNA, 328 bp, Triticum aestivum
  Clone ID: PAT_TA_29376
gcgccaggccggcgctcttgatcagcgagacccactcagcaccatcagcgccaggccggcggtggagcacctgaccggggagggctctattttcggcggcctgactccacaggtggtgcaggcatcgctgaaggtggcgccggagctggtgaagctgctctgagcggtggtgaccgactctcggtgcacgtgtgcgtttactttctgtcgtgcgtgtcaaatacgctttctccaacaagaagatcgtcgtgcacgctgtatgctgtggcgacgtgtatcacttggtctgtgattgtacgctgtaccgtccttttttccccttccgaat

SEQ ID NO: 29377 - DNA, 637 bp, Triticum aestivum
  unsure (1)..(637): unsure at all n locations
  Clone ID: PAT_TA_29377
gggccaacgctcttccacctccagctccagctcagggtaaatacgtacgtggggaagagaggcatgtctgcgaaggccggcaagcccctggtccagaccgacgcgggggcgtacatcgcttggtccggtgctgaccagccggagctcgcaacggaggggctcgggtgtggccttctcgtgctgaggcccctcggcttcgcgctgccgcactatgctgactccaacaagttcggctacgtcctcggtggctccggggtggctggggtcctcccggttgacgccaaggagagggtcgtccgcctgaaggccggcgacgtcatcgccgtgcgcacgggggacgtctcgtggtggtacaacgacaacgacggccacgctgatgacttgtccatcctgttcataggcgacacggggcgcgccctcagcccgggggacatctcgtacttcttcctcgccggcggcaacagcgtcctgagcggccttgacgcgggcctcctaccagggcgtggcctggtgtgacggaggagcaggcggccaccgcgttccggagccagccggccgtnctcctcaccaggctgagcgcgaagctgcccggcgtatgcccgcgcgagcacgacaggaaagggctcgtcgtgaacgc

SEQ ID NO: 29378 - DNA, 369 bp, Triticum aestivum
  Clone ID: PAT_TA_29378
cggacgcgtgggcggacgcgtgggtgcaggcatcgctgaaggtggcgccggagctggtgaagctgctctgagcggtggtgaccgagtctcggtgcacgtgtgcgtttactttctgtcgtctgtgtgaaatacgctttctccaacaagaagatcgtcgtgcacgcttgtatgctgcggcgtcgtgtatcactcggtctgtgattatacgctgtacctgtccttttatttcttctccgaataaaagtgttaaataccacaaaaaaaaaaaaaaaaaaaaaaaaaaaaaaaaaaaaaaaaaaaaaaaaaaaaaaaaaaaaaaaaaaaaaaaaaaaaaaaaaaaaaaataaagaaaaaaaaaaactggcgccc

SEQ ID NO: 29379 - DNA, 1546 bp, Triticum aestivum
  unsure (1)..(1546): unsure at all n locations
  Clone ID: PAT_TA_29379
ggatctacgtcgatgtccctccgggcccccttccgcgtcgcgccgccgttggccgtggggcgcgtcgccgcccgcgccgatggagcggcgtggctggcgctgagcaagagcgcccggtacgtgcccgggcgctagacaaatgcgaaatgcaagttctgccccgtcgatcgctagctccatctcaggtaaatacgtacgtggggaagggaggcatgcctgcgaaggccggcaaggccttgggccagaccgacgcgggggggtacgcagcttggtctggtgctggcgagggagctctctcaagcggcgcgcagcggtggtgactgctcgtccggacgcccgtcggcttcgcgcctgtcgattatgctgaatacacctagttcggcaaggtcctcggcggtgcccggttgtatgctgtcgtgccggtcaacgcccaggtctgggacgatacgcttgtacctggcctcttaatccttgcgcgcactggaaacgtatcgtggtggtaaaacgacaacgacaacgaaggcagcgctgatgacttgtccatcttgttcataggcgacacggcgcgcgccgtcagccccggggacatctcatacttcttcctcgccggcggcaacagcgtcctgagcggcttcgacgcgggcctcctcaccatggcgtggcctggggtcacggaggagcaggcggccaccgcgttccggagccagccggccgtcctcctcaccaggctgagcgcgaagctgcccggcgtatgcccgcgagagcacgacaggaaagggctcgtcgtgaacgccggccacgtcgctgcagggaccctgaagatgctcaccgcgtcggatctggacgcgctgggcggcttcggattcagcgcggtgctcgggcggctcgagcccggcgccgcgagggcgccgtgggtgctccgcgagggcgcggcgcaggcggtgtacgtggcccgcgggagcgcgcgcgtccaggtctcgtccgccgtgggcggcgacacgctgctgctggacgaggatatcgctgcggggagcttgttcgtcgtgccgcggttcgccgtggcgctcgtcgccgccggcgccgatggagtggagtgggtctcgctgatcaagagcgccaggccggcggtggagcacctgatcggggagggctcgattttcggcggcctgactccacaggtggtgcaggcatcgctgaaggtggcgccggagctggtgaagctgctctgagcggtggtgaccgagtctcggtgcacgtgtgcgtttactttctgtcgtctgtgtgaaatacgctttctccaacaagaagatcgtcgtgcacgcttgtatgctgcggcgtcgtgtatcactcggtctgtgattatacgctgtacctgtccttttatttcttctccgaataaaagtgttaaataccacagaatctgcattggttgatgcatgtaacctacgcatagttgtacacactacgtgaataattgtttatagggaaaaaaaaattcctacacccctcacactcccttccactggtaaacaaagnccacattcct

SEQ ID NO: 29380 - DNA, 678 bp, Triticum aestivum
  unsure (1)..(678): unsure at all n locations
  Clone ID: PAT_TA_29380
cccacgcgtccggcggcgggagctggtgaagctccggcgtgacctcgccatgccggtgttcgacatcggcccgctccacctgttctcccccgccgccgcagccgagagtagcctgctgcggcaggaccggagctgcctgaagtggctggacgcgcggccggcagcgtcggtgctgtacgtgagcttcggtagcctcgcgtgcatgtcagcgcgggacctggtggagacggcgtggggcatcgccggcagcggcgtgcccttcctctgggtggtccggccaggcctggtcgccgcacggaggctgacgcggcttccgtgccggttcgaggaggcgacgcgcgggcgcgggatggtggtggagtgggcgacgtcgagcaaggttcgccggcacgctgccgtggccgggttctggacgcacgggggctggaactcgacgacggagggcgtgtgcgaaggggtgccgatgctttgccgcccgcacttcggcgaccagatggggaacgccaggtacgtggagcacgtgtggagggtgggcttcgcattcgccggcgcgcttaaatctggcggcgtggagggagctaccgtagccataagtcccctgtcaatttagtcttttcangtgtnacgtgtagttcaatccggtaattantancnattaaaaaananactttaatatct

SEQ ID NO: 29381 - DNA, 1119 bp, Triticum aestivum
  Clone ID: PAT_TA_29381
aataaggagcataaaagcttaattattccaaattacaaagtatacatactcgtacccatgtcttaatttatagcataactagctacaaacccagtcatgccaatacaagtgtttatacactcgtatattatcaagctataaattgggatctttagctactagtgcgtgtaaacatctctgccgtacgtcttagacacagacacttgacgactgcgggcgagtggtgcgacttgtggtgcatacgccgtcggttctcctttgttgccgccggccagcatcccgctgattgcgccgctgaccaggccggcgcccagcccccacccgaactccatgctggggttgtgatctgccggcaagttggctggttttggaggcggcgacacaaccacaggggcggctggttttggagcaggcggcatggacaccacctggccgtatggtgctggagacggcggcatggacaccacctggccgtatggtgccggagacggcggcatggacacatgcccgccggatggctttggagacggcggcacggccgtcacatgcgtgcttgtctttgaagatggaggcaccgcatgaacaggtggtttcggagacgacgacggcatggtagcgacatgtccggcgggtgttggagacggcggcacggtgtaatgacttgatggttttggggacggcggcacggccacatgtgcagctggtttaggaggagacggtggcggggcctcgtatccagaaggttttggagacggtggcggggccacttgtgccgctggttttgcagatggcggcaaggacacatgctgctcggttggctttggagacggcggcatggacgccacacgcccgactggtttctgagacggcggcatggacacggcacgttcgactggtttcgatgccggcggcatggacaccacatttccggccggtttctgagacggcggcatggacaccacacgttcgactggtttcggtggaggcggcggcacggacaccacctgcccggccggtttctgagacggcggcatggacaccacacgttcaactggtttcggagccggcggcatggacaccacatgcccggccggtttctgagacggcggcatggacacc

SEQ ID NO: 29382 - DNA, 1043 bp, Triticum aestivum
  Clone ID: PAT_TA_29382
gagaaaaattaacattgtcattgctaagagaagtgaaagaagagacagggttgatgcagaattcgactaggtacttgccttcagcatgcaaaattgtgcgtgagagataggagcactgagactgctgacacgaacttcataccttctgctagcaagaataatatatgcaaaaataaaaatggaacacgtagtatcagagcaaacggcagagccacaaagcttattttgaaaaatcagatctattttttgtgtgcatcctaaggccacattccttcgacattactaagcaagagtctgaaatcgaggatgctcagtggatgccggtggaggaatttgcggcacaaccattcgtccagaaacatgaactggtgaagtatattctcgaggttggcctggctaagaccgacaaggaatacgcaggattttcaccaatcagcataaaatcagcgttctcagagaaacagtccttgttttacatgaacaggagggacctggagaaagcctcaggacccatcatcaatacacaaaaagatagctgaaatttcagtcagagttaggaaagggttgaagcactcgtacccaattactcagctgttcgattggtagcttgtacgcctgattttgacagtatgatgcctgccccctaccattatatcgattcagaaagagatataacctagcagaagtgcaacggaagttgttgtactcggacatcaaaaaggaagatattaatgcgctactcgttgtcaaatttgtatcgatgagcgtacaaataatggaacatatcaaagattttttgtttttgtttgtctccccttgttgtgctgcagtatctgtgcaagacactatttatttttttgtgcgaaaacaccgttgttgtgttacccttttttgacatgtcaaatgcgagataccgttgctgtgttacctacgtttggatatttttgtaacctatgtttgtatatctttgtattgggcttgtaaaatattgactggtgttgtgttttaaaaaaaaaaaaaaaaaactcgagactagttctctc

SEQ ID NO: 29383 - DNA, 889 bp, Triticum aestivum
  Clone ID: PAT_TA_29383
cttttctggagttgccctaacttctccttctctctggaaaccctaagccccttctccctcctaagccgccgatccgaccccaaatccgaacgcctctgcctcccggtccaagccgcacgccactatgccggacatgcagccgctcatcagcgacttcgtcctcaagctcaagcgacgtaaggtggaggggtcacatgccgtggcgcggcagacggcggagctgctgaggtcagtggtgtcgcagcaccggatgggcagcactaaccaagcggcggctctcgccgacgccatccatgccgtcggggagcatctcatcgcagccaatcccatcgagctcgctgttggcaacactgtgagacgtgttttgcatataataaaagaggaagatatatcttttaccgcagttggtattgaaggtctttctgtgactgctgtcagtgacgatgaatgtgacagtggaaatgatgaccgtcctaccttatccgctgctgttcttgcttcccatgctagaaacgctcttcgggcaccttcattgcagactctcctggatgatattcctgtgagcactgcacttacacattcttcatcgtcagctggggattcagatgggaaaactggagataagagcttaaaaactcggaaactaaaacatgatgttattgctgccattggtgatcttattgaggagattgatacatgttatgaccagatttctgagcaagctgtggaacatatccaccaaaatgaggtcatcctaactctaggtcgttctagaactgtgaaagagttcctgtatgctgcaaaggagaagaagcgatcttttcgtgtatttgttgctgaaggtgctccaagatatcagggacatgctcttgcgaaggagctggtcgag

SEQ ID NO: 29384 - DNA, 1703 bp, Triticum aestivum
  Clone ID: PAT_TA_29384
ctcgcggtgccgacgccccacgaatctaaacctcacccactctacagcaaccactcagcaagcgctacccacgggagcgcgcgaccacgcataccgccggtagcccactcggctgcgcgacctccgaaaccaagcgccagatttgattacctacccgtccgaggaggaagcagatagaacggcatcggggaaaatcggattagatcggatcggttcaccttggcataagtcattctagctctaggaagctatggatagccaaaatcgaaagaaagatgaatgtaaagaagaaatggatggatgagtcacatcttcagataaagagtaagaccaagtcctgggtgaatgaggaggacgagtaaggagcatcgagcatagaaatcgacgccaaggttgtggagaaggaagaggtgtcaagttatggttcaaagtatgcaggcaaagttaaggaaaccaaaaaagaagggaaaaacaagtcatgagaagcatatagatgaacatgaagacgatcagagggcgagtaagaagtaaggaaaataaggcagtagaaacatgaagatggtaagagggaaaagaagttagagaagcatgaagatgacgggaagactagtaagaagggatagaaaggagaaggatgagagaaaaaaagaagatggcgaaggctcagaactggcgaaagacacatatgcagatggtaagttgagcgagagcaaagagaaggataaaataagcgacaaggagaccggagctgatgcagatgacagtagcaccaagaacaaaaagaagcagcaggactagggcacgaagaaggatgaaagcgatgaaaaacaagagaaagacaaagagagcgaggaacatgagaacaagaagaagcatgtagaagtggatcaggcaagagaaatcaagctacaagataatgagtcggcgaagaaagaaactgatgcttctgaagagaagaaggatggcacggacaaagcaaaggataaaagaaagagagacagtgcgaagaagcaagatgaacataaggaaatcggtgacaaggacgaacaaggtaacaagaaagatacagagaagaaggacaagaagaaagataaaaccgacaggaaggggggaggcaagaagaaggatggcgatgatgagaaggaagaaggtaagaaggacaaagaagcgaaggagaagaagaaagataagaccggcaaggaagaaactaagaagaaaaagaaggatggtgaggatggggaggaagaaggtaagaagaaagacaaagagaagaagaaagacaagggcggcaaggagaagaccaacgatccggcaaagcttaagaagaagctggagaagatcgacgcaaagttacaagacctacatgctgaaaaggaagacatcctaaggcagctgaaggagctcgaagagggaatgaccactgaagagaagaagcctgtacagatagtggaagcgagtggcaaggccaagtccaaggaagatgatcttgttactgcaccctgatcttctggaaatctttgacttgttgacacttgctgtgattttatatggttgtaacgcgaataatttctgatctgggtacgtgcacacgtttctgtgtgcagtacagaactccctctatatacatatacagcttgagtgtaagaatataaacgcccaaaaaaataaaataaccacataaaccaaaaaaaaatgcgtcggct

SEQ ID NO: 29385 - DNA, 711 bp, Triticum aestivum
  unsure (1)..(711): unsure at all n locations
  Clone ID: PAT_TA_29385
ctttcagaagggcaactgaatgcatacntggaagaatcatattttacagggatggtggatgttgaactttctgccataaaaaaggcctgtgcatccctggacccttgctatagcccacgagttacctttgttgtcgttcagaaacgtcatcatacccgtctgttttctgataactatgatgttgtgagtacaatttatggaagtggaaatgtactgcctggtacagtgattgataaagaagtatgccatcccactgactttgatttttatttgtgtagccatgctgtcactaagggagtgagccgacctgtgcgttatcatgttctgtgggatgaaaacaagtttacggctaacgctttgcaaacgctcacaaaccacctatgctacacgtatgcgagatgcacctcttctgtttcagttgtgcctcctgtctactatgcacatcttttggcttcgcggggacgactttatattaaacgagggcatgagggatcctttcccgttctcagtgaaaatgtgaaaggtgttatgtttttctgctaaagcagttttgaaagtgttgatatgggtgaataggagcccagaacaatttacattgagcttgagctttagtttaatactaatcatgtttctgagtagatcctaattactccctcctatccattgtactacattaatctgcgataatcaatatggatcagagagagtaca

SEQ ID NO: 29386 - DNA, 967 bp, Triticum aestivum
  Clone ID: PAT_TA_29386
gccggcaaggtccacgactacggggctccatccgcctactcgccgccaggtaacgcgtacccgcctcagtccgcgtacccacaggcggcgaaggccgacggggcagcaaccgctggtgcctacccacctccctccggctacccacctgccggaaagacaggcgagccatccaccgcctaccccgcacccgccggttacccacccgctggtccgtcaggaaagccggcgaaggcaggcgagccagtgacggcctacccagcagccgccgcgggacccagcaccggagctccctacggcgccccgcccccgcagtacggctacgggtacccaccgcagcagcctgccgggtacggctacccgcccccgcctccgcaaggagggtacggcggctacggctacccgccgcagcagccggccgggtacgggtaccagcagcaggccgtgaagccgccgaagaagagcggcatggggatgggcctcggcgcggggctcctcggaggcgcgctcggcgggctcctcatcggcgacatgatctccgactccgccggagggtacgacggcggctacgacggcgggttcgacgacggcggtggcttcgatttctagatcgtcgggaggataagatatgcagcagcacagttcttttgtacgctcttggtatttcttcagttctttcgtcttcagattttctgctcaaaaaaaaaggagcataggcgcctcggcagcacggttcttttgtacgtccttggtatttcttcagttctttttgccttcggattttctgctcaaaatcgccggcgcctgtgggcgcagctagtgtgatatggtaatgtaaatatgagttttaacatgatatattgtgaaacctttttgtctcgattggactagaatctctgataacttggccgtattgtctttgtactcattcattcgattcgtttgatcaaactttgcgtgttggaactgt

SEQ ID NO: 29387 - DNA, 718 bp, Triticum aestivum
  Clone ID: PAT_TA_29387
gttttccttgaacaacgttgcaagattgactactctacttgtgatcgtgaagtccttcttatctctttgagattaattttatccgaatactcccttgaaaatgcattcactgatgaagaattgaacaccctttgcacaacttggttcaagcttcaacctttccaagacagtacttccagtcttcaaaagattaagcaacttgatggtatgtttgctgtctctatctcatgcggattcaagctctgtactttaatgaaggtggcaagacatgctggacttaactggcacgctcaactcactggtgatgtgttcgctgcttgtattgctagagataactttactgatatcagaagcacttctactactgtcctttccaacgccgctatgctttgttgcttaaaggatcctagtgaactcgctgttgtttcttccaacccagaaatcctccaagctgctaagcaaaatggagccaagactgtattaattgatcgccaagaaagcattcctgctcaagacttcgatattcactttgatggtttagacatctttgctgaaagttatgaagcattcgttgaaactaaagccgttacaaaggtagaagctccagttactcgttcttggtttcaaagagtagtcgctactgtagctgacgctgctgaaacagttactaacgctgttatcggctaaagaaaaacatgtacactgttatccatttcat

SEQ ID NO: 29388 - DNA, 678 bp, Triticum aestivum
  unsure (1)..(678): unsure at all n locations
  Clone ID: PAT_TA_29388
cgactatggaaggcgcatggctcgagcatctacatccgactatggaaggcgcatggctcgagcatctacatggctcttgagagcggaagcagggtcgggatgaaccgcaaagctgagcgcttcagctttgcggtgcctctcctgacctcccaggtggtcgcctgaggtacgcaagaatcggcaagtcacaaaacggcaatggtgaactccggcaggagtccaccccccttttatccttttctctccattcagttgtatcaggtggaagtcgaataatcggaagtctctgtgtgtgatgaatcaatggatgcttcaagtccatgttttgtttttctcttcctttattatgtgtactctggaaacactactataaatggctgatgttcatctagcaaaaccactttatggtgtccaggttgtttccattggctcctcttgacccgatttggtggttgtaggggctgccacgaaaaggaaacataggttggataaaaaaaaaatatttgggcggttacgcgcgctcacgggcgtcgtttaaaagtctgacnggaaaacctgcgttaccaactaancccttgagaaatccctttccactgngtatacaaaggcncacgttgcctccaaattccactaangaatggaccccntcggcatacccggggttggtaccactacgta

SEQ ID NO: 29389 - DNA, 558 bp, Triticum aestivum
  unsure (1)..(558): unsure at all n locations
  Clone ID: PAT_TA_29389
gnaaaaccacccagtccctcctcggcctttccgattcttgatcgccctttgccctagctacctctcccagatgagataaccgatctcggtaatggtatccgcccctcccattcgatcatcatcaggttggcattcgtccagctgcagctgcaatacgatccaggaggaggaggaggagagggggctgcgatggtgaaggacaccgcgtactacgacaccttgggggtcagcaccgacgcccccgccgccgagatcaagaaggcgtattacctcaaggccaagctggttcacccggataagaatcccgggaaccctgatgccgcgcgcaagtttcaggaattaggtgaggcctatcaagtcctaagtgatcctgcgaaaagggaatcttatgataagcatggaaaagaaggtctatctcaggataacatgattgatccaactgctgtctttgggatgctttttgggagcgactattttgaagattatgttggtcagcttgcactggcatccgtggcttctgtggagagtgaggaagattcggatactcccgaggccagg

SEQ ID NO: 29390 - DNA, 855 bp, Triticum aestivum
  unsure (1)..(855): unsure at all n locations
  Clone ID: PAT_TA_29390
attcggcacgaggggatcttcaagcctatgtgtacctcggtgcctccggcccctccggccgctcgtgccgggttcggcgcgtgatagcgtcagcggagcgtgtcggatgatgcgcaagaaacgttcgggcggcggaatggacgcgacggtggacgagctgagcgcggcgtataaggagttcgtggcggctgcggtggccgtgatggaagctcgcgagcagtcgggcggccagaagacggcagccacggacgcggcgcttgaagccttcaagcagcgatgggagctcttccgcgtctcctgcgaccacgccgaggagctcgttgagtccatccgccagcgcataggctccgagtgtctcgtcgacgaggccacgggatcttcctcttcctcctccgcgcccgcaagcgtcgcgctggctgcccccggcatcaagccaatcagcgccgtccgcctcgagcagatgagcaaggccgtccgctggctcgttatcgagcttcagcacggcgccggagggccctcagctgcgggacctggcggtggcgtctcaaccccggctgccggcgccggagggcagcatgtgcacggcggggtcggatcgcgctttcccgaggatggcacccagtaggtactgttgttgcttattaagtagtagtatcatgtttcaaaaaataagacaaggaatttatgtgatatgtgtgttaagttttgagattggaaacattacagtttgttgtgctcagcatagtacctgatgcgtaaaggtgcgaaatatggggaaagaaccaccaaatgattggcattattgttgctagcttgtttccttggcggcttatattttttccgtgtncttagtgc

SEQ ID NO: 29391 - DNA, 742 bp, Triticum aestivum
  Clone ID: PAT_TA_29391
cggaactagattctagaatcgcagagtggaccctatcacataaagcatcatgggatttattaatatagcaatgaaggacattgacaggcagtactaactctccattcccgaaggcgtcaaggttaacatcaagtcccgtcaaattaccgttgcaaggtcctcgtggtgttcttaccaagaacttgcgccacttggctattgaaatcaccgttgttgacaagaagatccgtttcgttgtccaccacggtctccgtaagcacgttgcctgtatccgtaccgtccgctctttggttaacaacatgattgttggtgtcaccaagggtttccaatacaagatgcgttaagtatatgctcactttcccatcgacgttattatcaatgatcaaggaaacgccgtcgaaatcctaaacttcttgggtcaaaaggttgttttcaatgtccccttgcgtgaaggtgttaaggctttaagcctcccaaggctctaaaggattgaactcctccgtgactgagtaactcccttggaatgccgtttctacaatctgtctgcctgaaagtcacacaatcattgtccttgtctaagaaccaaggcatatcacgtaagttctttggagtgggatactatgtctcctcccacggaatgttttggaagacttaaattgtggcattccatgaagaggcaaaaagaaaaaaactcgctgtttactattaatgaaacagaaacaagagtatttccttattttgg

SEQ ID NO: 29392 - DNA, 411 bp, Triticum aestivum
  Clone ID: PAT_TA_29392
acggggcggatgatgccggtggccctgcgtggaggcgcagttggcttcctgctttcacgtcatcgttcctgaaggtcgatgattctccttgtatgttcttgtatggatgcttgctttccttctgtcttctgtttgcaatgctttgctcgtcgtgaagacgaacagtacaaataacgtgttaaaacgtgaagatgaaatcgaatagagggcaccggcgggaattgatccaccgccggtggttgaagaaaaaaaaaaaaaaaaaaaaaaaaaaaaaaaaaaaaaaaaacaaaaaaaaaaaaaaaaaaaaaaaaaaaaaaaaaaagaaaaaaaaagacgggaaaaaagaggagaaaaaaaaaaaaaaaggggggcccccaaagggttctaagttttatttcccggttaaggaaa

SEQ ID NO: 29393 - DNA, 515 bp, Triticum aestivum
  Clone ID: PAT_TA_29393
atacattgtttattggatacagtatgagatcattgatatactttaagtattttaatacaagaaaaaagatttacactgaaatgatgcttgatgattaaatatcaccaaaaaagtcctttaatacactatcgatgccatggataatcttctttttagtgttattttcagcaccattgttgattaacaaattgggagtatcagaaggaataccatccaagatgtctttagtagccgtactcaatatcttttcctttatcttttctgctgttgcatcttcttccaaacttagataataagcagcgagaccagcgacatgaggagcagccatggatgtaccagagattgtgtttgtggcataacgacttcctttccagatggacaatatgttgtaaccaggagcaaatacatccacacatttaccataatttgaaaagtacgcacgttcatcctttatggtcgatgcaccgactgtgatggctaattcggccgcagcaggtgaataatcacatgcgtca

SEQ ID NO: 29394 - DNA, 411 bp, Triticum aestivum
  Clone ID: PAT_TA_29394
gcctcaagtcgtacgagaatcccaagaacaaggtcaccgctgtgcctgcagatgaggaggaaatctgtggtgcaaccttcatggtggaagggtctaccgttgtcgcggcacttcagtaggagattctcccgtctccgtcgctgggcaaagcaggcaacgccgttcgtgtggtggtggtgtaatataatgcaacaaggcgcgtgtgctactctcttgtgtgatcttatgtgaactgttcggttgtgtatctgatcatctgtatctctagctgttcaaattctcgcagcggattcaagaccggccgtcttcagttggatgttacaattaatgtagtagcaaataagctttcttccttttccatctgaaaaaaaaaagaaaaaaaaaaaaaaaggggcggcgctctagaggatc

SEQ ID NO: 29395 - DNA, 626 bp, Triticum aestivum
  unsure (1)..(626): unsure at all n locations
  Clone ID: PAT_TA_29395
agactattgctctgaaccatataaaagtccaaatgtccatgctataaaataaagaatatgtgatgaacatgttaggcagcattccacatcaaaaattctgtttttatcatttacntactcgaggatgagcaggaattaagcttgcggatgctgatacgtctccaacatatctataattttgattcttccatgttgttatattatcattcttggatgttttatatcatttctagaaccaccagatccaatctagacaccatcatggaggggttcaccactttcattggtgcctctccgatgatgcgtgagtagttctttgtagaccttcgggtccatagttagtagctagatggcttcctctctctctctcttgattatcaatacaatggtctcttggagatccatataatgtaagtctttttgcgatgtgtttgttgggatccgatgaactttgagtttatgatcagatctatgtttttattcatgaaagttatttgaaacttctttgatcttttatatgcatgattgcttatagcctcgtatttcttctccgatatttgggttttgtttggccaacttgatctatttatcttgcaatgggaagatgtgctttgtantgggttcga

SEQ ID NO: 29396 - DNA, 610 bp, Triticum aestivum
  Clone ID: PAT_TA_29396
atcgcaggaaatcaataccaaacggagtccaaacgtagtgaaactttttgtggatttttttggaccaaaagacatccaatgggccgaagaagcacctgggggatgctccaaggggagcacaacccaccagggcgcgcctggaggcccaggcgcgccttggtgggttgtgcccacctcggatgccccccggactgcctctttactctataaataccccaatattccagaaaccataggggaatcgatgaaaatcacttccagcccagagtccagaaccaccagatccaatctagacaccatcacggaggggttcaccacctccattggtgcctctccgatgatgcgtgagtagttctttgtagaccttcgggtccgtagttagtagctagatggcttcatctctctctctcttgagtctcaatacaatggtctcttggagatccatatgatgtaactctttttgcggtgtgtttgttgggatcttatgtgaactgttcggttgtgtttctgatcatctgtatctcttagctgttcaaattctcgcaaaatataagctcaacaaaaatgtcaccaagattgaattcacaggccgtccatttacaaaagcaaa

SEQ ID NO: 29397 - DNA, 942 bp, Triticum aestivum
  Clone ID: PAT_TA_29397
atcaggcaaacatgtagctttatttagacaagtgcctcattcaggaacatctgttcattatttccatgttgcaattagtactaggcacacatgatgatgcatgacattttattttgccactgctatattgatcaactagcaggtaccatcggtatagctagctgtcatggtaatgctatagggggtggtggtggtggctgggcattgtacagggatgtagattttgcacatcgacggtagggtgtgaagtgacatcctcaggccctcaagttgtacttcctgttgtggttggtgatgttgttgttgcctgatagactctaccacattatgaatggcttggcagcggaattgctctgggatctgtgctagctgccggcagcattgggactgcacgttctggcagctggtgggcttctgcactggtgtatgcgggaatggcactgtcattggcctacattgatgttgtaggaatgtcgcacacggttttaactgctcctgcaactgttgttgttgttgtcgccccagttgttgctgttgctggcattgtaccgggacgtagatgttgcacatagacggcagggtctgaagcgacatcctcatgctcttaaggtgtgcttcctgttggggctcattccattgttgttggggctgttgttgaatgatagcctcttccacgctctgtatggccttgcaccgggcttgttctgggatctgcactagctgccgacagcattggtgttgcacggtttggcaactgctatgctgctctccccgtgtttgggggaatggtgttctcactgggctacactgatgttgtacgaaagccacacatggcttcatctgatccagcaactgttgttgccctagttgttggtggtgttggcattgtccgaagccctggctacatatggtttccaattgggcaatggcggtggatgctgc

SEQ ID NO: 29398 - DNA, 1403 bp, Triticum aestivum
  Clone ID: PAT_TA_29398
gccggcctccatcagacccctgccggcaataggacggaggaaaggacgaccagtaacaacagccacaatcagcaactgtacctgtaataccttacctagtctgggtgtagttggtttgagcctggtgtgttgggggtgtggagcggcgaggtggtgggggtgccggcggaggggggcgggcccgggcgcctggacgccgtcgcccaagacgcgggcgtcggtagctgcgtgaacgcgcgtcctcagccggacgccgacccggccgtgtccgtgtggctgggcatcgcctagggcaaccacgcctactcccaccgccaaccagtcgctcctcctcccaaggtcgttccgctgcatatgatgagatcttctgggtgttcgaagggagtccttgacaacttggggcggttcagccaagcagtactggcctctccaaggggcggcaacgaggtgctcctcgtgatcgaggcctacaagacgctgagggacagagccccctatcccgccacgcttcatgctctcccagctcaccggcagctatgcctttcgtgctcttcgcacaagtccacctcctccctcctcgtcggcatccgggcccctgagggcaaaggtgctaactgcttctggggaatcacccgcttgacggctcccgtacgcctttctccggacatcttgggaccttgttacaggggacttttggcggcaagtcactggcgccgtttcccgtcaaggttggcttctaccttggaaagcctctttagggaggcctcaagttcggtgcggagaatcccaagaacatggtcaccgctgggcctgcagtgaggaggaaatgcgtggtgtacctttcatgtggaaggatctaccgttggtcgcggccttcttcatgggaggagatctcccgtctcccgtcgccgggcaaaagcaggcagcgacgggtttttcgtgtattggttggcttcgtgtaatatagtttggcaaaagtcggtgtgctcaactgggctactcttgatgttttatggaactcgcatatggttgtgtctcgagccagcaactgttgttcctctagttgttctagtttgtcattgtccggagctctgtctcatatggtttgccattcagcattggcggtgtatgcatcaaggggtaggaaagcaacgaagaaaattctcttttttgttggcaaaattaaaagtaggtttaaataagctttcttccttttccatctaaaaaaaaactttctcgatctctgttgttatgcgtgtaccatggggctaaggaaatgtaggtttttttttagcaaaaaaaaaaatgtacctccggcctctgcatccggaaacgatgcatgcagccctatttttaattattcacaaagaccataaaaaaaaaaaaaaaaaaaactcgagggg

SEQ ID NO: 29399 - DNA, 597 bp, Triticum aestivum
  Clone ID: PAT_TA_29399
ctctatagtcgttgccgtgctactgttgtttgtccaacaagagcagttgccacttcatttcctgtggtttccaaatcgattgtcacctactcctattaactaagctgtgcgttgccttgccaggtcactctgtccgggctgctcaacatggtggacggcctctggtccagcagcggccatgagcggatcctcatcttcaccaccaaccacaaagaccggctagacccggcgctgctccggcctggccggatggacatgcacgtccacatgggctactgcggcttcgtcgccttcagggagctcgcggccaactaccacggcatccaagaccaccggctcttcccggagatcgaggcgcttctgcgggaggtgggaggtggcaccggcggaggtcgccgagaggctgcttatgaccgacgatgccgatgcccgctgtcgagatggccgcgaagctgctgagagacaggaaggcggggaccgggggaagatggcgggtacatcaagcagaacctgcacgtagggcctaagcgcccgcgtcggcccccggctgcaagacaggcggtgcttgacagggaatttggggggggtcctcacgac

SEQ ID NO: 29400 - DNA, 1312 bp, Triticum aestivum
  unsure (1)..(1312): unsure at all n locations
  Clone ID: PAT_TA_29400
gcacgaggagcagcaagccaaccaactcctcgccggatcacgggcattttccctccaaaaagcttcctctcctcctttttccccttttccccaacgctcttatctcctccctcgtccatccaaccaagctagcaatctctctctctctctctctctcatcctccccgcggcgtgcgtttctttctttcttggctagctcctcgatcaaggtgttcgcgcgcaggcgtgcgggtcgatgcgcatggagggtggaggcgccggggcaggaggaggaggccacggcggcggccatggcctcggcggcgaggcgcagatcaagggcacgctcacccacggcggcaggtacgtgcagtacaacgtctacggcaacctctttgaggtctctgctaagtacgtcccgcccatccgacctgtcggccgcggcgcctgcggcatcatctgtgctgctgtaaatgcacagactcgtgaggaggtcgctatcaagaagattggtaatgcgtttgacaaccagatcgatgccaaacgcactttgcgagaagtaaagctgcttcgccacatgaatcatgagaatgtgatttcaataaaggacatcatacgcccaccaaggcgggagaacttcaacgatgtttacattgtctacgaactgatggacactgatctcccacaccttctaagatcaaaccagccactcacagatgatcactgtcagtattttctctaccaagtgctccgaggattgaagtatgtgcattcagcaaaggtcttgcaccgggacctcaggccgagcaacctgctgctcaatgccaagtgtgaactcaagattggagattttggcttggctaggaccaccactgagactgacttcatgatggagtatgttgttactcggtggtacagggcgccggagctcctgctcaactgctcggagtatactgcagcaattgatatctggtcagtgggttgcatcctcggtgagattgctatgagggaaccactgtttcctggaaaagattatgttcatcagctgaggctaattactgaggtatggccactcactactacacgagtcaagattttgttttttcccttctgttctttttcttcttttggatattctcctgctctctttttcctcggagtctgacactatgattgcagttctgatttagcataggttccaactgcaatgattttcaagcttagatccctggattacaaccaattagnaaggtacacacataggtggagctaactggnancggtgnaaagaaatcatgcatagcctcaatcagccaatgttggccagcatgga

SEQ ID NO: 29401 - DNA, 1759 bp, Triticum aestivum
  unsure (1)..(1759): unsure at all n locations
  Clone ID: PAT_TA_29401
gagcatttggccatgcattctaatggcttctccggcttcttgccaccgtctctttcatcactatcttctctccgtgagctcaacctccgaaacaactccatgtccggtccgattgctcgtgttagcttctccgacatgccacttcttgcctcgcttgacttttccacaaactccctgactgggtggatcccgactagcctcgccggctgcggtgagctcaagtcgctcaaccttgccaacaacatattggtcagcaccatcccgtcgtggattggtgagtttgacaacctttggtacttgattctctcaaataattcatttgtcggcgaggtacccaaaagtttgttacggctcaaaggcctcgccaccgcgggccgctcatcgggtatggttttcattaacatgccctctttcgtaaatcacgaaagaagagcactcgatgaacaaccaaataccataactgggaccaacaacactgtcagatctgggcgcaacaacaccatgtctgggaacgacaacattgtcatgtccggagacagcaacactgtgtccgggagcttcaacaccctcgtatgtggaaacaacaatattctaagtggtgaccaccatgttgtatctgggagcaaccatattgtaactaacagtttcaataaagtgactgggtgcaccaataacgtatctgggagcaaccatactgtatccgggagcaacaataccgtaactgggagcagcaatacggtatctgggaacaaccatgtcgtgtctgggagcaacagagtcgtaaccggagattaatgacctgttagtggactgatttcatctacaagtatgaggtcccaaagcacatctaagggcgacccgtgaagagaagaataagaggttctccggtcttgaactcgaaaaccaaggtcgatggatcccgtaccttgttccagttttggggaggctccataaagactttgtgtatcattactgtttaaatcccaattcattttccgcacccatattagtatgtatttccgtaatggtatcactagtgttatcttcaagcctatcatgagaattagtataaccaattctgaactcgtcgacttaacaatgaagttcattgatacaccagattgttccagttgggccgacgcccctgcaagacctgggcgctccttctccctgtctgggtaccacgtctctgtctccgctgccgtttgcgttgctgtgtccgggcgcttcaacaccctcgtatgtggaaacaacaatattctaagtggtgaccaccatgttgtatctgggagcaaccatattgtaactaacagtttcaataaagtgacgggctgcaccaataatgtatccgggagcaaccatactgtatccggaagcaacaataccgtaactgggagcagcaatacggtatctgggaacaaccatgtcgtgtctgggagcaacagagtcgtaaccggagattaatgacctgtcagtggactgatttcatctacaagctaagtatgaggttccaaagcacatcaaagagagatccatgaagagaagaataagaggttctccggtctgaactgaaaatctaggtcgatggataccctagcttgttccaagtttggcgaggctccataaagaccttctgtatctttactgtttttagcctatttaaatttccgcaaccatattagtatgtatttccgtacttgtaatattagtgttatcttcaagcctgccatagaattagtatatccaananaactcatcg

SEQ ID NO: 29402 - DNA, 842 bp, Triticum aestivum
  Clone ID: PAT_TA_29402
attaaaaaaaaaaagcgtgggaagggccggtgtggataccacaccattgacgcggcaagtcggcagaaactcatcaaaagcgcacaagctcgagccagaacacgagcccacgatggccggcattcgccgcgcccccgcgctcctcctgctgctcgccctcgcgtgcacccccgccctggccgcgcgcgacgtctccagcagcgccgccaaggcgaagaccaagtacccctcgggcccggcgcccggcaagaagccggccaagccgtacgtgccaccagccaccaagccccccgggtcgggcgccgtcgacggaggcgggatgcccgccatccccggcttcggcaccatccccgggttcaccgtgcccgggatggggggcgggtggggcgggggctacggcgggcccgacggcgggtactcgcgcggcggcgtggcggcctccaccaccgtctgctccgagaagggcccctgctacaagaagaagctgacgtgccccaagaagtgcttctcctcctacagcggcgccggcaaggggtacggcggcggcggcggcgggggcggctgcaccgtcgactgcaagaccaagtgcatcgcctactgctgagtgctgatcgatcgtacgtacgtacggggagctcggcggctccttggcttccatggtcatcgatggcgccggtgagcaccacattatacgtagctatcttgcgtgatacgcagaggaggcgcatacggctgtatgtttcctccccgatgtcgttctagtcggctgtaatatcgtcgcctcatgggtgtcagaattgctatgaactatgaagtgtatgagcaaataaacatagagatat

SEQ ID NO: 29403 - DNA, 875 bp, Triticum aestivum
  Clone ID: PAT_TA_29403
gtgcgggccggccggcggcggggacataccataccatcgacgcggcaagtcggccggcagcaccccatcaaaagcacacaacctcgagccggaacacgagcccacgatggccggcgttcgccgcgccgctgcgctcctcctgctgctcggcctcgcgtgcacccccgccctggccgcgcgtgacgccgcccaggcgaagcccaagcacccctcgggcccggcggccggcaagaagccggccaagccgtacgtgccgccggccaccaagcccccggggtcgggcggcgtcggcggcggaggcgggatgccgaacatcccgggcatcggcaccatcccggggttcaccgtgcccgggatggggggcgggtggggcgggggctacggcgggcccgacggcgggtactcgcgcggcggcgtggtggcctccaccaccgtctgctccgagaagggcccctgctacaagaagaagctgacgtgccccaagaagtgcttctcctcatacagcggctccggcaaggggtacggcggcggcggcggcgggggcggctgcaccgtcgactgcaagaccaagtgcatcgcctactgctgaatgccgatcgatcgtacgtacgtacggggagctcggcggctccttggcttccatggtcatcgatggcgccggtgagcaccgcattatacatagctagcatgcgtgatatgcagaggaggcgtgcatacgactatgtgaacgtatgtttcttccccgatgaaatttattcaactgtcgtctcgtcgcctcctgggtgtcaaaatcgctatgaactatgaacaaataagcagagagatatgcctgacatggtactctcgaaaaaaaaaaaaaaaggccccaaggccgc

SEQ ID NO: 29404 - DNA, 1497 bp, Triticum aestivum
  unsure (1)..(1497): unsure at all n locations
  Clone ID: PAT_TA_29404
ttttttttttttatcntgaaaacgtagtatantgttttttgggcagcccctctccagggctaccacgagtccatacagcatgcaacagacagatccaggtgccttatctccatccaggctgtattacaagcacagctgaggtgatattgtttcagcagcaaaagtaccttcggttcatgtcaaaatgtcaaaaccccactgaacgttattcatcattcgagcgaagagactcgagcgaaacagcgcctgatgataataactatgtacagatccccgcgacgcgatcgtcaccctgacctacaacgcgtacatcttcttgtactcggtgttgatcaggtccgggtccgagtcgaccggcatggaccatgaccgggactggctcgcggaggctttcctgatcttcctcatgctcttctcctccatcctgtgcgccacgatgcagtagcacatggagccgagggtggtgagcatgatcaccgcgccgatggccatggtgcaccaggccagccaccagtcgccgcggccgaccacgacgtaggtcagcgctatgaacgccgcggagatgaagaggcacgccagccacatgagcttgttcatcacgaagaccatcctccgcttggccttctgctccaccacgatcagcgacgtctggacgaccacgacggcgagcgagatgaagagcgccagcgagtcgaacaccaggaacattatgaaggccggttcgctggccacgtacgcctgccccagcgacatgccggggggcgcctggctcatgtcctccacgaagttgccgggcacggtgaatatggcagcgaaggcgacggtggcgatgagcaccgccaccacggtgttggagttgatggcgttgttcaggccgccgatgtggagcttctccagcctgctcttgatcttctggacctgcatcttggtctgccgtgtctgcttgatctgggactggacgtcgtgcctgatatcactcacggtttgcttcagctgctttgccgggtttgcaggatgcactggctcttttgcagttacgacgccgccggcgtctctcagaatgttgacgagttcttggttgttcatcttctcagcaatggcaagagcagtctctccagacctgttaactgcattgacatcaatcccctcaactgacagtagagtctgcactataacgatattgcccttccgagtcgcaacatgcagtggcctgttccccttgttatcttctagatggctaactgagaaatcaggcttcaacaactcaaccacaatttcagcattcgttcctttggacgccatatgcagcgccgtctgccccttcttgtctgttcttaaaccaatccctggatccttatttaacaaggatcttacaacttccacatggcccatcctcgccgcggaatgcaaaactgttttcccattatttctcgcaattttggcaaggctagcatcagtttccagtaggaggttgacaatatcaatgtgaccccccgc

SEQ ID NO: 29405 - DNA, 1108 bp, Triticum aestivum
  unsure (1)..(1108): unsure at all n locations
  Clone ID: PAT_TA_29405
cttcttctcctctgctttgcttcgctgccaagccatcctcggatcgcttctctcctctcctctcctctcgccggcgacgactctccgttcttcaccccgcgcaggaagaagaaggagaaagaaagaaagaaaatggcggacagcggcggcggcagcgactgggaggtggtgtcgctcacggcctccacctacgccgccgcgccgggaccaatccaagtctcgcccctcctccacgccgcccacaaaacagcagagtcgcctcttcttctcctcccaaatcctcctgctccccctgcacatttcttcatgtcccagcacttcaatctgccaccgctttttactagtacccatcctgggaataataagggaggccaagaattacaagaatccggccctgccgtgccggacggtgatgcttccgatgatgccgacggtctcaacatgcccatcagcccagaaaactactgccacagcgagagcgagagggaggatgtgctgcttcttgctagtcccgccggcaatggccttggcctgcaggtggaaggaggaggtgatcaactgcagccaaccaccacgccctgctctcttcctgacgttgctgcaggttcagatgctgctgctcctgctcctgcttccggcggagtcgctggcaatgctgctcangctcagaagataggttgcgcggcaactgagccacttggtcaggcgaaggtcagcatgcttggtggaggaggccctgtttctcagcaaggggtaaattaactaaacaaagctgcgtagaaacatgctacggctaatgataataatagcgaaaaacctagcatggtagctaagtaacaagttgatgatgacttggatcgataatgatacaaaaaagggtgtggtgaatactttctccttcctctgatccatgtaagtggagtggtattccttaattagtagctaggcaatggagtaatgaacatgtgtggatgggtgaccagtggtgctggttaattccatcttgctaactagtgtgagtgtggtgcttgtaaaataaagtgttgtgtttaagcaagcagagactgatatttcttgttaaaaaatgattaaccagagcccgactgat

SEQ ID NO: 29406 - DNA, 1600 bp, Triticum aestivum
  Clone ID: PAT_TA_29406
actagttcaattgaggtctgcaggcaatgcggctccaggctcccctccgctccccccgccgccctcgccccgccgctctgccccccgcgcgggctctagaacgagatcggaaggtggaaattgccgcacagcggcggcgccgccgactgcgggggggtctcgctctcggcgcgcacaaaccaccaagcaccccgcccaccccaacccctgccccccctccccgccccccccaaaccacttgagcccccccccgtcctccttcgctgccaacccgtccatcgcttctctccttcctctcgccggcgacgactctccgctacccgcaggtaagaaggagagagaaagaaaatggcggacagcggcggcagcgactgggaggtggtgtcgctcacggcctccacctacgccgccgccccaggaccaatctcgcccatccacgacaccgctgacaaagcagagtcgcctcttcttctcctcccaaatcctcccgctccccctgcacatttcttcatgtcccagcacttcaatctgccaccgcttttcggtacccatcttgagaataatagcggaggccaagaattagaatccgaccctgccatggcggacggcgatgccgaccatctcaacatgcccatctgcccagaaaactaccgcgacagcgggagggatgatctgcaggtggaaggaggaggaggagaggaactgcagcgaaccaccatgctctgctcccttgctgacgctactgcaggtgcagatgctgctgctgatgccactgctgctaccctgcctgctcctgctcctgccgccacgcagacggtggctgctccttccggcggagtcgtccctcgcaaaagttgcaatgccgctcaggctcaggctcaggctcaggctcaggctcaggcgtggtgggagaagaccttctccttcccgcgtcaaggtgggaatgggaatgggaatggcggcacacagcccctcctcgccttccgcttcgtcttcgtcgccggcaaactgcagcttcaggaacaagaccacctcagcactgtccctgaattcgtcggcgtccacggccaaacccagaagataagctgcgtggtgactgagccacttggtcaggtgaaaggcagcatgcttggtggaggaagccctgttgctcagcaggggtaaattaactacacaggctgcatagcatgctgctgctgatgatgatgatgatggcgaacaaattagtactagtatggtagctaagaagttgatgatgacttggatcgatgatgatgacgaaaatggtgtggtgaatactttctacttactctgatccatgtaagtggagtggtattacttaattagtagctaggcaatggagtatgaacatgtatgtatgggtgagcagtggtactcgttaattccatcttgctagctagtatgagtgtggtgcttgaaaaaaatatatttcttgttagaaaatcagaggcggatcttgctgccctggagagctcatcccgtgcccgacggtttttacacacttgttttcgtgagcaacattgttttctctctagcgctcttcctctgagacaatccacactattctcctgtaaaaaag

SEQ ID NO: 29407 - DNA, 731 bp, Triticum aestivum
  unsure (1)..(731): unsure at all n locations
  Clone ID: PAT_TA_29407
ggttagtgagatgggatcactcccgcagccccgccccaccctcacactcaccatcgacgacccccgccgccatcgcacaccatagcgccatcccctcaccctagccccaggtcaggcangtgcgaggccgcccgcccaggcccgcgatggccgtctgggtcatcgccttcgaggacgacgagtacgccgacccggcagtcatcatcgcctccgagacggacgcgtgttggcggcacatggggcccacatcatcatggccgtgcgcaacctcgccgcggcagaggccgtgcgccaggtcgtccttgccgagacccccgtcgccagcctcaacctgatagagctggacctctccccactgacctccatccgcaacttcgccgccaacttcgccgacaggggcctaccgctgaacatcctcatgacaattcaacatacccctgccctttcggagagggaaggtttcccactcatggacacctagctgaatgcctgaacctgaacctcgcttttcttcttcttcttcttcctccccttcttcttcctcctccctccctccttccgtctgggcccgctggttgattgcctgccccggcgaattgccgtccttgttttgggggccttcctgncaagttcatcctttagtgctagtactagtggtacatcagtttgatttaggaaaaacaccagcctctgcttaacattaaatctagtcaagcaattnatgcacaaca

SEQ ID NO: 29408 - DNA, 818 bp, Triticum aestivum
  Clone ID: PAT_TA_29408
ttttatagtggtacacataacattttatttggatacaaatatttatgtcttgaagttattaaactctagatcgagagctaatagatcaagctgcctagctggcagcatatgtatattttatgtagttactccgacgggacaatgcatgatggacggcgattgagagctgctgctagctagtagcatggcatggcacgaccttggcacggagtgggcgcttcatgactatggtgagctccagcgtctcagtgaagtccaccggctcgccgggcacctcgctccactggaacgccctcaccatggtggccacaaggaggttgacgtgcagtagcgaaacatcgatgccagggcacatccggcggccggcgccgaacggcatcattttgatctccttgctccccgtgaggcccaggttctccccctcgccgccggcgccgaacggcatcattttgatctccttgctccccgtgaggtccaggttctccccctcgccctcgggcaggaaccgctccggccggaactgtgtggggtccggccacacctttttgtcgatgaacatgtcgcccagcgtgaagttcactgacaccgccttgggcacgaggaagccgtctagcaccgtgccgttctcaccggcagccgcgtgtggcaggatgaagcgtggcaggtgctcctcctcccggacttcgccgtcggcgacgcggtttatttcgaggtgctcctcctcccggaatgtcctgtcggcgacgctgtttatttcggcccggagcttcgcctggatgtccggccgtgtgacgaggttcgccatggcccactgcaac

SEQ ID NO: 29409 - DNA, 804 bp, Triticum aestivum
  Clone ID: PAT_TA_29409
aaaagcctgacgcaagcaccgaagtggcaggcaggtggcgacatttatctgaatccaaaatatgcaacaccggttccatgttccaagtcactgcgccaggtgacacagttgagcaacgagtgccagtttgacagacacatacaccgggcgggcacacgaacagatcgagaatattacaaacaagactgactccagcgatccgtgcgccgtcttacattacatggcatacctttgcgtccaggtcctggcggtgctctcatacttgtgccggtccgtcttgtacatgtgagcgatctcaggaaccagaggatcgtcagggtttgggtcacacagcagggagcagatggacagcagcaccttggaaatggtcagagcggggctccattggtccttgaggatgtccagacaaatgctcccgttgctgttgatgtttggatggaacaccttggtgcggaatgccacctttggtggtttgaaaggataatcaggagggaagtggatagtaactaggaaaactccaccggaatatgggctgtcagatgggcccattattgttgcctgccaatggaacatatcttcacccacagggcctgcgctgcatgaggtggggggatccttctgcagatccttgagctccttctgtatcctcttggacgccatcgcgccctccctcgccctcctctggcctgatctcctctctgcctcctgcttccgcttctccgcccccctcctcgcaagaaccaataatgggatggaactggggaaaggggccaggagcagcagggctatatatgtaaatgggcc

SEQ ID NO: 29410 - DNA, 993 bp, Triticum aestivum
  Clone ID: PAT_TA_29410
ttattttttgtgattgcaggggtattttctttaagtggcaggcaggtggctacatttatctgaatccaaatatgcaacaccggaaaccatatcgcaagcaccgacgctcggaggcaggtggcgacatttatctgtaacccaaaatatgcaacaccaagttaccatgttccaagtcactgcgccaggtgaaacatttgagcaacgagtgccagtttgacagacacacacacgtgccgggtacacacgaacagatcgagaatgtgacaacagggacttcggcgacctcttccgccgtcttgcattacatggcaaaccgtgggctatctaagtcctcagcggttctccttcgtatcttgtgccagggccgtgttggtaattgtgggcgacctcatggaaccgatgagggagtgattccggggttccgtcaggaagccagggagcagtgttggccagcaggcacgatgtggaaaatagtcaacagtcgggggatcttccaatcggtgccgctttgaggtattttaccaggcaaaatgctaatcctctcgctggttgatgttttggatggaacaccttggtgggggaatgccacctttggtggttttgaaaggaaaaaacgagggagggaaatggatagtaacgtaaggaaaactccaacctaggaatatgggctggtcagttggtcccattattcttgcctgcctagtggcacatatcttgccccacaggacctgcatctgcatgaggtggggggatccttctgcagatccttgagctccttctgtatcctcttggacgccatcgcgccctccctcgccgccctctgtgcttgaagggctggctgatctcctctccgcctcctgcttccgtttctccgccccctcctcgcaagaaccaataatgggagcgacctggcgaaaggggccaggagcagcagggctggatctgtattagtgctccttacccgtgcgatcacaggtctgccccgcgccgaat

SEQ ID NO: 29411 - DNA, 893 bp, Triticum aestivum
  unsure (1)..(893): unsure at all n locations
  Clone ID: PAT_TA_29411
ccgccagcacctcaggggcagcaagcccgcaccccttttttttttttttttttgttctgggaaatgcatacactgataaatgcacatacctctttggccgaaaaccaaaaggcacatgtttcttcacattcataccatcacgcacgcacaaaaggtaacaaagtataccgttatcaattgacaaattgcttctgaagaacgacgagaaaatgtggctgtgagatttattgcatgcaccacagccttatgattaaccctagactgaacgcagaccatggacaacagttcgagggccatttgccgccagtcgaaaaatgcaaccggccaccctaggcactagctagctagctgctaagtacctggaaatcggcaccgattggcaagtgatcactaggatggtggaagttgggcaggcctccttccacatccggggaaccccctcgcgggatccgaagtaggctactaggttttattgaaccgccgtctgacaagaatatgtagtccagcgttccagtaaaacctggagtgcaatttgtgaactccggctcccctccgttctcagcatacaggctgcgcaatttgaccagggcttcgtccgtagattcggcgctagctgataaaaggtaattgtataccttatcaccaggggtggagttaaaatcaccagcaatgatcacagaaggtttacaggtgaacttatttgcgataattttctcaaactcagagacttttgaaagaagatactttgcctccaacgtgtccgtcccatctcccctcttcaattccttgccaagcatatccaatgaggttgatgaaagctccacanctcatgggaattctttttcccgctaangatctcgagaactaaaacacnaaagctgaattacatccga

SEQ ID NO: 29412 - DNA, 614 bp, Triticum aestivum
  Clone ID: PAT_TA_29412
gatgccgggtgatggttgataaggctcaatcggtattgcaagcatgtgatattcgtccactccctttgactgttcatcggcccaccttgaaagaagcgaaacgcgtatacaataacctaacacagctctattatgagacggaatgctctattatgggtgaagtattaccccttgtggaaaatgtgacaaagtttgagcaaagtacagaagcaagggaagaaataagtgtggcccctgaggaacctattttggactcatcgagttcgcatgaagcaatggccataccatctaataatgcaacaacacctctccatgaagctgcaaaggctggcaatgttgaacaaactatggaattgctcgagcagggtttggatccttgtatcaaagatgaaagaggaaagacaccttacctgctggcttcagacaaagaagtcagaaatacgttcagaagattcatggcgctcaaccttgacaaatgggattggcatgctgctgaggtgcctagtgcattaacaaaggaaatggaagaatcacaagctgcaaaacaggcagagaaggatgccaagaagaaagccagagcaaaggaactgaagaaacaaaagaaggctagagag

SEQ ID NO: 29413 - DNA, 709 bp, Triticum aestivum
  Clone ID: PAT_TA_29413
aattctcctttccttccggagaaaaattcggacataaatattcttttccacggcaataggacaataaatcttcgacgatacaggtacgatgtcaacaccaaaactatatcttcagggtactgttacaagcttacttacagcatctcgtttacaaacagcgcaagttcttctgattcccgatgaccaatctaagaactctacgagtgaaatttccagacgcggatgtagttttcaccgtgcgtggtcacgatcttcttcatgccgaccgacagaccggtgattggtgggcgcaggtgcataggaatgttgtccagccgggcatccggagcaatttcacggaccctcttcttttcgacttgctgcctggggccagattccgctgggcggacattcttctgttcagcttgtggcctggagctggactgtgctgggtagcctgcatccatgatgaagcttcgaatagtctcaccggttctctggcataccaggcgtaggactccatcaataccaccgagcaccagcatcgaagtgtcaccaggcaaatgatgtgcactgtagatgacatttgggctaactcttgtttcccagagaggcctcagggtccttaagtcccagcaatgtgcataaccagaagatgagcccgcgaatattaagtgtgaatttgcactgaaagacaagcatcttatcactgttggtgcaaaagctgact

SEQ ID NO: 29414 - DNA, 409 bp, Triticum aestivum
  Clone ID: PAT_TA_29414
cacaaatggctatcgttaaggctttcgaacttcgtaacaagaacaaggctgaactcttgaaggttcttgatgaacaaaagcaagcccttgctaacctccgcgtccaaaaggttgctggtggtaagagccaagaagttggtgaagctcgtaagaacgttgctcgtgtcttgactgttatcaaccaaactcaacgtgaacaacttgctctcttctatcacaagaagaagtacgttcctttggatctccgtgttaagaagacccgtgctatgcgtagagctttgactcctttcgaaaagtccaagaagaccctccgtcaacaaaagaaggaagctcacttccctcttcgcaagtacgccgttaaggcttaaatatgactttgaaataaaaatagcttgaagtttttattctt

SEQ ID NO: 29415 - DNA, 723 bp, Triticum aestivum
  Clone ID: PAT_TA_29415
cggccgctcgaggcggcgggcgggatgatagtttggcattaaccctttccccgtccatgtagagaaagggcgacttttgggcgacgccgggcgatccacctcgccgctgccagatcggcgggttcctcaccctccggcggctgctctggcagcgggaggatggggaggccccgatctgcggcgtgtatatagcgtaggttcgatttggcagctagccggcggcgttggggagtgggcggcgcggccggagtggcgttttgcgacggaggtcttcctctccggcggtggaggtccgaggagctccgctgccgatcttccgtcttccccgtgctcggggctcggtggagctgctgggtgcacttttccctcgccggagtccgcgggacggcggatccgggatctcgaaattctgaatcgagctggtggtgcggtgcagggcgttggctttgacgatgcgggatggaggtcttccggggctgagcttcgtcgactttccgtccgcggagggtctgttccaaatccaaggcttgtgtggagcagcagcggcggcgcgccggcgatacgttttcgtcgtcgtcttcgtcaacggggcgctgggggcttcaatgtaattttttttgtcttaggacctttctgtaagaaccctgtgctaaatatcaacagttcttttcccgcaaaaaaaaaacctccctttcattcatcgtcggcttgattcggtacacc

SEQ ID NO: 29416 - DNA, 331 bp, Triticum aestivum
  Clone ID: PAT_TA_29416
gtcatccattacctctgttatctctcaaactgcccgtcgctcttgcaatctctcaaaaagaaccatggttcgcgcttattttgctacacctacggcaaccttctcaaaaattgatgtcaagcaaaagcaagaagaaatgcagcatcaatctcctgatacaactgttcatattcctcaagaagttgctgaatccgaggcttcctttagtcctattatcaatcacgtctttgacgattaattaaatggcctgatattttgtgtattcaattagcacttttcttttgtacatatttttataccaaataaaacaaggtatctctttacgcgtgtg

SEQ ID NO: 29417 - DNA, 553 bp, Triticum aestivum
  Clone ID: PAT_TA_29417
cccacgcgtccgagaagctgcagatgctgaagcgcgggatgcggctggtgatcgcgtcgctcggccccgccgaccggctctccgtcgtcgccttctccggcgccgccaagcggctcatgccgctgcggcggatgtcgcggcaggggcagcggtcggcgcggcagatcgtggaccgcctcgtggtgtgcgccgccgcgcaggggcaggagcaggcgcagagcgcgtgcgccggcgacgcgctgcgcaaggccaccaaggtcctcgaggaccgccgcgaccgcaaccccgtcgccaccgtcatgctcctctccgacacgcagcagcagcaggacgcgaggaagcacggcgatcaccaccactccctgcgccgcccgcaggcggctccggcggcggccacgcggttcacccacgtggagatccccattgccgggccggccgacaacgcgccggcgcggtcgccgctcgcgcccaaggaggagcacctggagtcgagcgcccccgcggagcacgccttcgcgaaatgcctgggcggcctcgtgagcgtggtcatgca

SEQ ID NO: 29418 - DNA, 1313 bp, Triticum aestivum
  unsure (1)..(1313): unsure at all n locations
  Clone ID: PAT_TA_29418
ctggtggttcatccccgtcaacgtgctcatcgccaccgccgtcggctgcgcgctcggctacgccgtcgccctcgtctgccgcccgccgccgcgcttcttccgcttcaccgtcatcatgacgggcttcggcaacacgggcaacctccccatcgccatcatcggctccgtctgccacaccgccgaccaccccttcggccccggctgccaccgcgagggcatcgccttacgtctccttcgcgcagtgggtcgccgtcnctcctcgtctacaccnctcgtcttaccacatgatggagccctcccatgcaagtactacgagatcgtcggcgagggccacgagatcgaggaggagccgcagctcaagcaaacttcagccgccaccctgctccacgaggccgagtggcccgggatgcccgacaaggagacggagcatctccaagacgccattcatcgccaggatcttcgccagcatctcgggctcctcgcagaacaccttccccgacatcgatttcaccgaggagggggggatctccggcgccgggcctagcagcccaaagtcgctccggtgctttgcagagccgaaagtggtcaggaggatgagggttgtcgccgagaagactccgattcagcacgtccttcagccgccgaccatcgcctccttgctcgccatcatcatcggcatggtccccgtgctcaaggctttcgtgtttggggctgatgcgccgctctccttcttcaccgacagtttggagatcctggctgctgccgtggttccctcggtgatgttgattctcggaggcatgctcgcagaaggcccaaatgacaacgcactgggtatgcggactatcttcggtataaccgtcgcaaggctcctgatactcccctgcattggcatcggcatcgtgatgctagcagacaggttgcatctgctcgtcgagaacgaccacatgtaccggtttgtgctctcactgcaatactccacccccagtgccatcctgcttggagcaatcgcgagcctgaggggttacagcgttaaggaagcatccgcgctcctcttttggcagcacatctgtgcgggtgttctctctttccatctacctggtcgtatatttcaagctgttgtcgtacatctgaaagatgattgccggcctcgcaaaaccgggttatagcagtcatcatgggaggtgattcccaagaaaaggagtgcttgaatggattctcagccatgcctccttgttgttaagaagtgtattcataatttgctagtggtttgtaatttctgttacattgtattattcgagaacaggagatacttt

SEQ ID NO: 29419 - DNA, 107 bp, Triticum aestivum
  Clone ID: PAT_TA_29419
gtttgacatggtaatgggttgtgaaatcgtgcttgtctgactggtctgcttagtttcgtacaacattgtactaaaatcagcgacagtgctgcaaccattttttcccc

SEQ ID NO: 29420 - DNA, 297 bp, Triticum aestivum
  Clone ID: PAT_TA_29420
ggtcgacggggaggacgccgtggtgtcgccggtgaacaagtgaagccgacgtatccatcagcccatctcacgttcgggttcgtgtaatgcatgcatgcatgcacaaataattcgttcacgttcagggtctatgatctggactagtatttcacgtcgttgtttcgaaatatcccaatgattagtaaactccactacatctacattctattaccttttgattgcgcgattatagcccaaatgatgtttccacgagcacatatgatgctaattattcataaatacaatcctatttgcatg

SEQ ID NO: 29421 - DNA, 922 bp, Triticum aestivum
  unsure (1)..(922): unsure at all n locations
  Clone ID: PAT_TA_29421
gccgggccgcgcccgctctacgccaagcccgggccccgccgtcacgcgagggcacacgccttcgcgccccgcccgggcgggggccgctccgggcccccccgctccacgccgaccaagaacgccgcccccggctcagcccgccgcggccgccggcggacccggcggcggagctgtaccagagcccgcagttcctcgcggcggcgtcgcgggcggggagctcgaagccgggcggcgccttcttcccgccgaccaagagcgactgcgcgcgcagcctcttcggcggctactccgaccaccccaactacaggtccagcacggagtcgttccccgccaaggcgcggtcgcagagcgcgcccaagcagcggccgctgtacgataagtccgggtccctgcggaaggcgtcggcgcacgcgttcgcgccgggggcggcggcggggcagaggtcgtcggcgtcggcgtccctgcacgccaggttcaccaacaaggcctaccccggctccggcaggctggaccggctcggcatgcccgtcaagtactgaatcctgccgccatgtgagctttgttgagagcagggttcaggtcagtgtgcatgtccccgagaccccaacgagggcgaagtaaagtttgtagcggcagtttgtttaggtttgagcttcgcttttgtggtgtgctattaccgtcagaaagtgctttcctgttaatgaccgtgactggttaagtgtaagttgctactggtgttccctccaaaaaaaaaagtgtaagttgctagtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaangggggggggcgcgttcgaaattaaaacgacccctggg

SEQ ID NO: 29422 - DNA, 657 bp, Triticum aestivum
  unsure (1)..(657): unsure at all n locations
  Clone ID: PAT_TA_29422
acnaccccgntnttccaaggggncnttcntcggtngaaattgaggnanggtnggctttgtttaccnnttgaaggggtttctcagggtaatggtancccggttttccctcatcacttcttattgctttgggcccatttaaattttttggcggatttttgcaattccaaggatcctcagttaaccaggtgaatagacatgagtttcaaataaggatgaaatcaagcataaccagggaccgttattgacatgctagaacaacattacatttagggtagtctagctctggctatccaatctgagaacatcgcggaatcgcacaacgaatccgccgccctcctgccagacccgtacgcactaattaccaaccaagccgtcgcagaggtcggggagggaggacgagccgagggagcagggcaggtccgggtccagatccggggcggcggcggcggcggtcttgctcgcgagctccaccgcgcggtcaaggaggctgcgtggcaggaggtccgccggcggaggcagtcgctggtggcgctgcagccaccacgcgaccgcggccgcccttgccgcgcctccgctgatggcgctccccggcatcggatcgccttgcttgccccgacgccgcgagactccgagagggtggggaaagcgggccttgac

SEQ ID NO: 29423 - DNA, 886 bp, Triticum aestivum
  unsure (1)..(886): unsure at all n locations
  Clone ID: PAT_TA_29423
nnnnttggaccattcaaccacaagctcagattaagaatgaatcaagtcttataattactaaggaaaaaacatggagtaattaacaagaaggaaaggaaaggaaaaaaaaagcaatatcatggaggatcctagtatttcacttggctactcttttaacaacaacaatggcagcagcacctctagccgtccgtccaccgccgcactccggcagggtcttcttcttcttcacgtccgattcacaaaaccaaaccaaaaacaaaaacaacttcacgtgctcgttacagatcgaccgtcgaccgtcgccgtcgtcagaagcgcgcgttctcgaagccgtgcaggtcgctcacccggttcatggacttgcgcatgatggccaccttcgccagctgctccgccgcgcgccacgccgacgtcggcgtcagcggctcgccccctgctccccctccgccgcccgacgacgctcgtggcgtgcccgacggcgttgccgaccgggatgttggcgttggtggctgctgctggccgcgccgccaccgcatgtcgctcagctccgtgtccagcccgcccagcaggtcctgctgctgctgcgtcggcggggactgcagcaccagccgccgcgccgacgacagcaggtgcgtggccgtcgagaagtcgctcagctccgccagacgccgcgactccgccacggcgcgcgtcgccacgaacaggtcgtgcaggcgctgctgcgaggacgtggagctcccgccgccgccgccgtcgtggagcgggggcaggagcagcggctgctcggcgccgcgtaccgtctcctgcgacgccgggtcgcggtaggcgcaccggacggacagcgagtgcgggtgcgcgcccagcggcgcccgcagctccctcgtgc

SEQ ID NO: 29424 - DNA, 1397 bp, Triticum aestivum
  unsure (1)..(1397): unsure at all n locations
  Clone ID: PAT_TA_29424
ggcggcctgccgcaagctcccgacccccccccgcacccccccccccggcagcgcgccctcgtgaccgggtcggcggagagacgacaggagaagaagatggccggagggaagggaggagacaggaacaaggggggggcccgggccggcgaaggccggggcccgcgccccgtgccggccgcgcggggcgccccctcccgcagggcggcaacgcccgcccccccgggccgggcccccccgcccccctccccgccgccgccgcgcccctctacctcggcgccgcgcccgcgtgccgccccggcgacgccggaaaacaagcagacgcggacccccacgccccccgcgctgccccgcgtccccccgcgcgacgtgcgcgccggcctgcgccacggccgcccgctcgcccgcgagctcgccggccacaccaccgaccacgccgacctcccccccatcctccaccgcgacccggtccccgacgacgccccccaagaggacaagccgcccagccacacccacgacccaaggagccccccggcggcaaccgcccccaaagcatcaccgtcgccatcaatcattagtccaccaccgctgcaggcgaagtgggtttggtggtgctgtgtcttgtctgtaatggactagatgtgtagtagcttttttggtagtgagtagctgtctagtttggggtatatttttgtaacgcttttatcaaatgcgtacgagaaaaagaggaggtacggtttctcggattatgttgggaaatacctaactagaggtgactttttaagtgttttgatgaacggaccacagagggcggtacttaatgcataatttatcgatggaattcggagcggacgactataagttagaagacatatccctgcttctaaatgaaactaaaccaacattgcaaggttcagcatacatcaaccaacagccgtggtgggttaaggggaaattttccttcgaggaaagctgatagtgaagacttgttttctaggggaaagctggaagtgaggatttcataccggtggcaatatccgtatactgcgtagtgttaactataattcacaaagaaatcaaaaattggcatacatttttgttttcccccaagaattaaaacagtgatgttgcgcactgatagctattgtttctgggagacgatgatgcactgattgtaatgataaatcgatcgatagaccgctattcacattgcgcgacagttcttggagacttggacagaggagcatgcgcacttaaggaccgagatcaggtgacttgcctcttgtcagtcaccgcgtaacatgcggcctcacatctgccatgcattcatgatcggnggggcncngcgaccgaaggcctgcccacttancaacgcacttgttgaccattgtggaaaanga

SEQ ID NO: 29425 - DNA, 750 bp, Triticum aestivum
  unsure (1)..(750): unsure at all n locations
  Clone ID: PAT_TA_29425
gccggccggttctggactacacagagcagagcgcattccgatcccgcaccgccgcccacgcatctcgagtagtttccacctcgccggagaagtagaagcaggatggccggaaggaagggcggcgacaggaagaaggcggtgaccaggtccgtgaaggccgggctccagttccccgtcggccgcatcgggcgctacctcaagaagggccgctacgcccagcgcgtcggctccggcgcccccgtctacctcgccgccgtcctcgagtacctcgccgcagaggtcctggagctcgccggcaacgcggccaaggacaacaagaagacccgcatcatcccgcgccacctgctgctcgccgtccgcaacgaccaggagctcggcaggctgctcgccggcgtcaccatcgcccacggcggcgtgatccccaacatcaactccgtgctgctccccaagaagtcccccgccgccgccgagaaggaggccaagtcgcccaagaagaagacctccaccaagtcccccaagaagaaggtcgccgccaaggagtagccgccaccatagactactatcgcgacaccgcttaggtcgatagcagggagaggaagaggagctttggttggttggattctgtatgtaattgcctagtctgtagtggctttttcattggtttgatgaacgggctgtaatttatctctaatttatgtctggaatggctccctatgcantcctttcaatcatgttctctttgtttgaaaa

SEQ ID NO: 29426 - DNA, 768 bp, Triticum aestivum
  Clone ID: PAT_TA_29426
ttttcgagcattcctccaatccagcaccaccgccgccagctccacacctcgagagggacgcctcgtcgccggagaagcagcaagaagaagatggccggaaggaagggcggcgacaggaagaaggcggtgacccgctccgtgaaggccgggctccagttccccgtgggccgcatcgggcgctacctcaagaagggccgctacgcgcagcgcgtcggctccggcgcccccgtctacctcgccgccgtcctcgagtacctcgccgccgaggtcctggagctggccggcaacgcggccaaggacaacaagaagacccgcatcatcccgcgccacctgctgctggccgtccgcaacgaccaggagctcggcaggctgctcgccggcgtcaccatcgcccacggcggcgtcatccccaacatcaactccgtgctgctccccaagaagtcccccgccgccgccgagaaggaggccacaagtcgcagaaggccgccgccaagtcccccaagaagaagaccgcagccaccaaggagtagccgtccccattcccatagcctagccagtgttgctgctctgttccatttctcatggacaagatgagtagtagtcgtttggttggcagatctgtatgtagtgcctggtagtctctagtgaccctttcctcagattcgtcgagcaaaagggtgggcattgtatctctgatttctgtgggaaatactatactaaagatgcatccatctgaatcttagtaaaaaaaaaaaaaaaaaagcccct

SEQ ID NO: 29427 - DNA, 824 bp, Triticum aestivum
  Clone ID: PAT_TA_29427
gccggccggttcgggacaaacacagagcagcgcgcattccgatcccgcaccgccgcccacgcatctcgagtagtttccagctcgccggagaagcagcaagcaagatggccggaaggaagggcggagacaggaagaaggcggtgacccgctccgtcaaggccgggcttcagttccccgtcggccgcatcgggcgctacctcaagaagggccgctacgcgcagcgcgtcggctccggcgcccccgtctacctcgccgccgtcctcgagtacctcgccgctgaggtgttggagcttgccggcaacgcggccaaggacaacaagaagacccgcatcatcccgcgccacctgctgctcgccgtccgcaacgaccaggagctcggcaggctgctcgccggcgtcaccatcgcccacggcggcgtgatccccaacatcaactccgtgctgctccccaagaagtcccccgccgccgccgagaaggaggccaagtcgcccaagaagaagatctccaccaagtcccccaagaagaagaccgccgccaccaaggagtagccgcccccatagactactatcgtgacaggatgaggtgttttggctggttgggtcctgtgtgtaattgcctagtctgtagtggctgtttcatcagttcgatgagcaagccagtaggggctgtattcttatctctgatttatgtccggaatggctaaagatgcaatcctttcaatcatcttctctcttgtgtatccatggctgcaatccatcttgtgtatgtttggttacccgcctttgcttcaaagacaatccatcttataaattttaccttctgtc

SEQ ID NO: 29428 - DNA, 810 bp, Triticum aestivum
  Clone ID: PAT_TA_29428
acctacccagagcattcctccaatccagcaccaccgccgccagctccacacctcgagagggacacctcgtcgccggagaagcaagaagaagatggccggaaggaagggcggcgagaggaagaaggcggtgacccgctccgtgaaggccgggctccagttccccgtcggccgcatcgggcgctacctcaagaagggccgctacgcgcagcgcgtcggctccggcgcccccgtctacctcgccgccgtcctcgagtacctcgccgccgaggtcctggagctcgccggcaacgcggccaaggacaacaagaagacgcgcatcatcccgcgccacctgctgctggccgtccgcaacgaccaggagctgggcaggctgctcgccggcgtcaccatcgcccacggcggcgtcatccccaacatcaactccgtgctgctccccaagaaggccgccggcgccgccgagaaggagtccaccaagtcgcccaagaagaaggccgccaccaagtcccccaagaagaagaccgcagccaccaaggagtagccgtccccatccccatagcctagccattactcatggacaagatgagtactagtcgtttggttggcagatctgtatgtagtgcctggtagtctctagtggccctgaagatggtgtgggaaatactagtactactgaagatgcactcctttgagtcttggttattctcttgttctatatatctatggttgtctgcaatttggtcttgtgaatgcttgacacctgctttttttcgcacgcgtgggaaaaagcgtgggccgacgcgtgggcggacg

SEQ ID NO: 29429 - DNA, 802 bp, Triticum aestivum
  Clone ID: PAT_TA_29429
cggcgacacagcaacaagtagcgctccactagcaatcatcgcctgttgcagcatctgtagcttctttttgttctgtccttcagtccgcggctgattgagcattatggccactgtgagccccgtgcgcctccgcctgcgcggccccgtcctgccgcggggctcggcgccgcttcggcgcccggtctctgccagcgccgggccgccgcgccctcgtcgtcagggcacagaccgagggcccgagcgcaccaccgccaaacaaacccaaggcgagcacctcgatctgggacgcgctggcgttcagcggccccgcgccggagcgcataaatgggcgcctcgccatggtggggttcgtgacggcgctgccgcgggagccgcgcggcgccggggcggtcccttcgcgcagcggcggcgcgcctacgccgtggcggtgctctccgtcgctgcgggggttgtctctggtgccgctggcgcgcccgcgctccagggagagagcgccgagggcagagccggcaacgccggagctctggacacggccgcttcgccagtgctcggactcgtcgcgctcgcggccactgagatcatcaccggcgcgccctttatcaacgtgtaaaatagctttgttgtctcgaccggttagcacaacacatgtacttagtactagtaggacatgtaaatgatgagaactgatcatcctccaaagccttcggtattctttatagtactaattacagatacatagttcatatgctaccgggagctgaattagagatggattggaatataataggcttatgaaaaaaag

SEQ ID NO: 29430 - DNA, 1208 bp, Triticum aestivum
  Clone ID: PAT_TA_29430
gccgccccgaccgcatccccaccgtgaccccggccgcctcctcctctgcggcggcccggggctcctccaagagctgggcgtgcccccccacggccggcgcggcgtagccccgggcggcggcgcccccgggccaggccgcccccccggcgttcttcaactgccggttcgacgcgccaccaggacacgctgcatctgcccccccggcgcggccgcgtccgccaccgcgtccacggcggccccctccacggctgccgcggcgaagcgcccggcggtggtccagaactgccgcctggtgccggaccagaagctcttcgcggaccgcctcaagatcccgtcctccctgggccggccgtggaaggagttctcgcggctggtcatcatggagagcatgatcgccgacttcatcaagcccgaggggtacatgccgtggaacggcgacttcgggctcaagacgctctactacgccgacctccagaactcggtgactgcgcacggccgcacggaacccctaacatgaagtccgggctggtgatccagaactgccgcctggtgccggaccagaagctgttcgcggaccgcttcagcgacatggctcaagttcaccggcatgcccaactacctcgggttcaaggtataaaggcgcatacatgcatatgcatgcaacgccctgcgccctgtacatgaggtaccgatcgaggtaagcgtaatgtgtgtacctacggtgtgatgactgatcccggccccggcgcctaaaccttcactgctccgttctcaccttctgttcttttcatctggtttgtttctggcgatctcttttcctcggggacctatatcgacggggcgacatggctcaagttcaccggcatgcccaactacctcggattcaaggtctaaacgcgcatgcatatgcatgcatgcaacgcctgccccctgtacatgagataccgatcgaggtaaacgtaatgtgtgtacggaacgtgtgatgactgatgcttgcaagatcagcaaaccttcgctgctccgttatcaccttctgttcttttctggagttctcttttccctggtaaatgattaagtgtatgttgtgagttgtgacattgattaactggaaaatgtatcattcagatgcccattaactaagaaaaaattactaaaaaaaaaaaattataggaaactcaaaaaataaaaaaaaacggacacccaaaagg

SEQ ID NO: 29431 - DNA, 765 bp, Triticum aestivum
  Clone ID: PAT_TA_29431
aataaagacacccaagggcatcttaaatctgattatcatcgaggaaaacaaaggccagtacaaaggatagacaactggacgtagaacgaccagtaaaaaataaaattacaataaaaagcatactagtcttcttcttcctctgattgtacgctgcccgccggtgattgaaaattgcactgaaccaacagcaaagaaaagcaaaacctgcaaatgccctcgccacacaaggctttgaagaccgcaatagccactcgccccttgagacgagatctaaaagtcgttgaagcagcatcggctggagcatcaccccaagcagaacaaacttgcaatccaccaccaccagatcagagggttggagaaaccgggttaagccacagaacaacacagaagaagatgtcgtggtcgccacaccaaacgccagcccaaagtactccttgaaagacacaccaactgccaagatctgaagggaaccaaccgatctggggacaccaactctcacaggcccttcgccggcgccggatcggacgtcgtcgaggtagggagagaccggagagactttattccaacacgccatcgtcgccaccacctcgtcgatgccaccggagaaacaaaaacctaagaaaaataaaacaagacggacgggtccccactcctcttgccgccgacgaggccgccggacgggaaagaggagggggaccgaggcggcggcagtagttgtggcggcggcggcggcttagggttaggaggcggcggctcgtccgaatc

SEQ ID NO: 29432 - DNA, 1028 bp, Triticum aestivum
  Clone ID: PAT_TA_29432
gcacgaggcagcagcccagcaacggcgagctctccccaaccgacgacccacgaccccgtcacggcctcgccggcggcggcacgctcactggccttgccgtcgctgcctcgcctccggcttcgccccgtcatccggcgctcgccgccgcccccccgagcccccgcctccccctcctactctcaagtctgaccccctcgctcgtccccggctccccgacgccctgcgcccaacggccgccgacgctccctgccccttctggcaaagccacacaggtgagcacgatgctgcgcagcttcccccaggcccgtcggcttctgaagaggctgggttttgagaagggggacgcctacttctttaagcagatgggcaagggcatgctatgcacatatgcgctttttggcgccgcgtggttctggaatgagacatcaccgcttggctggtggacgctcaagccacggcccaaggtagagaaggagatggcccatctgtacgttcgcagggggttcccgcacccaggccacgagcctgcggtggcgcagttcattatgtgcgcgggccccctgggccacccggccgcccccaaggggttcgctgacgcgaacatggactcggacaacatgcagaagcagctgcagtccaagaagttcgaccaggaggcgcggaagctgtggttccgtatgcgcaacgaggtggtgcaggagctccaggagaaggggttcgacgtcgaatgaagattagttttattcccatgaaagaaatgggggaaggcatcggcttgattaagtattttgcattgataagagtagaagaaacattttcctgggataaagttagatgtatccaagttcagtgcaagcccttttttctcggtggagattaagtaaatcctgttgcatccaggcttgtattcctttcctctgtctttctttgggattaaataagttgttttccttgattaaacaattaatcatggattaatcatatatattgagacaccggtttaatattttaatttgtactttgccgat

SEQ ID NO: 29433 - DNA, 437 bp, Triticum aestivum
  Clone ID: PAT_TA_29433
accccgggtccccccgtccgggggggcattgacaattgagccaatcactaatattccatacccagaatattatgaattctttatggattggaaaacgcctgtggtgattgccactctttacgctggcacaattcatcttttaaatcctagtagcgccacagccaagttatctcgagtggaggccaaaaatcgtggtgtgaataatgcgtcatgtagcagtaagctgttcacaacctttgtactttcttcacaacttggtcttgtccatctattctggtgtgacattcgaaaatatggttcaagccttacacaggttattcaacaattactctgtacatgatgcttattgtgactttgatggatcattttgccaccacgcattgtgttatgggggatatttattttatctttctaaactttatgacgtggttgacact

SEQ ID NO: 29434 - DNA, 1059 bp, Triticum aestivum
  Clone ID: PAT_TA_29434
caattcggacgggcccccccccccccgcccccgcccccgcccccccccacgaactccggcaaccggcggccaccccgcgcccccgatccaccagatcccttctctccccctcgaccgatccacgcgggcggcgaccctccgtagccatggccaacacgctgcgcctgtacctcacctgcatccgcaacactctggaggcggccatgtgcctgcagaatttcccttgccaagaggtcgagaggcacaacaagccggaggtggagctcaagactagctctgaacttctgctgaatccggtgcttatatgtcgtaatgaagccgagaagtgtttggtagagacttcaatcaattcgatccgtataagcttgaaggttaagcaggcagatgaactggaaaatattcttgcaaagaagtttcttaggtttttgtcgatgagggcagaggcattccaagtgttgaggagaaaaccagttcagggttatgatattagcttcctcataacaaactaccactgtgaggacatgcacaagcataagctcatagatttcattgttcagtttatggaggacattgacaaggagatcagcgagctcaagctgtcggtgaacacacgtggccggctggtggcaaccgagttcctaaagcagttcatctgatctcgctatccgacttctcatcgcggaaggaccaattctccattgggagtttctcaacctcctccttggaggtgttggctgctctcctcaggttaatgagcttctggagtattggtgcacccggtcgatgacaaatgcaaggaacagtgtgtgtcctgctaggagcgatgaactgttagaattgtggtgccaggtttaactatgaatgtgtattctactctacttaattgtttgatagaggacaatattagtgtattagacatggaaaaaaatggagttctgcatttatcagtgtggtgccttaatccctcgtattttatgggtcggagggccttgtgcgtcagacatatgggggaaaatggagttctgcattcatcaaagtatatcctttatgccaaaaaaa

SEQ ID NO: 29435 - DNA, 805 bp, Triticum aestivum
  Clone ID: PAT_TA_29435
tcggcacgagggttcttctggtaggcttgtctgtggctgggatgacaagggaagctgaaggcctcgcgcagaggatgatgaagacaggggtgcaactgagcccgctcgcaggaagtgcaatggcgagggagctgtgtcagaggaaaatgtggttgcatgcttgctgttggttgagactgatggatgagaatggggtgctctgtgattctgatgtctatgctggcgtgttgctggggctgtgtcaagaggggcatgtccttgaggcctcggcgttggtgaggaaggtcatggataggggaatacggattgacgcttcttgcgctgattgtttggtgcagttactgaagcaacatggtgatgaggagctagcatcacatgtattacagtattaggattgaggagatcctctgaagtgatgtcactttgagcattgtgtggctctgtgctcaattcttgtagaagatggtttgaagaacaagaacagtgcagggaaaaaatacattcattggaggacctgttattttaacattcttgtgagtagattgcacgatctgctatttttcgtggaagagaaacccctgcatttatcaaagctatcacaataactctagatatctgcggagagggaagcaaattatagcaactagaatacctgcatcaattttatgcacatgtgcaattcttcagtgcactatctgtgtgtgataattttgtgcatatccatgcaaatgcaaccttctctataaacatgcttttttttcaagggaaatatacacccggtatttgtatcgagacatagagaact

SEQ ID NO: 29436 - DNA, 732 bp, Triticum aestivum
  Clone ID: PAT_TA_29436
gccagacaagacgaacaaccccacccccacgcaaccacacaactctgtctcagtacattagagcctcccagttagcaatatggccaagtgtctcgccgccgcgctcctcgctactcggtgggtgctcgcgtactgcgacgggagggagctgaaccagaaggaccaggcactagcaacggcacgcggtgctggtgccggggccggtgccggtgggggcgtcggcgaggagaaggttttggggttgccagagttgcccgcttgtgggaaccgttaccggtaccagcacagttcccggtccggtggtggtggttcctgcctttcccgggatccctgcacacccatgatcatctccacttcatgtgttggcttacaagctgaagctgaacttgtaggcttatgacttctaggtagcaccggtccgtaagataaacgccggcctgacccggcgtttcgctcatttccatgttccttaatgagcgtctgtatcaactaccctatcgtcctgtattttctttcagttcatgttctagtattttctgttcctctggattttctttcagttcatgttctagtatgatgtattgtcaacctaataagtactactttgtcatcgtgagtatcttcttagatcatgttctagtattttccgtttctctgtattttctttcagttcatgttctagtatgatgtatcgtcaacctaataaatactactttggccgccgcggccgcg

SEQ ID NO: 29437 - DNA, 669 bp, Triticum aestivum
  Clone ID: PAT_TA_29437
gggggggaataaagctacaaatgtccaaagtatttcaatcgtctttgtagcaaatcttggtaatccatgtaaactatcactcaaaacatgacttaagctttcaaatggagaggagttggttacgtcttaataaacgcttcagactcgccaaaccatttatttttaccagcttaatttgcttgtttcaagccagaagcacctccttgatgagcctatcaacattgcgcatggaccttccgccatgccgtgcggaggccacagcactctggcgaagctccagcacgcgtcgccgcatctcacgcccctgctccccctccatggcctcccgtatcatggcctccacctcggtcctcctcacgtcgtccccaatctccataccgatgccccactccgtacacttgaaacggcagttggtctgctgctccgcgaaaaagggccagcacaccatcggcacgccgccgcagatgccctccagcgacgagttccagccagagtgcgtgaggaacacccctacggcctcgtgctccagcacctactgctgcgggcaccacgtcgacagcatgctccgcccctcagttgccgcatagaactccggcggaagtgcggccttgacgtcgccctgcacgagcccaggccgcacgttccataggaaggcataaccagtgttgg

SEQ ID NO: 29438 - DNA, 582 bp, Triticum aestivum
  unsure (1)..(582): unsure at all n locations
  Clone ID: PAT_TA_29438
tntnnaataancagtanttantntnntcnnatntaancagtatnatttnncattntatatancaanancctntnttntttgttatgntaatgtattgttnagnatctactggtnaagccatagggtaaaatagcacaggaattcatgaagttttttaaactaaattatttaccatgacatggagtttttcaactaaatcatttaacacgagttcatccatatatttatttacctgttcatgtaattattagaggtcactattgtcacagaggactctgatggttggtatagaaaattttctgactggggatcaaggataatgttgctactggagcagtttgtacagtttttgaccttctttactgaacataagggaatagggaggccaccctggatgcaagtctatacatgtggatgtttgtgtgtaaccatcattgtatttagggtttgaggcgctaatttagatgttcgttaccttgatgttcgatggagaataaattattatttctgaagtggcggtcaataaacagagcccttcagtgttacttgctgctgttgatttatctgtgctttgccaagcnn

SEQ ID NO: 29439 - DNA, 517 bp, Triticum aestivum
  Clone ID: PAT_TA_29439
gagaaatccgagcgagcccctcctcctccccggcgaatccctcctcctccctgagcatccaaagtgcgagatgtcgaaggtttcgtctcccggtggcggcgccctcaccctgggcaccaagcgccctcccggcgcacccggactcggtaggggccgagagttcctcgtccccatcgcaggggcccttgccgtgttcgtcatcctgtacggactcggctgcttcagatcgctgaagattcgcccagctagccggcggtgggcaggccctcgtctgcagatcgagcagaggtgcaagcggcagccctttgccctgctctttcatgttgttcatctttcaacatctccggatttctctctgtccgggcagcaggcgcggcgatcaatggacgactatcaaggcgtgaccgtgtgaaacgcacaaaggctaaagcaaagactgaatctatgcatgtggctgacgaacatcacaacccactctaacatatattaatcgcctatctaccactgaaaaaaaaaa

SEQ ID NO: 29440 - DNA, 507 bp, Triticum aestivum
  unsure (1)..(507): unsure at all n locations
  Clone ID: PAT_TA_29440
aacatccttggcttcaccttcgggatgatccagatggtcctctacatgttctacatgaacgcgacgcccgtggtgacaagcgatgtgaaggaggtgaaggaggcatggaaggtgcctgcagaggaccaagtcgtcgtgatcaacgtcggcaaggccgacaagagctcgtgcgctgaggtgcgcccggtcactgagatggctagcgccgtggacgtccccaggagatgcgctgctgaggcggcggcgccgaggcagcaagtgatggcggtggactttgcccgctctgtccaggtggtctagatgcaaccacgcatggctcatgcatgatcatgcaagcttaatattcgtacaactttccgggagggtatgcaaggtcctaatccccgcatgcggggtatcgatcctttgttccgntatacaacgtgttgataatatgagcataaacatttctgcatgtatatgcaagtgcaatatgttccaactgaattcctgagaattatttgtaac

SEQ ID NO: 29441 - DNA, 460 bp, Triticum aestivum
  unsure (1)..(460): unsure at all n locations
  Clone ID: PAT_TA_29441
ctccagtcccagcagcagcagcaacagcagtcgccttcccacgctgccgatcagcagcgggggccgctcctgcgcgaggccatgtccacgcccgtgctgatggtcacagcggagcaggcgctggtggaggttgaaagccacttccagctcgtgtcaggcctcccggttgtcgacagcgctcgcagatgcgtcggggtcatccgtcaagagcgatcgcgtgagggcttcacatgggtcaaagacgtttattgcagatgtgatgacatctccaagcaatcacgctatcttgcgataaaacaatgaccgatgccgcagctctgatgctcaagaagaagatcacaagattaccgatagtaaaccaggacaatcaaattataagtataatttccccgaanaacttnttccnccnttggggcatgctaatttttanatcaagantcanccccgtattttgatttgt

SEQ ID NO: 29442 - DNA, 764 bp, Triticum aestivum
  unsure (1)..(764): unsure at all n locations
  Clone ID: PAT_TA_29442
aggctaagagtttcaccaacttagagagctctcctctccagacctctcccttctctccgccaggagtctagggttagagagagagcgagacgagcaaaaacaatctctcgccccactgttataccaagttcgcatccacctcactgttatacatctttgtatcacaatgggtggcctatccatggagcacccttgggcatttgccttcggcctactaggcaacgtgatctctttctcaagcctcctggccccgataccaacattctaccggatcttcaagagcaaatccacggaggggttccagtcggtgccctacgtcgtggccctgttcagcgcgatgctgtggatcttctacgcattggtcaagaccggtgagggcctcctcatcagcatcaacgctgccggctgcgtcatcgagaccgtctacatcgtcatgtacctcgtgtacgcccctaggaaggccaagattttcacagcaaagatcgttgtcctcctcaacatcaccggcttcgggctcaacttcctcctcaccctgttcgccttccacggtgagacacgcgttgtctcactcggctggatctgcgtcggcttctccgtctgcgtcttcgttgccccactcagcatcatcggacgagtcatcaagaccaagagtgtggagtacatgcccttcacgctctccctcacgctcaccctcagngcaatcgtctggttcctctacggnctgctcatcaaggacaaatacgtcgcactcccaaacatccttg

SEQ ID NO: 29443 - DNA, 418 bp, Triticum aestivum
  unsure (1)..(418): unsure at all n locations
  Clone ID: PAT_TA_29443
cacaagacaaggaagcagtaagcagtgaagaacagctagcatccatggcgtgcatcaataccttgcagagctgctccatgttcaaaggggccaaggctgaggccaggaggggcaagagccagcggcggcgggagcttcgggtgccgggcgtccacattcatggatggaagcgggctccggctccgggctcgacgaagaaccccgacgccatcatctccggggagtggcccgaagaacttctcccttctcaactacgacgacctccgcgcgttactccagtcccaagcaacaacaagcaacagcagtcgccttcccacgctgccgattaaacaacnggggggcgctccctgcgccgaaggcaagtccacgcccgttgcttgatngtcaaaaacgggancaaggcgcttgttggagggtt

SEQ ID NO: 29444 - DNA, 631 bp, Triticum aestivum
  unsure (1)..(631): unsure at all n locations
  Clone ID: PAT_TA_29444
aagcagtgaagagtagctagcatccatggcgtgcatcaataccttgcagagctgctccatgttcaaaggggccaagagtaaggccagaagaggtagagccagtggcgggacctttgagtgccgggcgtccacgttcatggacgggagccgggctccggctccgggctccgacgaagaaccccgatgccatcatctccggggaagttggccccgaagaacttctccctcctcaagctacgaacgacctcccggcgcatacctccagtcaacagcaagcaagcaagcaacaacgacaaccatcccatgccggcgattcagcacggggggctctccctgcgttnaggcatgttcgaccccgttctgatggcacagcggagcaagcctggtggaggtttaaaggcattccactccgttcaagctccggtttcnacanncccgccgattttccggtcctcctcaaaacnatcactttanggttcacatgggcaaaacnaanatgcaatgtnatgaactcaacatcanctacatgcataacatgacgagcncaatctatccaggaanagtcacagttacgtntaacagcatcantatagtaatacccatactctcccctggggcactaattaaatag

SEQ ID NO: 29445 - DNA, 740 bp, Triticum aestivum
  Clone ID: PAT_TA_29445
gaaacaccttgtagctatcagcggaggaacagtaattgatggtgttaaggttgttcctgatttagtagagccactggatgcccaagctgacacaaaaaggacgcgacttaaaatagtggttcatgaaggaagaaaccacgaagttcgtgaacttgtgcagaatgcaggactaaaggtctacgctttgaaacgtgttcggataggcaggttccgcctcccatcagacctgggaattgggaagatggttgaacttaaagaagctgacatcaaggcactagatggcaacagctagtagagtgcgcgcctgagttcatgggcttccgtttccgaaagcggtgtggacgggtggataacatatatgtcatacctcctgtggcataaggcacgactactctgtgcctgagaggcctgcgattctgctatcatagatgtcaaataggaaactaatggtcaggttcgataggcatgcctttgttttcaagaacacatgaactgcttcgctgaaggatctccaagatcctacgtggcagcagtgttcgctggagttttgggatatgttcagctaggcttgctagtactgtagtagagttgttgatagcgtctactcttatgcagacctactgatttattatctgtggaaatgtaaatgctgtcagtcgagtcatgaacttttctttaacttagtcgagtcatgaactggcattacttgccaacagtttttgcaacttgtaacttgtatg

SEQ ID NO: 29446 - DNA, 578 bp, Triticum aestivum
  unsure (1)..(578): unsure at all n locations
  Clone ID: PAT_TA_29446
ctcgtgccgaattcggcacgagcaactaacttagagagctctcctctccatacctctcccttcgctccaccaggagtctagggttagagagagagagagagcgagacgagcaaaaacaatctctcgccccactgttataccaagttcgcatccatctcactgttatacatccttgtatcacaatgggtggcctatccatgggagcacccttggggcattccgccttccggcctactaggcaacgtgatctctttctccgagcctcctgggccccgataccaacattctaccggatcttcaaagagcaaatccacggaggggttccagtccgggtgccctacgttcgtgggcctgttcaagcgcgatgctgtggttcttctaccactggncaaaaccggttgagggctcctcatcaanatcaacgctgccggtgcgtcatcnaaacgnctaatctcatgtactcgtctacgccccaggaagncaaatttcacagcaagatngtcgtcctctcaacacgccggttcgggtnactcctcctnactctcgcttcatggggaaaaccntgtcccctcggtggt

SEQ ID NO: 29447 - DNA, 868 bp, Triticum aestivum
  Clone ID: PAT_TA_29447
gcacgaggccagaaagtctcgcacccttcttcaaacataacaaaggaatatgtagtaactatagatggagcagtgcacaagaaacaccttgtagctatcagcggaggaacagtaattgatggtgttaaggttgtacctgatttagtagaaccactggatgcccaagctgacacaaaaaggacacgacttaaaatagtggttcatgaaggaagaaaccacgaagttcgtgaacttgtgcagaatgcaggactaaaggtctatgctttgaaacgtgttcggataggcaggttccgcctcccatcggacctgggaattgggaagatggttgaactcaaaaaagctgacatcaaggctttagatggcaacagctagtagagtgcacgcctgagttcatgggctgccattttcgacagtggtgtggacggatcaataacttatatgtcgtacctcctgtggtgcaaggcacggctactccgcgccttaaaaggcccgcgattccgctgtcatagatgtcaaataggggcctgggtggtcaagttcgacaggcatgcctttgctttgaagaaaacatgagctgcttggccgaagaatctacacgatcctacgtggcggcagtgttcgctggagttttggtatatgttcaactaggccagctagtagtagagttgttcatagcgtctactcttatgcaaatctaccgatttattatctgtggcaatgtaaatgctgttagtcgagtcatgaacttcttttttaacttattagttgagtcatgaactggcattacttccaacagttcttgcaaacttgtaaacttgtatgcctcttccacaagaaaaatatctgtatacctgataaaaaaaaaaaa

SEQ ID NO: 29448 - DNA, 618 bp, Triticum aestivum
  unsure (1)..(618): unsure at all n locations
  Clone ID: PAT_TA_29448
gagagctctcctcttcagacctctcccttctccccaccaggagtctagggttagagagaaagagtgagagaagagcaaaaacaacctctagccccactgttgatttaatttgccagcaggcttgttgtcaacttcatatctatcccatttcccttcaatatcttcatatcacaatgggtgggcctatccatgggagcacccttggggcattccgccttcggcctactaggcaacgtgatctctttctccgagctcctgggccccgataccaacattctaccggttttcaaagagcaaaccacgaggggttcatccggtgcctaagtcntggcctgttcaacgcatgctgtggttcttctacgcactggcnaaaccggttaaggctcctcaacaanatcaagctgccggtgcgtcatcnagacgtctaatctcaagttctcgtctaagcccccaagaaggcaaattttanagcaantttcgtcncctcaaaangccgntcngggtaactctctaacccntcgcctcatggggagaaccgtctctaatcgntggatngctcgnttccgtcgngtcttcttgccatanaacatcgcagtatcaacagatgtggtaancctt

SEQ ID NO: 29449 - DNA, 1112 bp, Triticum aestivum
  Clone ID: PAT_TA_29449
atggacaggcatattatataactaatccgtttgatgtcccgccagccacggggatatgagtggagcaagggtgagtctgcatgtcagccacacagacatatactaaagacaaattcacattcaggacaagaatgtacggtacgctgccaccctggatctaactataccttataagttcttaccagcagccattaactgcgaactccctgaattatctctcggcaccacagtataggctagagtaattggtgcaggactgggtaccccctcttggaatttgacatcaaaagccacagattggtaaagacaaacttcatcttctttgcagtagtaaaccttgcagttgatccttcctgttgatgatgatgatgatgttcttttgaacttgagtgacgcctgcccatctgagtttagagatccattcactggctcgatctcaattgcattagctggttctgtttccacatcaaatttgctgcgagcttccttcgagaaatggtaaccatcaggaactgagattgcaagagacacatatccttccattgaggaaccaccatcaacgttaataacattttgtgtctgctgataacccgtcgtcttaggcgtctcaatgccttcggttttggtgatggcgcctgcactccagtcaaatctagtgtgcgcacctcagcacctctctcattcaaaactatagatctgattgcactgttgtttgtatctgctacaagaaatcttccttctccaacttcaacaagtccagctggctcagatagttgagctgacaaggcatcatcatcgttgtatcctgcacgtccggtaccagcaatcgttgtaactttttttgtgacaggatctaacttttttatctggcctggggctctccaggggtggaaaaggaggtgcctatccgcccgttcctttggtgatcggtggccacaggcctggtgcgggggcgggttaggagccatggatgccaggccagcagccctggagggcagctttcacggttggctttccagcaagcatcgttgagcaggttgtggccggcgagcttcgttcatgtgggtggcgaggtgtatggtgtggtcctggcaaagttgtcgccggcagtg

SEQ ID NO: 29450 - DNA, 1379 bp, Triticum aestivum
  Clone ID: PAT_TA_29450
ttagacgtggaagtgccatttttagtacatggccagcaagacagagtattaaggactaatatgatgagcactcattaggcattgctatttaaaatgataagccatactatcttgatggtacatagcaaaaaatctctagcatttcccgccggttatactacttcttgctctgggagagatcacaccaaggaaacacgattcagttgagcacagacacgtaaagattcatgaccaagaacagagttaaatttatcttgcataaaaattctctcaattgtcagaaaggggagactttgataaaagcttcttctatctgtctgtagtcctgatgtttccgcttgtcagagcatcatgcatctcgttgtgtaaatggaagagataaatgagaatccatgagctgaacatgaattagaaaatcagctgacacaattctcagcgtctgccattcttctccgcgtgactgggccgctgcaacagaaacatgtacgaccagaagttatgtagctgaccaggttctgaacgaaaggccattccttcatatctttgcaatgccccctttagcttcaatccaatggtctgattgagttcacggccaaatccttcgtacatcctcatctgcagctgcagatgggctggtgatgggtgaggtcgccagcaagtagacctagctgcagaagacaccgcctcacccacgctgctgatgggaaaccacccggacacgtgcactctcgccagagaggcaccctcaatctccgctgatggctgccttccttgatagctgagggatctgccggcgaggtcctgaaggtgagtgaggtggcctgatctggtgagaatccacaagaggagatgaagtgctgccgcgatgcgtagatgggagagagcagatcttgcgggcgagggagcacatacccgagacagagccagatcgtcgagtgttttccttttctgaagatccgatcagggccaacagaacaatgagaacatccagcttacatgcaacaccatcggtggtagaactgctgccgtccctaaactcagcccaccttggaaacaacaattccttgaggtgtttttcatgtcgtagaatatgcatcggccaatgatgtgagtctcttttcttgagtagttcagcgcacctctcccaggttgaacctcccactaaaatcattctttgtcttagcctttctaccttccatagtagtatattcattccagcctcctgctccagcataacacacctcctatttagagtgttactgcatgaagcctgcaaatctcattggccttacatccgagagattgctgaatgtcatgtgtatgcctattgctttcctcagacaatgtatagcagcagattcacaaccctcgtgccgaat

SEQ ID NO: 29451 - DNA, 588 bp, Triticum aestivum
  Clone ID: PAT_TA_29451
agatggtcctctacgtgttctacatgaacaagacgccggtggcaagccaggtcaaggaggggaaagaggcatggaaggcgcccgcagaggaccacgtcgtcgtgatcaacgtcggcaaggccgacaagagctcgtgcgccgaggtgcgcccggtcaccgagatggccgccgccgtcgacgtccccagaagatgcgctgctgaggcggcggcgacgcctggggtggactttgcccgttctgtcgacgtggtctagattcacgcacgcatgcaagctttgcatgcatggcttatgcatgagtcgtgcaaccaagctttaatattcgttattattaaactttttcattttccaagaaaaataataatattcgcaccaccacggtctgcaggtgcctgtacctacctattgtatgtatgtaaaacaaactacgtatgatgattcggcctgggtcgtaggattggcagcccacttattctatgatgtgtttatagaccacgctccagcccttaaatgttcccaaagatgtttaatgaatttataaatcgaaattatatatataaaaaaaaaaaaaaaaaactcgagactagtt

SEQ ID NO: 29452 - DNA, 1006 bp, Triticum aestivum
  unsure (1)..(1006): unsure at all n locations
  Clone ID: PAT_TA_29452
gatccagtcagacaacatccacaacacaagacaaggaagcagtgaagagtagctagcatccatggcgtgcatcaataccttgcagagctgctccatgttcaaaggggccaagagtaaggccagaagaggtagagccagtggcgggacctttgagtgccgggcgtccacgttcatggacgggagcgggctccgactcgggctcgacgagaaccccgacgccatcatctccggcgagtggcccgagaacttctccctcctcagctacgacgacctccgcgcatacctccagtcacagcagcagcagcaacaacaacaaccatcccatgcaggcgatcagcagcgggggccgctcctgcgcgaggccatgtcgacgcccgtgctgatggtcacagccgagcaggcgctggtggagattgaaggccactttcagctcgtgtcaggcctcccggttgtcgacagcgcccgccgatgtgtcggggtcgtcgtcaagagcgatcgcgtgagggcttcacatgggccaaagacgaagattgcggatgtgatgacatctccagcaatcacactatcatgcgataaaacagtgaccgatgccgcagctctgatgctcaggaagaagatccacagattaccgatagtaaaccaggacaatcaagtaataggtatagttacccgcgatgacgttcttcgcgcgttggaggccatgctgaagttttagagatgcaggagtccatgcccggtacttgtggatctgtaaatatgtgtgtccgcggtactttgagtagcaggcagatcctatagtctgtcaaagtgtttgtagtctgtatcacaaaaataagcctaggagcatttaggagagcttttccttgtaaagaagcacgccagaaagcttctgctctgtactgtactgtttggtatctgcgcatgaaaatgtttccatgagcaatgaaaaaaaaaaaaaaaaaaaaaaaaaaaaaaaaaaaaaaaaaaaaaaanaaaaaaaaaaaaa

SEQ ID NO: 29453 - DNA, 824 bp, Triticum aestivum
  Clone ID: PAT_TA_29453
cacaaagatcatttcattattggccaaagagaaaacaaatatgttcatgccatattgttcgaagccactctcaataaaatagcatccagcataacatgaaccgttttgaataatttggaaccatagatatctaaacaagcaacatccaccttcaggacctgatgcataagaaatggtctctcaggaaccatatccattcaagtaggctacagatgggctggtgacggtgaggtcgccagcaagtagacctagcggtagaggacaccgcctcccccatgccgctggtgggaaaccaccacgacacgagcactctcgccggagaggcaccctcaatctccgctgatggctgctttccctgatagctgagggatctgccggccaggtctgtttagtaaactgcaatttggaaggttaagttgctgcatcatagcatcaaaaagcactttttgttgggatcttaactttgtccatcacgacagactgaaggtgagtaaggtggcctgatctggtgagaatccacaaaaggagctgaagtgctgttgcggatgcgtagatgggagagagcggatcttgcgggcgagggagcatatacctgagacagagccagatcgtcgagtgttttccttctctagtgtagaagaggctgcggataggaatcagaaccaaaattaatgtcactttgatagttgtacctcacatccttctataaacatcattaatcttaagaaccttaacttcatagcatacacaccgatcagaccccccagaacaatgagaacatccagcttacatgcaacaccatcggtggtaaaactgctcggacg

SEQ ID NO: 29454 - DNA, 524 bp, Triticum aestivum
  unsure (1)..(524): unsure at all n locations
  Clone ID: PAT_TA_29454
gttcaacgaacacagagagctcctctccaaacctctcccttctccccgccaggagtctagggttagagagagagagagagagagagtgagacaagagcaaaaataatctctcgccccactgttataccaaggttgcatccatctcatatccctctatatatctttgtatcacgatggctggcctatccctagagcacccttgggcattcgccttcggcctcctaggcaacatcatctctttcacaagcctcctggcccccataccaacattctaccggatcttcaagagcaaatccacggaggggttccagtcggtgccctacgtcgtggccctgttcagcgcgatgctgtggatcttctacgcactgggtcaagaccggtggagggcctccctcatcaagcatcaacgctgccgggctgcgtcattgagacagtctacatcgtcatgtactcgtctacgcccccaaggaaggcaagatttcacaagcaagatcgtcgtcgtcctcaangtcgccgggtcgggg

SEQ ID NO: 29455 - DNA, 429 bp, Triticum aestivum
  Clone ID: PAT_TA_29455
tagcgtggtcgcggccgaggtcttcatctgttttacacacaactcttgctgcctttcgggtccggcagacgacgaagaagaaaaagacagaaaaagaaaacacaccccacccacatatacaagttgctacctcagtatcaccatcttgtgttagctaatctagttgctatttgttgcaacagtcgaagacgaagattgcagatgtgatgacatctccagcaatcacgctatcatgcgataaaacagtgaccgatgccgcagctctgatgctcaggaagaagatccacagattaccgatagtaaaccaggacaatcaagtaataggtatagttacccgcgatgacgttcttcgcgcgttggaggccatgctgaagttttagtgatgcaggagtccatgcccggtacctgcccgggcggccgctcgaaatc

SEQ ID NO: 29456 - DNA, 1058 bp, Triticum aestivum
  Clone ID: PAT_TA_29456
gaattcggcacgaggctcaggaagatccatcattccacttctctagagatgaggaaaccaaccagacagttattgaaggaatgggcgaattacaccttgacatcattgtagacagattaaagagagaattcaaggttgaggcaaatgttggagctccacaggtcaactaccgtgaaagtatttccaaaattgcagagattcagtatgtccacaaaaagcagtctggtggttcagggcagtttgcagatattattgtgcggtttgaacctatggaggctggaagtgggtatgaattcaagagtgaaattaagggaggggcagtgccaaaagaatacgtacccggtgtgatgaagggaattgaagaaagcttacctaacggtgtccttgctggttacccagttgtggatttacgagcagtgctggttgatggctcctaccacgatgttgattcaagtgtccttgcattccaaattgcagccaggggggccttccgggaaggattgaggaaagctggcccacgactcctggagcctataatgaaggttgaagtgattacccctgaggagcatttgggtgatgttattggtgatttgaactctagaagagggcaagttaacagcttcggagataagccaggtggactgaaggtggttgatgctttcgtgccacttgccgagatgttccagtatgtcagcactctgaggggaatgtccaaggggcgcgcgtcgtacacaatgcagcttgccaagttcgacgttgtcccacagcatatccagaaccagctttttgcggcaaaagaggaagctgctgcttaaatgttcattattcgtagataatatatatgaggacggcagagcaggtgagtataggacatcaatgtgtatgtagctttgtagtgtcgaacccagtgggtgatattatttgccattgtttttggacctgataatgtccataattttgcaagctgttataatttcataatgaccttgtcaagttctcacaaacgagaaaacagttcgttataaattttgcttccatggaaaaaaaaaaaaaaaaaa

SEQ ID NO: 29457 - DNA, 701 bp, Triticum aestivum
  Clone ID: PAT_TA_29457
aaccaacttagagagctctcctctccagacctctcccttctctccaccaggagtttagggttagagagagcgagacgagcaaaaacaatctctcgccccactgttataccaagttcgcatccacctcactgttatacatctttgtatcacaatgggtggcctatccatggagcacccttggggcattccgccttcggcctactaggcaacgtgatctctttctcgagcctcctgggccccgatgccaacattctaccggatcttcaagagcaaatccacggaggggttccagtcgggtgccctacgtcgtggccctgttcagcgcgatgctgtggatattctacgcactgggtcaagaccggtggagggcctcctcatcagcatcaacgctgccggctgcgtcattgagaccgtctacatcgtcatgtacctcgtctacgcccccaggaaggccaagattttcacagccaagatcgtcgttctcctcaacatcgccggcttcgggctcatcttcctcctcaccctcttcgccttccacggcgagacacgcgtcgtctcgcttggctggatctgcgtcggcttctccgtctgcgtcttcgttgccccactcagcatcattggacgagtcatcaagaccaagagtgtggagtacatgcccttctccctctccctcacgctcaccctcagtgccgtcgtctggt

SEQ ID NO: 29458 - DNA, 1296 bp, Triticum aestivum
  Clone ID: PAT_TA_29458
gaattcggcacgaggagagctcctctccaggcctctcccttctccccgccaggagtctagggttagagagagagagagagagtgagacaagagcaaaaataatctctcgccccactgttataccaaggttgcatccatctcatatccctctatatatctttgtatcacgatggctggcctatccctagagcacccttgggcattcgccttcggcctcctaggcaacatcatctctttcacaagcctcctggcccccataccaacattctaccggatcttcaagagcaaatccacggaggggttccagtcggtgccctacgtcgtggccctgttcagcgcgatgctgtggatcttctacgcacttgtcaagaccggtgagggcctcctcatcagcatcaatgctgccggctgcgtcatcgagacagtctacatcgtcatgtacctcgtctacgcccccaggaaggccaagattttcacagccaagatcgtcgtcctcctcaacgtcgccggcttcgggctcatcctcctcctcaccctcttcgccttccacggcgaagacacgcgtcatctcgctcggctggatctgcgtcggcttctccgtctgcgtcttcgttgccccactcagcatcatcggacgagtcatcaagaccaagagtgtggagtacatgcccttctccctctccctcacgctcaccctcagcgccgtcgtctggttcctctagggcctgctcatcaaggacaaatacgtggcgctcccaaacatccttggcttcaccttcgggatgatccagatggtcctctacatgttctacatgaacgcaacgccgggtggtgagcgatctgaaggaggggaaagaggggctgaagatgtcggcggaggagcacgtggtggtgatcaacgttggcaagagcgaaaagagctctggcgccgtggttcgcccggtcaccggagatggtcaaagccgtcccggcggcgccgggggcaacaagtgatggcgctggactctgcccgctctgtcggatgtggtgtaaattcacgcatgcaggcttgcctcatgcatgagttcgtgcaagctttaatattcgtgcagcttttttggagggtcacgcctgcagggcatgcatgatgcttcttttctgttagatcaacatgttgattgtatgaggcataagccatttaatagctgtaactctgctttcaccaaccataaaaaaaaaaactctgctttcaccgcgcccaaaaaaaaaaaaaaaaaaaaaaaaaaactcgagacctcgtgccgaattcggcacgag

SEQ ID NO: 29459 - DNA, 614 bp, Triticum aestivum
  unsure (1)..(614): unsure at all n locations
  Clone ID: PAT_TA_29459
cccacgcgtccgcagacaacatccaccacacgagacaaggaagagtagcatccatggcgtgcatcaataccttgcagagctgctccatgttcaaaggggccaaggctgaggccagaaggggcaaagccaccggcgcagggagcttcgggtgccgggcgtccacgttcatggacgggagcgggctccggctcgggctcgacgaagaaccccgacgccatcatctccggcgagtggcccgagaacttctccctcctcaagctacgacgacctccgcgcctacctccagtcccaagcaagcagcagcagcagcagccaccttcccacgctgccgatcagcaacggggggcccgctcctgcgcgaggccatgtcgacgcccgtgctgattgtcacagcggagcaagcctggtggaggtttaagcacttcaactcgtgtcaagctcccggtttccacaacgctcgcaaatcctccggtcntcctgaanaccatttccccanggtcacatgggcaaanacnaaaattcaaatgtgatgaactccaanaacaagctacatgcgataaacattacgatcccantctgatccaagaaaaatnacagattccgtntaacaggca

SEQ ID NO: 29460 - DNA, 2894 bp, Triticum aestivum
  Clone ID: PAT_TA_29460
gattcctccgcgatttcctcctcggccgcccgccgattccctgtcgatcgagctgtcgcggtgccttggtcggattcggcaccctcagccatgacgacagaccagccagtgatcagcctgcgccccggcggcggcggcggcgggccccgcggcggccgcctcttcgcccccgccttcgcggtcgccgcctccggctccggcgacttcctccgcccgcacggcggcggcgcctccggcgtctccaggattggtgacttgcattctgagtcacgtgagcgtgttcgttattcaagagatcaacttcttgacctgcgcaagattactgatgtaaccgagcaaatcttgaggcttcagcaagaaattgaagcagagcttaatggtgacgatcagagctgggttcgcaacgattcaaatgtgcaattgcagacacaggcacagccacaagtacaagctcaaaacaggtttactgagacagataaccgtgactggcgtgcacgcacagagaaacctccagcaccagcagttcaggaagagaagtcttgggacaacattcgtgaggttaaagaacagtacaatgcaagtggcaggcagcaagagcagtttaacaggcaagatcaatcgagctcccagaaagctcaggttggcccccctcctgctcttatcaaggctgatgtaccttggtcagcccgaagaggcaatctctcggagaaagacagagtcctgaaaacagtgaaaggtatactgaacaaactgacgccagagaaatttgatctactcaagggccaactgctagattctggaattaccactgctgatattttgaaggatgttatctctctcatatttgagaaggctgtttttgaaccgacattctgtccgatgtatgcccaactttgttctgaactcaatgacaaccttccgacattcccttctgaagaaccaggcggtaaagagattaccttcaaacgtgtgctgttgaacaattgtcaggaagcttttgaaggtgctgacagcctgagggttgagattgcaagtttgactggccctgaccaagagatggagaaaagagacaaagaaaggatcttcaaacttagaacacttggaaatattcgtctaattggtgagctactcaagcaaaagatggttcctgagaagatagttcatcacattgtcaaggagctactggggtctgataaaaaggcttgccctgacgaggaacacgtcgaagcaatttgccagttcttcaatacgattggtaaacagcttgatgagaacccaaagtctcgccgaatcaatgatacctacttcgtccagattagggagctagtagcgaaccctcagttgaccccacgttccaagttcatggtccgggatttgattgatctccgttctaacaactgggtgcctcgacgtgctgagatcaaggcgaagacaatcagcgagatccacacagaggctgaaaagaaccttggattacgtccaggggccacagcgaacatgaggaatggccgtaatgcaccaggtgggcctctttcgcctggaggtttttcagtgaaccggccaggaacaggaggtatgatgcctgggatgcctggatctagaaaaatgcctgggatgcctgggttagataatgataactgggaagttcagcgttctagatcaatgccaagaggcgatccgcttcgcaaccagggtccgttgatcaataaggttccatctattaacaagccatcacccatcaaccccaggcttcttcctcaaggcactggagcactgattggcaagagtgcactcttgggcaccggtggtccaccatcccgcccttccagccttacggctagccccactcctttaccagctcaaactacagcatcaccaaaaccatcaagtgcaactccagcttctgtacctattcctgacaaagcagccagttctgccaaggtgatccctgcagggcttcagaagaagacagcatctcttcttgaggagtattttggtattcgtattttggatgaagcacaacaatgtattgaggagctgcagagtcctgattaccaccctgagattgttaaagaagctatcaatcttgctctggataaaggtgccagttttgttgaccctcttgttaagcttctggagcatctgtacaccaagaaaactttcaagaccgaagatctggaaaatggttgcttgttatatgggtcgctgttggaagatattggtattgaccttcctaaagctccaacgcaatttggtgaagtggttgctcgtttgattctgtcgtgtggcctgagatttgaagccgcagaggggattctaaaggcaatggaggataccttcttccgcaaagcaatattcacctccgtgacgaaaaccctaggagcagacccagcaggccaggccatattgagctcacatgctgccgtagtcgacgcgtgcaacagcctctcgatataacagctcttggcagctcaacttctcaggtgctgtgtctagtgaaaaacagcgtatggtgtattctctatagcttaggtgtttcaccgcagaggaactgggatgtgagcaacagccagttttgagctgtatatttttgcgaggtcacatgagtgttgattattgtttcgaggaaaggaagaagccatggattttggtctctcggcgacggcggcctaactctcgctggagcctgggaatgaacaaggcttttttgttttcaaaatgggatgtttttgtgtctcctccaatgttattatttcttttcagttcttacacaatttgtaacaatgtactgtggttttggagtattctgtcggttacaatatatcgtgtcagcattgtaggagtcgaaaactgaatctaagattatttttggcttaaaaaaaaaaaaaaaaaaa

SEQ ID NO: 29461 - DNA, 724 bp, Triticum aestivum
  unsure (1)..(724): unsure at all n locations
  Clone ID: PAT_TA_29461
ctcgtgccgaattcggcacgagaacacagagagctctcctcttaagacctctcccttctctccgccaggagtctagggttagagagaaagagtgagcgaagagcaaaaacaacctctagccccactgttgatttaatttgccagcaggcttgttgtcaacttcatatctatctcatttaccttcaatatcttcgtatcacaatggctggcctatccatgggagcacccttggggcattcgccttcggcctactaggcaacatcatctctttcacgagcctcctgggcccccgataccaacattctaccggatcttcaaagagcaaatccacggaggggttccaagtcggtgccctacgtcgtggccctgttcagcgcgatgctgtggatcttttacgcgctagtgaagaccggtgagggctcctcatcaacatcaacgctgccggctgcgtcatcgagacatctacatcgtcatgtactcgtctaagccccaaggaaggcaagatttcacagcaagattgtcctcctactcaacatcccggttttgggccaacttctctnacgtctcgcctcaagggagaccgcgtcactcgctggntggattgctcggtcccgtcgtgtctctcncccctaaaaaacgtcgtgtataaacanattggataatcctccctccctaagtaactangcatgcngtccaggctgcacaggaatntccgncaaanctg

SEQ ID NO: 29462 - DNA, 692 bp, Triticum aestivum
  unsure (1)..(692): unsure at all n locations
  Clone ID: PAT_TA_29462
gagccctcctgctgggatctgcaagagaacacagtcagacaacatccacaacacaagacaaggaagcagtgaagagtagctagcatccatggcgtgcatcaataccttgcagagctgctccatgttcaaaggggccaagagtaaggccagaagaggtagagccagtggcgggacctttgagtgccgggcgtccacgttcatggacgggagccgggctcccggctccgggctccgacgaagaacccccgatgccatcatctccggggagttggcccggagaactctccctcctcaagcttacgaacgacctcccgcgcatacctccagtcacagcagcaagcaacaacaacgacaaccatccccatgccggcgattaagcacgggggggctctcctgcctttaggcatgtcgaccccgtgctgatggcaacagcggagcaagccttgtggaggttnaaaggcacttcaactcgtgtcaagctcccggtttcgaaantgcccccnattttccggtcctcctcaaaacattacgtnanggtcacatggcaaaacgaaatgcanatggataantcaacatcancntcatcgataaacatgacgatcgcactctatccaagaagagtcaagttacgtataacagcatcagtatagttatncncatactcttcccttggcagctattttaatcagtca

SEQ ID NO: 29463 - DNA, 3216 bp, Triticum aestivum
  unsure (1)..(3216): unsure at all n locations
  Clone ID: PAT_TA_29463
aaaaaagctcgngattcctccgcgatttcctcctcggccgcccgccgattccctgtcgatcgagctgtcgcggtgccttggtcggattcggcaccctcagccatgacgacagaccagccagtgatcagcctgcgccccggcggcggcggcggcgggccccgcggcggccgcctcttcgcccccgccttcgcggtcgccgcctccggctccggcgacttcctccgcccgcacggcggcggcgccttccgggctctccaggattggtgcttgcatctgagtcacgagcgtgttcgttattcaagagatcaacttcttgacctgcgcaagattactgatgtgaccgagcaaatcttgaggcttcagcaggaaattgaagcagagcttcatggtgacgatcagagctgggttcgcaacgattcaaatgtgcaattgcagacacagacacagacacaagtacaagctcaaaaccggtttactgagacagataatcgtgactggcgtgcacgcacagagaaacctccagcaccggcagttccagaagagaagtcttgggacaacattcgtgaggttaaagaacagtacaatgcaagtggcaggcagcaagagcagtttaacaggcaagatcaatcgagctcccagaaagctcaggttggcccacctcctgctcttatcaaggctgatgtaccttggtcagcccgaagaggcaatctctcggagaaagacagagtcctgaaaacagtgaaaggtatactaaacaaactgacgccagagaaatttgatctactcaagggggaactgctagattctggaattactactgctgatattttgaaggatgttatctctctcatatttgagaaggctgtttttgaaccgacattctgtccgatgtatgcccaactttgttctgaactcaatgacaacctcccgaaattcccttctgaagaaccaggcggtaaagagattacattcaaacgtgtgctgttgaacaattgtcaggaagcttttgaaggtgctgacagcctgagggttgagattgcaagtttgactggccctgaccaagagatggagaaaagggacaaagaaaggatcttcaaacttagaacgcttggaaatattcgtctaattggtgagctactcaagcaaaagatggttcctgagaagatagttcatcacattgtcaaggagctactggggtctgataaaaaggcttgccctgatgaggaacatgtcgaagcaatttgtcagttcttcaatacgattggtaaacagcttgatgagaacccaaagtctcgccgaatcaatgatacctacttcgtccaccttagggagctagtagcgaaccctcagttgaccccacgttccaagttcatggtccgggatttgattgatctccgttctaacaactgggttcctcgccgtgctgagattaaggcgaagacaatcagcgagatccacacagaggctgaaaagaaccttggattacgtccaggggccacagcgaacatgaggaatggccgtaatgcaccaggtgggcctctttcgcctggaggtttttcagtgaaccggccaggaacaggaggtatgatgcctgggatgcctggatctagaaaaatgcctgggatgcctggtttagataatgataactgggaagttcagcgttctagatcaatgccaagaggcgatccgcttcgcaaccagggttcgttgattaataaggtttcatctattaacaagccatcacccatcaaccccaggcttcttcctcaaggcactggagcactgattggcaagagtgcactcttgggcaccggtggtccaccatcccgcccttccagcattacggctagccccactcctttaccagctcaaactacagcatcaccaaaaccatcaagtgcaactccagcttctgtacctattcctgacaaagcagccagttctgccaaggtgatccctgcagggcttgagaagaagacagcatctcttcttgaggagtattttggtatccgtattttggatgaagcacaacagtgtatcgaggagctgcagagtcctgattaccaccctgagattgttaaagaagctatcaatcttgctctggataaaggtgccagttttgttgaccctcttgttaagcttctggagcatctgtacaccaagaaaactttcaagactgaagatctggaaaatggttgcttgctatatgggtcgctgttggaagatattggtattgaccttcctaaagccccaacgcaatttggtgaggtgattgctcgtctgattctgtcgtgtggcctgagatttgaagccgtggaggggattctaaaggcaatggaggacaccttcttccgcaaagcaatattcacctccgtgacgaaaaccctagaagcagacccagcaggccaggccatattgagctcacatgctgcagtagtcgacgcatgcaacagcctctcgatataacagctcttggcagctcaacttctcaggtgctgtgtctagtgaaaatcagcgtatggtgtattctctatagcttaggtgtttcaccgcagaggaactgggatgtgagcaacagccagttttgagctgtatatttttgcgaggtcacatgagtgttgattattgtttcgaggacagaaagaagccatggattttggtctctctggcgacggcggcctaactcttgctggagcctgggaatgaacaaggctctttggttttcaaatgggatgtttttgttgttcatgctattattctgcatcaacaacaaaaacaacaacaacaaccatcgagccagttctccttccaacagcctctgcaacaatatccgttaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcatgtaagaacccgaactatactagttcaaacttgggaataaaagacaaacactggtcttgtctacataaaaaaaaaaaaaaaaaaaaaaannannnggg

SEQ ID NO: 29464 - DNA, 546 bp, Triticum aestivum
  Clone ID: PAT_TA_29464
tagcgtggtcgcggccgaggtgttccaaccaacacagagagctctcctcttcagacctctcccttctccccaccaggagtctagggttagagagaaagagtgagagaagagcaaaaacaacctctagccccactgttgatttaatttgccagcaggcttgttgtcaacttcatatctatcccatttcccttcaatatcttcatatcacaatgggtggcctatccatggagcacccttgggcattcgccttcggcctactaggcaacgtgatctctttctcgagcctcctggccccgataccaacattctaccggatcttcaagagcaaatccacggaggggttccagtcggtgccctacgtcgtggccctgttcagcgcgatgctgtggatcttctacgcactgggtcaagaccggtgagggcctcctcatcagcatcaacgctgccggctgcgtcatcgagaccgtctacatcgtcatgtacctcgtctacgcccccaggaaggccaagattttcacagccaagatcgtcgtcctcctcaacatc

SEQ ID NO: 29465 - DNA, 1198 bp, Triticum aestivum
  Clone ID: PAT_TA_29465
aacttagagagctctcctctccagacctctcccttcgctccaccaggagtctagggttagagagagagagagcgagacgagcaaaaacaatctctcgccccactgttatacgaagttcgcatccatctcactgttatacatctttgtatcacaatgggtggcctatccatggagcacccttgggcattcgccttcggcctactaggcaacgtcatctctttctcgagcctcctggcccccataccaacattctaccggatcttcaagagcaaatccacggaggggttccagtcggtgccatacgtcgtggccctgttcagcgcgatgttgtggatcttctacgcgctggtcaagaccggtgagggcctcctcatcagcatcaatgctgccggctgcgtcatcgagaccgtctacatcgtcatgtacctcgtctatgccgacaggaaggccaagattttcacagccaagatcgtcgtcctcctcaacatcgccggcttcgggctcatcttcctcctcaccctcttcgccttccatggcgagacacgcgtcgtctcgctcggctggatctgcgtcggcttctccgtctgcgtcttcgttgccccactcagcatcatcggacgagtcatcaagaccaagagtgtggagtacatgcccttcacgctctccctcacgctcaccctcagcgcaatcgtctggttcctctacggcctgctcatcaaggacaaatacgtcgcgctcccaaacatccttggcttcaccttcggggtgatccagatggtcctctacgtgttctacatgaacaagacgccggtggcaagccaggtcaaggaggggaaagaggcatggaaggcgcccgcagaggaccacgtcgtcgtgatcaacgtcggcaaggccgacaagagctcgtgcgccgaggtgcgcccggtcaccgagatggccggcgccgtcgacgtccccaggagatgcgctgctgaggcggcggcggcgcccggggtggactttgcccgttccgtcaacgtggtctagattcacgcacgcatgcaggcatgcatggctcatgcataagccgtgcaaccattaatattcgtacaactttattttcttttccaagaaaaaataatattcgcaccacggtctgcaggtgcctgtacctattgtatgtatgtaaaacaaactacgtatgatgattcggtaaaaa

SEQ ID NO: 29466 - DNA, 1478 bp, Triticum aestivum
  Clone ID: PAT_TA_29466
ggtttcaaccaacacagagagctcctctccaaacctctcccttctctccaccaggagactagggttagagagagagagagtgagacaagagcaaaaacaatctctcgccccactgttataccaagtttgcatccatctcatatccctctatatatctttgtatcacgatggcaggcctatccctaagaagcacccttggggcattcgccttcggcctcctaggcaacatcatctctttcacaagcctcctgggcccccataccaacattctaccggatcttcaaagaagcaaatccaacgggaggggttccaagtcggtgccctacgtcgtggccctgttcagcgcgatgctgtggatcttctacgcgctgggtgaaagaactgggtgaggggctcctcatcaacatcaacgctggccggctgcgtcatcgagacgtctacatcgtcatgtacctcgtctacgcccccacgaaggccaagattttcacagccaagatcgtcctcctactcaacatcgccagcttcgggctcatcctcctcctcaccctctttgccttccacggcgagacacgcgtcgtctcgctcggctggatctgcgtcggcttctccgtttgtgtcttcgtcgcccctctcaagcatcatcggacgagtcatcaagaccaagagtgtggagtacatgcccttctccctctccctcacgctcaccctcagcgccgtcgtctggttcctctacggcctactcatcaaggacaaatatgtccgcgctcccaaacatccttggcttcaccttcgggatgatccagatggccctttacatgttctacatgaacgcgacaccggcagtgagcaatctcaaggaggggaaagagggattgaagaagccagcggaggagcacgttgtcgtaatcaacgttggtaagatcgaaaagagctccggcgctgtggttcgcccgggtcaccgagatgcacaacgccatccccaagcagatgcgctgctgaggcggcggcaccagggcaacaagtgatggcgctggactatgcccgttcccgtcgacgtggtctagatttacgcatgcagggcttgcctcatgcatgaggcataagctatttaatagctgctaccgctgccttcaccaaccgtaaaaaaaacattgctttcacctcgtccttgataattagaggttattgcaatccgttgtttcgttttgattttatttgcgccgacagggttttaaatatgttatggtgtttttttttcatttgtagtatatcttggtgtgctacttagagacgacatttgttctgagaggagattggagttattcggtgcagggttgtagtgtccttagtccttacacatttcagctttggtgtgagccgctggtcggggcatgacttccttgagagctcatattcatgttgaaaccatgaaattgttgctatacgttcacatgagttggcccacaaaaaaaaaaaaa

SEQ ID NO: 29467 - DNA, 1387 bp, Triticum aestivum
  unsure (1)..(1387): unsure at all n locations
  Clone ID: PAT_TA_29467
ctcgtgccgaattcggcacgagctcgtgccgaattcggcacgagattttgtgtggcatatgtgtgatcggacagcttgcatacgccaaggcagtcatgtcttcctgcctatataaagcaccccattaccaaccttacaattcaggctaagagtttcaaccaacttagagagctctcctctccagacctctcccttcgctccaccaggagtctagggttagagagagagagagagcgagacgagcaaaaacaatctctcgccccactgttatacgaagttcgcatccatctcactgttatacatctttgtatcacaatgggtggcctatccatggagcacccttgggcattcgccttcggcctactaggcaacgtcatctctttctcgagcctcctggcccccataccaacattctaccggatcttcaagagcaaatccacggaggggttccagtcagtgccatacgtcgtggccctgttcagcgcgatgttgtggatcttctacgcgctggtcaagaccggtgagggcctcctcatcagcatcaacgctgccggctgcgtcatcgagaccgtctacatcgtcatgtacctcgtctatgccgacaggaaggccaagattttcactgccaagatcgtcgtcctcctcaacatcgccggcttcgggctcatcttcctcctcaccctcttcgccttccatggggagacacgcgtcgtctcgctcggctggatctgcgtcggcttctccgtctgcgtcttcgttgccccactcagcatcatcggacgagtcatcaagaccaagagtgtggagtacatgcccttcacgctctccctcacgctcaccctcagcgcaatcgtctggttcctctacggcctgctcatcaaggacaaatacgtcgcgctcccaaacatccttgggcttcaccttcggggtgatccagatggtcctctacgtgttctacatgaacaagacgccggtggcaagccaggtcaaggaggggaaagaggcatggaaggcgcccgcagaggaccacgtcgtccgtgatcaacgtcggcaaggccgacaagantcgtgcgccgaggtgcnccggcaccgagatggcgccgccgtcgactccccaagaagatgcctgctgaagcggcggcgaccctgggtggctttgcccntctgtcgactgggctagatcaccacgcatgcaantttgcatcatggttatcatgatcctgaacaactttaattccgtatataaactttcaattccaagaaatatatatccacacacggtctgaagtgctgtactactatgttgtttaaacaacactatatattcgctggtctagntgnaaaaagggggccgtacaattcccnaaggntcnatacccccangcgt

SEQ ID NO: 29468 - DNA, 1230 bp, Triticum aestivum
  Clone ID: PAT_TA_29468
ctcgtgccgaattcggcacgagcatccaccacacgagacaaggaagagtagcatccatggcgtgcatcaataccttgcagagctgctccatgttcaaaggggccaaggctgaggccagaagggggcaaagccaccggcgcagggagcttcgggtgccgggcgtccacgttcatggacgggagcgggctccggctcgggctcgacgagaaccccgacgccatcatctccggcgaagtggcccggagaacttctccctcctcaagctacgacgacctccgcgcctacctccagtcccaagcagcagcagcaacaacgacaaccatcccatgccggcgatcaggttcttcttcttgctgatcttgtggtctctgctcatctcctctcttgatgcttcttcttcctgctgatcttgtagtctctttcatctcctctcttgatgatgcttcttcttcctgctgatcttgtagtctctgtcatctcctctcttgatgatgcttcttcttcttgaccccttgcttgactttgtactcggttggctggttgcagcagcgggggcctctcctgcgtgaggccatgtcgacgcccgtgctgatggtcacagcggagcaggcgctggtggaggttgaaggccacttccagctcgtgtcaggcctcccggttgtcgacagtgcccggccgatgtgtcggggtcgtcgtcaagagcgatcacgtgagggcttcacatgggccaaagacgaagattgcagatgtgatgacatctccagcaatcacgctatcatgcgataaaacagtgaccgatgccgcagctctgatgctcaggaagaagatccacagattaccgatagtaaaccaggacaatcaagtaataggtgagtaacagaaaacgcgacaaaaccagcagcgaatgacttgtatataatactactatcattcccttaacatcgactattgtttggagtatgtttcaagcttaacgggatattctaaacactgctaacaggtatagttacccgggatgacgttcttcgcgcgttggaggccatgctgaagttttagagatgcaggagtccatgcccggtacttgtggatctgaaaatatgtgtgtccgcggtactttgagtaacaggcagatcctatagtctgtaaaagtgtttgcagcctgtatcgcaaaaaataagcctgggagcatttaggagagcttttccttggaaagaagcacgccaggaagct

SEQ ID NO: 29469 - DNA, 1337 bp, Triticum aestivum
  Clone ID: PAT_TA_29469
gcacgagggtttcaaccaacttagagagctctcctctccagacctctcccttctctccgccaggagtctagggttagagagagagcgagacgagcaaaaacaatctctcgccccactgttataccaagttcgcatccacctcactgttatacatctttgtatcacaatgggtggcctatccatggagcacccttgggcattcgccttcggcctactaggcaacgtgatctctttctcaagcctcctggccccgataccaacattctaccggatcttcaagagcaaatccacggaggggttccagtcggtgccctacgtcgtggccctgttcagcgcgatgctgtggatcttctacgcactggtgaagaccggtgagggcctcctcatcagcatcaacgctgccggctgcgtcatcgagaccgtctacatcgtcatgtacctcgtgtacgcccctaggaaggccaagattttcacagcaaagatcgttgtcctcctcaacatcaccggcttcgggctcatcttcctcctcaccctcttcgccttccacggtgagacacgcgtcgtctcactcggctggatctgcgtcggcttctccgtctgcgtcttcgttgccccactcagcatcatcggacgagtcatcaagaccaagagtgtggagtacatgcccttcacgctctccctcacgctcaccctcagcgcaatcgtctggttcctctacggcctgctcatcaaggacaaatacgtcgcgctcccaaacatccttggcttcaccttcggggtgatccagatggtcctctacgtgttctacatgaacaagacgccggtggcaagcgaggtcaaggaggggaaagaggcatggaaggcgcccgcagaggaccacgtcgtcgtgatcaacgtcggcaagacggacaagggctcgtgcgccgaggtgcgcccggtcaccgagatggccagcgccgtcgacgtccccaggagatgcgctgctgaggcggcggcggcgccgggggtggactttgcccgttctgtcgacgtggtctagattcacgcacgcatgcaggcatgcatggctcatgcatgagccgagcaaccgttaatattcgtacaactttattttcttttccaagaaaaaataatattcgcaccacggtctgcaggtgcatgtacctattgtatgtaaaacaaactacgtatgatgattcggcgtgggtcgtagctaggattggcagcccacttattctatgatgtgtttatagaccacgctccagcccataaagttcccaaagatgtttaatgaatttatcaatcgaaattatatatatatactactatctataaaa

SEQ ID NO: 29470 - DNA, 1819 bp, Triticum aestivum
  Clone ID: PAT_TA_29470
ccacgcgtccggagctactcaagcaaaagaggttcctgagaagatcgttcatcacattgtcaaggagctactggggtctgataaaaaggcttgccctgatgaggaacacgtcgaagcaatttgtcagttcttcaatacgatcggtaaacagcttgatgagaacccaaagtctcgccgaatcaatgatacctacttcgtccagattagggagctagtagcgaaccctcagttgaccccacgttccaagttcatggtccgggatttgattgatctccgttctaacaactgggtgcctcgacgtgctgagattaaggcgaagacaatcagcgagatccacacagaggctgaaaagaaccttggattacgtccaggggccacagcgaacatgaggaatggccgtaatgcaccaggtgggcctctttcgcctggaggtttttcagtgaaccggccaggaactggaggtatgatgcctgggatgcctggatctagaaaaatgcctgggatgcctgggttagataatgataactgggaagttcagcgttctagatcaatgccaagaggcgacccgcttcgcaacaaccagggtccgttgattaataaggtttcatctattaacaagccatcacccatcaaccccaggcttcttcctcaaggcactggagcactgattggcaagagtgcactcgtgggcaccggtggtccaccatcccgcccttccagccttgcggctagccccactcctttaccagctcaaactacagcatcaccaaaaccatcaagtgcaactccagcttctgtacctattcctgacaaagcagccagttctgccaaggtgatccctgcagggcttcagaagaagacagcatctcttcttgaggagtattttggtattcgtattttggatgaagcacaacaatgtatcgaggagctgcagagtcctgattaccaccctgagattgttaaagaagctatcaatcttgctctggataaaggtgccagttttgttgaccctcttgttaagcttctggagcatctgtacaccaagaaaactttcaagactgaagatctggaaaatggttgcttgctatatgggtcgctgttggaagatattggtattgaccttcctaaagctccaacgcaatttggtgaagtggttgctcgtctgattctgtcgtgtggcctgagatttgaagccgtagaggggattctaaaggcaatggaggataccttcttccgcaaagcaatattcaccgccgtgacgaaaaccctagaagcagacccagcaggtcaggccatattgagctcacatgctgccgtagtcgacgcgtgcaacagcctctcgatataacagctcttggcagctcaacttctcaggtgctgtgtctagtgaaaaacagcatatggtgtattctctatagcttaggtgtttcaccgcagaggaactgggatgtgagcaacagccagttttgagctgtatatttttgcgaggtcacatgagtgttgattattgtttcgaggaaaggaagaagccatggattttggtctctcggcgacggcggcctaactcccgctggagcctgggaatgaacaaggcttttttgttttcaaaatgggatgtttttgtgtctcctccaatgttattatttcttttcagttcttacacaatttgtaacaatgtactgtggttttggagtattctgtcggttacaatatatcgtgtcagcattgtaggagtcgaaaactgagtctaagattatttttggcttattactgtcaaaaaaaaaaaaaaaaaaaaaaaaaaaaaaaaaaaaaaaaaaaa

SEQ ID NO: 29471 - DNA, 1088 bp, Triticum aestivum
  Clone ID: PAT_TA_29471
agactactccaccacacgagacaaggaagagtagcatccatggcgtgcatcaataccttgcagagctgctccatgttcaaaggggccaaggctgaggccagaaggggcaaagccaccggcgcagggagcttcgggtgccgggcgtccacgttcatggacgggagcgggctccggctcgggctcgacgagaaccccgacgccatcatctccggcgagtggcccgagaacttctccctcctcagctacgacgacctccgcgcctacctccagtcccagcagcagcagcagcagcagccaccttcccacgctgccgatcagcgggggccgctcctgcgcgaggccatgtcgacgcccgtgctgatggtcacagcggagcaggcgctggtggaggttgaaggccactttcagctcgtgtcaggcctcccggttgtcgacagcgctcgcagatgcgtcggggtcgtcgtgaagagcgattgcgcgagggcttcacatgggccaaagacgaagattgcagatgtgatgacatctccagcaatcacgctatcatgcgataaaacagtgaccgatgccgcagctctgatgctcaagaagaagatccacagattaccgatagtaaaccaggacaatcaagtaataggtatagttacccgcgacgacgttcttcgcgcgttggaggccatgctgaagttttagagatgcaggagtccatgcccggtacttgtggatctgtaaatatgtgtgtccgcggtactttgagtagcaggcagaagatccacagattaccgatagtaaaccaggacaatcaagtaataggtatagttacccgcgatgacgttcttcgcgcgttggaggccatgctgaagttttagagatgcaggagtccatgcccggtacttgtggatctgtaaatatgtgtgtccgcggtactttgagtagcaggcagatcctatagtctgtaaaagtgtttgcagtctgtatcgcaaaaaataagcctgggagcatttaggagagcttttccttgtaaagaagcacgccaggaagcttctgctctgtactgtactgtttggtatctgcacacgaaaatgttt

SEQ ID NO: 29472 - DNA, 1309 bp, Triticum aestivum
  Clone ID: PAT_TA_29472
gcacgaggaaccaacatagagagctctcctcttcagacctctcccttctccccaccaggagtctagggttagagagaaagagtgagagaagagcaaaaacaacctttagccccactgttgatttaatttgccagcaggcttgttgtcaacttcatatctatcccagttcccttcaatatcttcatatcacaatgggtggcctatccatggagcacccttgggcattcgccttcggcctactaggcaacgtgatctctttctcgagcctcctggccccgataccaacattctaccggatcttcaagagcaaatccacggaggggttccagtcggtgccctacgtcgtggccctgttcagcgcgatgctgtggatcttctacgcactgggtcaagaccggtgaggggcctcctcatcagcatcaacgctgccgggctgcgtcatcgagaccgtctacatcgtcatgtaccttgtctacgcccccaaggaaggccaagattttcacagccaagatcgtcgtcctcctcaacatcgctggcttcgggctcatcttcctcctcaccctcttcgccttccatggcgagacacgtgtcgtctcgctcggctggatctgcgtcggcttctccgtctgcgtcttcgttgccccactcagcatcatcggacgagtcatcaagaccaagagtgtggagtacatgcccttcacgctctccctcacgctcaccctcagcgcaatcgtctggttcctctacggcctgctcatcaaggacaaatacgtcgcgctcccaaacgtccttggcttcaccttcggggtgatccagatggtcctctacgtgttctacatgaacaagacgccggtggcaagcgaggtcaaggaggggaaagaggcatggaaggcgcccgcagaggaccacgtcgtcgtgatcaacgtcggcaaggccgacaagagctcgtgcgctgaggtgcgcccggtcaccgagatggccagcgccgtggacgtccccaggagatgcgctgctgaggcggcgtcgccggggcagcaagtgatggcggtggactttgcccgttctgtcgaggtggtctagatgcaaccatgcatggctcatgcatgagtcgtgcaagctttaatattcgaacaacctttttggagggtatgcagggctctagattcctgcatgcagggtatgcgatgcctttgttctgttatatcaacgtgttgataatatgaggcataaacaatatgtatctgcagtgtatagtgcagttgccagtattgttgcccatctgaagtttcctgagataaatttattttgt

SEQ ID NO: 29473 - DNA, 1554 bp, Triticum aestivum
  Clone ID: PAT_TA_29473
tcgagcggccgcccgggcaggtgttccaaccaacacagagagctctcctcttaagacctctcccttctctccgccaggagtctagggttagagagaaagagtgagcgaagagcaaaaacaacctctagccccactgttgatttaatttgccagcaggcttgttgtcaacttcatatctatctcatttaccttcaatatcttcgtatcacaatggctggcctatccatggagcacccttgggcattcgccttcggcctactaggcaacatcatctctttcacgagcctcctggccccgataccaacattctaccggatcttcaagagcaaatccacggaggggttccagtcggtgccctacgtcgtggccctgttcagcgcgatgctgtggatcttttacgcgctagtgaagaccggtgagggcctcctcatcaccatcaacgctgccggctgcgtcatcgagaccatctacatcgtcatgtacctcgtctacgcccccaggaaggccaagattttcacagccaagatcgtcctcctactcaacatcgccggttttgggctcatctttctcctcactgtcttcgccttccaaggcgagacccgcgtcatctcgcttggctggatctgcgtcggcttctccgtctgtgtcttcgtcgcgccgctcagcatcatcggtcgtgtcatcaagaccaagagtgtggagtacatgcccttctccctctccctcacgctcaccctcagcgccatcgtctggttcctctacggcctgctcatcaaggacaaatacgtcgcgctcccaaacatccttgggcttcaccttcgggatgatccagatggtcctctacatgttctacatgaacgcgacgcccgtggtgacaagcgatgtgaaggaggtgaaggaggcatggaaggtgcctgcagaggaccaagtcgtcgtgatcaacgtcggcaaggccgacaagagctcgtgcgctgaggtgcgcccggtcactgagatggctagcgccgtggacgtccccaggagatgcgctgctgaggcggcggcgccgaggcagcaagtgatggcggtggactttgcccgctctgtcgaggtggtctagatgcagccacgcatggctcatgcatgagtcatgcaagctttaatattcgtacaacctttctggagggtatgcagggctctagattcccgcatgcggggtatgcgatgcctttgttctgttatatcaacgtgttgataatatgaggcataaaccatgtatctgcagtgtatagtgcaggtgccagtattgttgccctaaaaaaaaaaaaaaaaaaaaaaaaaaaaaagcttgtacaaaagacatctccagcaatcacgctatcatgcgataaaacagtgaccgatgccgcagctctgatgctcaagaagaagatccacagattaccgatagtaaaccaggacaatcaagtaataggtatagttacccgcgacgacgttcttcgcgcgttggaggccatgctgaagttttagagatgcaggagtccatgcccggtacctgcccgggcggccgctcga

SEQ ID NO: 29474 - DNA, 1404 bp, Triticum aestivum
  Clone ID: PAT_TA_29474
gccggccggtcctggaggctaagagtttcaactaacttagagagctctcctctccatacctctcccttcgctccaccaggagtctagggttagagagagagagagagcgagacgagcaaaaacaatctctcgccccactgttataccaagttcgcatccatctcactgttatacatccttgtatcacaatgggtggcctatccatggagcacccttgggcattcgccttcggcctactaggcaacgtgatctctttctcgagcctcctggccccgataccaacattctaccggatcttcaagagcaaatccacggaggggttccagtcggtgccctacgtcgtggccctgttcagcgcgatgctgtggatcttctacgcactggtcaagaccggtgagggcctcctcatcagcatcaacgctgccggctgcgtcatcgagaccgtctacatcgtcatgtacctcgtctacgcccccaggaaggccaagattttcacagccaagatcgtcgtcctcctcaacatcgccggcttcgggctcatcttcctcctcaccctcttcgccttccatggcgagacacgcgttgtctcgctcggctggatctgcgtcggcttctccgtctgcgtcttcgttgccccactcagcatcatcggacgagtcatcaagaccaagagtgtggagtacatgcccttcacgctctccctcacgctcaccctcagcgccatcgtctggttcctctacggcctgctcatcaaggacaaatacgtcgcgctcccaaacgtccttggcttcaccttcggggtgatccagatggtcctctacgtgttctacatgaacaagacgccggtggcaagcgaggtcaaggaggggaaagaggcatggaaggtgcccgcagaggaccacgtcgtcgtgatcaacgtcggcaaggctgacaagagctcgtgcgccgaggtgcgcccggtcaccgagatggccggcgccgtcgacgttcccaggagatgcgctgctgaggcggcggcggcgccggggatggactttgcccgttctgtcgacgtggtctagatatattcacgcacgcatgcagccatgcatgcatggcttatgcatgaagtcgtgcaagcaagcattaatattcgctattaaacttttttccttttccaagaaaaataatattcgcaccaccacggtctgcaggtgcctgtacctacctattgtatgtatgtaaaacaaactacgtatgatgatgattcggcctgggtcgtaggattggcagcccacttattccagcccataaatgttcccaaagatgtttaatgaatttatcaatcgaaattatatatatatatatatatatatatatatattatctataaaaaagaggaattctttttttaaaaaggggggg

SEQ ID NO: 29475 - DNA, 1981 bp, Triticum aestivum
  Clone ID: PAT_TA_29475
aaagttgtacataaatttcaggtggttagtgacagagtaaacattttgggttgatggttgaccttagcctcacatttttaaaacgcacacgtacacgtcatggtgataagctctttcattagtgagatgcttacagatttgccatcagaatatagaggggttttggtttttttggctgctatagccactgaaagtgacaccgcttgagccccgccggcaataggcagttccttcttggctgctacagccactagaactctggaagtgacatcgctgtcggcaggcttgttggcgcccccacgcaaaatatgatttcacagcatgtatctgatcatggtgcgattcgacgccactgaaacctcattcaatccatgggttcgctcaacttctactctctccctttcctgttgacagggtcactgacgagcatgcagcatagactgcagatgggctggtgacggtgaggtcgccagcaagtagacctagctgcagaggacaccgcctcccccatgctgctggtgggaaaccaccacgacacgagcactcttgccggagaggcaccctcaatctccgctgatggctgctttccctgatagctgagggatctgccggtgaggtcctgacaactgaaggtgagtgaggtggcctgatctggtgagaatccacaagaggagctgaagtgctgccgtgatgcatagatgggagagagcggatcttgcgggcgagggagcatatacctgagacagagccagatcgtcgagtgttttccttttctagtgtagaagaggctgcagataggaagcaaaaccaaaattaatgtcactttgatagttgtacctcacatcctgcatcaccgatcagagccaacagaacaatgagaacatccagcttacatgcaacaccatcggtggtagaactactgccgtccctaaactttcagttcagtaacacagttcggcgaggttgcaaagtggtctttgtcgcctctgctgccatcgttgtaggaacccagacccatccaaaccctagcaaggaagcagtaagcggtgaagaacagctagcatccatggcctgcatcaataccttgcagagctgctccatgttcaaaggggccaagactgaagccagaagaggtagagccagtggcgggagctttgggtgccgggcgtccacgttcatggacggcagcgggctccggctcgggctcgacgagaaccccgacgccatcatctccggggagtggcccgagaacttctccctcctcagctacgacgacctccgcgcgtacctccagtcccagcagcagcagcaacaacaaccaccttcccatgccggcgatcagcagcgggggccgctcctgcgcgaggccatgtcgacgcccgtgctgatggtcacagcggagcaggcgctggtggaggttgaaggccactttcagctcgtgtcaggcctcccggttgtcgacagcgctcgcagatgcatcggggtcgtcgtcaagagcgatcgtgtgagggcttcacatgggtcgaagacgaagattgcagatgtgatgacatctccagcaatcacgctatcatgcgataaaacagtgaccgatgccgcagctctgatgctcaggaagaagatccacagattaccgatagtaaaccaggacaatcaagtaataggtatagttacccgcgatgacgttcttcgcgcgttggaggccatgctgaagttttagtgatgcaggagtccatgcccggtacttgtggattttgtaaatatgtgtgtccgcggtacttttgagtagcaggcagatctatagtctgtaaaagtgtagtagcctgtatcgcaaaaataagcctgggaacttttaggagagcttttccttgtaaagaagcacgcccggaagcttctgctctgttatgtaccgtatctggtatctgcgcatgaaaaatgtttccatgagcaaaaaaaaaaaaaaaaaactcgagctcgtgcc

SEQ ID NO: 29476 - DNA, 763 bp, Triticum aestivum
  Clone ID: PAT_TA_29476
ctcgtgccgaattcggcacgaagcggcacgagcaacatccacaacacaagacaaggaagcagtgaagagtagctagcatccatggcgtgcatcaataccttgcagagctgctccatgttcaaaggggccaagagtaaggccagaagaggtagagccagtggcgggacctttgagtgccgggcgtccacgttcatggacgggagcgggctccggctcgggctcgacgagaaccccgatgccatcatctccggggagtggcccgagaacttctccctcctcagctacgacgacctccgcgcatacctccagtcacagcagcagcagcaacaacgacaaccatcccatgccggcgatcagcagcgggggcctctcctgcgtgaggccatgtcgacgcccgtgctgatggtcacagcggagcaggcgctggtggaggttgaaggccacttccagctcgtgtcaggcctcccggttgtcgacagtgcccgccgatgtgtcggggtcgtcgtcaagagcgatcacccaaagacgaagattgcagatgtgatgacatctccagcaatcacgctatcatgcgataaaacagtgaccgatgccgcagctctgatgctcaggaagaagatccacagattaccgatagtaaaccaggacaatcaagtaataggtatagttacccgcgatgacgttcttcgcgcgttggaggccatgctgaagttttagtgatgcaggagtccatgcccggtacctgcccgggcggccgctcgaa

SEQ ID NO: 29477 - DNA, 979 bp, Triticum aestivum
  Clone ID: PAT_TA_29477
gtggatcccccgggctgcaggcagtacacaacatccacacaagacaaggaagcagtaagcagtgaagaacagctagcatccatggcgtgcatcaataccttgcagagctgctccatgttcaaaggggccaaggctgaggccaggaggggcagagccagcggcggcgggagcttcgggtgccgggcgtccacattcatggatggaagcgggctccggctcgggctcgacgagaaccccgacgccatcatctccggggagtggcccgagaacttctcccttctcagctacgacgacctccgcgcgtacctccagtcccagcagcagcagcaacagcagtcgccttcccacgctgccgatcagcagcgggggccgctcctgcgcgaggccatgtccacgcccgtgctgatggtcacagcggagcaggcgctggtggaggttgaaagccacttccagctcgtgtcaggcctcccggttgtcgacagcgctcgcagatgcgtcggggtcatcgtcaagagcgatcgcgtgagggcttcacatgggtcaaagacgttgattgcagatgtgatgacatctccagcaatcacgctatcttgcgataaaacagtgaccgatgccgcagctctgatgctcaagaagaagatccacagattaccgatagtaaaccaggacaatcaagtaataggtatagttacccgcgatgacgttcttcgcgcgttggaggccatgctgaagttttagagatgcaggagtccatgcccggtacttgtggattttgtaaatatgtgtgtccgcggtacttttgagtagcaggcagatctatagtctgtaaaagtgttgtagcctgtatcgcaaaaataagcctgggaacttttaggagagcttttccttgtaaagaagcatgcccggaagcttctgctctgttatgtaccgtatctggtatctgcgcatgaaaaatgtttccatgagcaaaaaaaaaaaa

SEQ ID NO: 29478 - DNA, 2184 bp, Triticum aestivum
  Clone ID: PAT_TA_29478
tataacagttgcggtgaccggtgacatagtagctcttgctggtctgaaagaactattactggtgaaacactctgtgacccagataatcttgtagtgcttgagcgtatggaatttcccgatcctgtcattaaggttgctattgaaccaaagaccaaagctgatgctgataaaatggcaaatggactgattaagcttgctcaggaagatccatccttccacttctctagagacgaggaaaccaaccagactgttattgaaggaatgggagaattacaccttgacattattgtagacagattaaagagagagttcaaggttgaggcaaatgttggagctcctcaagtcaactaccgtgaaagtatttccaaaattgcagagattcagtatgtccacaaaaagcagtctggtggttcagggcagtttgcagatattattgtgcggtttgaacctatggaggctggaagtgggtatgaattcaagagtgaaataaagggaggggcagtgccaaaagaatacgtaccaggcgtgatgaaggggattgaagaaagcttgcccaacggtgtccttgctggttacccagttgtggatctacgagcagtgctggttgatggttcctaccacgatgttgattcaagtgtccttgccttccaaattgcagccaggggtgccttccgtgaaggattgaggaaagctggcccacgactcctggaacctataatgagggttgaagtgattacccctgaggagcatttgggtgatgttattggtgacttgaactctagaagaggacaagttaacagcttcggagataagccaggtggacttaaggtggttgatgctttcgtgccgctggccgagatgttccagtatgtcagcactctgaggggaatgtccaaggggcgcgcgtcatacacaatgcagcttgccaagtttgacgttgtcccacagcatatccagaaccagctttctgcggcaaaagaggaagctgctgcttaaatcttcagtattcgtagataatatatatgaggacggcagagcaggtgagtataggacatcaaggtgtatgtagctttgtagtgtcgaacccagcgggtgatattatttgccattgtttttggacctgataatgtccataattttgcaagctgttataatttcataatgaccttgtcaagttctcacaaacgggaaaacagttcgttataaattttgcttctcgtgccgaattcggcacgagcacaacacaagacaaggaagcagtgaagagtagctagcatccatggcgtgcatcaataccttgcagagctgctccatgttcaaaggggccaagagtaaggccagaagaggtagagccagtggcgggacctttgagtgccgggcgtccacgttcatggacgggagcgggctccggctcgggctcgacgagaaccccgatgccatcatctccggggagtggcccgagaacttctccctcctcagctacgacgacctccgcgcatacctccagtcacagcagcagcagcagcaacaacaaccatcccatgccggcgatcagcagcgggggcctctcctgcgtgaggccatgtcgacgcccgtgctgatggtcacagcggagcaggcgctggtggaggttgaaggccacttccagctcgtgtcaggcctcccggttgtcgacagtgcccgccgatgtgtcggggtcgtcgtcaagagcgatcacgtgagggcttcacatgggccaaagacgaagattgcagatgtgatgacatctccagcaatcacgctatcatgcgataaaacagtgaccgatgccgcagctctgatgctcaggaagaagatccacagattaccgatagtaaaccaggacaatcaagtaataggtatagttacccgcgatgacgttcttcgcgcgttggaggccatgctgaagttttagagatgcaggagtccatgcccggtacttgtggatctgtaaatatgtgtgtccgcggtactttgagtagcaggcagatcctatagtctgtaaaagtgtttgcagtctgtatcgcaaaaaataagcctgggagcatttaggagagcttttccttgtaaagaagcacgccaggaagcttctgctctgtactgtactgtttggtatctgcaaaaaaaaaaaaaaaaaaagaaaaaaaaaaaaaaaaaaggccccta

SEQ ID NO: 29479 - DNA, 1046 bp, Triticum aestivum
  Clone ID: PAT_TA_29479
cccacgcgtccgcccacgcgtccgcccacgcgtccgcccacgcgtccgaacatccaccacacgagacaaggaagagtagcatccatggcgtgcatcaataccttgcagagctgctccatgttcaaaggggccaaggctgaggccagaaggggcaaagccaccggcgcagggagcttcgggtgccgggcgtccacgttcatggacgggagcgggctccggctcgggctcgacgagaaccccgacgccatcatctccggcgagtggcccgagaacttctccctcctcagctacgacgacctccgcgcctacctccagtcccagcagcagcagcagcagcagccaccttcccacgctgccgatcagcagcgggggccgctcctgcgcgaggccatgtcgacgcccgtgctgatggtcacagcggagcaggcgctggtggaggttgaaggccactttcagctcgtgtcaggcctcccggttgtcgacagcgctcgcagatgcgtcggggtcgtcgtgaagagcgattgcgcgagggcttcacatgggccaaagacgaagattgcagatgtgatgacatctccagcaatcacgctatcatgcgataaaacagtgaccgatgccgcagctctgatgctcaagaagaagatccacagattaccgatagtaaaccaggacaatcaagtaataggtatagttacccgcgacgacgttcttcgcgcgttggaggccatgctgaagttttagagatgcaggagtccatgcccggtacttgtggatctgtaaatatgtgtgtccgcggtgcttttgagtagcaggcagatctatagtctgtaaaagtgttgtagcctgtatcgcaaaaataagcctgggaacttttaggagagcttttccttgtaaagaagcacgcccggaagcttctggtctgttatgtaccgtatctggtatctgcgcatgaaaaatgtttccatgagcaatgacttccacattccacagtaagattgactaaaaatcataataatgtatcagaagaatggaggcaatatgctttg

SEQ ID NO: 29480 - DNA, 411 bp, Triticum aestivum
  Clone ID: PAT_TA_29480
cggggggtgaagaccccatttttggaagatatgatggcaaggaatcacacctttgttgacggaagagtgctgtctttgcaggatggagtagccatcgctctgagaatcctgaactctggtgattcacccgttaccataggatcctgtattggtgtgaacgagccaactgcctcactagtaactcagagttttgttaaggctatgtttgagcgagcaatgccccatttgcgttggtcatacacttcccagaaaatggagaagatgaagcgcaagtttcacaaggtccatggcatgcccaactgctgtggtgttgtacatacaactcgcatcacatttggatcacaaaaccgtgagcatgtggagaatgaaggcatactcatgcaagccgtccttgatccggataggggggtc

SEQ ID NO: 29481 - DNA, 1286 bp, Triticum aestivum
  Clone ID: PAT_TA_29481
gtgtatatctagttttccctttttttgatagacaaccggccattcattaacatagattaactttgataatcattcgtagttggaagcaatacgcaattatagttctccaactgacgtttcatcgacaaaacaaccgcgtacatcacaggttacatgcaaggtgcgagtatccagtgaacatgattaaccattcagcagcaccggtttaataatgcatcggaaaagacattttgtgcgacaaatacagcttggtcgagagcacgacatcttttgcatgataacggagttcttgagtccagcttgatcaagagtctgcgtagggtcagtcagctgcttgggtgggaagccagtctgcaattgatacggccgcgcagctcctgggcgggatgcatcaatgaaagacctgatgtcgcccacggttgtggttgaaggttaaaccgagcgaccatgcgagtgccgtccgcctaaccttagctgtatagatgtaaagggctgcgagtcgtcacaactatgccaattgacctgggagcactgcggggctcttgggtcacaggagctggtgtggtgcaggactctcatctggctgaagaaccaccaagggttctaccaacaccctggaaagctgatcgaggccttgcaggttcctcataatctccatgtcgttttataacattgacatggacagctgtccttcgatcagcaggctccagctcttgggggcactgggacttcttgatgctctcgatgaagtctgcatttgcagggtcctcataggctcttagtggaccatcatctactgtgaaaccattgttccagaaatgtatattgtgaagaacatcctgcggtggttgaggagcagctggtgctgtctgcgcatcccctgaaagcagacgacctgttcctgcaaagctggttgagctggaagattggccttcaaaagaaggcagtggaacttgctgagcacccatcactctagcttgctcaaagattgagtccacattatttctccttgttggatcttgaacaagcatcccactcttctcgccgccggtgtagtactcctggggctcatcggagtcgctgccgctgccgcctgcgcctgggaacccggaggggccgcggttgatgtcggcgagggtgcggatgcccccgcgcccgccggacggtgccggcttcttcccgccgttgccgttggaggagctcatcgccgacgtgttcgcggtagggtttggctcgcggtcgcgtcgtgtccctgcgcgcgagtccgggtgggcggatgcgatgaa

SEQ ID NO: 29482 - DNA, 715 bp, Triticum aestivum
  Clone ID: PAT_TA_29482
gctcaacaatgatttgtgatgggaatgaagtcatgaacaactgtcagactagatatctccatctcaggggccactctatataggacttcttttaagggaccgctaaatattgtacttcttatcattatgatattaccaagcacccaaaaaaattagttggtatctcattgcacaatcacaaacagaacttgacacaatctacacatggtccccacattccattatatgcttcttatgcttgccactaaatcaggtgagtatggcagcatactgtattgtccaagcatgcccaaaagcatcgttcacaacaagtggcaaacagatggccccagagaaatctaatcaagatcacactacttgcccttgcacttacagcattgcatgctctgagctcatggcttcccaacttgtcatgatagctggacctaaactgcattgttctctttcctttatccctcacctattgtattcatcagcttaagcaccaccatcacttgagttcatccagaaagtacctgcccgggcggcaccaccagaccacgacagtggcgaaaggagcagccaatgacgagtgctgtgccacatcgccgtcagtggcgatgaagggccactgtgttttgtacaccgctgacagggcgcggttcgaggtgccgctagcatacctcagcacattgatcttcagcgagcttctgacgatgtcccaggaggagtttgg

SEQ ID NO: 29483 - DNA, 546 bp, Triticum aestivum
  Clone ID: PAT_TA_29483
ttttttttttttttagataacagaacttgaataatcttgtagccaagtttacacaagtacataacatggccataaaacacttgtaatgaagcatcaaagttgaacattacacatacatagtagtagggcggacgagaagtacataataacacagcacaagtacacaaccgaacggtgccacacaacctttctttatcctacaagccaacctttgcttctttctttctgcattcacttgacactctaccacagcctgctgcaaccgcgtcgcatcttccccgcaaagacgtcaccatcgctcgatcatggttctttcgaaatgaagcatctgatgatcatacgctttgcactggcttcttcatcagtgctccatggccgttggagcacaagcaagttcggcggtgaggatgaagattgacacaccagcttcccttaggtgacgaacatcgccattcatgagcctcaacaggtttctggagaccaggaggcccaagccctcctctgactgctgcggctcgttcttctcaaacatctgcgccattagct

SEQ ID NO: 29484 - DNA, 1417 bp, Triticum aestivum
  Clone ID: PAT_TA_29484
tgcaaatttcaccgcggaaagcttcaggtgccctcagcatggttgcatggtttgtaagcaaaaaatgtttttttggcgctgtggacgttgtacagttgcagcacatacaaaatgtgcaccatggcctctaattcatctaaaagatgaccaaggaagtgcaatttgctggaggcacccttccaattggctccttcaaaatgagaatgctgacctgacaaacaacatagaggaagtcttctgccgactacctcttccatatgttaatgaagaattcaatattgattcaaccattaggaatttcacggcaattgtttgtaaaccgccctcctacacacatatcaggcgcaatgtatatttagtcaagaagaaacgcgccgattcgagtgccgagactgggtgcacaaattgcaaatcggattctgtttgcaaagatgattgtgaatgcaggggtctttctatgagttgttccaagagttgccactgttcagatctgtgtagcaacaagccattccgcaaggataagaaaattaaaattgtcaagtcagaaggctgtggatggggtgctgttgcattggagccattggagaaaggtgatttcataattgagtatgtgggtgaagtcatcaatgacgcaacatgtgaacaacggctttgggacatgaagcggcgcggggacaaaaatttctacatgtgtgaaatcagcaaagattttacaatagatgcaacttttaaaggaaacacttcacgttttctaaaccatagttgtgatcccaactgtaaactagaaaagtggcaagttgagggtgagacaagagttggtgtttttgcctctcgtttcattgaagttggagagcccttaacttatgactacaggtttgtgcattttggagagaaggttaagtgccattgcggagcaaagagttgccaaggatacttgggcagccaactaaagaatccaacacagaacgctcttgcggctgcggcgcttgagaataataagttgctcgtgcaacagggcggctgctctccttcaagggtcaaaacagagactcgcctgttaccctggaccaactgtatagaggttccctttaacttgaggagcaaaacgaagatagaccggatatgttggggacacaaacggcagcggacgtcccttttagatccatcgtcatcttcagctagcgtgcagccatcagatattgaagctggtgcattcattctatagagagcttttgggctaagctgaagtcctgagtcgattctgtataaatatatcatgatgatacactcgtatatgagttcatttgaaacgattctttcacatttgctgattcaggacttttacggtgttgtaagttgtaacatttttttcatcccatagtcaattttatagttgaagttggagagaccaaaaaaa

SEQ ID NO: 29485 - DNA, 555 bp, Triticum aestivum
  Clone ID: PAT_TA_29485
cggtcttctgcgaatctccgattttctttgctatacaaacgttcgcaagctacttacagagctagataatcacgaaccacacgcgacaacagattactccgcgtcatacggtgcaacgggtgccgtatcgttgacctgaatcccacccctcttcttctcgttactatcggggaacggcaatttccatccaccctcgccctccggcgtactcaaccacaacctcatcaagtgcctccttggcgccggtggcgcataatctttgtacgctgttctggcgtggaatatatggttgttggacaggaactggatatcgcccacgtccagaatcatgtgcagcgcatgcttttggcatatctcctcgagaatggtaatggcgcgctcttgggcgtcggaaagagcggggacgagacctgcgtccgagaaacgggtcaaggaacggacaaagtaggggtcgaatttgctgtagacccttggattctctcccgtctcgaggtagaacacggcggttttaatccattccttctgtccaacgcttgtctcgcctttgcggtcaaa

SEQ ID NO: 29486 - DNA, 733 bp, Triticum aestivum
  Clone ID: PAT_TA_29486
gccacgcgcacggtcccgtgcacacgagctcctcagcgcccagagcagcggtgggctagggcgggggccgccgagcgggaaccagccgagggtcgacccgacggacgccgccccgcagctcctccccctcctgacccggggatccccccccagcttggagggccgacggaggggcttcatccccagccccaaaggatctcgtcagcgacgcaccccggcacgccgatccatatcaggatggccaaggtggaccccaccgccggtgggtaggacgaggaggcgactacatccgcagatacagtggccttgagccgtgtcgcccagggttcgaatgatcaacatcatgatgaccaaggtaaaccacaccggcaaagtgtgccacttgagggtgaagaggcagatgactcacaccttggggcagatctccatgttcaaacgccaataaaagcacgacgcgccggaggagaacttagacaagtagggcattgctgtttgcaaaggagatatacattctcctaagccttaagttgcatcgtcagattttagttaatgaactttattcgtggaattttgtttccattctcagggataatgctgtttaaacctctgcaagttcgtgtcacttgcatgttgggattctcagagccataaaacaaaaggaaattttgaacccaattagtttctgttttggcatcagttaatggttgggcaagaaaaaaaaaaaaaaaaaaac

SEQ ID NO: 29487 - DNA, 717 bp, Triticum aestivum
  Clone ID: PAT_TA_29487
attgcaatctagttgtggtatgttattgcgcctgcaagctgcaataataagattgtaaattccgggagccaaattggatatccacaagaacgctcccgggcgcgcgtgctcccgggagccaaattggatatctgtatagcaaccgatattgcaatctagttgtggtatgttattgctcctgcaagctgcaataataagattgtaaattccggccaatcagttggcaatatctgccatgatgctatctagaatttgtttgaggagttctagatcagaaacttggatgataagcagcagagtattccctccacccacaagaactttctcgggtaacaacaaatttcaaacggagagaccaccagctggggaaagtcggtcggatttgctccatatgaacaagctgcatgatcagatccagcccttcctaattcgagcccacacaagagcagccactagggtaccccctaaatgagaagcacctgatgtctgaccctgacccttgttcaccctccacaaatcaagaccaatccaagcaacccccactaaggcagctggaacaggaatgaccatgtaaaggtagattactccctttggtttgagaaaaatgtgaagaagcacaatggcattaactgcagcacttgcaccaagcgcgttacttcttaacacgtcccatcccgcataaatctgtctccttggagctataaaagccttatctac

SEQ ID NO: 29488 - DNA, 1269 bp, Triticum aestivum
  unsure (1)..(1269): unsure at all n locations
  Clone ID: PAT_TA_29488
cgggtcgacccggggttttctcccgaagcaaaacggaaaggaaaaaaggaagagttaccgagagacagaggagccaggggaggggggtaaaatcaagaataaattataaccgcacggccaagaacaagggagggtaaataaatcgcccatcgcctcaccgcccgggaggggatgatgtccgaaagcgaggagcacgggtcgctcctggaaaagattggcgacaagatcggcgacaagatccatgagttcaagaaggattcatcgtcctcggactcggacgacgacaagaagaagccgcataaatccaagaagaagcacctgtttggcaggaagcatccgctccacaacgtccttggcggaggcaaagctgctgatcttgtgatgtggagggacaagcagaagtccgggagcatcctgggcggggtgaccgtcatctggttgctgttcgagggcatcggctaccacctcctcaccttcctctgccacttgctcgtcatcttcctcaccgtcagcttcgtctggtccaacgctgcatccttcatcaacaggtctcctccaaagttccctgaggtcattttatctgaaacccaatgcctgataatagctcatgttctgaggaaagaaatcaatgaggctttcatcaccttgcaaagtgttgcttccggaaaagaccttaaaacatacctcaagtcaattggagtcctctggttcatttctataattgggggctgcttcagcttcctgactctgtcttacactattttcctgatggcatacacgctccccatgctctatgagaaatatgaagatgaagtcgatgttgtgggtgagaaggccctgatcgagctcaagaagcaatatgcagtgttcgatgagaaggttctgtcaaagatcccactcgtagccgacaaaaaacagcactgaaactgatgctttgaagcgttcgacacatccatcatttcatctgcagctcagcacatcaaccaaatagtctcgtttggttacctctgctgccatcacctagcaaccttttagatggcattatattgatattatgtcgactctaaagcatcggaaatttgtcttttccaagccatagaacagaacgttgtcgatggtcacacgaagtagttgcctctgcttgtcagtttcagtttcatatttgtttggtcacaagatacatatgtcatactaatttctacaactattttctatgtatgtatgattttacactttatgaaaaaaaaaaaaaaaaaaaaaaaanaaaaa

SEQ ID NO: 29489 - DNA, 1397 bp, Triticum aestivum
  Clone ID: PAT_TA_29489
ttttttttttttggaaaaaatatgtactcttattttggcaacaagcaagcagtgaaagaagtatcagaaaaagggatcattataattcgaaggctagaagctgattctaaaaaacagcaatgtcattggcatctcgaagcatcagcatccgcgttttcagataacaacaatggttctgaaagattggtcccactttctacttttacacccatacaatcttgctctaaaatgctttcagaatcaccagagcggatggccagcccctcaccgcttgcatcatcagctttaccccacagcacaacatacaggcctaggatgattacaatagcacctaacacgctcccaatatgcagttcctcgtgaaggacgagcgtggacaatattgttgtgatgaccgcgctcagcggtgtaaaaattgcgctgtaaagggggcctttcactgatatgcaccaagattgcataaaaaagtttgcgcccgatgcgaaaacgcctccgtataagatgcaggggagctcccaaatagaagcaagcttccagatctccatgtagttcgcttctaggaagaaggccatcaccgcgcattgcaaggtcgctaggaagcacatccaggttgccaaggatagtggatcaaggtaggatttacagaccggtacctgcaagatgtaccatatggagaaacagaaggcgttccccatgaggtagatgccgcctctcacccagtcatcggtcgccggcaggaggagggcgccgagaagctttgggcccttgaagaacgccatgagcattgctccggcgaggcagacgacggtgccgacgatcttggcgatgcttcttgagctcctcaagtccaccttctccagcccgatgacggcggcgatggcgaaggtgatgcccggggcgaggttggtggtggccctggccatggacggcgacgcgagctgcagccccatgaagtagaagtactgccccgtcgcgctggcgagggaggcgaggaagaggagggcgaaggcccgggggccgacggccaatggggcgcagcgtgagccccctggcggcgagcgaggcgaggaggagcgcggcggcggcgatgccctggcggtaggcgacgaagacgatggggcgcatgcccagcccgtaggccgtcttgagcgccatgtccaccagcgaagtagaagagctgcaccagcaccatggccacgcacggcttgtgccgctccgcccacgccctccagccgccgcccgccattcgccttcgcgcgcgaagaagatccgccgcgcttctcggcaggccgccggctaaggaggaggcatccggtgcggcggacaaagccaggttttgcgtgctttttttttcggacgcgtggcggaacggcttgcttcgaacccgggagtgtccg

SEQ ID NO: 29490 - DNA, 1199 bp, Triticum aestivum
  Clone ID: PAT_TA_29490
ctcgtgccgataaaatttacttcgcatggattacacggaaatgcggacaagccccatgtgccctagcttgaggaccatggggagacgatgttccctgcaacaagccccacggtagacgtacccacggcgcttattcatcatttaacaagatcaaagacccaagtctccgaaattagtgacagcgagtgacattgttctcaactccaacatttgcacacaatatcacgtggttagactaattaaaaccaaattataaaccagcacttaatctttataaatagtgcgagtacacattgttgcgcatttatttataacacacaaagtctcagctcttccccactcgttattaatagaagattcccgcgatacaacaatgaccgacattctactgccttaagctctgcagaatatactgcgcatacaggtccatcgaatactgaatggcctcgcgggcagtggtcgcaggtaagaacgcatcgacagccacctccttgttctcattcttcttgtagtcttcaaagaagcgcttgatctcttggaggcggtgaggagacagctcactgatgtcattgtagtgacggtattcaggatcatcggcgcagactgctatgatcttgtcatccttttcgccctgatcaatcatgggcataaggccaattgctctagctcggaggaaagaaccaggaataacaggctcctgcatcaggaccaacacatccattggatcgttgtcttcacaaagtgttctcggaatgaaaccatagttgtgaggatatacaactgatgagtacagaactctatcaaccttaatcagtccagttttcttgtcaagctcatatttcactttgcttccctttgtgatctcaacaacaacattgaacaccgctggagccccagggccgatctcgagatcatgccacggatgcgcggccactgccctcctcgacagcgacgaaaggatcctctcgttgagcttcggagctggccggctcgtcgagtcctcttcactcatcctgctgcgctgcggttggaggcggcctcttgaaagggggaggggggggggcggcggtgggaggaggggcggcggcggcggcggcagcgggggtgggagaaagactagattgactcgcccactctgcccccggcgcgttcgatcccgggcccgccggcggcgaaatcaggacaaggccctcgtgccg

SEQ ID NO: 29491 - DNA, 1280 bp, Triticum aestivum
  Clone ID: PAT_TA_29491
gagtttcactcggacctccactccccatctcgctctcgcggccgagagaatcgaatcggagaagaagaaggagcggagaggcctctgctgcccttagctccgcccgcccccgcaccggccatggcgctcgccgctcgcctcgtatcccgctcccgccagttatattctgtccaagctgctttgggccaatggaggtctcactcaagtccgctcatttgccaaggaggcagctcctgtcagcggagacgacctattggcagggcatcttttttgaggtgaagaaaaagtttgagaccgcacttggggttcctaaagaaggagaagatcacgattgacccagatgacccaacagcagttgctaactatgcccaacgtcatgaggactgtaaaaagaaaaggcagatcttctttacgattctcagagaatttaaaatatactgattgagactttcacgaagggcatccctgatgcaaggacgtacgttgtatacccttcagcaactcaggaaaaagagtggtcttatagatgatatggggtattgaggatatgatagatggaagctctagagaaagttgagaaggacattaagaagcttcttttgaggagtgacaagaagaacatgaatctcctcttggcagagtttgacaagataaacaaaaaaacttggcatttgctatgggcggatctttccaagaatgaagaaaatgtttgacatggaacttgaccaaagctgagctgacggaactcaagaagggaagttgttgaagcaatggagggtcaacctaaaaggaaagagggaggagtttaaaggtgaggcaatgcctgacggtcagaaagttgagacattagaaacttccaggtagttcccatgattgatgatagcccgtccgggcgaccgatttgtgttttttcttttcacgtgacggcaggtgctgtaagcccgcaccgaatggatgttattgttgtattatttttgtaataaaactgcaccgaaaatatgacagtcaaccgttgagttgggttgcttggttaccttccggcgttgagagttttgtttcttcttaggctggcaacgtgaacatcaagcgttgctgaatatgtgcctgcggctgctgttgtatgtagtagccacacattataattatatgggatgttccattgtcttgttcatgaggcattgacttgttcaccaaaaaaataacagcaaaaacgattttcaaatgcagaatcgatattcattacctcaattacccttaacaaatatgaaacatagcggctc

SEQ ID NO: 29492 - DNA, 684 bp, Triticum aestivum
  Clone ID: PAT_TA_29492
tccgcacatctcgtcgcccccgcgtccggctgggttgaaccggtagaactggtgcatttcacatctccggtctcgtctcgtctcatctcatcggcggtggtcgtcgtcgtcgtcatccggaggcgcgagaaagatcagaagaagaagccacgtgaggtccggcgatggaggattcgtgggacgaggaagggcggcggctggcggcggcaagggtggtgcacagccaggtgaggaagatcaaggaggaggagggcgacaaggtgaaggtggacgagacgtaccagcagcagcagctggccgagatgcgcctcgtcctccgggacctgggccggcagcgctcgcgctcgccgctcggccgggtcggccgcccggccatctccatcggcggcgactcctagtcctagggccggccttgctctttttttccttctagctgggtcgtcgtcgtcgtcccctcgggctctctcgtcgtgtattaggacctcttttttttcttttcctttctctctttctttggtgatcctgtccatccgtggatggggcagaggatcatcttctgctggtaattagggtgtcgttcgttcccatctctccgtgatggttgtgtaaatacttcatactcctatgtgtgagttgtcagtctcttcccttttccagtttaggaaacaaaacaggaatttttgg

SEQ ID NO: 29493 - DNA, 2271 bp, Triticum aestivum
  Clone ID: PAT_TA_29493
ggaaaaatcatctgggcaaagcataatgagatacagactgtgaatataaagactgttggtgcaaactttgaggctacagatggggaaagattgcccttagctgtgaaggaattaggcagctgtgatctttacccgcagaacttgaagcataaccccaatggccggtttgttgttgtatgcggggatggaacaatgataatctatcgtcagcttgcttggaggaacaggcaatttggttccgcgatagagttcgcttgcgccaaaggaggagaagccccatggttaaacctgctgtttttccgagggtaaacaaatgcaattccaactttataatggcacttcggaatgggttgatgcttagtaaccaatgagccacttattgcttcttggccaaatcccacaaaatgaaatccaaactctacagtggaaggcttcgcttatggggtcaatattgatgtgccggtctgcagcaacctagctgatcttatggtcttgtacggcacattttctcgccaagtgatacatcatcttaacacgctgggttggctgcagagttggtggtgctgcctgagcgttccgtggaatccctgcacgacatgggtggcgcttgtgatacttcagtgttgcttcatgaggtcaatgagcgggttcgaactgggatttgggttggagactgttttatatacaacaactcatcatggcgcctaaattattgcgttggtggagaggtcaccacaatgtatcacttggatcgccctatgtatttgatgggatatcttgcgaatcaaagtcgagtttatcttattgacaaggagtttaatgtcattgggtatacattacttctcagtttgattgaatacaagacgcttgtgatgcgtggggatttggaaagtgcaaatgagatcttaccgtccataccaaagacgcaatataatagtgttgctcatttcttggagtccagaggaatgttggaggaggctcttgagatagccactgatgctgattataagtttgatttggctgtgcagcttggaaaattagaagtcgcgaaggctattgccgtagaagcacaaagcgaatcaaagtggaagcagcttggtgagctcgccatgtccaccgggaagctcgaggcatcagaagagtgtcttctgcaagcgaaggacttgagtgggttgttgctactatactcatctctcggagatgctgaaggaagtcgaaaagcttgcttctctagcgaaagaagcacggaaaaaacaatgttgctttcctctgtctctttatgcttggtaaattggaagattgcatacaattgcttgtagacagcaatcgtatacctgaagctgcattaatggcacgttcttatcttcccagcaaagtttcagagattgtagcaatttttttccgaggggtaaacaattgcaatccaaactttataatggtcctgcagattcggctgatgcttagtaaccaatgagccacttattgcttcttggccaaatcccacaaaatgaaatccaaactctacagtggaaggcttctctaatggggtacttgaaccatgctgagaagtcagacactactcttgtggaagcgtcctgtacggcgcaggtccgtgcccaagtggtcccggtcgaagctcgggatgaaaatggagagcctgatgaagaggtaatggaaacggaggagaacgtggatgaagttggccaagtttgataccgatcaaccagaataaacagttcttgtaaatgggtatgagggtgaggaacagtgggtgctaacccaacatgatgagtaggcgccaagggaaccacagctcaatggttaaacctgttgtttttcaagggtaaacaattgcaatgccaactttataatggaacttcggaatgggttgatgcttatagtaaccaatgagccacctattgcttcttggccaaatcccgcaaatgaagtccaaactccagtggaaggctactctaatggggtcaatcttggcaggctgtcttgcagcaacataggcaattctttggtcttgtacggcacattttcgtacccaatttttcatgtactaaaatcgatgggttgggtgcagagttggttgttgatggagagctttccaataaatcgttatacagatgtgtagtatatgtgatattacaatagccataacaaccttgtagatgaaaattttctatagccaatcactgtgtgttaccattccatacatgtagcgttaatgattgtggcgcaaaaggcttgccagtgtattcttcc

SEQ ID NO: 29494 - DNA, 731 bp, Triticum aestivum
  Clone ID: PAT_TA_29494
cggcccagaggcagaacaagccgctggccagtggccatggagtgcggccagtgcagcgcgcgcttggctgtcacgcggggcgcgagctccgttcagtgcgcgcactgccgcagggcgacgcgcgtcgaacggcacggcgccgtcgtgcacggggccgtcggcttcgtcaggagcgtgttcacgaacattggccgggcgaggccgcacccggggtacccgccggtgcacggcaacaagcgcgctctcttggtcggcatcaactacaccggaacggcggccgagctgcccggccccatcaacgatgtcaagtgcatgagcttcctgctcaccctcaagtacggcttcccaggcgattgcatccttgtccttaccgatgaagagcgctacccctacaggaggccaacaagggccaacatcctattggcgatgcggtggctggtgcatgggtgcagctccggggactcgcttgtgttccacttctccggccacggtgatcaggagaaagacaaggacggcgacgagcaggacggccaggacgagagcatctgcccgctggactggcagctgaacggcgccatcctggaccgccagcccggccggcccgtccttcgccccctccggccgcccgcccgcccccgccccctcgctcccccccgccgccgcggcccccccctgcgtctccccaacctctgccagatcaaaaagaacgggaaacccctgtggattgatca

SEQ ID NO: 29495 - DNA, 679 bp, Triticum aestivum
  Clone ID: PAT_TA_29495
gtggatagccacggcgcgggcagagcgcagagcctgagcaccacctagcccgccggtccttctcgccagtcgccacacccggcgagcggcgagtccagctcctgatcaagaccttgctagttgctcctgatcgcgccatggacgccggatcggcatcctcgtcgctgcgcatagtggtcgtcccgtggctcgcgttcggccacctgctcccgtacctggagctctccgagcgactcgccgagcgcggccaccgcgtgtcctacgtctccacgccgcgcaacctcgcgcgcctcccaccgctgcgccccgccacggccccgcgcgtggacctcgtcgcgctcccgctgccccgcgttgacggcctacccggcggcgccgagtccaccaacgacgtccccgaccagcagcgggagctccactggaaggccttcgacggcctcgccgcgcacttcgcggagttcatggccgccgcgtgcgccgacgaggccaccaggcctcactgggtcatcgccgactgcttccaccactgggtcgccgcctccgccgtcgagcacaagtccccgtcgacggagcaaagtgaagcgcgcgccgagacccgccctcgttacgagcaggaggacatggctcccatgttcgacgaccaaagcgcatcgggtatgtccctcggccagcgctggca

SEQ ID NO: 29496 - DNA, 855 bp, Triticum aestivum
  Clone ID: PAT_TA_29496
gagcagctctttcttgcaggcatggcgatgagcttgacgcgtccggagcacggggcaaagtgcagtgaccaggggaggccccgcggacgcgaagccagcggctcgtcggcaatcaggctgccagcaaggacggttcgtcgggcggccggacatgccctccacggcgtgcgcgccagctcgggcgcggccaggagctctctgcgcaccgccgtgcgtagcaattccagcgtgtcgcagcgtcgccaaccgccgtgcacaacctccctgcacatcgctgccagcgcgtgctccgccgtggacgttggggccgtccttcttgcgtcgcacatggccgatgtacgtgaacgacggagctgaggaagaacgacacgacggccgactgctcgggaactggtccacaagacggccagcaaggtggtgaatcgggcaccaccgcgccgctggggctagccgtccatggccgcgccgccgcaccaagggcttcacgggcgccagtgtcaaaggcgcggccgggcgtgctgggaggcgtcttcaggccgagcgccactcctggtccaacggtcgtcggcgcgctaccggagggcgctgattcgccgcgctccaggccgagcgccatggctaggatgctcgccccgcgccatggctgggctgtgcgccacccttgctgtatgcacgatggaaggcaagggaagctccatgactcaatgtctggcatccttgacggcgtcctgtccgcaggcggcggcccggctgagctcgcaccgacctgctcctatcctacggtgaccacaatgacgagatgggcaatgcccagaacgtgcttgtttaaatgcccatgaagatggaggtagaagt

SEQ ID NO: 29497 - DNA, 1425 bp, Triticum aestivum
  Clone ID: PAT_TA_29497
cgcgggtcttgtcgcctcgcccctcccctgccctccctcccccaccccgcccccccccacttgtatggctactactagtagacacacaacacaaaacagagagcgccatgcttctccttcctcctctgcaaacgagcggcacttcgagtcgaggcttgccggttcctattttgtctgtggagaggaacgagttttacctcttgctactttttttatttatctgttcttattaatggtgttgttcttgtgtgtagcttcaggcaacgcatccgattgtctccgttctacaagatacccgaggcctctcatgaaaataaactaatataagagcgttagtgatctaaacgctcttatattaatttacggagggagtatgtatcttgaggcaaggcatccggctctttgcgttctaagcgcgggattaacttgattaccctgggatggaagcctgctacccgagggatctctttccctgcctggagccggctgtggcccatctacaagatagtaccacctcgcttccctggatcaatcggcgcctcacctcgactatatatacgccgcatcactcgttccccttccacaccagtcgaccgaatccgtggggctcaccagaagacgcgggctcagcagaccgccatccccagccgaccctctcccgagtcgacgcccaaggtgcgatggcctccaagcctgagatcccctggacagttgtggctgagtggaagtatgccagggttcgcaagcagctggccaatggctctgccagcgacgagtctgatgatctagagaaagagcatggactgacaggaattaagggaagtgtttcgtatcgccagccgtatgttctatatgttgatggcggaatatctagtgtttagagtctgatcttgtgtaatatctaggttcttatcagtgtaaattctctagtgtttagagtctgatcttttgtaatatctaggttcttatcagtgtaaattcttttgtttcttgcagtttaacttctataaatattctaggtgtaatatctagttacaagaactgtacttttaaggttcttttcagtgtactattctagttgtaaaaatgtaatatcttggttcttacaaaataatatttttccttctcttttgaataaaagcccagattcatgctgtttcagtcttggtttgttattctgttctggataatctctgttgtatacactgtaatatacaagttggtgctctgttataatttatttgtgatctgcactgtaatttcctatgttcttttattggttagtactctgtaatatacaagttggtgctctgttgtaattttttgtgatctgcaccttaattgtaattttctaggttcatttatttcagaatatacaagttggtgctctgttgtaattttttgtgatctgcactgtaattgtaa

SEQ ID NO: 29498 - DNA, 1540 bp, Triticum aestivum
  Clone ID: PAT_TA_29498
gtgctgtcgtcgcgcctggtcgtcccggctgagccgacgccggggggcagcatctggctgacgtgatgaacgcgcccggcaaggacggcgccctcgcgctcgtgctgtcgctggagcccgagagcctgcccgcgtttcttcaggtgttcgcccatgagctggcccccctcgagggcggtggacgacatctaagcggtcgccgtccgactgggccttgacggcaccgggcgcgtcctggttgtctgcaccagcgagggcgaggtcttcgtcactgccggctccgagcattacgtgatcgagaagctgttgtacgactttgtgccgtgcgacgagatgagggacctgctcgtgccgacctcgccggcgccgaacccgccctgcgccctgctgttcgtgcagatcacacgcctccggtgcggcggcctggtgctcggccaggcgatgcaccactcgatcgtcgacgcgcgcggcgcagcccacttcttcgagacgtgggcgagcatctcccgcggcggaggcgcgcccaccgtgccgccgtgcttcgaccacacgctgctcgccgcgcgcccgccgcagtcgcgcgcggtgctgtacgaccacccggagtacaagccggagccggagccggtggaccccgtgtcggcctccacgtacgcgagcgccatcgtcacgatgagcaagggccaggtgggcgcgctcaaggcgcggtgcctcggcgcatccacgttccgcgccgtggtggccctggtgtggcagtgcgtgtgccgcgcccgcgcgctccctccgtcggccggcacgcggctctactccatggtcgacatgcgcgcgcgcctggacccgcagctcccggcggggtacttcggcaacgccgtgatccgcacgtccgtgtcggccaccgtggaggaggtggtgtccagcccgctggtccacgccgcgaggctggcgcgcgcggcgacgagccagggcggcgaccacgcgaggtcgctggtggactacctggaaggggtggacacgatgaacctgccacgcagcggcatctcgcgcgcgcacctgcgcgccatcagctggatgggcatgtcgctctccgacgccgacttcgggtggggcgcgccggcgttcatggggccggcgctcatgtactacagcggcttcgtgtacgtgatgaacgcgcccggcaaggacggcgcgctcgcgctggtgctgtcgctggagcccgagagcatgccggcgttcaggaaggtgttcgccgacgagctggctcgcctcgagctgtagcatacgcatgccgtaaattaaggacgtattcctacacacactgctgccatgcatgcgtatactctgcatgcatgtacgtttgcgtcatgattaatttgctcttcgttaattactactacgtacatgtgtatgtgaatatgaacgtgtcgagcgctggtcggtaagtagccatgcatagttgtatgctgctatcttacaagctagtacatgtaataagactcgaaaaatattggacttgggcctgtgtaatctaaaaaaaaaaaaa

SEQ ID NO: 29499 - DNA, 725 bp, Triticum aestivum
  Clone ID: PAT_TA_29499
acgcgtccgcctaaaaaagcccaatggactggtgataccggaataaatggactgacatcacatgatccttccagttcaacttccaaagatttgccagcaaaaggtttgttagtctgtaccttccatccagcacagtattttaaatgtggtccttatatttaaccattttgatctccggcgaaagagcctcatataccaccagttgctgccagatcaaatggtgaggtatctcagggtcttgatgccattgaggaacatccccaaacaattgaaacggttgctgaaaggagaccatctcttagcactcagattagcatgaacgaagcctacaatcttgccattggcatgagtggtttcccatccccaaccttgactgatgtgattcttggaaaaggctcttcggctagtgtaaatggagaactaaggctactgctttcacaactctcggcttccagggggctcgaggcaacttggcttgatccaggccctagcccacgcacatatgggcgtggtgatgatttgatagtgcagaacataacaagaagaatctcgctcgagagaaatgtttctggtctggaatcactggacggaagcattatcagcgaaatggaaggtgagagcaccatcgaccggctgagacgacagattgatctagaccggaagtcgatacacctcctctgcagggagctggaagaagagaggaatgctgcggcgatcgctgcaaa

SEQ ID NO: 29500 - DNA, 1641 bp, Triticum aestivum
  Clone ID: PAT_TA_29500
gttatttccgcaaaacggatccgcaacttcgggaaaaggattggctctgaggactgggctctggggtcccggccccgaacccgccggcgctcgcccggggagtacgaccacgtgagggagctcatcaagtggggaaccgactgcctgctgctcaccttcaactcctccgcctccaccatcaacaagctctacagtcaggtgggtaccgccaagatcaacggcagcacgccggacgaccacttctgctggaaccggccggaggacatggcgtacccgcggccggtccagcaggcgagcgcggccccggacctcggcggcgaggtggcggcggcgctggcctcagcctccatcgtgttccgcgacaacgccgcctactccaagaagctggtgaagggcgcggcgacggtgtacaagttcgcgcgcgccaacgggaagcgcaccccctactcccggggcaaccctgccatcgagtacttctacaactccaccagctactgggacgagttcatgtggagcgcctcctggatgtactacgccacgggcaacaacagctacatcagcttcgccaccgaccccaggctgcccaagaacgccaaggccttcttcaacatcctcgacttctccgtcttcagctgggacaacaagctccccggcgccacgctgctgctgtcgcggctgcgcatgttcctcaaccccggctacccctacgaggagtcgctcatgggataccacaacgtcaccagcatgaacatgtgcatgtattttcccaagttcaatgcgtttaacttcaccaagggcggcctcgcgcagttcaaccacggccagggccaggcgctgcagtacgccgtcgccaactccttcctcgccgcgctctacgccgactacatggagtccgtcaacgtccccggctggtactgcggccccaacttcatgaccgtcgacgacctccgctccttcgccaaatcccagctgaactacattcttggggacaacccgatgaagatgagctacgtggtggggtacggcaagaagtacccgaagcggctgcaccaccgcggggcgtccacgcccaagaacgggatcaagtactcgtgcaccggcgggaacaagtggcgcgactccaagaaggccgaccctcacgtgctcgtaggcgccatggtcggcgggccggacaagaacgacaagttcaaggacgcgcggatcagctacgcgcagaacgagcccacgctggtcggcaacgccgggctcgtcgccgcgctcgtcgccatcaccaacagcggacgtggcacgggcgtcggcgccgtcgacaagaacaccatgttctccgccgtgccgcccatgttccccgccgccccgccgccgccggccacgtggaagccgtgaggagaggcctgcccgaccggccggttttacgccgacgttgagcaggtcgaacacttcgattgggttcggttggtagtgcaattttctggccatcatgtaaaattcttttgtattatacgtacacacgttaaccgtggcgcgcgatatgacggtggcatgcctcacgcatggcctgtactactgtagatgtttcttgtgcacaatttgggtatggacaattaatggatacttgttgattcccccagaagaacacaaaac

SEQ ID NO: 29501 - DNA, 1575 bp, Triticum aestivum
  Clone ID: PAT_TA_29501
gaggtcggcgcccggccattctgtttttaacgattcacttcggcgcatttttcagtcaagcgataggcacctccgcgtatcgttcaacggcatatttgagatcaactgctccaaggatgtcaaaattcaaggcatcattggaccttgtacttccctggagaagaaaggtcctctatcctcagatacagttgtaggtcaggggaacactagcgcttggaagatgtgtggtctagataggaaaacatcactatgcctagtatttgatatggccaaaaaagatgccccggacgcaattggtcaatcacaaaacaatctgttctacttccaattcttaacctattatcagcatcatgatgggcaaatgagattgcgatcgactacaatttcaagaagatgggttgctggttctggcagtgtgcaggagttaataactggctttgaccaagaggcagcagcagcagtcatggcacgcttggtctcatttaagatggaagctgaggttgattttgatccagtaaagatggcttgaccgagcattgattagtttatgttcgaaatttggagactatcagaaggaagcaccttcatctttcagtttgtccccgcgtctatcaatttttccacagttcatttttaatttgagacgttcccagtttattcaggttttcaacaatagtccagatgaaactgcatatttcaggatgatgttaaacagagagaatgtagcgaatgcagttgtgatgatccagccttcacttatatcatattcatttcagtcaggtcctgagcctgttctattggatgtaagcgcaattgctggtgacaggatacttttgttggattcttattttactgttgtcatattccatgggataacgatcgcacagtggcgaaaggctggttaccaacatcaagaaggccacgaggtgtttgcccagttgttgcaagccccacaggaggaagctgattcaataatcaaggagcggtttcctgtgcctcgtttggttgtgtgtgatcaatatggttctcaggctcgattcttgctggcaaagctgaacccatccgtgacatatgactccgacactcctccgcctcctgggggggatatgatattcacagatgatgcgagcttccaggtcttcatggagcatctccagcggttggcagttcagtagagcatggacgtgcagtaattttgcatcaatggcctcttctctcatgtacagcaaagaaaaccttttcatgtgtgtgtatcactgttataccggttgccacgtactgtaggccgacataccactgttagctccgcatgtgtacattgccatggactgtaaggtttatgtcgtatatcccgagatggagcattcataaattgtgttgttagcgcaacatatggttgatcactgcttacaccaaagaagattgtcatcgtctgggtgttcaagcttagtggtgaagaggattttttaagtcatgtgttgatagagatggtgtggttgctgcgtctactaaggtttattgatagcaggtgtttgctccaaaaatgtgtgataattgatgttatggtggtggttt

SEQ ID NO: 29502 - DNA, 489 bp, Triticum aestivum
  unsure (1)..(489): unsure at all n locations
  Clone ID: PAT_TA_29502
cggacgcgtgggcggacgcgtggggtttgccgggctgccgtacacggagagcgctgcgaatccgggaagatgctgctacccaactgtcgccgcctccttgctcggcttcttgccatcctcacgttactgctgctaatcgtcggtggacatgcaggtcgtggtggaaggtttgttccacgtccacctgcaaactgcgattctcgtcagaacccaggcggttgcccacgtttgccgcctccgaactgtccaggctgtggatagcagcggagctcactcccaagcatatgtcgtcgacgatggtcttttagtatgtcttgtgttatatttctcgtgttataagagagatttatcaaggtcacaatcatttacgtacaacatgttaaggaaaacaagcatagctgaatatataagacaggtgatgtgcttccggcttccggcttgaccaggattnttcccccttccaaggattctnatgcggggcnaacccng

SEQ ID NO: 29503 - DNA, 535 bp, Triticum aestivum
  Clone ID: PAT_TA_29503
tccacaacaagtcgccaaatgatccattccctgcagaatggggggttggttcaatatttggtgccgagtgtgagaagcgtggtatgcttatcagggtcgctggggataacatcatgctgtcacctccactaataatgactcctgatgaagttgaagaaattgtgagcaaatatggcggggccctaaaggccacagaggaaagaattgaggagctcaaatcagccaagaagtgagcaatgccaatttgctgaaagcctctagtgatgatggtgacgacaatgtacagagtgacttgaacaaataaataccaataataacaccgtgagcctgaaaattgatcttgatgtggaaatgtcagttcttatttaccatctccagtcacagaatatgcacgtttgtgaccggacggaatggctgcactgtttttccaactattatggcaactctttggtgtcgttcatcagcgtcatgtttgataaaaaataacttggtagtgttgcacttcctgaattaaattaatccgcctagctaaata

SEQ ID NO: 29504 - DNA, 531 bp, Triticum aestivum
  Clone ID: PAT_TA_29504
taccggtcttatattcccgggcccacggggatgaaaatggcggagctcaaatcgaagaaaaactagacaagatgcagcacaacgacgatgataatgtcgactgcggcgttggtctcggatgtgtacagaataattcctcgctatcaggtggtaataacgcaccggaacggacgctgttcttgatgcgcggaatggcaaggcaaagcattctttcaccgagcaatggtgattgacgacttgattacagacaagatagatttggcacattcttacctgtaaagataatttgccaaataaagccgtttataagctttgccactttgataatctcttgtactgacacaatttgaaagaattcctttgagatcaaaaaaaataaaaaaaaaaaaaaaaaaaaaagcggccgctctactacgtaaaaaaaagttagaaccccctcatgaagatcaattataaaaattatcttagaatgccaagaaatggctgctacaattgggacaccaaaatctcggtaaacaaaaaggggggggc

SEQ ID NO: 29505 - DNA, 499 bp, Triticum aestivum
  Clone ID: PAT_TA_29505
cccacgcgtccgcccacgcgtccgcgcttacttccaaggttacaggtgagtgaaggtgccttgcaaggttacaggtgagtgaaggtggacggaaaccaggggagatgatgattgcccgcggctgcctcctcagatccaagctggctgagagcttagtgaaacatgtagccagcggtggaagctggcatgggttgcatagtttttcagaggcatcagccaggggtttcagctctgagccgtctcttcagcccgactcgacggaagaaatcgggttcaaggggcatggcatgctggctccattcacagctggatggcagagcaccgatgtgcatcccctggttattgatagatctgagggtgcatatgtctatgatatcaatgggaaaaagtatatagatgctcttgcaggactctggtgtacagctctaggtggtagcgaacctcgactagtcaaagctgcaacagagcaattaaacaaattacccttctatcattcctt

SEQ ID NO: 29506 - DNA, 1237 bp, Triticum aestivum
  Clone ID: PAT_TA_29506
attctcgtctctctcccttacccttcgcctctcgctctgtatctctcctctccgacggaagcagccatcgctgatcctcctatgtggccgccgagatgattgcgcgcggcctgctccgatccaattcctcatcgcaggcaagcaaattagtgaagtatttaaccagcgccgggagcttacaagggcatgcagacagcttgtcagatgcatcagtcagacatttcagttcagcatcgtctcctcagacgaactcaactgaagaaaatgggtttaaggggcatggcatgttggcaccattcacagctggatggcagagcaatgatgtgcatccgctggttattgagagatctgaggggtcttatgtttatgacatcaacgggaataagtatctagattctctagcaggactctggtgtacagctttaggtggtagtgagcctcgattagtcaaagctgcaactgaccaattaaacaagttgcccttctatcactccttctggaaccgtacaaccaaaccaacattggatcttgcagacgaccttcttagcatgtttactgcaagcaaaatgggaaaggcattcttcacaaatagcggttcggaagcaaatgactcacatgtcaaactagtatggtattataacaacgcattgcttgaggccaaacaagaaaaaggttattgcacgatcaaaagcatatcatgggtcaacattaatatcagctagtctaactgggcttgctacgttgcaccaagacttcgatctgccaggaacttttgttctacacacagactgccctcactacttggcgttatcacctacctggtgagacggaagaagaatgtgctgctacgacttgccaataattgagagaatcttatactcacagaaggaccagacacgattgcgtgccttcattgctgaacctgagattggtgctcggcggtgtcactcctaggctccaaaaacatattctgagaacattcaagaaggtggtaagaagcatgacatgcttttaatagtggatgaggacagtacaggattgggaaggctggtggctatgtgttggatctgatttgtatgacatcaatccagatcttgatgccttggcaaaggctctgtcttctgcatatgcccccattggagcagtactcgttagccgggaaatatcagatgtaatttattctcatagcaataagcttggtacatttgctcatggatttacatactctggacatcct

SEQ ID NO: 29507 - DNA, 1647 bp, Triticum aestivum
  Clone ID: PAT_TA_29507
accaacattcatcttggggaagatggagactcctcgtggcctactccagtcagatgcctcggccgatcaggtggcttccgaacggtcagactctgttcaacaacatggggttgataaggagcatgccatgctggcaccgttcacagccggatggcagaccgcaatctcgccgacattgattatcgagagatctgagggctgttatatttatgatgccaacggaaacaagtatctggatgcccttgcaggattattgtctacagctttaggtggtagtgagcctcgattagtcaaagctgcaacagagcaattgaacaagctgcctttctaccactccttttataatcatacaacaagaccctctttggatcttgcgaacgaacttattagcattttcactgccaggcaaatggggaaagtgttctttacctgcagtggttcggaagcaaatgactctcaggtcaagctagtatggtattataacaatgcattggggaggccaaagaagaagaaaatcattgcacgatcacaatcgtatcatgggacaacatacatatcagctagtctcactggtcttcctgccctgcaccagaagttcgatctaccagcaccttttgttctgcacacagactgccctcactactggcgcttccatcttcccggtgagacagaagaagaatttgcaacaagacttgctaaaaatttagaggatcttatcctcaaggaaggaccagaaacaattgctgcgttcattgctgagcctgtcatgggtgctggtggtgtcatccctcctccaaagacttattttgataaggttcaagctgtggttaagaagtatgacatccttttcatagtagatgaggtcattaccgcatttggaaggttgggaaccatgttcggatctgatatgtataacatcaagccagatttagtcaccttggccaaggctctttcgtctgcgtatgtgcccattggagcaacctcttgttagccccgaaatagcagctgtggttgattctcagagcaataagctaggttcatttgctcatggctttacatactctggccatccagttgcttgcgctgttgccattgaagcgttgaaaatctatcgggaaaggaatattcctgatcatgtgaagcaaatcgctccacgcttccaggagggaacgaaggcctttgcaggaagcccaattgttggggagatccgtggtgtaggattgatactcggaactgagttcgccaataataaatcacgagatgacccattccctgctgaatggggtgttggtgctatattcggacaggagtgccagaagcgtggcatgctggttagggttgccggcgacagcattatgatgtcaccgcctttgacaatgacccccggcgaagttgatgagctggtgagcatatacggagaagctatgaaggcaacggaggagagagtggcggagctcaaatcgaagaaaaactagacaatctgtaaagataagagagattgacgacttgattgcagacaagatagatttggtacattcttacctgtaaagataatctgccaaataaagccgtttataagcttgcccactttgataatctcttgtactgacacaatttgaaacaatttgaaagaattcctttgagatc

SEQ ID NO: 29508 - DNA, 2086 bp, Triticum aestivum
  Clone ID: PAT_TA_29508
cttgtcgcgaaccgccctcgcccttcgccccctgtcgtgcctctccgacatgcatcgtgagctcgaagcggactgcttgtgctctaccccggttgcctgcttcgtgcgcccagctaggtcctaatggaacatattcggatcagtgaaatctggaatcggtggcgagggctttcaggggcatgtgccaagcctgtcggctgtcagccatctccgtgacacttcttggccgacgaaatcgggttcatgggatatataatgatggatctgcgtgaagcgggctgttcgcgtcatgatcttcttcgcctggacagtgaatgatctgcaagggcttgtggctgcgagatctgatggggaaaggatttttatgcttctgcaggactcaagtgtcccgctcttgaagcaagaaaacctcggcttgtcaaagatgtaagatggtagggaaaacctatggtgcttcaatgatactcgcaacttaggtagctcaaaatactatacgaccttttcgaatcacggctgcaacgggtcatcggaacatgcaatggcaatagtattcgtagcgtaacgtgattaaaaaagtaaccggcgcaatggtgaaaatggcatcgaatttgaacaagacaccggggagacgataatagtattaatgaaatgctacggaaaaaccatataattcaccgatgagagtatcgcggaatttctaaattcgaacgaatattaataaaagatgcagtccaacggtaatgttaacgtccgactgcggcgatcgcctccagtggcgtttcaatctactcccacgctgccaggaggactaataacgcactggaccggcagatattcttggagaatctgaatcgaaaagcaatgaccaagaaacagatggttacttacaatgctgatccgggacaagggtgccggtggtgctctcccaccctcaaaagattttctgtcagaataatcccgcttaaaacgatgcctctttaatattctcaagaacagatataatgagtaccacatcgaagtcattgtgaagcatggtcttctctgcattgtagaagatgccatcaaagctcgtctctgttgcggagcccctttctccagcttacatgccaattgccaatcctcttcttggcccagaagtagcagatgtagctccttcgtatggccccaaactaggatctcttgttcacggctttacatcagccgggcatcctgttgcctgcaatgttctcggtacatttgctaagagctttacggacaggaatattcctgtttcatgtaacacaattgttagaagcattaaaaatttatcgggaaacatatcattccgtccaatcattggggagatacgtggtgtgggattgctgctaggaacagagttcgctgacaacaagtcgccatatgatttattcccttctgagtggggcattggtgaaatatttggtgccgagtgtaagaaacgtggtatggtggttaaggttcttgggaacttgatagcgatgtcccccactgataatgacccttgaagaaattgataaactggtgagcatatatggagaagccctaaaggtcacagaggaaagagtagcggagtgtaaagccaagaaggagtagttagcatatgcaatgcataataatggtggcaaggttgcggcgatgatattggtttgtgcatggaataaatcccttggtgttgtgtttttaaataatttgttaagatatttatcttattgggccaaaagaaggctattatctttctaaaagagcgcaaattgtatttttttttttcatgaaagaatgtatattttgattatctcaagaatatatatggaaaatgtgtggactaaaaaaaaaaaaaaaaaaaaaaaaaaaaaaaaaagaaaaaaaaatttaaaagaaacaaaattaaaaaacacaagcatgcaaaaagcataacctctaatatagtgcaaccgtaaattaaattaacatgaccgtaagttgggcaacgccctttattgaaaaaacctttagcgccacccaacttaaagccccttgcgttttttttcccctttccccaattggcgtaataccgaaggggtttaaaacc

SEQ ID NO: 29509 - DNA, 913 bp, Triticum aestivum
  unsure (1)..(913): unsure at all n locations
  Clone ID: PAT_TA_29509
gcatgcatgaatcagaaacatttgctgagattcatcaagtccaaactgagaaaagaacctgatgaggttgttattttcagagatggtacatatatgactttgaaggaggtttttgaaagcttggacttaactgggtatgacttgaatgttgatttgctagatgtccatgcggacaaaagtacgtttcatcgttttgacaaattcaaccttaaatacaatccatgtggccaaagtaggctacgggagattttccttaaacaggacaatcttattcaaggacgatttcttgctgagctgacgatgcaagttttttctgaccttaatgcaagcaagtatcagatggctgaatataggatttcaatctatgggaggaagcaaagtgagtgggaccaacttgcgagttggatagtaaacaatgaattgtacagtgaaaatgttgtttggttgattcagattccacgcttatataacgtgtaccagcaaatgggcattgttacatcatttcaaaatcttcttgacaacattttccttcctctgtttgaggttactattgatccagcttcgcaccccgcagcttcatgtcttccctaaagcaggccgtagggttagatttggttgatgatgaaagtaacccggaagngtccaactaacacatgcctacacctgaaagaaggacgatgtctcaaaccngatttcanaataagcatactacggcnanctacttnttcacacngacaacgcgnagcanagggagatacancaaatccgtcanatccgtgangcggaacntgatacttgaacaacattctcttgccatannccatgatcanttaggagncccgtctcaaacnncaccttgcaattgcngaantcccccaaaaancctttntgncacgacctttcagtttaagng

SEQ ID NO: 29510 - DNA, 1350 bp, Triticum aestivum
  Clone ID: PAT_TA_29510
ttggacgcgtgggcggacgcgtgggtggtactacaactactacgacgacaggcgcgtcgggggggcgtctcgccacaactttaattttgcggaaaaggcccctccaactaccggcgctggacgaacgtgggcgatgctccggccatcgccgtattcgtcgaggcgtctcctccagagcggcgaccccagccgcatcccgggcatccccccggccgatccgcccgccggcgtcagctcggatgtcgtcgtcatcctcgccgccctgctctgcgcgctcatctgcgtagtcggcctcgccgccgtcgcgcggtgcgcgcgctcccgccgcaacgccaacgcccacgccaaccaatcctcgccgtccggcagcccggcccacgccctggcggccttcggcgggggcggcggtgggcataaccatggtactacaactactacgacgacaggcgcgtcggggggcagcgtgacgaccaccagcaaggggctcaagaagaaggcgctcaaggcgctgccgaagctggcgtacgcggacgcggtggccgcggctgcggcggcgaggggcgccgtggcggggggcgaggaggaggaggggcaggacgggatcctcgccgagtgcgccatctgcctgacggagttcggcgagcgggaggaggtgcgcgtgatgccgcagtgcggccacgggttccacgtcgactgcgtcgacacctggctgcgctccaactcctcctgcccgtcctgccgccgccccatcgtcctcgacgaccccgcgccgcccaagcggtgccgcaagtgcgaggagaccatcctggaggcggtcatcgcctcctcgtcgtcgtcggccggcggcagccgcggcggcggccgtgggggattcttgccgtagtagcagtagaagaggcgtcatgtcccctggcgggtgggtccaggtcggtgtgggtagttgagctgctcctttctgctgctggcccacgctgcagtactaccgcagtgaagtttttcttctcaagaaatggaagggagaataattagagctgtgatgtgaacgtgactcttttctgcaacctttttcgccctgcacttgcgctactgctccagtacgtgtggatgtggggaacatgacatcagatttgtaaagagcgtgcgtggtctcgtgtaaaaatatatttgtactggatatagcttgctcaaaagaggcaaagaaaaaacattttacatgtggatccggcaagctagaaatatgcagctcgtgtctgaaaatctgtttggtgtgggcgatttgggtggaagttgtggagtaatggcagttatgaaataccccctccgtaaaaaaaaaaaaaaaaaccccaaacc

SEQ ID NO: 29511 - DNA, 661 bp, Triticum aestivum
  unsure (1)..(661): unsure at all n locations
  Clone ID: PAT_TA_29511
catggnaactcactcgcctgagcctcgtcctactctgcgccggattgccactgctcctcttctcgcgtgcagaggcaggcgaggtgggcgtgtgctacggcaggaacgggaacaacctgatggacccagcgtcggtggtgcagctgctgaagaagaacggcatcacgtcggtgagggtgtacgacaccgaccagggcgtgttggacgcgatgaagaacagcggcataaagatggtggtggcggtacccaacgagatgctcccgtccgcggccggggacccagactgggccatccagtgggccaacaacaacctgttgccctactaccctgccacggatatccgtggcgtcacggtagggaacgaggtcttcaagcaggcaagcgagcatacgtcgcacctcgtcccggccatgaagaatgtccaggcggcgctggctggcctgggcctcgccgacgccgtgaaggtgacgaccccgattgcgctcgatgcgctgaagctatcgttcccgccgtccgaaagctcgtacctcatggtcaacatctacccgtactacgcgtatgcgtcgtcaattcttggngcaaaaaaggtccttactcaatgggtcaaaatttaaccgttataaccgttantccntccttcaaatggggncaatggggcaat

SEQ ID NO: 29512 - DNA, 451 bp, Triticum aestivum
  unsure (1)..(451): unsure at all n locations
  Clone ID: PAT_TA_29512
ggatttccgcagggcatccatggatcacgagctgcggtggacatgcggtcgcgggctgaagaaatggatcgaccaaggctccatccatgatccatctgtagatagaagatcttctgcgcagatgagacgacggctcaatttctgcctcgttgatctcatcctgccagcaaattggcgatggacaagaagcggtggtggtgccggagttcagttcagtcagtagaagtagcgctaattcagtctgtgatcgtttaaggtcgagaggtggtggtggtgaagctagaattgcagaagctttcacctcgctgagcctgaacctgtttgttctgaatctctgtacttgtagatacagtcttgttcagttctagctgaagaagaagagggttagtaactacgtatagtgcttaagtagtcggcagagtttgttcacaagaacgaaaatggagcnnna

SEQ ID NO: 29513 - DNA, 1268 bp, Triticum aestivum
  Clone ID: PAT_TA_29513
ggtacatgtgaaaacttcacgtcgatgttaatttaggcatgcttacccctaatgttatttctcaatccagcatatgaggtttggcaggatgagcacgtcttgtctccagtaaggatccgaccctgaacacttgtggcaaaattgcaggctggatattactaagtgtgattccaaacagctcgaaactctccaaggcttcaggaaagagttgctctatgctcgtcgtgaattcagcacgaaaaaggactggggcatgtagtttaacgcctgttttatacactgtcaatcaagtgaataccttagacgtggcactggtccatctgcccgaaggaatttataacaagacaatcagctgaagcgttgggaaacaggttccttttaaccgggacctgcggaaaaagtttactcactgcagttcagatatggagccaggacagtgcatttttccacgggaagttgcaaaaggcatccacaccccaatgttcattctcaatccagcatatgatgtttggcaggtggagcatgttttgtctccagaaggatccgaccctgaacgcttgtggcaaaattgcaggttggatattactaaatgtgattcaaagcagttggaaactctccaaggttttaggaaagagttgcttgatgctataagtgaattcaagaagaaaaaggattggggcatgttcattaacgcctgctttatacactgtcaatcaatgaactccttgacttggcactccccatctgcccctagaatcaacaacaagacaatcgctgaatcggtgggagactggttctttaaccggagagaggtgaaggaaatcgactgtgaatacccctgcaacccgacatgccacaacgcagtcctcgatcaagcttacaaggaagaatgacagacattttccgccaaagcattttggtgattttcagcacagtttgtcctacgtgtgctcagaaatgggcagtagttaagttttattgagggaacaccgagctcagatttgattcgaacatgtactcgagaagtgttgaaatatagaaactgtagattggcagagggagacaattgataactgatgatatgatactggtatgtatgtatgtccttgtggagaagcatgagcctgtcagctcagtgcgcatgcattatttccaaaccataaaagccggctagtaattaatactttctccgttcctaaatataaggttttttagagatttcaataagaactacatatggatatatatagatatagtattttagagtg

SEQ ID NO: 29514 - DNA, 713 bp, Triticum aestivum
  Clone ID: PAT_TA_29514
ggagttaaacaaacaaatttgaacgaaaccccaagttctgtacatatgtgcgcataatgtgattattacaacactataaggaaaacataacctatcaaagacgctgtatatctgaggccaaaagagaatgaaagaattggtgtccttacaaaaaaaataccagggcacaataagtctctccaaccagtgtgtttctatactgtacacatctcagcagaagtttctcaaaccgtatacatgtatgtgtatccctaacggcgattggttcggagcgacttaaactgtgcagcgaaagaatcatagtctgttggaagcttggggtgaacatgggcaggaccagctgttggggtgcttactttcagggtctctgctgaggtctctctgtttccctcgttttctggagaagaacttccctccggttcatcttcttgccacctgtctctagctgtgggaggttcaatgcgcacaggatttggcgaagattgctgtactgaaaccctggagtatgcaggtgctgcttttctttgttcagtactcgagttggagaatgctttagcagggctttttggcatgctttcagtttcaacagcatatggtgctccagcccgggctcggccatctctctttgtatcgggtgctacctccctggtcctccgtgattgtatctgctccccagacaactttgtccggccagaccggcgtcgttccaattc

SEQ ID NO: 29515 - DNA, 489 bp, Triticum aestivum
  unsure (1)..(489): unsure at all n locations
  Clone ID: PAT_TA_29515
cgtcgacgctgatggtcttgccgtcgacgctgatggtctcgttgtccacgatcttcacgtccgccttgaaggtgcccagcatcgaggtcgtctccaacagggaccccctcaagctgccatgggccgagctcgggatcgacatcgtcatcgagggtaccggagtgttcgtggacggccccggcgccgggaagcatctccaggctggcgccaagaaggtcatcatcactgctccggccaagggcgccgacatccccacctacgtccgtcgggtgtcaacgagggcgactacggcatgaggtccccaacatcatcaagcaacgcttcctgcacaacaaactgcctcgccgccattcgccaaggccctggacgaagatttcggatccctgaaggggacatgaccacgaccactccgtacacgggcgacaaaagctgctggacgcgtccaacgcgacttctgagncaaggccgcggcgctgaaatcctccgaca

SEQ ID NO: 29516 - DNA, 704 bp, Triticum aestivum
  Clone ID: PAT_TA_29516
gcacgaggcggtggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgccaacgagctcaagggcatcctcgacgtctgcgacgagccgctcgtgtccgtcgacttcaggtgctccgacgtgtcctccaccatcgacgcgtcgctcagcatggtcatgggagacgacatggtcaaggtcatcgcgtggtacgacaacgagtggggttactcccagagggtcgtcgacctcgccgacatcgtcgccgaccaatggaagtgaacgccggacggcggcattattgccctgtgaagtgactcctctcgaaattttccccagccatcgtcacggatgatcgattctttgtaatgagaattcgaagtatcgagctcccaacagcttcttttttttcctttcttttcttgttcttcttttttctttctctgatttttcagtgtccagacacggattataatagacttcctgcaaaggaagtctcaacgctgtgcatctgtaatatatactatcgtttgccaggttctgatgtagaaaaaaaaaaaa

SEQ ID NO: 29517 - DNA, 601 bp, Triticum aestivum
  unsure (1)..(601): unsure at all n locations
  Clone ID: PAT_TA_29517
gcacaacacacgaatccgcagccatggcttcccagctctccgccatgacctccgtgccgcagttccacggcctcaggagctactcctcgcccaggtccatggccacgctgccgtccttgaggaggaagaggtcccagggcatccgctgcgactacatcggctcctccaccaacatcatcatggtgaccccgacgaccctggatgctgttcgccgggcggttcgggctggcgccgtcggcgaacaggaaggcgacggcggggctcaagctggaggcgcgcgaantccgggctgcaaacggggcgaacccggccgggttcacttttgccgacacggttgcatgcggctcctttggccacattttgggggtcggcatcgtgctcggcctcaaaaacaccggggtcctcgaccagatcatcggctagaaccttccttttccgtcgaaaactgttttgcatccgcatcgcgcgctccatgtagtggatcaattaatgctccctttgtgatttgatgatgtggtgtagtacaatgtatgtatgtgtatgcatctttgtttcaacgggacgtacccccgcgccggtgtggcaactgcttcatcccatg

SEQ ID NO: 29518 - DNA, 625 bp, Triticum aestivum
  Clone ID: PAT_TA_29518
cggcacgaggctcctccccgccgcttcttctcccgcccgccgccgccgcctccgcctccgcctccgccagtctcctggtaatttctcttctctcttctctccccaccccaatcccgccccccgactccatcagcgattgcacttctcgacggtctcactgatacggttgcttccgctccgtcggatttttcaaggttgattccggcgccttgaaccaagatgtatctccagtactacatcaacgagaagggcgtcaaggtgtacaccaccaagaaggaatcccctctcggtgtgccgacgcagtctgcccacccagctcgtttctccccggatgacaagtacgcccgtcagcgttacctgttgaagaagaggtttggattgctgccaacccaacagccagcacaaaagtactgaagcactggatgggtcctcctaagagatctgttttctttgctgaatgctgtttggagtgtagattagctatgtgaagagagaatcatcaccgctacttatcttgcttgttattgcagtacctctaaatgtaatgttatgctatacgatggatcgtactcttttgtactatgtgctctctgtgtgactaaatcatttgggatcaaaaaaaaaa

SEQ ID NO: 29519 - DNA, 632 bp, Triticum aestivum
  Clone ID: PAT_TA_29519
accagcaccaccaccacgaacagcagcaccaccaccagcagcagcaggaggacggggaggacgagcgcgaggacggcgactccgaggaggagtccgggcagtagcaggctgttgtccacttgttatcaccacatctgtttctgttaatttctgcagaaggagaaaccaaggaaggagagaaaactgtatgcacgcagctatggcgacgctttgattacctttaggttgttgttgttcgtttcttgggcttgtgatgagtttttaagtcgatttttttcacttgtggtgtccaaaactcaaaagaggcttcttgctctgggcttttagtggaatggatcagggattcaggctcatcctcagctcctactcctgctgctcttttgatcatccgccagaattccctccggttcaggtgtataatagctgagagctggatgtttgcgatcatcctcccctgagtgagcgccttatatgttgttattgcaaggtgtgtagatattcaggtgattttgcagctagggaggtgttcttttataggagcagtgatctgctcttgagcgatcaagatgatggctggcaattttatcctcccttcacgggcaatttctgcaacgaaaatatgatccaataat

SEQ ID NO: 29520 - DNA, 799 bp, Triticum aestivum
  Clone ID: PAT_TA_29520
cggcggcgctgacatcgtgccgacgagcacgggcgccgccaagccgtggcgctggtgctgccccagctgaaggggaagctgaacggcatcgcgctccgtgtgccaaccccgaacgtgtccgtggtggacctggtgatcaacaccgtgaagacgggcatcactgccgacgacgtgaacgcggcgttccgcaaggccgccgacggcccgctgaatggcgtcctgtcggtctgcgacgtgccgctcgtgtccgtggacttcaggtgctccgacgtgtcctccaccatcgacgcgtcgctcaccatggtcatgggcgatgacatggtcaaggtcgtcgcctggtacgacaacgagtgggggtacagccaacgcgtggttgatctggcgcacctggtggcggccaagtggccaggcgcggcggcggcgggcagcggcgaccctctggaggacttctgcaaggacaaccccgagaccgacgagtgcaaggtgtacgaagcatgatgaggcccccttgttgtaggccaggggccgccgtgtgctcagaaaattcactagctttgcctcgtgttctttcgatagagaatactatatacagattcgccgaaagagacgtagacgaaaatgtgccgttttctatgagttgtgtatgtaatcactgaactcgtacaggcttccgcttttcgatcatttcctgttgggactcctgtaattctgcggtgtgtgtttatttcatcaatcatgccgacatgatcgatccatcatatacttttatactaatataagtacatgtaaagatttcgtg

SEQ ID NO: 29521 - DNA, 600 bp, Triticum aestivum
  Clone ID: PAT_TA_29521
gcgaaacacctctccctcactctcacctccgagaagctccagcggcagccatggccccaaaggcagacaagaagccggcggccgagaacaaggtggagaaggcggcggagaagacccccgcggggaagaagcccaaggccgagaagcggctgccggcaggcaagacggcgtccaaggaggccggcggcgaggggaagacccggggcaggaagaagggcagcaaggccatgtccatcatgaactccttcatcaacgacatcttcgagaagctcgccggcgagtcggccaagctcgcgaggtacaacaagaagcccaccatcacctctagggagatccagacctccgtccgcctcgtcctccccggcgagctcgccaagcacgctgtctccgagggcaccaaggccgtcaccaagttcacatcctcctagactgacgacgcgccgcttgttgtgacagatgtagttggctgctgttagtcgctgactctgcttatgtatctgcaagtagtggtaggagtggtcgtctgtgtgccaacgcttcgttggctagttggttgtcagaactgaagttgctaatctatctgaaaaaaaaaaaaaaaaa

SEQ ID NO: 29522 - DNA, 661 bp, Triticum aestivum
  Clone ID: PAT_TA_29522
aaattgaacgaaatcccggggttgtgtacatctgtgcgcgtaatgtgcttattacaacactacaaggaaaacataacctatcaaagacgctgtatatctgaggccaaaagagaatgaaagaattggtgtccttacaaaaaaaataccagggcacaataagtctctccaaccagtgtgtttctatactgtacacatctcaacagaagtttctcaaaccgtatacatgtatgtgtatccctaacggcgattagttcggagcgacttaaaatgtgcagcaaaagaatcatagtctgttggaagcttggggtgaacgtgggcaggaccagctgttggggtgcttactttcagggtctctgctgaggtctctgtgtttccctcgttttctggagaagaacttccatccggttcatcttcttgccacctgcctctagctgcgggaggttcaatgcgcacaggatttggcaaagactgctgtactgaaaccctggagtacgcaggtgccacttttctttgttcagtactcgagttggagaatgctttagcagggctttttggcgtgctttcagcttcaacggcatactgtgctccaacccgggctcggccatctctctttgtatcgggtgctacctcccgagtcctccgtgattgtatctgcgcttta

SEQ ID NO: 29523 - DNA, 596 bp, Triticum aestivum
  Clone ID: PAT_TA_29523
agcttgggaacaataccttggtttggagcatactgacacaacacccaaaaggtcttacgcagctaatcagaatcgacacacatatgagaagcctgtgaagatttacaattgagaaaccttccatctgggctgcaagccccggacaaaggcctcatccgagaaagtatgctgaagaggccaagtgacctcaacagaagggaaatgctgtcaaatatatggtcatttgtgtgccaaggcctatattacttgctacttgttgacagtcggtgctgtggttggcagaagatatattctttgaggctttccctcttgcctgctccctgacaacgaagcaagcatgctgatttcgttatcctgagtgtgatagaccccactaggatagatgtggcttcttttgtgtagagcagagctggtacataagaaaatgattttggtaggggcatgtatacatggttatagctgagactgattgctttatttgctgctccggcattggaacaacgggatagattgtgtaatgggtttgtggctggttccagtttttggtgtccattgtgaatgcaggcagtaacttcagcaaaaaaaaaaaaaaaaaa

SEQ ID NO: 29524 - DNA, 606 bp, Triticum aestivum
  unsure (1)..(606): unsure at all n locations
  Clone ID: PAT_TA_29524
atccacagcacacaaatccgcagccatggcttcccagctctccgccatgacctccgtgccgcagttccacggcctcaggagctactcctcgcccaggtccatggcgacgctgccgtccttgaggaagaggtcccagggcatccgctgcgactacatcggctcctccaccaatatcatcatggtgaccacgacgaccctgatgctgttcgccgggcggttcgggctggcgccgtcggcgaacaggaaggcgacggcggggctcaagctggaggcgcgcgagtccgggctgcagacgggcgacccggccggcttcactctcgccgacacgctcgcatgcggctccttcggcacatcttgggcgtcggatcgtgctcggctcaaagaacaccggcgtctcaacaaattatcggtagaacntcctttccgtcatactgttctgatcggatcgcgcgctcatgtatggataaataagctcctttgtgattgtgatgtgggtatanatgtagtagtgtatgatcttgttcacggactacgcgcccgttggaatgctcaccatggntttaacancaagnacttcaatgggaaatgattggcaaaaaaaaaaaa

SEQ ID NO: 29525 - DNA, 592 bp, Triticum aestivum
  Clone ID: PAT_TA_29525
gccggccgggctgggaaacaaagaggaaaggcttgcggtggatacctaggcacccagagacgaggaagggcgtagcaagcgacgaaatgcttcggggagttgaaaataagcatagatccggagattcccaaataggtcaaccttttaaacaccccgacatcggcatctcctccaaggccatgtccatcatgaactccttcatcaacgacatcttcgagaagctcgccggcgagtcggccaagctcgcgaggtacaacaagaagcccaccatcacctctagggagatccagacctccgtccgcctcgtcctccccggcgagctcgccaagcacgccgtctccgagggcaccaaggccgtcaccaagttcacatcctcctagactgacgacgcgccgcttgttgtgacagatgtagttggctgctgttagtcgctgactctgcttatgtatctgcaagtagtggtaggagtggtcgtatgtgtgccaacgcttcgttggctagttggttgtcagaactgaagttgctaatctatctgaatgttactgtttcaagtagtacttttgctcaaaaaaaaaaaaaaaaaaggccccta

SEQ ID NO: 29526 - DNA, 532 bp, Triticum aestivum
  Clone ID: PAT_TA_29526
gccggccgggtctgggccagagcagccctcgtccccgccgcttcttctcacgcccgccgcctccgcctccgcctccgcctccgcctccgccaacctcctgggctgatcccagcgccttgagccaagatgtatctccagttctacacgaacgagaacggtgagaaggtttacaccaccaagaaggaatcccctctcggtgtgccgacgcagtctgcccacccagctcgtttctccccggatgacaagtacgcacgtcagcgttacctgttgaagaagaggtttggattgctgccaacccaacagcccgcacaaaagtactgaagcactggatgggtcctcctaagagatctgttttctttgctgaatgctgtttggagtgtagattagctatgtgaagagagaatcattactgctacttatcttgcttgttattgcagtacctctgaatgtaatgctatgctatcgatggatcgtactcttttgtactatgtgctcactgtgtgaataaaaaaaaaaaaaaaaaaggccccta

SEQ ID NO: 29527 - DNA, 1019 bp, Triticum aestivum
  Clone ID: PAT_TA_29527
cctcattccaccgccgtaggccaaacttcgacccagtacaactgagccgcagccgatactcgcctagcgcccgtccgatctcgttgcctccagggagcgcatggggctacgccgttgaggcttgccagtgccccacggtggcgcgcgccgaggccgtggaaagcagaagcagccgcggaatccggaagccgatccacgagccgcgaggtatccgcacttcctgagtcgcagcagcgcgaggaggggtgacagatggacgagttcgagagcggcgataagggaatcgccggccccgccccgggccccggcgctggcgacgacggcaactcggcgccgctccctgagacggtgcaaattggaaattcaccaacctataagcttggaaggaagcttggaaagggtggatttggacaagtatatgttggtcgacgtgtttcctctcccagtcttggtgatagaaaccctggtgcaaatgctttggaggttgcattaaagtttgaacatcgaaccagcaaaggttgcaattatggagctccatccgagtggcaggtttacaacactcttagtggaaatcatggtgtcccacgggtacattacaaaggaaagcagggcgagttttacatcatggttatggatatgttgggacccagcctgtgggatgtttggaataataattcccattcgatgtctgttgaaatggttgcctgtatagctatagaagccatctccatactggaaaagatgcactcaaaagggtatgtccacggtgatgtgaaacctgagaactttctgcttggtccgtgtggtaccctggaagagaagaaactttttcttgttgatcttggactggctacgaaatggaagggtgctggtaacgggcacattgaatacgaccagagacctgatgtatttaggggaactgttcgttatgctagtgtgcatgctcacttgggaagaactggaagtaggagagatgaccttgaatccctccatacacacttatttttcttctcccgtgg

SEQ ID NO: 29528 - DNA, 985 bp, Triticum aestivum
  Clone ID: PAT_TA_29528
tcgagcggccgcccgggcaggtcgtggcgctggtgctgcccaacctcaagggcaagctcaacgggatcgcgctccgggtgcccacccccaacgtgtccgtggtcgaccttgtggtgcaggtctccaagaagaccctcgccgaggaggtgaaccaggcgttccgcgacgccgccgccaacgagctcaagggcatcctcgacgtctgcgacgagccgctcgtgtccgtcgacttcaggtgctccgacgtgtcctccaccatcgacgcgtcgctcagcatggtcatgggagacgacatggtcaaggtcatcgcgtggtacctcggccgcgaccatcgagcggccgcccgggcaggtactcgtcctcttcgctgtcctgactgcccttgttccgcttttctgtaaccatttcgaacgaatcaatcctgttccgcgaagatccgtatggcgtcttcgcccagacgagattgatcgtgcgctttaggagtccggcaattgctggcatgcagcagcagatcatgctgctttccacctcgattaaacaccactggaggagcgacatgaagtcgtaggtcgcatttcgaatggtggttagctgacgcaggtgcgtgaggcggactatgctgcaggccgtcacaatgaatccaacaaggaagcaagagatgatgccggatcgtcgtagggttgacatcctcaacttaagcagtagtggcagtggaatgacaatgacgatgatgtccagaacgacattgattcctccgacggcatagtatagcgcaatacgatcgatgcaggctccgcctgcccgattcggtttgttcagtgcggtgagaataggatggcatgcaaagattgtggccggtatgcaagacaggactccgagaagcagaaatacagcgataaccttgcacaaccttcggaacttgtaatttccagattctgccggccagatacgaaggtaaagtagtacctcggccgcgaccacgcta

SEQ ID NO: 29529 - DNA, 747 bp, Triticum aestivum
  Clone ID: PAT_TA_29529
acagtgggagagaaatactatatcactgcattggctggtgcgaatagtggaagttctttagtgatcatgtcaagaggaacaacgtatgcacaacaatcctataaagtaagtgatgcatttccattcaaatggataaacaaaaagtggaaggagggcttctatgtcacatccatggctacagctggaagtcgatgggcagttgtcatgtcccgaaatgctggtttctcagaccaggtagtggagctggatttcttatatccaagtgagggcatccatcaacgctgggataatggttatcgcatcactgcaacagctgccacattggaccaggcggcatttatcttgagcatacctagacgaaaacctaatgatgaaacacaggagacgctaagaacatctgctttcccgagccagcatgtgaaggaaaaatggtcaaaaaatctgtacttagcatccatctgctatggaagggcggcatcttgaaagcccatttactaaagttggttcttggtaagggctactaatatggatcgccagtttttatgatgagaatggggtattttgaaatgctaacattactaatttacttacccataaactaacgaaaggtaaacctgtgacagactgacttggttctgcttctctagcttgagacttggttgtgtataactttgaactatccatatcataatgttgtataaacaaagaagtgtacttaattaagtgtcatgtatataaatttaagtc

SEQ ID NO: 29530 - DNA, 816 bp, Triticum aestivum
  Clone ID: PAT_TA_29530
ccccacctttcccttccagcaaactcacgcaaccccacccgaagctcccaaccccacccgaagcggccgccatggcccccaaggcagacaagaagccggccgccgagaacaaggtggagaaggcggcggagaagaccccggcgggcaagaagcccaaggcagagaagcggctgccggcgggcaagacggcgtccaaggaggccggcggcgaggcgaagacgaggggccggaagaagggcagcaaggccaagaagggcgtggagacttacaagatctacatcttcaaggtgctgaagcaggtccaccccgacatcgggcatctcctccaaggccatgtccatcatgaactccttcatcaacgacatcttcgagaagctcgccggcgagtccgccaagctcgcccgttacaacaagaagcccaccatcacctcccgggagatccagacctccgtccgcctcgtcctccccggcgagctcgccaagcacgccgtctccgagggcaccaaggccgtgaccaagttcacatcctcctagaatgaccctgcgtcgcttgctgtcacctgcttgtggtcgctgactctgcttatgtatctgcaagtagtggtaggagtggtcgtctgtgtgccaacgctttgttggctagttggttgtgggaactgaagttgctgatctatttgaatgttattgtttcaagtagtagtacttttgctgaatttcaggggaatcgctgaatgcttgctgtcgcctcgttggtgtgagaactgaattttgtcatgccaactgagattcagagaagtcagagatagttatgcaaaa

SEQ ID NO: 29531 - DNA, 717 bp, Triticum aestivum
  Clone ID: PAT_TA_29531
gccggccgggctgggtcaaaagaggaaaggcttgcggtggatacctaggcacccagagacgaggaagggcgtagcaagcgacgaaatgcttcggggagttgaaaataagcatagatccggagattcccaaataggtcaaccttttaaactgcctgctacccgtgcagccctcctccccgccgcttcttctcccgcccgccgccgccgcctccgcctccgcctccgccagtctcctggttgattccggcgccttgaaccaagatgtatctccagtactacatcaacgagaagggcgtcaaggtgtacaccaccaagaaggaatcccctctcggtgtgccgacgcagtctgcccacccagctcgtttctccccggatgacaagtacgcccgtcagcgttacctgttgaagaagaggtttggattgctgccaacccaacagccagcacaaaagtactgaagcactggatgggtcctcctaagagatctgttttctttgctgaatgctgtttggagtgtagattagctatgtgaagagagaatcatcaccgctacttatcttgcttgttattgcagtacctctaaatgtaatgttatgctatacgatggatcgtactcttttgtactatgtgctctctgtgtgactaaatcatttgggatctaccttgccctgaagtttgaactgctacttttggaaaaaaaaaaaaaaaaaaggccccta

SEQ ID NO: 29532 - DNA, 725 bp, Triticum aestivum
  unsure (1)..(725): unsure at all n locations
  Clone ID: PAT_TA_29532
gccaaccccacccgaagcggcagccatggcccccaaggcagacaagaagcccgtcgccgagaacaaggtcgagaaggcggcggagaagacccccgcgggcaagaagcccaaggccgagaagcggctgccggcgggcaagacggcgtccaaggaggccggcggcgaggggaagacccggggcaggaagaagggcagcaaggccaagaagggcgtggagacgtacaagatctacatcttcaaggtgctgaagcaggtccaccccgacatcggcatctcctccaaggccatgtccatcatgaactccttcatcaacgacatcttcgagaagctcgccggcgagtccgccaagctcgcgaggtacaacaagaagcccaccatcacctcccgggagatccagacctccgtccgcctcgtgctccccggcgagctcgccaagcacgccgtctccgagggcaccaaggccgtcaccaagttcacatcctcctagactgatgtcgcgtcgcttgttgcgacagatgtagttggctgctgttgtctcctgttagtggtcgctgactctgcttacgtatctgcaagtagtggtaggagtggtcgccaacgcttcgttggctggttggttgtgagaactgaagttgctaatctatctgaatgtttcaagtactagtacttttgctgaatttcgtgggaatcnctgaatgcttgctgtcgtactcgtggctagtaag

SEQ ID NO: 29533 - DNA, 1467 bp, Triticum aestivum
  Clone ID: PAT_TA_29533
tccacgcgtccgcgcctaccttggcaaggataccagggagacaacaaaggttttcttgtcagcaagaaaaagatggcgacctctcctgaatctctgtgtggcatttgtccacagtcttttcgacactttgttgagtatgttgtgaacttgaagtttgacgaagaacctaattacgccaagtgcatctctctttttgacggcattgttggtccacatccagacaccagaccaataaacacagatggtgctcagaaactaatatatcaggtcggtcagaagcggggccgtctcatagcagaggaagatgatgagcaacctaagaagaagattagaatgggaatgccagcaactcagtggattagtgtctacagtgcccggcggcctatgaaacagaggtaccactataatgttgcagatgatagattagtgcaacatattctgaaaggaaatgaagatggcttgtttataagttcagtttcctcttccgcaaacctgtgggctttaataatggatgctggcaccggttttactgctcaagtatatgaaatttctcaacatttccttcacaaggaatggatcctggagcagtgggagagaaattactatatcactgcgttggctggtgcgaacagtggaagttctttagtgatcatgtcaagaggaacaacgtatgcacagcaatcctacaaagtaagtgacgcatttccattcaaatggataaacaaaaagtggaaggagggcttctatgtcacatccatggctacagctggaagtcgatgggcagtcgtcatgtcccgaaatgctggtttctcagaccaggtagtggagctagatttcttatatccaagtgagggcatccatcaacgatgggataatggttatcgcatcactgcaacagctgccaccttggaccaggctgcatttatcttgagcatacctaggcgaaagcctaatgatgaaacacaggagacgctaagaacatctgctttcccgagccagcatgtgaaggaaaaatggtcaaaaaatctgtacttagcatccatatgctatggaagggcggcgtcttgaagcccatttacttcagttggctcttcgtaagagctactaatatggatctccggtttctatgatgagaatgggggattttgaagtgctaacattactaatttacttacccataaactaatgaaaggcaaacctgtgacagacgacttggttctgcttcgcgactttgttgtgtgtaactgtgaactatctatagcatataattttgtaaacaaagaagtgtacttaattaagtgtcatgtatataaatttaagtctgactgtaccttgagatgactggtttgaaatggctctggagcaattgactaatttagctgttcatgttactctggccggctgccgaggaaaattttgtagtgccatacattaatttgttttagcatagtactttttattttgccc

SEQ ID NO: 29534 - DNA, 1436 bp, Triticum aestivum
  unsure (1)..(1436): unsure at all n locations
  Clone ID: PAT_TA_29534
cagctcccgcaccactccccaccccacgctccacgacgcgagccatggccgccctccgcctcgcctcctccatcaccctctgcccggcggccgcggccgcgtcgccctcgtccgccgccgccgcgccccgcgccgcctccttcgcctgcgcggtcgcgcgcgggctcccctccctccgcctcgccgcgccccgccgccgccgcggcgacctcggcaggcccagcgccgccggcgccgaggccgcggccgagaactacgcgaccgcgctcacggaggtggcctacgagagcgactccctcgacgcgaccgtggccgacatggagaagctggagaagatcttcgccgaggaggccatcgccgagttcttcgacaaccccaccgtgccgcgcgaggagaagacggcgctcatcgacgagatcgccaagtcgtcggagctgcagccgcacaccgtcaacttcctcaacgtggtcatcgacaacacccgcgcgggcctgatgccgcagatcgtgcgcgagttcgagaccgcctacaacgcgctcaccggcaccgaggaggccgtcgtcacctccgtggtgcagctcgagtcgcaggacctcgcgcagatcgccacgcacgtgcagaacatcaccggcgccgccaacgtccggatcaagacccgccttgacccggagctcatcgccggattcaccgtgcagtacggccgcgacagctccaacttcatcgacatgagcgtccgcaagcagatcgcggagatcacctccgagttcgagatgccctccgtcaacctcgaagtctgatgcttagtaattgctgtcacaaggatttgcaacacccagtaagggcgttgatcttcttcagacctggagatgtgacggagggaggaaggcattcttttctgcaaaatatagtaatgacataaatcattttttcggcaggagccagcccctgtaatttcttttttgcctttgtgctgttgagatcttgtaaaataatatgctccaaaatactcaaccatagcagagtttgctcctccatcttcaggcgataaagttaacagcatgtaatgtatagctatgtatccgccgatcaagttgtgtgcagacgtgtatagcagtggcattgctatcaagtggcaaccaagatcatgttgcattctgtacttccatttcgtcgtgtccatccatgacttatgctcaaaaaggcgtcgggtgtgatgtgttctacaattaccgcagntctgcgtctttatcactctgctgngtaattgttctgaaatcacatcccccaatcaggaattggttctttcttggcattggcttanccatgggccccaccctttcaaaaggaggttttgtaaattggnaatcgngccctgnnntatttttatgtangaaccttctattttggctggttttaaaaaaaaaaaaaaaaaaaat

SEQ ID NO: 29535 - DNA, 2396 bp, Triticum aestivum
  Clone ID: PAT_TA_29535
agttctgtacatatgtgcgcataatgtgattattacaacactataaggaaaacataacctatcaaagacgctgtatatctgaggccaaaagagaatgaaagaattggtgtccttacaaaaaaaataccagggcacaataagtctctccaaccagtgtgtttctatactgtacacatctcaacagaagtttctcaaaccgtatacatgtatgtctatccctaccggcgattggttcggagcgacttaaaatgtgcagcaaaagaatcatagtctgttggaagcttggggtgaacgtgagcaggaccagctgttggcgtgcttactttcagggtctctgctgaggtctctgcgtttccctcgttttctggagaagaacttccatccggttcatcttcttgccacctgcctctagctgcgggaggttcaatgcgcgcaggatttggcgaagattgctgtactgaaaccctggagtatgcaggtgctgcttttctttgttcagtactcgagttggagaatgctttagcagggctttttggcgtgctttcagtttcaacagcatactgcgctccagcccgggctcggccatctctctttgcatcgggtgctacctcccgggtcctccgtgattgtatctgctctttagacaactttgtctggacagaccggcgtcgttccaattcttcttcgctctcatctgaatcaaagaaagttctggcagttcttgatctactttccctgcgcaccccactctcttgaatggaattttccctaacagaagtcttggctgggctagaaattggactgccagatcgttcagataacttccctgtatcacctgaatagaagtcattcctcgtcatggatgatcttgattccacaggtttgccaacagtatgtctcccatcgagatgttcactgtggtaatttgcaccaaaagaattcttggttgtgcgtgaacctttaggagtatcacccgtctgttcagatgacgtgtcattctctttgaaatgcaccgattcttcaatgctggcagaagctccttctaaggactgttttcgcagcaagttatccccagaaattttgtattgtggacgttgcctgagtttgtttcttagtccaggagttaaccttccataattcaggccaagatcaccgtcatcgctgtcatcagatgtcgctgaagtttgcatgcggaaaggcgagggccgattctcatttgctcctgttatccctgaggatgtaccttccaatctatgtggttctgtttcttcttctgaaagatcataatctctgctttgcacacgacccaagttcccccgtgcccccgaatagtcatatctaggtgaaccatcactgttttgctccttgcggaatacatcagaacctggtggattctggtagtgcttgctgggcctagattcatgatcttcaataacagcaggaacaaactttccagaattcttattgaacattttgttctcagagtaatcagatcctcttgaatgggtccttaagatatgcatgtctgtacttgtttcctcgtcagaactaacaccatctgaatcaaaagtaggtggtctagtatcattcaggggaatatcctctttgtttgctcctaaatcataagatggctgtgtttctgttcttgaaaagagagttgaagtggtacgatcaaccggagattcacttctaggctgcttactccaatctgcacttgagaatcccttgtggccctgcacagttgacagctcttcagtatgttttgaagcgaaatgatccagtaagttctcttcttgaacatcatagtcatattcatcgaataaaacagctgaagaatcagctccagctttatcattctggttgtcccaagacatactgctgccaccgtgggaagcactaaaattactatagtggttattcctactctcttgatcaaagctagcttgcctgcttcctatatccttggtgtggtgccaatcaaatccagcatctggcaacctttcctcatgcaaatcaaatgggtgatcctcaggtcttctgatattgctttctttctcagatgaatcatcaaaatatggaggctcagacgaatcattaaaatatggaggctcagatgaatgagcatgatgcggttcagttggcatgtcatgatcagtacggctttcaggagcatacgagtggagctgagaggagtaaggagttgacatattctggctactcacgcggccctgtttctgctctttcttcatcttctcttgcattacttgagatcatccttggatcattaatacctgaaatctgctcattaaaactcttaccatccttcatcaaacgtccagcttgttgcttcctgggtgtagtgtcattcatataagcagttgattcataagcaccag

SEQ ID NO: 29536 - DNA, 813 bp, Triticum aestivum
  Clone ID: PAT_TA_29536
atctgcaattccccacctccgagcgaaacacctctccctcactctcacctccgagaagctccagcggcagccatggccccaaaggcagacaagaagccggcggccgagaacaaggtggagaaggcggcggagaagacccccgcggggaagaagcccaaggccgagaagcggctgccggcaggcaagacggcgtccaaggaggccggcggcgaggggaagacccggggcaggaagaagggcagcaaggcgaagaagggcgtggagacgtacaagatctacatcttcaaggtgctgaagcaggtgcacccggacatcggcatctcctccaaggccatgtccatcatgaactccttcatcaacgacatctttgagaagctcgccggcgagtcggccaagctcgcgaggtacaacaagaagcccaccatcacctctagggagatccagacctccgtccgcctcgtcctccccggcgagctcgccaagcacgctgtctccgagggcaccaaggccgtcaccaagttcacatcctcctagactgacgacgcgccgcttgttgtgacagatgtagttggctgctgttagtcgctgactctgcttatgtatctgcaagtagtggtaggagtggtcgtctgtgtgccaacgcttcgttggctagttggttgtcagaactgaagttgctaatctatctgaatgttactgtttcaaaaaaaaaaaaaaaaaaaaaaaaacggccagagaaggcataaagtgcaaaatgacgcacgtccacgttgccagcctccgaagcctgcaacctcggccgcgaccacgcta

SEQ ID NO: 29537 - DNA, 2333 bp, Triticum aestivum
  Clone ID: PAT_TA_29537
gacaaggcagaaaataatgtgtaatgttgatgagaaggacattgctgagcatttgaggataaggttgaagaaagaacaagaagagaaagaacacaagaaaaaggaaaaagctgaagctcacctctacaccatcataaaggttgctcgagatgaagatttgaaggagcagattgggaagaatatatattttgatctggtggaccatgaaaaagtccgtaattttcgtatacagaaacaattaccctttaattcattcaaggaggaagttgcgaaggaatacggcattccggtacagtctcagcgcttctggttgtgggctaagaggcaaaatcatacataccggcccaatcgtccgctggcccctcatgaagaagcacaatcagtggggcaacttagggaggtatcaaacaaggcacacaatgctgagctgaagctatttcttgaagtagagctaggattggatttgcgcccaattcgtcctcccgagaagagcaaggaagatattttacttttcttcaagctttataatcctgaaaaggaagagcttcgttttgttggtaggctttttgttaaggctttgggaaagccatctgatatcctgacaaaacttaatgaaatggctggattttccccaaatgaagaaatcgaactttatgaggaaattaagtttgagcctaatgtgatgtgtgaacatattgacaagaaacttagtttccgatctagtcagcttgaagatggggacataatcagtttccaaaagccatctataccaggtggcgatactcaagtgcgctataaagatgttccttctttcttggagtatgttcataataggcaggttgtgcacttccggtgtctggagaaaccaaaggaggaggaattttgtttggaattgtcgaagcttcatacttatgatgatgttgttgagagagttgcacgccaacttggattaaatgatccatcaaaagttcggcttacgtctcacaattgctattctcagcaacctaaaccacagcccatcagatatcgtggagtagagcatctattggatatgcttgtccattataatcagacttctgacatactgtattatgaagtcttggacattccactgccagaattgcagtgtttaaaaacacttaaagttgcatttcaccatgcaacgaaagatgaggttgtaattcacagcatcaggctttcgaaaaatagcaccatcagtgatgtgatcactgacttgaagaccaaggttgaactatccaatcctgatgctgagctccgcttgcttgaagttttctaccacaagatttataagatatttccacctcatgagaagatagagaacataaatgatcagtactggacactacgtgctgaggagattccagaggaggagaagaatctcactgcacaggatcggttgattcatgtctatcatttcatgaaagatcctaatcagaaccagcagattcagaattttggagatccctttttgctggtcatccgtgaaggtgagactgctgcagaggtaatggaccgtgtgcagaaaaaactccgagttcccaatgaagaattcgccaagtggaaggttgcattcatatccatgaatcgtccagaatacctccaggatattgatgctgtgtctgcacgctttcagaggagagatgtctacggagcttgggaacaataccttggtttggagcatactgacacaacacccaaaaggtcttacacagctaatcagaatcgacacacatatgagaagcctgtgaagatttacaattgagaaaccttccatctgggcctcatccgagaaagtatgctaaagaggccaagtgacctcaacagaagggaaatactgtcaaatatatggtcatttgtgtgccatggcctatattacttgctacttgttgacagtcggtgctgtggttggcagaaggatatattctttgaggctttccctcttgcctgctccctgacaacgaagcaagcatgctgatttcgttgtcctgagtgtgatagaccccactaggatagatgttgcttcttttgtgtagagcagagctggtcgccggacggcggcggcattgccctgtgaagtgactcctctcgaaattttccccagccatcgtcacggatgatcgattctttgtaatgagaattcagagtatcgagctcccaacagcttctttttttttcctttcttttcttgttcttcttttttctttctctgatttttcagtgtccagacacggattataatagacttcctgcaaaggaagtctcaacgctgtgcatctgtaatatatacgtacctgcccgggcggccgctcgaa

SEQ ID NO: 29538 - DNA, 1290 bp, Triticum aestivum
  Clone ID: PAT_TA_29538
aaggtggagccggggctgagcgcgtacgccggacggccgcaggaggcggccaagtccatcgtgcctctgctggagaaggccaagagcaccgtgcctcgctggctcatgaagaaaactcccgtcaaactaggggcgacggctgggctcaggctcatcggagacgagaaagcggagcaaattcttgaagcagtgagggatgctgtccacagcaagagcaaattccagtacaatcccagttggatcaatgttctcacggggtcccaggaaggatcttacctatgggttgctctgaattacctgctgggtaatctgggaggagactactccaagacggtgggtgtgatcgaccttggaggcggatccgtgcagatggcatatgccatctctgcggatgccgccgctgccgctcccgtggtgcctcaaggggacgatccatacgtcaccaaagagtatctcaaaggaagagattacaacgtctatgttcacagctacttgcactatggcgcaatggcttctcgggtagagatcttcaaggcgaagaatggaccagtgagctactgcatgctgcgcggatacaatggcaaatacacctacaacggagagcaatacgacgccgtagcgcctccgcaaggagcggcatacgacaagtgcagagaggacgtcaccaaggcgcttaagatcagcgcgccctgccaggccaagaactgcaccttcaacggcgcatggaatggcggcggcggccccggccaggccgacctctacgtcacctccagcttctactacatggcagcagacgttggcttgatcgacagtgaggccaccagcgggaagaccacccctgcggcgttcagggccgccgccgagaagatctgcccgatgggcttcgtggaagccaaggccgcgtaccccaaggtgcgatccgtcgacgcgcccttcatctgcatggacctcatctaccagtactccctgctccgtggacggttttggtctggagccgaccaaggaaatcacggtggcgcagaaggtgaagcatggggagtacttcattgaagccgcgtgggcgctcggagaagccatcgaggccgtctcacccaccaagcggctcaacgatgcatgattttagatataattgctagtccctcgcaataaggtgcaagcatgtgtatcgtacgattaattgcaataaggttcatatgcttggacgccatctccaattgtaatcctttttatcatctttgtggcgagaattgcctagtataatgcgctacaacatataaaaaaaaaaaaaaa

SEQ ID NO: 29539 - DNA, 744 bp, Triticum aestivum
  Clone ID: PAT_TA_29539
gccggccgggttgcgatctgcaattccccacctccgagcgaaacacctctccctcactctcacctccgagaagctccagcggcagccatggccccaaaggcagacaagaagccggcggccgagaacaaggtggagaaggcggcggagaagacccccgcggggaagaagcccaaggccgagaagcggctgccggcaggcaagacggcgtccaaggaggccggcggcgaggggaagacccggggcaggaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctctagggagatccagacctccgtccgcctcgttctccccggcgagctcgccaagcacgccgtctccgagggcaccaaggccgtcaccaagttcacatcctcctagactgacgacgcgccgcttgttgtgacagatgtagttggctgctgttagtcgctgactctgcttatgtatctgcaagtagtggtaggagtggtcgtatgtgtgccaacgcttcgttggctagttggttgtcagaactgaagttgctaatctatctgaatgttactgtttcaaaaaaaaaaaaaaaaaaggccccta

SEQ ID NO: 29540 - DNA, 478 bp, Triticum aestivum
  unsure (1)..(478): unsure at all n locations
  Clone ID: PAT_TA_29540
ctcgtgccgaattcggcacgagggtggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttaagtagccaagaggaaaagaaagcaaaagcgatccccgttagtaacggcgaacgaaatgggagcagcctaaaccgttgaaaacggggtttttgggaagagcaatacaagcgtttgtgctgctaggcgaagcggttgaatgccgcacctaagatggctaaagtcaattagccgaaagcatcactaggcttacgctctgaccccgagtaacatggggcacgttggaatcccgtgtgaatcancaaaggacaactttgcaaggggttaaattctccctggggtgancgatt

SEQ ID NO: 29541 - DNA, 1507 bp, Triticum aestivum
  Clone ID: PAT_TA_29541
acgaaaatgtcgcgatttaggcacaaagcaggtgtcaaagtgcaggtctaacttcttataacacacagacgacaaagcagttgtcaaaggacaggtccaacttcttataacatggtgtcagctagacgataagcttcggtacgggtacataagtgttcttgtttactaatgctagagctagaacagcatatggaaaccgcctcgctaccataaccgagataactgtccatcagtcataacctcttctgttgggagctggggatcttgagcgctggacaggagatcggcttcgatagcgatcacgaacaggactcctgctcctgccatatgcaccatactgaggactcgctggacgaccatagtcaggactaggtcgtgaccttcggtacattgggctgacagaacggcgatatgaactgtcatccggccttccatagccaccgcctctacttggcctgtcatacttgtcacctggttcactatcatccctgaaggcatactcaacagaaatcactctgtccagtaacttcgtcaaatgagtagcatcaagggcttttgtggcttcttcctgagtttcaaattgcacgaaagcaaagttcttccttatccgaacatttgaaatcctcccaaaatgaccaaaatgcctttcaagatcactgactcttgtgttgatcgggtcaaagttaatgacaaacagggtcttggtgggcttagtattcactggtggtttactatagccatcacggtcatcacgtctggttccacggtcaccccgtgaccactccactgaaagtctgcgtctcccagggccaaagggataaccatccagagcccgtatggcatcatcaccatcacgctcatcctcaaagtagacaaaagcaaaccctgcacagatctgatggtatcaacagagctattgagcttactggtagattccattcatgactaggcatggtgttgtacaacttatatccaaaatttccaaagtaagaaggtacgactggcggcactgaacatgcttcaccattctacagaccaaagagcctcacagacattgcttactgagacagcgcacatagcaagttatcaagttgatgcctggtggatacttctagtcgtggcatggtacggcatgatggaactgatggcatggtatggcatgatggaactgatggcatggcacgaatcgcatgatgattgatgtcagtcccggcaagacatgcttggcagtggtaacatattacagtgcatcaggaaaacggatggccaagtgcagggagtggtggccggatgaggcaggagtgaatggagggtgagttgaggagccccggggggagctatgtatgtttgcctcggcagttcctgacttcatgtcgatgcgctcgatcctgccgtagcggtagaagaggcggtcgagctccgagtgacgggtgtcgtagtccaggttccccacgaacacgggcctcatcctcaccacctgcctgcgtcgcgtcgacggagagcctcg

SEQ ID NO: 29542 - DNA, 750 bp, Triticum aestivum
  Clone ID: PAT_TA_29542
gccggccggtccgggatctgcatccccacctccgagccaaacacctcctccctcactcccacctccgaagcttcagcggcagccatggcccccaaggcagacaagaagcccgcggccgagaacaaggtcgagaaggcggcggagaagacccccgcgggcaagaagcccaaggccgagaagcggctgccggcgggcaagacggcgtccaaggaggccggcggcgaggggaagacccggggccggaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggctgtcaccaagttcacctcctcctagattgactatgcgtcgcttgttgtgatagatgtagttggctgctgttagtcgctgactctgcttatgtatctgcaagtagtggtagtagtagtcgtctgtgtgctggctgattgccaacgtttcgttggctagttggttgttagaactgaagttgctgatccatctgaatgttaatgttgccagtcgtattattactaatttcat

SEQ ID NO: 29543 - DNA, 564 bp, Triticum aestivum
  Clone ID: PAT_TA_29543
gccggccgggtcgggagccgccagatacccgtgcagccctcctccccgccgctttcttctcccgctcgccgcctccgcctccgccaacctcctgggctgatccccgcgccttgaaccaagatgtatctccagtactacatcaacgagaagggcgtcaaggtgtacaccacaaagaaggaatcccctctcggtgtgccgacgcagtctgcccacccagctcgtttctccccggatgacaagtatgcccgtcagcgttacctgttgaagaagaggtttggattgctgccaacccaacagccagcacaaaagtactgaagcactggatgggtcctcctaagagatctgttttctttgctgaatgccgtttggagtgtagattagctatgtgaagagagaatcatcactgctacttatcttgcttgttatcgcagtatctctaaatgtaatgttatgctaccgatgggtcgtactcttttgtaccatgtgctctctgtgtgactaaatcatttgggatctaccttgccctgaagtttgaaagaaaaaaaaaaaaaaaaaaggccccta

SEQ ID NO: 29544 - DNA, 1212 bp, Triticum aestivum
  Clone ID: PAT_TA_29544
aatacaaaaaaaaaaaacagccgagccagctgctccacaccactccccaccccacgctccacgacgcgcgcgagcgagccatggccgccctccgcctcgcctcctccatcaccctctgcccggcggccgcggccgcgtcgccctcgtcggccgccgcgccccgcgccgcctccttcgcctgcgcggtcgcgcgcgggctcccctccctccgcctcgccgcgccccgccgccgccgcggcgacatcggcaggcccagcgccgccggcgccgaggccgcggccgagaactacgcgaccgcgctcacggaggtggccgccgagagcgactccctcgacgcgaccgtggccgacatggagaagctggagaagatcttcgccgaggaggccatcgccgagttcttcgacaaccccaccgtgccgcgcgaggagaagacggcgctcatcgacgagatcgccaagtcgtcggagctgcagccgcacaccgtcaacttcctcaacgtggtcatcgacaacacccgcgccagcctgatgccgcagatcgtgcgcgagttcgagaccgcctacaacgcgctcaccggcaccgaggaggccgtcgtcacctccgtggtgcagctcgagtcgcaggacctcgcgcagatcgccacgcacgtgcagaacatcaccggcgccgccaacgtccggatcaagacccgccttgacccggagctcatcgccggattcaccgtgcagtacggccgcgacagctccaacttcatcgacatgagcgtccgcaagcagatcgcggagatcacctccgagttcgagatgccctccgtcaacctcgaagtctgatgcttagtaattgatgcgacaaggatttgcaacacccagtaagggcgttgatcttcttcagacctggagatgcgacggagggattaaggcattcttttctgcaaaatatagtaatgacataaatcattttttcggcaggagccagccactgtaattttcttttttgcctttgtgctgttgagatcttgtaaaataatatgctccaaaatactcaactatagcagagtttgctcctccatcttcaggcgacaaagttaacagcatgtaatgtatagctatgtatccgaccgatcaagttgtgtgcagacgtgtatagcatgtggcattgctatcaactggcaaccaagatcatgttgcattccgaattccaaaaagggggggc

SEQ ID NO: 29545 - DNA, 1520 bp, Triticum aestivum
  Clone ID: PAT_TA_29545
cgcgcactagccacccaccaccagcaggtcgccatggctcaggctcatcatgcctcgagcgtcctcctcctcctcctcgtggccttctcgttcgccggctccgcctttgccgccgacgtggcggtgctcggccggaaggccggtattggcgccgttgccgaggaggggcccgagctgaaggcggcgcccgggaagtacgcggtgatcttcgacgcgggcagcacgggcacgcgcgtgcacgtcttccggttcgacaagaagatggagctcatcgacatcggcgacggcgacgacatcgaggtcttcgccaaggtggagccggggctgagcgcgtacgccggacggccgcaggaggcggccaagtccatcgtgcctctgctggagaaggccaagagcaccgtgccccgctggctcatgaagaaaacgcccgttaaactaggggcgacggctgggctcaggctcatcggagacgagaaagcagagcaaattcttgaagcagtgagggatgctgtccacagccagagcaaattccagtacaaccctagttggatcaatgtcctcaaggggtctcaggaagggtcttacctgtgggttgccctgaattatctgctgggtaatctgggaggagactactccaagacggtgggtgtgatcgaccttggaggtgggtccgtgcagatggcatatgccatctctgcggatgccgccgccgccgctcccggggtgcctcaaggggacgatccatacgtcaccaaagagtatctcaaaggaagagattacaatgtctatgttcacagctacttgcactatggcgcaatggcttctcgggtagagatcttcaaggccaagaatggtccagtgagctactgcatgctgcgcggatacaatggcaaatacacctataatggagagcaatacgacgccatagcgcctccgcaaggagcggcatacgacaagtgcagagaggacgtcacaagggcgcttaagatcagtgcgccctgccaggccaagaactgcaccttcaacggcgcatggaacggtggcagtggccccggccaggccgacctctacgtcacctccagcttctactacatggcatcagatgttggcttgatcgacagtgaggccacaagtgggaagaccacccctgcggcgttcagggccgccgccgagaagatttgcccgatgggcttcgtggaagccaaggccgcgtaccccaaggtgcgatccgccgacgcgccctacatatgcatggatctcatctaccagtactccttgctcgcggacggtttcggtctggagcccaccaaggaaatcacggtggcgcagaaggtgaagcacggggagtacttcatcgaagccgcgtgggcgctcggagaagccattgaggccgtctcgccgaccaagcggctcaacgatgcatgattttagatataattgctagtccctcgcaataaggtgcaatcatgtgtatcatacgattaattgcaataaggtgcatatgcttggacgccatctcc

SEQ ID NO: 29546 - DNA, 1405 bp, Triticum aestivum
  unsure (1)..(1405): unsure at all n locations
  Clone ID: PAT_TA_29546
gcggccgcgtcgacgtttgtagtaccaaccagccaagccaagaagtaacagagaaggaggaagagaggccggccggcgaaatgaaggcgaccgcgggggccctcctcgccgtggtggcggcggtgctgctacgcggcgtggcggcagcgccccggaagccggtggacgtgccgttcgacaagaactacgtgccgacgtgggcgcaggaccacatccactacgtgaacggcgggcgggaggtgcagctgtccctggacaagaccaccggcacgggcttccagacccggggctcctacctcttcggccacttcagcatgcacatcaagctcgtcggcggcgactccgccggcaccgtcaccgccttctacctgtcgtcacagaactcggagcacgacgagatcgacttcgagttcttggggaacaggacggggcagccgtacatcctgcagaccaacgtgttctccggcggcaagggcgaccgggagcagaggatctacctctggttcgacccaaccaaggactaccactcctactccgtcctctggaacctctacatgatcgcgttcttcgtggacgacacgccgatccgggtgttcaagaacagcaaggacctcggggtgcggtacccgttcgaccagcccatgaagctctactccagcctgtggaacgcggacgactgggcgacccggggcgggcgggagaagacggactggtccaaggcgcccttcgtcgcctcctaccggggcttccacgtcgacggctgcgaggcgtccgcggaggccaagttctgcgccacccagggcgcccgctggtgggaccagcccgagttccaggacctggacgccgcgcagtaccgccgcctcgcctgggtcaggaaggagcacaccatctacaactactgcaccgaccacgaccgctacgccgccatggcgccagagtgcaagcgcgaccgcgacgtctgagtcagccagccacgatgatatactgcttcgctactactaccactagttgttgttgtgccgctggtcgcggtgcggtcgctgagacctagtagtacgaggaatttgtatccctacactacatgtgtgtgtatgctcatgccatgcctactttattaatattattctgattgcccatccagatatcaaaaaaaaacggcatcgtgctcggcctcaagaacaccggcgtcctcgaccaagatatcggntagaaccttccttttccgtccatagctgttctgcattcgcatcgcgcgctccatgtagtggtnaattaatgctcccttcgtgatttgtcatgtggtgtagtacaatgtatgtgttgcatctttgtttcaacgggactacgccgcgccggtgtggnaactcttcannaaaaaaaggggggccngtaccaaattcgccga

SEQ ID NO: 29547 - DNA, 789 bp, Triticum aestivum
  Clone ID: PAT_TA_29547
actctgcattcccacctccgagccaacacctcgtccctcactcccacttccaccttcgaagctccagcggcagccatggcccccaaggcagacaagaagccggccgccgagaacaaggtcgagaaagcggcggagaagacccccgcgggcaagaagcccaaggccgagaagcggctgccggcaggcaagacggcgtccaaggaggccggcggcgaggccaagacgaggggccggaagaagggcagcaaggccaagaagggcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcccgctacaacaagaagcccaccatcacctccagggagatccagacctccgttcgcctggtcctccccggcgagctcgccaagcacgccgtctctgagggcaccaaggctgtcaccaagttcacctcctcttagactgacgctgcgtcgcttgttatgacagatgtagttggctgctgttttcttctgttagtggtcgctgactctgcttatgtatctccgactagtggtaggaatggtcctctctgtgctggatgattgccaacgcttcgttgggctcgttggttgtgagaactgaagttgctaatctatctgaatgttattgtttcaagtagtacttttgctgaatttaatgggaatcgctgaatgctttgctgaaaaaaaaaa

SEQ ID NO: 29548 - DNA, 831 bp, Triticum aestivum
  unsure (1)..(831): unsure at all n locations
  Clone ID: PAT_TA_29548
gccggccgttccgggacatctgcaattccccacctcctcactcccacctctccctcactccccacctccgaagctccagcggcagccatggcccccaaggcagacaagaagccggcggccgagaacaaggtcgagaaggcggcggagaagacccccgcgggcaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctcccgggagatccagacctccgtccgcctcgtcctccccggcgagctcgccaagcacgccgtctccgagggcaccaaggccgtcaccaagttcacctcctcctagacagttgatgcgacagatgtagttggctgctgttgtctcctgttagtggtcgctgactctgcttatgtatctgcaagtagtggtaggagtggtcgtctgtgcgccaacgcttcgttggctagttggttgtgagaactgaagttgctaatctatctgaatgttattgtttcaagtagtagtgcttttgctgaatttcatgggaatcgctgaatgcttgctgtcgccttgttggtanntaagagctgaattctgtggtgcaaacagtgattcagaaaaaaaaaa

SEQ ID NO: 29549 - DNA, 1800 bp, Triticum aestivum
  Clone ID: PAT_TA_29549
gagggcacatgcaatcgccttatcctccgcccgtcccgacgccacaaacccaagcagtgatcacgccgcctccctccccgatcgatcgccggccacataaataagccggcgcaccacctgctcctttccgcctagcatcagcagcagcaatggccgcccatgcagctctcgccgccacccgcatccccaccagcgcccgtctgcacagcaaggccgcctccaggcagagggtcgacttcgccgacttctccgggctgaggccggggtcgtgctccgtcagcgccgccgccagggaggcgtccttctccgatgtcctcggcgcgcagctcgtcgccagggcttccggcgagaacaccgtgagagcgccggcggaggcgaagctgaaggtggccatcaacgggttcggccgcatcgggcgcaacttcctccggtgctggcacggccgcgagaactcgccgctggaggtcatcgtcatcaacgacagcggaggcgtcaggaacgcgtctcacctgctcaagtacgactcgatgctgggcaccttcaaggcggacgtgaagatcgtggacaacgagaccatcagcgtcgacggcaagaacatccaggtcgtctccaacagggaccccctcaagctgccatgggccgagctcggcatcgacatcgtcatcgagggtaccggagtgttcgtgggacggccccggcgccgggaagcatctccaggccggcgcccaagaaggtcatcatcaccgctccggccaagggcgccgacatccccacctacgtcgtcggcgtcaacgagggcgactacgaccatgacgtcgccaacatcatcagcaacgcttcttgcaccaccaactgcctcgcgccattcgccaaggtcctggacgaggagttcgggatcgtgaaggggaccatgacaaccacgcactcgtacacgggcgaccagaggctgctggacgcgtcccaccgcgacctgcggagggcgagggcagcggcgctgaacatcgtgccgacgagcacgggcgccgccaaggccgtctccctggtgctgccgcagctcaagggcaagctcaacggcatcgcgctccgcgtgcccacgcccaacgtctccgtggtggacctcgtcatcaacaccgtcaagaccggcatcaccgccgacgacgtgaacgcggcgttccgcaaggccgccgacgggccgctcaagggcatcctcgacgtctgcgacgagccgctcgtgtccgtcgacttccgctgctccgacgtctccaccagcatcgacgcctccctcaccatggtcatgggcgacgacatggtcaaggtcgtcgcctggtacgacaacgagtggggctacagccagcgcgtggttgatctggcgcacctggtggcggccaagtggccgggcgccgggaccggcggcagcggcgacccgctggaggactactgcaagaccgaccccaacgccgtggagtgcaaggtgttcgacgagtgaacccgagagctcggaggttgccgctggcttgaccggtcgaggctgatcagaaaacgcaacgaagcaactacattattatcctctatatctatagtctataaaatgtaccagctggattgtgtttcattcgtttccgagattgctcgccgagcttgcgggcttggtgctctatatatcagacaggattcgggcagaataaattgacccttcttatgtgagctgtactgagctcatatattcagatgtcagactttctcttgggactttcaaagcgttcttgtgcgaagttttgtctaacatgtgctttaagatgc

SEQ ID NO: 29550 - DNA, 1756 bp, Triticum aestivum
  unsure (1)..(1756): unsure at all n locations
  Clone ID: PAT_TA_29550
ataagccggcgcaccacctgctcctttccgcctagcatcggcagcagcaatggccgcccatgcagctctcgccgccacccgcatccccaccagcgcgcgtctgcacagcaaggccgcctccaggcagagggttgacttcgccgacttctccgggctgaggccggggtcgtgctccgtcagcgccgccgccagggaggcgtccttctccgatgtcctcggcgcgcagctcgtcgccagggcttccggcgagaacgccgtgagggcgccggcggaggcgaagctgaaggtggccatcaacgggttcggccgcatcgggcgcaacttcctccggtgctggcacggccgcgagaactcgccgctcgaggtcatcgtcatcaacgacagcggaggcgtcaggaacgcgtctcacctgctcaagtacgactcgatgctgggcacgttcaaggcggacgtgaagatcgtggacaacgagaccatcagcgtcgacggcaagaacatccaggtcgtctccaacagggaccccctcaagctgccatgggccgagctcggcatcgacatcgtcatcgagggtactggagtgttcgtggacggccccggcgccgggaagcatctccaggccggcgccaagaaggtcatcatcaccgctccggccaagggcgccgacatccccacctacgtcgtcggcgtcaacgagggcgactacgaccatgacgtcgccaacatcgtcagcaacgcttcttgcaccaccaactgcctcgcgccattcgccaaaatcctggacgaggagttcgggatcgtgaagggcaccatgaccacgacgcactcgtacacgggcgaccagaggctgctggacgcgtcccaccgcgatctgcggagggcgagggcggcggcgctgaacatcgtgccgacgagcacgggcgcggccaaggccgtctccctggtgctgccccagctcaagggcaagctcaacggcatcgcgctccgcgtgcccacgcccaacgtctccgtggtggacctcgtcatcaacaccgtcaagaccggcatcaccgccgacgacgtgaatgcggcgttccgcaaggccgccgacgggccgctcaagggcatcctcgacgtctgcgacgagccgctcgtgtccgtcgacttccgctgctccgacgtctccaccagcatcgacgcctccctcaccatggtcatgggcgacgacatggtcaaggtcgtcgcctggtacgacaacgagtggggctacagccagcgcgtggttgatctggcgcacctggtggcggccaagtggccgggcgccgggaccggcggcagcggcgacccgctggaggactactgcaagaccgaccccaacgccgtggagtgcaaggtgttcgacgagtgaagtgagagctcggaggtcgaggctgatcagaaaacgcaacgaagcaactacattattatcctctatctatagtctataaaatgtaccagctggattgtgtttcattcgtttcgagattgctcgccgagcatgcggcttggtgctctatatatcagacaggattcgggcacaataaattgaccctccttctgtgagctgtactgaactcgatataattcagatatgtcagactttctcttgggacttttgaaagtgttcttgtgcgacgttttgtccagcatgtgctttaagatgcttgganccaatgcctaaaaaaaaaaaaaaaaaactcgagggggggcccggtacccaattcgccctatagtggctcgt

SEQ ID NO: 29551 - DNA, 1771 bp, Triticum aestivum
  Clone ID: PAT_TA_29551
ggcacgagccgcctccctccctccccgatggatcgacggccacataaataagccggcgcaccacctgctcctttccgcctagcatcagcagcagcaatggccgcccatgcagctctcgccgccacccgcatccccaccagcgcgcgtctgcacagcaaggccgcctccaggcagagggtcgacttcgccgacttctccgggctgaggccggggtcgtgctccgtcagcgccgccgccagggaggcctccttctccgatgtcctcggcgccgcagctcgtcgccagggcttccggcgagaacgccgtgagggcgccggcggaggcgaagctgaaggtggccatcaacgggttcggccgcatcggccgcaacttcctccggtgctggcacggccgcgagaactccccgctcgaggtcatcgtcatcaacgacagcggaggcgtcaggaacgcgtctcacctgctcaagtacgactcgatgctgggcaccttcaaggcggacgtgaagatcgtggacaacgagaccatcagcgtcgacggcaagaacatccaggtcgtctccaacagggaccccctcaagctgccatgggccgagctcgggatcgacatcgtcatcgagggtaccggagtgttcgtggacggccccggcgccgggaagcatctccaggctggcgccaagaaggtcatcatcactgctccgggccaagggcgccgacatccccacctacgtcgtcggtgtcaacgagggcgactacggccatgaggtcgccaacatcatcagcaacgcttcctgcaccaccaactgcctcgcgccattcgccaaggtcctggacgaggagttcggaatcgtgaaggggaccatgaccacgacgcactcgtacacgggcgaccagaggctgctggacgcgtcccaccgcgacctgcggagggcgagggcggcggcgctgaacatcgtgccgacgagcacgggcgccgccaaggccgtctccctggtgctgccgcagctcaagggcaagctcaacggcatcgcgctccgcgtgcccacggcccaacgtctccgtggtggacctcgtcatcaacaccgtcaagaccggcatcaccgccgacgacgtgaacgcggcgttccgcaaggccgccgacgggccgctcaagggcatcctcgacgtctgcgacgagccgctcgtgtccgtcgacttccgctgctccgacgtctccaccagcatcgacgcttccctcaccatggtcatgggcgacgacatggtcaaggtcgtcgcctggtacgacaacgagtggggctacagccagcgcgtggttgatctggcgcacctggtggcggccaagtggccgggcgccgggaccggcggcagcggcgacccgctggaggactactgcaagaccgaccccaacgccgtggagtgcaaggtgttcgacgagtgaagtgagagctcggaggttgctgctggcttgaccggtcgaggctgatcagaaaacgcaacgaagcaactacattattatcctctatctatagtctataaaatgtaccagctggattgtgtttcattcgtttcgagattgctcgccaagcttgcggcttggtgctctatatatcagacaggattcgggcacaataaattgacccttcttctgtgagttgtactgaactccatatattcagatgtgtcaggctttctcttgggactttcacagtgttcttgtgcgatgttttgtctaacatgtgctttaagatgcttggattggatccaaaaaaaaaaaa

SEQ ID NO: 29552 - DNA, 1845 bp, Triticum aestivum
  Clone ID: PAT_TA_29552
gacactccagcggcagctcgccatggctcatcatgcctcgggcgcactcctcctcatcctcctcgtggccttctcgctcgccggctcggcctttgccgccgacgtggcggtgctcggccggaaggccggtattagcaccattaccgaggaggagcccgagctgaagaaggcggccgggaagtacgcggtgatcttcgacgcgggcagcacgggcacgcgcgtccacgtcttccggttcgacaagaagatggagctcatcgacattggcgacggcgacgacatcgaggtcttcgccaaggtagagccggggctgagcgcgtacgccggccggccgcaggaggcggccaagtccatcgtgcctctgctcgagaaggccaagagcaccgtgcctcgctcgctcatgaagaaaacgcccgttaaactaggggcgacggctgggctcaggctcatcggagacgagaaagcagagcaaattcttgaagcagtgagggatgctgtccacagccagagcaaattccagtacaatcctagttggatcaatgtcctcaaggggtctcaggaagggtcttacctgtgggttgctctgaattacctgctgggtaatttaggaggagactactccaagacggtgggtgtgatcgaccttggaggcgggtcagtgcagatggcatatgccatctccgcggatgccgccgctaccgctcccggggtgcctcaaggggacgatccatacgtcaccaaagagtatctcaaaggaagagattacaacgtctatgttcacagctacttgcactatggcgcaatggcttctcgggtagagatcttcaaggccaagaatggtccagtgagctactgcatgctgcggggatacaatggcaaatacacctataacggagagcaatatgacgccatagcgcctcctcaaggagcaacatacgacaagtgcagagaggatgtcaccaaggcgcttaagatcaacgcgccctgccaggccaagaactgcaccttcaacggcgcatggaatggtggtggcggccctggccaagccgacctctacgtcacctccagcttctactacatggcagcagacgttggcttgatcgacagtgaggccacaagcgggaagaccacccctgcggcgttcagggccgccgccgagaagatctgcccgatgggcttcatggaagccaaggccacgtaccccaaggtgcgatccgtcgacacgccctacatctgcatggacctcgtctaccagtactccctgctcgtggacggtttcggcctggagcccaccaaggaaatcacggtggcacagaaggtgaagcatggggagtacttcatcgaagccgcatgggcgctcggagaagccatcgaggccgtctcacccaccaagcggctcaacgatgcatgattttagatataattgccaatccctcacaataaggtgcaagcatgtgtatcatacgattaattgcaataaggtgcatatgcttggacgccatctccaattgtaatccttttatcatctttgtggcgagaattgcctagtctaatgtgtaggagttcggcatcgtgctcggcctcaagaacaccggcgtcctagaccagatcatcggctagaaccttccttttccgtcgatagctgttctgcatccacatcgcgcgctccatgtagtggatcaattaatgctccctttgtgatttgatgatgtggtgtagtacaatgtatgtgtatgcatctttggttcagcgggacgtaccgccgcgccggtgtggcaactgcttcatcccatgcgtttttcatcatctatagtatctttcacacggtgaagatcgtcttgtggt

SEQ ID NO: 29553 - DNA, 811 bp, Triticum aestivum
  Clone ID: PAT_TA_29553
gttcaccacgcgattccccgtgtggctcccgctccacaagatttaagaaaggagctcgttcagcattgcgcctgagcaatcgcagcatccacagcacacaaatccgcagccatggcttcccagctctccgccatgacctccgtgccgcagttccacggcctcaggagctactcctcgcccaggtccatggcgacgctgccgtccttgaggaagaggtcccagggcatccgctgcgactacatcggctcctccaccaatatcatcatggtgaccacgacgaccctgatgctgttcgccgggcggttcgggctggcgccgtcggcgaacaggaaggcgacggcggggctcaagctggaggcgcgcgagtccgggctgcagacgggcgacccggccggcttcactctcgccgacacgctcgcatgcggctccttcggccacatcttgggcgtcggcatcgtgctcggcctcaagaacaccggcgtcctcgaccagatcatcggctagaaccttccttttccgtcgatagctgttctgcatccgcatcgcgcgctccatgtagtggatcaattaatgctccctttgtgatttgatgatgtggtgtagtacaatgtatgtatgtgtatgcatctttgtttcagcgggacgtaccgccgcgccggtgtggcaactgcttcatcccatgcgtttttcatcatctatagtatctttcacatggtgaagatcgacttgtgctatagaaagagcaacataaagtccaaaaactaaattagtactcccactgtgaagaaatataagatcgtttacatcaaaa

SEQ ID NO: 29554 - DNA, 691 bp, Triticum aestivum
  Clone ID: PAT_TA_29554
catgcaggcgcaggaaattccacccctgagcaatcgcagcatccacagcacacaaatccgcagccatggcctcccagctctccgccatgacctccgtgccgcagttccacggcctcaggagctactcctcgcccaggtccatagccacgctgccgtccttgaggaagaggtcccagggcatccgctgcgactacatcggctcctccaccaacatcatcatggtgacgacgacgaccctgatgctgttcgccgggcggttcgggctggcgccgtcggcgaacaggaaggctacggcggggctcaagttggaggcgcgcgagtccgggctgcagacgggcgacccggccggcttcacgctcgccgacacgctcgcatgcggctccttcggccacatcttgggcgtcggcatcgtgctcggcctcaagaacaccggcgtcctcgaccagatcatcggctagaaccttccttttccgtccatagctgttctgcattcgcatcgcgcgctccatgtagtggatcaattaatgctcccttcgtgatttgatcatgtggtgtagtacaatgtatgtgtatgcatctttgtttcagcgggacgtaccgccgcgccggtgtggcaactccttcatcccatgcgtttttcatcatctatagtatctttcacatggtgaaaaaaagggggggggcccggtac

SEQ ID NO: 29555 - DNA, 2084 bp, Triticum aestivum
  Clone ID: PAT_TA_29555
ctcgtgccgaattcggcacgagatcgcagcatccacagcacacaaatccgcagcccatggcctcccagctctccgccatgacctccgtgccgcagttccacggcctcaggagctactcctcgcccaggtccatagccacgctgccgtccttgaggaagaggtcccagggcatccgctgcgactacatcggctcctccaccaacatcatcatggtgacgacgacgaccctgatgctgttcgccggggcggttcgggctgggcgccgtcgggcgaacaggaaggctacgggcgggggctcaagttggaggcgcgcgatccgggtgcagacggggcgacccggccggcttcacgctcgccgacacgctcgcatgcggctccttcggccacatcttgggcgtcggcatcgtgctcggcctcaagaacaccggcgtcctcgaccagatcatcggctagaaccttccttttccgtccatagctgttctgcattcgcatcgcgcgctccatgtagtggatcaattaatgctcccttcgtgatttgatcaaaaaaaaactgatcagaccctttggacatggcgtcgcccatgctctccacggccatggcgccactccaggggggcatgctggagttctccgggctgaggagctcgtcgtcgctgccgctccggcggaatgccacctccgacgacttcatgtccgcggtttccttcaggacgtacgcggtgagcaccagcggcgggtcgcgcaaggcgccgacggaggccaaactcaaggtggcgatcaacgggttcgggcgcatcgggcgcaacttcctgcggtgctggcacgggcgcggcgacagctcgccgctggaggtgatcgccatcaacgacaccggaggcgtgaagcaggcgtcccacctcctcaagtacgactccacgctgggcatcttcgacgcggacgtcaagcccgtgggcgacaacgccatctccgtggacggcaaggtgatcaaggtggtgtccgaccgcaacccctccaacctgccgtggggcgagatgggcatcgacctcgtcatcgagggcaccggcgtcttcgtcgaccgcgccggcgcgggcaagcatctccgaggccggcgccaagaaggtgctcatcaccgcgccccggcaagggcgacatccccacctacgtctgcggcgtcaacgccgacctctacacccacgccgacaccatcatcagcaacgcctcctggcaccaccaactgcctcgcccccttcgtcaaggtgctcgaccaaaagttcggcatcatcaagggaaccatgaccaccacccactcatacaccggcgaccagaggctgctggacgcgagccaccgcgacctgcgccgtgcccgcgccgcggcgctcaacatcgtgcccacctccaccggcgcggccaaggccgtggcgctggtgctgcccaacctcaagggcaagctcaacgggatcgcgctccgggtgcccacccccaacgtgtccgtggtcgaccttgtggtgcaggtctccaagaagaccctcgccgaggaggtgaaccaggcgttccgcgacgccgccgccaacgagctcaagggcatcctcgacgtctgcgacgagccgctcgtgtccgtcgacttcaggtgctccgacgtgtcctccaccatcgacgcgtcgctcagcatggtcatgggagacgacatggtcaaggtcatcgcgtggtacgacaacgagtggggttactcccagagggtcgtcgacctcgccgacatcgtcgccaaccaatggaagtgaacgccggacggcggcattgccctgtgaagtgactcctctcgaaattttccccagccatcgtcacggatgatcgattctttgtaatgagaattcagagtatcgaactcccaacagcttcttttttttcctttcttttcttgttcttcttttttctttctctgatttttcagtgtccagacacggattataatagacttcctgcaaaggaagtctcaacgctgtgcatctgtaatatatactatcgtttgccaggttctgatgtagaattcaactcgttcttgggatttggaaaaaaaaagggggggc

SEQ ID NO: 29556 - DNA, 1888 bp, Triticum aestivum
  Clone ID: PAT_TA_29556
ggtttttagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgttggacatggcgtcgcccatgctctccaccgccatggcgccactccaggggggcatgctggagttctccgggctgaggagctcgtcgtcgctgccgctccggcggaatgccacctccgacgacttcatgtccgcggtctccttcaggacatacgcggtgagcaccagcggcgggtcgcggaaggcgccgacggaggccaagctcaaggtggcgatcaacgggttcgggcgcatcgggcgcaacttcctgcggtgctggcacgggcgcggcgacagctcgccgctggaggtgatcgccatcaacgacaccggaggcgtgaagcaggcgtcccacctcctcaagtacgactccacgctgggcatcttcgacgcggacgtcaagcccgtgggcgacaacgccatctccgtggacggcaaggtgatcaaggtggtgtccgaccgcaacccctccaacctgccgtggggcgagatgggcatcgacctcgtcatcgagggcacccggcgtcttcgtcgaccgcgccggcgcgggcaagcatctcgaggccggcgccaagaaggtgctcatcaccgcacccggcaagggcgacatccccacctacgtctgcggcgtcaacgccgacctctacacccacgccgacaccatcatcagcaacgcctcctgcaccaccaactgcctcgcccccttcgtcaaggtgctcgaccaaaagttcggcatcatcaagggaaccatgaccaccacccactcatacaccggcgaccagaggctactggacgcgagccaccgcgacctgcgccgtgcccgcgccgccgcgctcaacatcgtgcccacctccaccggcgcggccaaggccgtggcgctggtgctccccaacctcaagggcaagctcaacgggatcgcgctccgggtgcccacccccaacgtgtccgtcgtcgacctcgtggtgcaggtctccaagaagaccctcgccgaggaggtgaaccaggcgttccgcgacgccgccgccaacgagctcaagggcatcctcgacgtctgcgacgagccgctcgtgtccgtcgacttccggtgctccgacgtgtcctccaccatcgacgcgtcgctcagcatggtcatgggcgacgacatggtcaaggtcatcgcgtggtacgacaacgagtggggttactcccagagggtcgtcgacctcgccgacatcgtcgccaaccaatggaagtgaacgccggacggcggcggcattgccctgtgaagtgactcctctcgaaattttccccagccatcgtcacggatgatcgattctttgtaatgagaattcagagtatcgagctcccaacagcttctttttttttcctttcttttcttgttcttcttttttctttctctgatttttcagtgtccagacacggattataatagacttcctgcaaaggaagtctcaacgctgtgcatctgtaatatatacgtacaagaagcaggacgcagccttggggtcagctggcttgaactggccgttctggatggactcgaaattcaagccgccgttgaaggagccggagccggtgttaccaccaaactcgactgggtgcaggccgtacctcggccgcgaccacgcta

SEQ ID NO: 29557 - DNA, 1615 bp, Triticum aestivum
  Clone ID: PAT_TA_29557
ctcgtgccgaattcggcacgagctgatcagatcctttggacatggcgtcgcccatgctctccacggccatggcgccactccaggggggcatgctggagttctccgggctgaggagctcgtcgtcgctgccgctccggcggaatgccacctccgacgacttcatgtccgcggtctccttcaggacatacgcggtgagcaccagcggcgggtcgcggaaggcgccgacggaggccaagctcaaggtggcgatcaacgggttcgggcgcatcgggcgcaacttcctgcggtgctggcacgggcgcggcgacagctcgccgctggaggtcatcgccatcaacgacaccggaggcgtgaagcaggcgtcccacctcctcaagtacgactccacgctcggcatcttcgacgcggacgtcaagcccgtgggcgacaacgccatctccgtcgacggcaaggtgatcaaggtggtgtccgaccgcaacccctccaacctgccgtggggtgagatgggcatcgacctcgtcatcgagggcaccggcgtcttcgtcgaccgcgccggcgcgggcaagcatctcgagggcccggcgccaagaaggtgctcatcacccgcaccccggcaagggcgacatccccacctacgtctgcggcgtcaacgccgacctctacacccacgccgacaccatcatcagcaacgcctcctgcaccaccaactgcctcgcccccttcgtcaaggtgctcgaccaaaagttcggcatcatcaagggaaccatgaccacaacccactcctacaccggcgaccagaggctgctggacgcgagccaccgcgacctgcgccgtgcccgtgccgccgcgctcaacatcgtgcccacctccaccggcgcggccaaggccgtggcgctggtgctgcccaacctcaagggcaagctcaacgggatcgcgctccgggtgcccacccccaacgtgtccgtcgtcgacctcgtggtgcaggtctccaagaagaccctcgccgaggaggtgaaccaggcgttccgcgacgccgccgccaacgagctcaagggcatcctcgacgtctgcgacgagccgctcgtgtccgtcgacttcaggtgctccgacgtgtcctccaccatcgacgcgtcgctcagcatggtcatgggagacgacatggtcaaggtcatcgcgtggtacgacaacgagtggggttactccccagagggtcgtcgacctcgccgacatcgtcgccgaccaatggaagtgaacgccggacggcggcattattgccctgtgaagtgactcctctcgaaattttccccagccatcgtcacggatgatcgattctttgtaatgagaattcgaagtatcgagctcccaacagcttcttttttttcctttcttttcttgttcttcttttttctttctctgatttttcagtgtccagacacggattataatagacttcctgcaaaggaagtctcaacgctgtgcatctgtaatatatactatcgtttgccaggttctgatgtagaattcaacttgttcttcgaacaaaaaaaaaaaaaaaaaaaaaaactcgagagtacttctagagcggccgcgggcccatccattttccgggcgggtg

SEQ ID NO: 29558 - DNA, 640 bp, Triticum aestivum
  Clone ID: PAT_TA_29558
gtcaaaatgcacttgccattaatttttgtatgtaaatgcaccttgtcagtagcccattttacagtagcgggctagatgcaactagtcgcgctggtgctgctaatttggaataaaatcgactgacttaaaccacattcagaacacaaaaaaggagtagtactgtggagattaactggcctggcggctggccgttggcaactccggttaccagtaaaacagacacgccaacgaacaagctcgtgcaagcagggtaggtcatgccctgtcttgcttgccgaacggtgaggacgacgaagacccgccgccggcgccggcgtcgccgtagccatacccgccttgccctcccgtcatcatctggtggtgatgctgcggatgttggtaccctgccgccggcggggacccgtacatgggctgccccatcatcatgaacatgccgccgccgccgcctccccctgccccggggccgccgtacatgccgccgtagccgccggcctcaccgcctccgccattgttccttggcgtcgactccctctgctgcgagccggagccgccggggagagggtaacgcgccaacgccgccggcgccgacggccttttcgccctccagctcgcggaacttgtgcagggtagagcttgagcg

SEQ ID NO: 29559 - DNA, 621 bp, Triticum aestivum
  Clone ID: PAT_TA_29559
aattgatatctttgcgatattaatatatttcctttatcggaaattgacatgtactacgaacataaagttcattcagaaacatgagacttctgtgcgactagtcctatgacacgacgcactagttttatttacccatcacctcgctgagaaggctgagatggaattactcaacgagcttgcgtctcctgtagcatttagatggcagctccagccgccgacacatcttgttgattttatagcataaatgtcttccggttgatgtcgaacttgtcggaagaagacagttgaggctcctgcacgccactgaagttcaccaccttccggacgtgcggtaagatcgacgcagggaggtcgcagtggatctggctgtcgcggttgcagtctacgaggatcgccttcgtcttttgaagcatctggccgtaggtgggcggccgatgcgcgcaccacgccgcagcgagacaactgcacgtcaaggctcccatggccatcggtctgatgggcgtaatccatactgcgcatctttgtcgtcggcgcagctactgatcaggcctcagcaagggcctcggcccatcatcccaggcaggggctacgggacacctggagggttcacacctcgggacc

SEQ ID NO: 29560 - DNA, 588 bp, Triticum aestivum
  Clone ID: PAT_TA_29560
gccatcgaagaaacaatgcaatttactgtaattacaagggcttgttcagccgaaccgtttgcatttgagagctgggacgtcctcacactcccacacagtgcatacaattagtgaacggcgatttgtctgcccatcgtcaatggggcgggggctcgaccgccgtcctgaagagcagtatgtagaccttatcaacagaaaagtacaagaatccgccattggcgtgcgtgacgtatgaaccgaagctcgtccccacgatgcagtgccaagccgcgccgtaagcggtgtcgaattcctgtcagcatataggataacaataagcgaaactgtatacgaggataggcacacaatgtttgaggattttcgaacaaataatgcggttaaattgtgaatgacattagaagaagcaacggcgaagttggcaggcattgagcatttgagcttggccgatgtgagtgttcagtccccagagcagtctgatcggcgcgtatattctggtcaaactttgctcatgccctcctgtgtggtgacagtgacaaccacatgattgcaacctttggactgttcgatttattaattgctctaatccta

SEQ ID NO: 29561 - DNA, 838 bp, Triticum aestivum
  unsure (1)..(838): unsure at all n locations
  Clone ID: PAT_TA_29561
aaaatgaaaatatttttttttcatggatcttcacataagatccgatgaatataacatcgactgagacttgtcagtcgactgagatttagcaaaattcatttctacaattctgagcgaaaacatacatcacatgtgctacagtttcagtgtttcatcccttcagtgaaaaactaaaaatacagtagctgtagaaaagcaaacatgcatgaaagtatcaaacacaaaaattccccttactgttcacgaagtagcggctgtagtggctttgccatctgttgcaatggcggcgccgtgagatctaaggtgatgaacaaactcgtcgatgtaccgttcctgccgttccgaattagctacgactacctgcatcttcgctgcacctgccacgaagttcctcctggcctctccgtcaaccatcacagcccggaccgcgctcgagacgccatggcggtcgaacgacccatcgctctcgtccctcgccacctgcaaccccaccttcttcacctccatttggcgtgcattcgggccttggtcgccgaagatgggcagcatgacgagagggtgaccgaacaggaggccctcgatcagcgaattccggccgcaatgcgtcaagaacccgcccacggcggcgtgcgccaggatgctcatctggggaacccggcccgtggtcaccagcccctggtcacgagtgcgctgttggaaaccgggaggaagcatgtcggcgccgtcatccaggacggcggcgccactgggcttccggagagcccaaaggaagcgcgtcccggcgagctccagccaagggccagcttgtgcacctgctccaggggcagngggactttgc

SEQ ID NO: 29562 - DNA, 728 bp, Triticum aestivum
  Clone ID: PAT_TA_29562
gaattcggacgaggttctctctttttttttcgtcccaatactgatcacttgttttataacaaaatcagtaggccacttggtgtgttgttacccactactatgtccatatccaagacaaactgactcgtctcacaaagaaaagaaaacaaacacatgccagtatacttgccaagttcttttgtgtaaaatctccctcaatagccaaaaacaaaattcctagatgtagcgacctaacaacaatttctttccttttggggcacaaaaatatacaatgtacaagttgggtgggaatctggtgcacgaagaggttttgtgtgaagagctaaaatccacaatgctatttgctctcaatggcaatagctcggagttctctgaggttgcaggcaatttcccttatgaattgggcgccttcttttccattcttaagggagtttatgctgtgctcgaggaaatcgcggtctccttctagagtcttcaatcttttattcaagctcgagatttcctcttgaaatgtggataggtcagcctcccccttagccaagagaatggactcttgtgtcccctctatagcatctgaatttgataaatctgtagaagtattgttgttggagtacaagtgaagctttttctccagcttcctcaaactttttgatatgtatgccctctcatcttcaaacaaagctgcagagcctatgttggtttttcaaagggggagctgattgtctttt

SEQ ID NO: 29563 - DNA, 492 bp, Triticum aestivum
  Clone ID: PAT_TA_29563
caaacatatgttctttcagactcttaatagaaacaactcatgagaccaacccaaactaatcgccaaaggagtacaataacttcattgagtttcaagaaaaaattacaagaacacgaacatataacatctaaaagataacttgacccagtggtggcacatccatattaaccagtttccactcttgagcaaatttgggtagctcatccgggtggtctctgcttgaatatactgttcacgaggcttctcctccgttagatctttttttaggatccttgatccgccactgacagcactcctaactttttcccgcaatcgacgctgccatcaagcaccgcctctgcccggtacttaaacttgaaccccagctccacaagcttgttcgtgttgacctgcactctgactccctctcccaccacctctttcagcgtcagcttgagctccgggtgcttgctcgcgtagtgctccaccagatcctgcatgttggggtgtgcg

SEQ ID NO: 29564 - DNA, 574 bp, Triticum aestivum
  Clone ID: PAT_TA_29564
atcgaaaaaggctttcgccccgttttatatataaagcaccgatcatcaagcatctagtatagacacacgccaccgcaacacacgcacacacccagagcaggatacataggcgctgagtgcagcaacaccacccctagcactaccacgacgaggagatgaagctacatatgacggaccatgagcttcaaggcggtgccttcaggaaggacacgacaccggagcgccgccaccgtccgatccgaggatcagagtttcccctggagccgcatgctgggcagtgagaaccgcgacaacgccttcaagaagggaacgaccttcgccgctgccggtccgtccgaagatagaacaggttttcacctgggccaacacccaccggcaccgaccgccacagcccgaccaccacgccgcccacacggccatggtgactgggcagcaccaaggcacgggctccgcccaagagcaccgcgctgcaccaccagggccgccgccccggcatccacgaccttgacaccacctcacccgagacccgccgcaaccccagcgaaagaggcgagcagaaaggtcccacatttcg

SEQ ID NO: 29565 - DNA, 434 bp, Triticum aestivum
  Clone ID: PAT_TA_29565
gggccgacggggagacaaggttgatagcattggccgactacctgctcccacaaagccacttcccttcacatcggaggaattagagtttactgccaagcgtgaagctgctaaagtgatcgctgcataggagggagtgcaaatcactgaagaagcccatccgaacttttattacttacataagtcctgcaccgggcatttataacaatcacctgctcttccctataggtgcattccttgtgggatccttgtgtttccttgtcatttgtgctacgcgggaatgacattgtcttcttctggtggcagtagtacctcctggtaagcaccagggctggcgggtaaaatatcctgtaactgtcttttgagagatcagttcattgttttcgttaatagaaactttttctctaggacaaaaaaaaaaaaaaaaaaaaaaaaaa

SEQ ID NO: 29566 - DNA, 598 bp, Triticum aestivum
  Clone ID: PAT_TA_29566
agcattgcaacatatctgatattcatcagagagtacagagtacagcgacaaaattgtacaaccaaatgaagtcaaattcttgaattcaccatgaataatcgacactacaaaacaaactcctggctggtggggtcagcatctccttattctgtaaactccaagaagaaaaacattctaatctaaacctcagatggagttgcactgaagaagcccttattcattctctttcttctctgcgccgcaactcgcatatctacacctcggcacactatgtacaccaacaaatccgacctcaaatctaacaaaaccgcctcctcccgcaatctcggaataaatcggagaacatatacaaccagccagatagatgaggtgaggtgaggtgagatgagatgctatcttgaccagggccctccaccaaactgcctgaagcaagcagcagaggaagaaggatgggtcattccctgtgcccattgcagattgctgtcgacctgactgcctgccacattattcttgggtgtacccatacatgtctgttgataaaggaaccatgttctcagcaacaccaagaggagcaactagattcctcctttctacaagg

SEQ ID NO: 29567 - DNA, 968 bp, Triticum aestivum
  unsure (1)..(968): unsure at all n locations
  Clone ID: PAT_TA_29567
ttttttttttttgagagagaaacagtgcggcatcactttattagcaatatattgttataacagttacagcatcctttgttaattacaatcctttacagatgagaagggcgacagttttacatcaagcacttgcacacttgcctccctgtaatgctagtctagcacaatggtgagccgctcagtcgctccgcacctgcgatctgaaattatttattttgtaggtcttcttcttccactttggtggtggctgtttggtgagatggtattcagctgaagtatgattcatcccccgcgacggctacagcttatacacctaggtgcctcttactggtccacctcgtcgggcaagatgacgttgttgaggtagacgagctgcatttcgtctctccagatcaggtccctgaattcgatcctgatggtgggcacatttgttctgtggatatcgttccctgaagggcctctcttgtagtagttcttgccaatccaatgtgccttgagagcatgtgaaaaccctgattgatacacagaatttctcgcaatttcacatagatcacaagaactgagcttccatagcgaggcagcgatgctgtattcttccaccaatggctcttttgtcagatgaatttgcaatggatcatccgtggacagcgagacattcagtccatcgtgggaaaaacataggaaaagggttcccgatggtaatcgcggtacaaggagttgttgctgagaggggacattgccagtcccatcggaccatccgtggacagcgagacattcagtcctcgttggaaaaacataggaaaagggttccgatggtaatcaagaaacaaggagttgttgctgagaggggacattgccagaccaatctgaccaaggtagtacagatattgaagcacaggagacttccttaaattgattccatgtgatatactgtgacaaagaagaaatgttgctgccaagnatcaacc

SEQ ID NO: 29568 - DNA, 1036 bp, Triticum aestivum
  Clone ID: PAT_TA_29568
ttgctgccgaagatgctacggagcttgccgcgctcctccagccgctccagcaggtcccgggcgccggcgacctccatgtccgacagcttcttcaggtacccgatggcgccgtgcgagaccatcagcttcttgcaccgcttcgccggcgacagcgtcgccaggcacgcgatggcgtacttcctcgccgtgttcgccgggctcggctccagcagctgcaccaggctcggcacgctcctctcgtccctccgcacctcccgcgcgttgcccgggtgccccgccgccaggctcgccaccgcctgcgccgccacctcccgcgcgccgcccgacttggcctccagcatccgcaccagcagcgggatgcagccgtgctcccccaccagccgcttcatgtccttgctgccgctggcggcgatcctgcagatcgccgcggccgccgcctgctgcgcgccggccgagccgaccctgagcgcgtgcgccagccgcgggagcacgccgagcgagacgatggtgtcgggggagatggcgtccaccatgttccccagcgcgcgcaccgcggactcctgcggcgacggcgcgtccaggtagaggagcaggctgcgcagcccgccgtcgtgcgccacggcgcgccggaagctgtcgccgcccgtcgtgaggttctgcaggcagtcggcggcgtgctccttggagcctagcacggtgccgtagtccagcaggctgaccatgacgcggacgatgccttcgtcggccagcgcttgccgcgcctcgggcgccgcggagaggttcttgagcgcgccggctgccgcggactgggacacggagtcccccgtctggcagatctcgatgagcgggcgcacgccgccgtggccggcgatggcgcgcgcgacgtcgggggacgcggagaggcgctgcagcgtgagcacggccttctcgcggccgacgaggctgctgccggactcggccagccggatgagcggcggcagcgcgccctccgacaccagcagcccctcgcaggcgccgcctccgactcggggagccg

SEQ ID NO: 29569 - DNA, 724 bp, Triticum aestivum
  unsure (1)..(724): unsure at all n locations
  Clone ID: PAT_TA_29569
agtttaaacgacgccnttggcnncgtaaacgactcctntaggcgaattggtacgggcccccctgngttttttntttttttatntttttttacattntgagtgtgcttcatatgtgggtggcggcgctcgtttttgtttctttgcaaagggtgtcttaatatgagcagcaaaggtcccttaatgggttatataagacgtaagcatgggtttattcgcctagttttacagcagaaaactggctatatacttctttgatacgaaggggttttctttctttctttgagacactttgatacgaagtagtagagcgttgagttcattattccaagctagtaatagctaggagccagcctagcctttggtcttcgctaccagttgtcggttcaggtcttcaggcccttgatcgcagcacgcagtttccgatctttggtgcctgatgaacaacggagccggctccgccaaaatggcatgaactgccagaccgcccgttgcgttggtagtaatcgttgaatgcgtaagacgcgtgcgcgacctttgtgtcaggatcaaagcaccgcgcgccgggctggatggcgctgcagtccgccccgtggccacacgcccagtccagcgccgcctggagccgagcgtccccgaccgccgggttcgccacgcaccaacttcctgtcttggggtcgcaggtgcctgctggttgccgggaaacaatggaagcggcgccggaaaa

SEQ ID NO: 29570 - DNA, 622 bp, Triticum aestivum
  Clone ID: PAT_TA_29570
gtcacaaacaaggcagcaataacatagatatggtgcattacatcacgaagacacgtgttcattagtactaaaacaaatagttatacaaatagttcaaacatagttgagttggaggacaaggttttgtggttctatttgttcatttgatcatgtttcctattgagccaatcaagtctccccttttttgtttcgatcagcatgaacaactctctatagttgggttggagcacaaggtcagtggctgtgaaatacaaaggagttccctcctcggccccacaatacttcgtcaaagtcaaaacttccttcatggtaggaacaacacttgctggagcatgagttgctgctatctctgagtttatattcccaagtgtggccttctactcacgtagaaaagggttcttgtcctccttagctgactcgtcaataaacttggccttgcgcttcagatattttgccgcctttccatccttaggtgagaccttgacctcctttgccgcctttccatccttaggtgaaaccttgacctccttcaatgcatttccatccttcttagacttttccacaacatcaggcatatcatcatcgtgttgtccggacttctcccaggcctaaatgatgtgcc

SEQ ID NO: 29571 - DNA, 1044 bp, Triticum aestivum
  Clone ID: PAT_TA_29571
gcacgaggtatcatatgagctgtaatgttcatcaatcaacttaaataactggtagcaagcaagtttcccacaagtcgcacagcggtaaatgtttacaggtccatgtaacacaacattcaacaaccaaatctctagctacatcgggtctcacacatgtcacacagcgaaagcgctatgcaaagatgcattccatatgcaaaaaaacgcttggcgtagcatcctagtacgtcttgacatcgatgtgcttgacacatcttgcattggcaagcagtatagccttcaacacgggaagcctgtcctcctcttcggcgcagtggatcgttaccttcttaaggcttttggcttggaataatattccctcagccatttgaagcggctgcttttgcgcttcacagtcaaacttgagcttcagatcaagattctcaagcataggagagtgcttgaggaagcaagctagaggagcaaatttgttggaaagacaccattcaccaagaatgagacttgtcagactgatgaacattgggcaccctggagtcattctatcgaacgcaacatgtctcactggtgttggcagttctatgctcttggcgtttgaaagatcacattaggattactgctgatgtagttcgaactatgtattttggagtgcacccgcatcgagtgtccttgaagcatagcgagaccagcttgccagtacgaatcagaagatgattcaaaactaagaagtttattatttccagagtcttcaatgaacttgatgaaatctcaggagaacaaagagtgctgtctgccaactgcagattttccaaagattcgcattcacggctgagctgatcaaagacagatgtgactattataacattagtgagcttcacagtttgtagatatttagagctaaagctgatagcttcaggatctaagtaaaaagcttcccatcttgtattttcagtgaaatcaatcgatttaactttatgaagtctgatagcatcaccgatccaatacttggctgcatcaatggcaaaagagtgaaggcggagtttgtcc

SEQ ID NO: 29572 - DNA, 809 bp, Triticum aestivum
  Clone ID: PAT_TA_29572
agcctacccccctctcccctacacccccgcgcctcacaaatggccgccatcatgcagtcggctgtcaccagccgcgttgccgccaaggcttcgctgaggcccgcctccgtcaaggcccccgttgtggccgcccccgccctggatgcccgcttcaaggtctggcagcccgtcaacaacaagatgtacgagaccttctcttacctgccccctctgagcaaccaggagatcgccaagcaggttgactacgtcatcaggaatggctggaccccctgcctggagttcgccgactcctccaactcgttcgtcagcaacgagaacgccatccgcttcggcaacgtgtccgcgggctactacgacaacaggtactggaccatgtggaagctgcccctgtttggctgcaccgaccccagccaggtgctgaaggaggtggctgcctgccaggtggccttccccaacgcctacgtgcgtttggttgccttcgacaaccagaagcaggtgcagtgcatgggcttcctggtgcagcgccccaagaacgctgtggagtactgcccccaggagaagcgctccgtttaagcggcgtgtcttggcgcgctgcaaggcgctggtagacatctctaggcaggcacattcttctgcacctttgaccgtgacgaaccatgaccacttgacgcaaattttttgtttgtgacgggctgccaactttggtggctttctttgtggggctcatgcactatgccatgagaggatgtaggcggtggtcaggggcaagggctgcaaacgacattgctttgtaaacccccaattccttg

SEQ ID NO: 29573 - DNA, 827 bp, Triticum aestivum
  unsure (1)..(827): unsure at all n locations
  Clone ID: PAT_TA_29573
gcagcagccatgtctagcagctccatctaggttagagagaaattgcgtgtgattggcaggcggctggaccaggcggattccaaagacggacagaactcaacttgtgatcttctgggcgaattcaggccaagccaatccgtgagggcagagcaggaggaggcacgcgttgaagccgcgggcacccatggaaacccatgagccttctggtcatcgtctcggcgactgggttgatggagagcagcagcacgtcgtctcctggagcgatatcattagtgggataggccgtagccttttcatcaaatgcctcctacggctgtccaggtcagactatggctctgtggcatgcttgaaccacgacttcaattcgctggtccgcagtggggagatctaccgcttgcgtcgcaacaatggcgtagcggagtactggctctacttctcctgcaaccctctgcagtgggatgcttacgacccacaccgtgggcgctggatccaagtgcccaagataccaccagacgaatgcttcatgtgctctgacaaggagtcccttgctgtcggaaacgagctgttggtgtttgggatggcacacattgtggttcaagatatancatcctaaccaattcatggacaaggggtggatccggtgaactccccccggnggcttttcgggatcgacaaagtgtcggtgnaaaangcatatnttgcgggggggcancnaattctttgtgggaagnataacttaagctcccgcggggattttntaaactccggcgaacacaataacnttgggnncaacccccttccccttggcaatngnaataaagggntag

SEQ ID NO: 29574 - DNA, 1356 bp, Triticum aestivum
  unsure (1)..(1356): unsure at all n locations
  Clone ID: PAT_TA_29574
cggcgagcgcacaaaagagtgagactacctagagcactcagcaccgtcgtaggctcgtcgccatccgttcagtgtctcagggtctcagcgtgcgtcgtctgatctgatggcggcaccagcaggagattcctccggcggcgacaagtacaggtctcacctggccggcgagggcgagaagaacaccgtgtggcggcacggcgcgccgcccacgtacgacgccgtgaacagcctcttcgaggccgggaggactcaggagtgggcgaaggggtcgctggaggagacggtgcagaacgcgatcaagacgtgggagatggagctgtcgcacaaggcccgcatcggggacttcaagtcggtgagccccggccggttcaccctgtccgtgaacggcgggcgggccctgacgggggaggagacgctggccatgggcagctacaacgcgctgctcgccagcccgatcctgccgggcacgggcgcgtacgacgccgccgccgagacgttcgagtcctcgcacgacctgttccgctccgccttcccgcgcggcttcgcgtgggaggtggtcaaggtctactccggcccaccggtgatcgccttcaagttccggcactggggccacatggaggggccctacaagggcaacgcccccaccggggacaaggtcgagttctacggcgtcgccgtgctcaaggtggacgagcagctgcgggcggaggacgtggaggtgttctacgacccgggggagctgctcgcggggcttgtcaagggccccaaggaggaagacgaggaggcggcggcgctcgccgggaggctccgcgaggcggctacggtgtcggcgtcaggtgccgacgcgcagccgcaggcctgccccttccttggctctggaaagcaggggtgatcgagtggcctcatccaataaaacgtgtcgagcctccagtcttcagggggttgctgttgcatcactgtttcgcaatcagaaagatcttttccgtcagctttggagaccaactgaaagctcagttcaacgtgtaatcgtactgtgaagtgcttgttgtttggttggaagttgttgggtcaagatcaggatcgatcgggatcggtgagtacagctctgtgaagaagtggtttctgacgtgctacatgattgattgctgcttgaattacaaaaaaaaaagaaaaaaaaaaaaaccgagggggggcccggtaccaattcgcctaanngatctattaccgcgctcactggcgtcgttaaactcgtgacnggaaacctggngtaccaactaaccgcttgcagaatccccttccaactggntaatacgaaaggcccacgatgccttccaaantnccacctaatgnaatgga

SEQ ID NO: 29575 - DNA, 2920 bp, Triticum aestivum
  Clone ID: PAT_TA_29575
cccacgcgtccgctcaatcgaccgagttaattgcctgtccgggccggaaaattcgtggagccgtcgtcgtcgtcgtggttgacggacgaggctggctgggagtgaggtggagcggatattccccccgccgatccctgccgtgtgcaatccacactgtgcgcggtcttcataaatagggcctccccgacggcggactcctccaacaatcttcttcctctacactctagctcatcttgcccatgcatttctccctggcttgactggcctgtgaagaagctgcacgagccaaccccctagttatctgtctgcctagctttcttcacagatgcatacgacctcttctgcatctccctcgtcaccaagctgctcggccgcatctactactaccgggaaggggcggacgcgcccggctcgctgccgcccaacctcgccgccgccgtcaacggcgtcgccttctgcggcacactctccggccagctcttcttcggctggctcggcgaccgcatgggccgcaagcgcgtctacggcatgacgctcatgtgcatggtgctctgctccatcgcctcgggcctctccttcgggtccacccccggctccgtcatggccacgctgtgcttcttccgcttctggcttgggttcggcatcggcggcgactacccgctctccgccaccatcatgtccgagtacgccaacaagaagacgaggggcggcttcatcgccgccgtgtttgctatgcagggcttcggcatcctcaccggcggctcgtcccgcggaccgccgccttcggcgcctccctctccccctgctatacactctagcccttcttgtccctggacgtccccctggcttcgactggatgtggaggaagctgcgggagccagccccctagctatctgcctgtctagctgcttcgctggaacgaccacgggcgcatgaaggtgcccgagccggcgcgcaacactgcgctcgtcgccaccaacgccaagcacgccgcggccgacaggtccaaggtgctccgactgggcatcggcgccgatgaagcggaccccacggccaacgacggtcgccccggagcggccgacgaccgcaactcgttcgggctcttctcgggcgagttccggcgccgaaacgctgccgacctcgtcggcacggccacctgctggttcgtgctggaaaccgccttctactcgcagaacctgttccagaaggacattttcacggcgatcaactggatccccaaggccaagccgatgagcgccctcgaggaggtgcatcgcatcgcgcgcgcgcagacgctcatcgcgctctgcggcacggtgccgggctactggttcacggtggcgctgatcgaccggatcgggcggttctggatccagctgggcggcttcttcttcatggcggtgttcatgctggggctcgccttcccgtaccaccactggacgacgccggggaaccacatcgggttcgtggtgctgtacgggctcaccttcttcttcgccaacttcgggcccaactccaccaccttcatcgttcccgccgagatcttcccggcgaggctccggtcgacgtgccacggcatctcggcggcggccgggaagctgggcgccatcgtggggtcgttcgggttcctgtacctggcgcagaaccaggacccggccaaggtggaccacgggtacaaggccggcatcggggtgaggaactcgctcttcatcctcgccgcctgcaacttcctcggcatgggcttcaccttctgcgcgcccgagtccaacggcctctcgctcgaggagctctcccgcgagaacgaggaggaggcgccggacgccaggacggtgcccgtgtgagaaacacgtcgtcagatagtagtatattctgcgagcaggtttcgatggatgtatggatgttttttatcgggtcggagagcgttcaactcaggagtcgagtcgagtcgagtacaagaataatctatctaatcttgtgatgggtcgagttgtccaggttaattagggctgctgctcgagttattagcagtgatataggtacggtgtaataccaagtcagagaagtgcatcgaagaggcaaagcttatatgtagcggatctggatccagctcggcggcttcttcttcatggccgtcttcatgctgggcctcgccttcccgtaccaccactggacgacgccggggaaccacatcgggttcgtggtgctgtacgcgctcaccttcttcttcgccaacttcgggcccaactccaccaccttcatcgtgccggcggagatcttcccggcgaggctccggtcgacgtgccacggcatctccgccgccgccgggaagctgggggccatcgttgggtcgttcgggttcctgtacctggcgcagaacaaggacccggccaaggtggaccacgggtacaaggccggcatcggggtgaggaactcgctcttcatcctcgccgcctgcaacttcctgggcatgggcttcaccttctgcgcgcccgagtccaacggcatctcgctcgaggagctctccggcgagaacgacgacggcgaggcggccgcgccggcgcacgccaggacggtgcccgtgtgagacagtcctcgtcagatagtatattctgcaggtttggatggatgtatggatcattttaatggttggagcgttcaaactcaggagtcagagtacaagaataatcgtgtgatgggtcgagttgtccaggttaattcattagagttgctggtcgggttagcagtaatagggagtgatacaagttaagagtgtagtagtgcatcaaagaggcacgcatatgtacgcgatatgatggaaaactttcatgcattttggcctgtgtggactggacaatatattatacagtactaaaaactaaaaccagctaaaaaaaaataaattaatcacttagtgaattct

SEQ ID NO: 29576 - DNA, 1070 bp, Triticum aestivum
  Clone ID: PAT_TA_29576
gccggccggaattcggcataccaatcgctcccacgaacaaaagccaccaatgggcctccacaaagctcatcgcagcgactcttctccccgctttcctcgccctccatctacacgccccagcagcaatggccaccgcggcaggaagctccaactccaacctcttccgcgactacatcggcgccctctacaacggcgtcaggttcgccgacgtgccggtcgacccgcgcgcccgcttcgacttcatcctcgcgttcgtcatcgactacaccaccgcgacggagcccccgtccccgaccaacggccggttcaacgtcttctggcaggacacggtgctcacccctgacgcggtcgccgaggtcaagcggcggaaccccaaagtgcgcgtggccgtcagcctcggcggcgccacggtcaacggcaggcccgtgttcttcaacgtcacctccggcgtcgactcctgggtccgcaacgccgtcgactccctcaccggcatcatccggcggtacggcctggatggcatcgacatcgactacgagcagttccaggtggacccgggcaccttcgccgagtgcgccggccgtctcgtggcggcgctcaagagcaacggcgtcatcagcttcgcgtccatcgcgccgtacggcaacggcgacgtgcaacgctactaccggacgctgtgggcggcgcacggggccgccatagactacgtcaacttccagttctacgcctacggcgcaagcaccaccgcggcgaagtacgtcagcctcttcgacgagcagatcgccaactaccctggagccaacatcctggccagcttcaccacggcggcgacgaacacctcggtgccggtcgacaccgcgctcagtgcttgccggactctgcaggggcagggcaagctctacggcatctttgtctgggctgcagaccattccaggaaccaaggattcaagtatgagacacagtcgcaggccctgttgactgatgccaccacttactagttacccacagcttcttggtttgcgtatatcgattttttagtgaaatcatatggaataaaatgagcatccgatttt

SEQ ID NO: 29577 - DNA, 1100 bp, Triticum aestivum
  Clone ID: PAT_TA_29577
aggggctctgggaactctgagatacatgcttggtcaacgtccacagaaacggtctggatctccaaggtcatttgcatccaattataataagcgctacaagccagatttccagccgatggcacaaaggattccttctggcagatattctaggaatgacagtcgtgttccctgattgttgtgtctgaattccgtgggcacgattcatcggaaattcaatgcaatctgtgacccccgaagaacttcagtaattgcaagtttgagcgagatggctgtgaaggcaagaaataactgtacacgcccgtaggtcttgttttcggtttctgagtcccccttcttgccccactgtcgtttccgagctaactcccagcagccgtggcttgaggttccgcgttggagatgccctaactcccagcaggtgcggcttgcatggacttgttgcaatctgttgcccaagtgagcccgctatgctgtcatatgacttccctcggatctgttacctgtgattccccatctgacagcggatcttagagcaaggatggcagtgcaactggttaagagagtttttcttgttgcatatcacgttaccacttaccactgtgttgctcctccaatggaaagggttgaactcgagttggcagctgttctccattttttccactagtgtatagacttggaggcggagcaattttttttctcattcaattttacggtgcagtgttaattggtcgagtcacttctgtaacttgcattacgagatttgcttctaccggtggctgctgtttttcaggctcttgcagctgaggcagggtgaagttatatcgactgtcgaaattatagtatagtgtgagagtggatttttggggccatgatacacgtgcgccggttttggacgctccccatcctgaaatgaacgacaccgggatttgttctaggaggcggtgaggcagcctgttgggttggccatgcaatactactgtattaacaacattcctctataaagttagcttggctgagtcaaaggactacgcatatcaaggatcttgatgtcagatccaagtgtgattttgccttggtatttataccatggttctccccaatgt

SEQ ID NO: 29578 - DNA, 985 bp, Triticum aestivum
  Clone ID: PAT_TA_29578
aagaacggcccctctcggcggcggggtcgccctccccgtgcgccgcgccactgccgaccccggcgcctccgaggaggtccggatggaggtctcctcgcacaacccggacgacgcgcagatcgtggtgcacaccaggggcgcctggaggatcaaggggataatgcaggtgtcaagatccattggtgatgtatacttgaagaaaccagagtatagcctggacccattatttcggcagatcggccctgttattgcgttgaagaggccagctcttagcgctgaaccacaaatccatgttcgcaagctcaaaccaaacgaccagttcataatatttgcctcggacggtctttgggagcatctcagcgatgatgctgctgtgcaaattgtcttcaagaacccaagaacgggcatagcaaaccgactggtgcgggccgccttgaaggaggccacgaagaagagagaggtcagtgtgcatgacctgaggacgatagagcggggcgtgcggcgccatttccacgacgacatcagcgtcgtggtggtgtacctcgaccggcaccggggccgccgtcagaccagggtggtggactcgagcagcaactgcaccagcgcccccgtcgacatctactcctcctccagctcggcttaccgcgactccggttaataggccagaccagacgggcagcagaagctcagaccatatatatgatcagggtggtagaaaacggtggtagggttgcagatcagcaacgcaagctgcaacccgcaagctgcagtggcagcgtccgaaagagatgcgcggaatgtacataagtagtgcgggcacgtggaacttttgtctgaagagatgattttttcgtatgtaattgcaggatttgactctctttttttggttcattatctctgcttagccagcagttaattaacccgtgaactagaacggtagcagtatatatcatactaaatttagaaagggcaccccggatttcac

SEQ ID NO: 29579 - DNA, 487 bp, Triticum aestivum
  Clone ID: PAT_TA_29579
gagcaagctgcacaaggagcaggtgtaactatactctgcgaaatgggccttgatccaggcatagatcacatgttgtcaatgaaaatgattgatgaagcacatgctctgaatggaaaaataaaggcctttacatctttctgtggtggacttccatctccagctgccgcaaacaatccactggcctacaagttcagttggagtccagcaggtgccatccgagcaggaagaaatcctgctgtctacaaatttcttggagagaccatcaatgtggatggtagtaaattatacgagtcagcaaagaggctcagactaccagagcttcccgcttttgccctggaacacttgccaaatcgaaattccttgatgtatggagacctgtatgggatctccaaagaagcatctaccgtatataggtccactcttcgttatgaaagatttaatgagatcatggctatcctggcgaaaattgggttttttggtgctggaa

SEQ ID NO: 29580 - DNA, 1841 bp, Triticum aestivum
  Clone ID: PAT_TA_29580
gtcttccaagcttccacttcaggttactaactggaagtctggactgccatgaatcagtaggagcagatgatacgactacattagacaagatcatcgattccttgacttctatagctaatgcgcaccgtggagatcctaatgccgccgagatatctctaaagataggaagagtcagcgaatgcggaattgatgacagcatggataaagtaggaccaaaggttttaatccttggagctgggagagtttgtcggccagctgctgagtttctaacatcttaccaaaacatcgaccaagtacatgttgttgtggcatctctgtatcaaaaagatgcagaagagacagttgacggaataaagaatgcaacagcagctcagctcgatgtttcagatactgaaagtctttcgaatcttgtttcacaggttgatgttgtagtcagcttgctgcctgctagttttcatgctgccattgcaagagtatgcatagagctcaagaagcacttggtcacagcaagctatgttgatgattccatgtcaaagttggagcaagctgcacaaggagcaggtgtaactatactctgcgaaatgggccttgatcctggcatagatcacatgttgtcgatgaaaatgattgatgaagcacatgctccgaatggaaaaataaaggcctttacacctttctgagatgagctttgatctccatccagaacaagggccagaggaacggggtgatccggcctctggaaccggagagctacatccctgcgctggagatcttggaagcgtcgggcatcaagctgatcgagagagtggagacctgaggatgtcaggatgggatgagaatctatcgagtatatatgctgcagcaacagaggcagtgagtaaatcaaatgatgattctcgccgttgtaagtaaaatgagtggactgtatgtatgtatgtgactatctattgtaccacatatatatcaactctgtcgccgatttagtgagatcatgactatcctggcaaaaattgggttttttgatgctgaaaatcatccactgctacaagaaactaatcgcccaacatataggaattttctcaacgaactccttaatgtcaacaatgtatccacatctaacacaaagataaatggtgaagaaactggaggacatgacgatgaactgatttcaagactcatgatgcttgggcattgcaaagaaaaggaactagctgtcaagatactcaaaaccatcaagttcttggggctgcatgaggagacacagattcctaaggattgttcaagtgcattcagtgttatttgccaacgtatggaacagagaatggcctatggccacaatgagcaggatatggtactgctccaccatgaagtcgaggtggagtaccccgatgggcgacccaccgaaaagcaccaagcgacgctgatggagttcggaaagaccgagaacggcaggtcgaccaccgccatggccctcaccgtcggggtaccggcagcgataggagccctgctcttgctccagaacaaggtccagaggaaaggggtgatccggcctctgcaaccggagatctacatccctgcgctggagatcttggaagcgtcgggcatcaaggtgatcgagagagtggagacctgagaggatgtcaggatgggatgagaatccaccgagtatatatgctgctgcaacagaggcagcgagtaaataaaatatgatgattctcgctgttgtaagtcaaatgagcgaactgtatgtatgtatgtgcctatctattgtgtatataccgaatctgtcgccggttgattcggttggtgaacttcccactcttcattgtcacatcaacatg

SEQ ID NO: 29581 - DNA, 629 bp, Triticum aestivum
  Clone ID: PAT_TA_29581
atagtatatcaaaactttgatcgaatctcaaggtggagatttcccagtttacccagacaccatgaaagagcaactgaaagcaagcaggagtaagatcatggctgccttgctggtcttcgccatggttactcaaggcttggcgattcatgtcaaggagatggtgaggaatgacttcaccgatgaggctgtgatcagtgcgaaaaccaccctcggtgcaggcagcagcacagccgtcgacaaccaccatgcaatcccacggggccagtatagtagccacggaggagaggacggatcaggtggcagtggtggtgatactacaaagaactagtgccattctctaagactgttctgttcggctaagatatattttatgatctatgatgtcatattgtatagatgtcagcagcgctaatattattattattcatgtctacatgaaaataagctgctgaagtgaagagtaatgtcgaagacaatatgcatgttatttacatcctcacagaaggaaaaagctatgttttattagaaaaataaagaagctatatatgtaactgatgtaatattctcgagcgtttgtgtaaggaaagtttcatgatgttacatggcagctatcaataaaatccatgcct

SEQ ID NO: 29582 - DNA, 743 bp, Triticum aestivum
  unsure (1)..(743): unsure at all n locations
  Clone ID: PAT_TA_29582
gtaaatctgttattataatatatttactcatgaaatatggtctcattgttgcttcttgagtaaatctttctgcgaaatcaagaatttcagcagagagtaatagccgtccgggacacaaaaatttgaagtatagggcaagcattctaattgttcacacatgaagtaatactcttgcaagagctacacactaagtactttaattataatcttttacgctcaggaaaaagattcaacctacaaatcttgaaagcattttttgaaatgtttttgcggagtaccttagaaatccaatagaaaaggctaataagcaaaatttcctgcttagttatagttctgtgattcattgctaataatcgtgcttctgtacggcccttgaaggatttccaggtgctgttcgatggaatgctcagtgggatgtgtgaattttatggtcagattttcctgccaggttgaatagctgatgcagtgcattgagtgttttccatctaccagatttttcctaatcgttatgcaggcttgtggatgttttggtcgagcttgtgcttggattgtaaatgtgacgtttttagctctgtgtaaatcccnatataattggccataataatgttttaagatagatgtacaatanccgcaggttgtagantcatcgaccttctgancaacggcctaattgttaggtcacaattgttggaaacacancaaattcttcttgtaacatggccaaatttgtaaaagacgggaaa

SEQ ID NO: 29583 - DNA, 732 bp, Triticum aestivum
  Clone ID: PAT_TA_29583
cggacgcgtgggtcacgatggatttggctctccggatgaaaatcctagcttcggtactccgaagcaggcggcggcggcgtctatgtcgtgtcctccttggaggcgtcgcttgggagaggcagttgaggctgttgcgggggatctctctaccatcagggtcagtggatgtcggggcagcggccccggacttgggcgccgagacggcggtctcgggaagcgatgcagtgacggctccatgaggcagtgagaataccccaccctcacgaagtccaacaataattgcttgcattccagtacagtatctagtatccgactccactagcactttgttgcatccaattttctcagctaagtatagcatgttcatgatccctatcatctccgttgaatcaacactgccaagttgaggcttaaaggccgcgtcaacattaactttcaccggggcatgcggacgcggcggcatggatggatgcagctaggtcattctctggatggggattgcaatcgggacgggtgtggttcgtgtgtgtgtacatttttgtgtgtctagagttttgtgtatgggtcacttgcaaatcggccctacaagtcagtaagggcaactaatgtcatttttgcaaaaactgacaggtctttttttggtcaactggctagagtaaacggtcaactcccggatgtgtaatggaatggcatttgtgatatattgtcaaaatctaagagtggcagaagtgg

SEQ ID NO: 29584 - DNA, 752 bp, Triticum aestivum
  Clone ID: PAT_TA_29584
tcgtcttcccctccgccatgaaggaggtcgcaccctcctcctccacgctccacttcccctctgacatgaacgaggacgaaccctcctcctccaccctcctcttcccctccgccatgaacgaggtcagaccaggcgtggttttggatctcgacgatcctcctagtcgctacaacagattggggaaagtcactaccgtcggggtggagcagggaatcggatgcggaggtgctgaaaaggaggcgggggtggatcttggcagtcatctccgctgtcggtcggggcggagcagagcatcccgggcgcaaggggtgctgaaaaggaggcggcggtcggtcttgggagctcgtcggcactcacggccatgtgcctctcgcccggtaatctcagtgttttgtatcagattgcttttggccatgatttcagatccagaacggagacatcgttcctttttacgtgtatgacttgatgcacttgaggggaaacaatggtgtccgcccgaggcaattcattgagactatcgatgacgactgagaaaagatgtgcctatgcatgatatgggggctgtcaaacatgcgtctggtgcaaataatcaagaaaaaaaagatccattatgtacccttttgttgcgatttggaatcttggtatgcaaacactatttgctttaatcaacaatttgatctgttgtgtatccttttgttgttggacctatatttctcttatgatcttattctgaacgcaagaagcttttgaat

SEQ ID NO: 29585 - DNA, 749 bp, Triticum aestivum
  Clone ID: PAT_TA_29585
ggcgacgtcgcgaagcgtgtgataaagaaggctgtttctacggctcgggcgaagtcaaagtccgttcgtgcaaaatccaagtcgccgatgaagaagttggcatcgcctgccaaaaacttgttgggcctcgctagcaaggcagtcgaaactgtgaagaacgccgcgccaaaactcaaatccgtgacgccgaaacacgccaagtccgcgtccccgaagaagaaggccgcatcggcctcgcccaagaagactgcttcccccaagaaggcctctcccaaacggagctccccatcgacgaagcgaggcgcgtcggcctctccgaaaaaggcctcgtcacccgcgaaggcggtagtcgaagctgcgaagaaagtggcgtcgcctgcgaagaaggtcgcagaatcgccgaagaaagcagtggaaactgtgaaaaaagccgcgtcaaacctcaagtccgtgacgcccaagcgcgccaagtccgccactccgacgaaatcttccccgaagaagaaggccgcgtcggcctcgcccaagaagactgcttcccccaagaaggcctctcctaaacgggccaccccatccacgaagcgaggcgcgtcggcctcgccgaagaaggcctcgtcacccgccgggaagattgcgcacgccgtaacgaaagccagctctgcgacaaaaggcgctgtcttcgcagtgctggacaagacgcctctgaaacgcgttgccgacaaggctcagtcacgcacgccgcagtcagc

SEQ ID NO: 29586 - DNA, 631 bp, Triticum aestivum
  Clone ID: PAT_TA_29586
gccgggccgctcgaagcggcggccgacagccgccggcaccaccgctcctcctccatttcgatccaaatcacacatccgctccaaggaaggaagccgtcagccatgtccggccgcggcaagggagggaaggggctgggcaagggcggagccaagcgccaccggaaggtgctgcgggacaacatccagggcatcaccaagccggcgatccggcgtctcgctcggaggggcggcgtgaagcgcatctcggggctcatctatgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggcttcggcggctaggccgcgctcgaactcacctcgtgccgtcaaattagtcgcttagctgtggttgttcagtgttcatcgtcttcagtgtaacggccgcatctcgctgctgttgttcagtgttgtgtgcttggatgcactatgatggaatggaaatcgcagcattttacccctgaattcgcatgtaatctgtggctctgttgatgaaaaaaaaaaaaaaaaatgggcccta

SEQ ID NO: 29587 - DNA, 1324 bp, Triticum aestivum
  unsure (1)..(1324): unsure at all n locations
  Clone ID: PAT_TA_29587
acatcccctcctggtgttctcttctcagcttggatcccgcaccaactgttcatcttcaaggctcaagtacatcccctcctggtgttctcttcccggcttggatccctgtgatcaagtgttcctctcaagcaatgagcaccggcggtataaccctagaaaacctaccgaaggaactaccactcgactttctcaaggaaattacgaataacttctccaatgaactactacttggtacaggtgcatttgggtcagtttataaggggattctgggtggtggtggagtggttgctgtgaagaaactcgcggaaaattcacctgtgccacgtgacaaaatatttgcgaatgaggttcagaatattatggtgctcgaacatgaaaatattgtcaagttgcttgcatactgccgtgaagcaaataacagattggtgcagagcaatggaagacacattattgcagagattactgaaactttactctgctatgaatacttacctaaggggagccttgagcagaagctttttggtgaatccattgacattgattgggacacacgcttcaaaataataaagggggtctgcgagggtatacattatctgcatgccttgcctagtcccgttctccatttgggtctgaagcctcaaaatattttgctggatggcaacatgacaccgaaaattgctgatttcgggttctccagaatatttggccaagaacaaacccgaatgaatacacgaagtgttgtgggatcggttggatacatggccccggagtatctatataatggtgaaatctcggcccgctcagacatatatagtttaggactaatcatcatgggagatctccacgaaagagaagaatagtcctagcactgaccagaagcatgcaaggaattatgttgatggagtaaaacaactttggaccccggagaaaataatgtctgagtaccccgatatagaagaccattgtgtcgatcaagtagaagcatgcatcaacattggtctacaatgtgtgggacattaatcaacacaagaggcctaccatacagaagatccgtcaacatgatcaataagctaccattggaattaaggagcaaggtcttgcatcccaagatgatgtnaaaagaagatccaacaatgctacactaagtgcaagtgtattatgggaacatgacccactattgtgacatggtttttaaaatatttaaacctttcctttgggagtcctcttttccacatattccctttttatcaagaaataatagtatgtgttgcacagttgtgccttttcaanaaanaaaangtgaaataaaaaaaccnaggggggg

SEQ ID NO: 29588 - DNA, 622 bp, Triticum aestivum
  unsure (1)..(622): unsure at all n locations
  Clone ID: PAT_TA_29588
caaccgattcgtgcgagcgcattgtcatccaaagtctgtccagagacaattttccggcagaacgttggctccccgtgggagagtgcgtgccacataccagatgtgttccctagccacagatgcagagccgacgatgactgtgggatagagtcagtaacatgcaagaggagaacatgcagtatggctggatactgcggcttgtggctggcggtttactagccaatgttgttggagaggattatactttcgccattcgttcacagaatgatcaaaataaggtaaacaccaccttgaaaatagaatgttacccacccgcttcagcctgactttgtacattagaatagcatcgatagcagattcgtgacgtctgaatcagccaaattaacctgtatgtcaaatgctggtttgaagtttcatgctgatgtgatgtatctgcggtccgatatatgggtgtattttattgtgcgatatatgtaattactgtctgatctgattattttagcacatgtgggcatgcaaaaaaagaacatactagagacattgtacattctggttaatttgttcggacataataattaagttcagtcttttgtttnnnaaaaaannnnnnnnnnnnaaaaag

SEQ ID NO: 29589 - DNA, 149 bp, Triticum aestivum
  Clone ID: PAT_TA_29589
gactagtggagtttgatcttctgtagggcggagtgattggatgtctggctagagatccgtttgatagcgtggtttgttttcctttatatttggagcatctgggttcctcttagctcatggttttgattttaaccgaactgcaagttccc

SEQ ID NO: 29590 - DNA, 814 bp, Triticum aestivum
  Clone ID: PAT_TA_29590
ggcgcagcgccggcgagttgctggagtacgggagggaggcaccgtatggattgtgcagcggcgaggaggcgccggctgcttccgcttccgcgccacgaaggcgacgatgcgcgagtcccggcctcgtccagatcatccatcgccaattcgccaggtagtagatcaccattgagaggtgctgcttctaaggtgtaaaatccatccagatagtggccgcagcgttgccgctggacggtgcacactggagctggagtatgcagccacgacagagctgctccgacatcactgtaggacatcggtgagtacagcggcgtctacagctggtgggagcggcggtcaagatcatgggcatggcttggggagtggtgcttgtgtcgaccagtgaggggcgcatctgctaccaacatgccaaggatcagtaggcgtgactgatgatgcagagccattcctggggtctcgacgatttgggagtttgaggttatcattgattaggtaccctggagagctgcaagctgcttgtcttgtttcgaatcatgttcctgctgttttatctttatccccgctgagagtgcattatgtgggtagtgtaatcatcatgctctctgaggacatgtatagagttgcaactctatttcttgaaaattaaccttgtaaattcctgtttccttagaactgttcctgtaaattgaccctgtaaattcctattttcttaagaactggtcctgtagagtcgcatctttgttctcttgaaaattgaccatgtaaattcctattttccctagaactgatcctggtaattcttccctgtatttta

SEQ ID NO: 29591 - DNA, 993 bp, Triticum aestivum
  Clone ID: PAT_TA_29591
cgcaaccagttcattttgtgaaatgatttcgtcccgagatcaaaattgtcaaatttgccgagcaatagcaggatacgttacgctttgggctcaacatctactaacgttagcatcaccgctgtcatccccatcaccacctgtcatccactgccatcgtcgtcacagccaccagcaagggttcccaaactccaagaggcaaggggcacaaaatgtgcactgtcagccaaaccatagatatccgagtctccgcagagtggccttcacgagctccctatctgtatctggtacatacaagttcagtgaacccaaggaacaggtcaacaggtgctactcgctcttttcacacaagtcccaagcagcacaaagccatgtagatttccaagccgaatcctttctctatgcaaaaggattgccagtagatacagtgctcaatgttatgttcctcaacggagagttcggggcctgctcgacaagacatgttagtccaccatgtgatccagacggaacataggtagaagtattgttggagaaccatgattcaggcaagccatcaagaaaagaaattggtaaattagggcaaagcagcttgcagcgtgctcatgtccatgaacagattagtagcctctgaatcagtaccaaaggggagatcaaatggatttagcacaatctgatcagcaaagggttttcccgaaggaacatcagatattggagatggctctaggaaaggagcaaatgatgcacttagagctaattcatccatgaacacattatggcaatcatcaccatgagatttctttgaactaatagggcaactaaaaggattgttggtaacattgactacatttgtgagctcattacttagtggctcagcaccagagtgatcattagagatgatcccagttgcatcatcaaatgaatgccataactgagagcaacttgtatcaagagatgtagcaccagactgattgctgattgaaacttcgtgcttggaag

SEQ ID NO: 29592 - DNA, 604 bp, Triticum aestivum
  Clone ID: PAT_TA_29592
aacaaggaacatccaactccatatgggcagaataaacattcaccaaaaacaatctgatcgaagcagctaggcatttcggttttcaactttacacaaaatccatagctgggccttcatctcaaggcagctggatggatgggtattgtcatataacttatacatatagattttggccgcaccctagtagctactagcaactaaggtatggggggtgggaatcgtcagctaccttataatacatatatgtacacaagtcttttcgtcgtcatactgtatgtttgctaaggatctccatcggcgggtttctcccccatcttgccatcatcccggggcaacgctttcgcacggtccagtatcgattctctgatagccttgtatttctttagctcctccagtgcgtccgctgccgtctttgattggagcaaggcagagcttgatgccatatcgccgtgttcctcggtcatgaccctctgaactgaagattcttgaggaactgggggaggagcttcgattgatgggcggcttgccctgaggcccggggcccgtcttgagcatgcgcacaagagcgccgatgcctgcagctggagtccttgccatcgagcct

SEQ ID NO: 29593 - DNA, 517 bp, Triticum aestivum
  Clone ID: PAT_TA_29593
tttacaggcagatacggattttttatctaaggacaacaagtaaatacatacgaagtacataaattcaactagtacacactattcctactttaatcattaataagccaaaagcttgtaagtacaaggtctgacacaacattttttttttttgaaaaaaactatatacgattagcggagcggctgcatcctcttcctaactggaagtacacaaggggaagtttgtgcagttcccagtaattgcattctttttctgtcaccaaaatgcagttctatcccattctagtgatcgagtctagtgtcgccctcaaaacaaggtcgtctttgcttgagtttttgtagtatttgtttgtagcttttgtagacatgccaagttgttccttcctgttgctgccatggctcgccaccagtggctgaacttgctctgcgttcggcatccggatcaggggactctgacccccatctctctctctctctctctctctctctctctctctctctctctctctctctctctctc

SEQ ID NO: 29594 - DNA, 486 bp, Triticum aestivum
  Clone ID: PAT_TA_29594
ggaaattaaagaagtagcaacgatcgagtatatatgccactacacgagtacattaattataacaagaaaaaggaagaggcactgagaaaggcacaagattcttgcgatcactagccacatatattatgctcccaagaaactatagccagcaaatatatagccgctccactcaccacccaaaagccagctgagcaatgaaccaatacacatgagttgatgagtacgatagctaaatattaatggcgccccattatacatggagatgtatatagtatcaagaatcgactacgaacgtaaatgaaaaatgcgggagtgctagcttagctagtaactgatgatgatcgtactagtaaccgacgagagcagcggcggcagttacggcggccacgaagcagagcacgggggccgaggcgctgcccctggtcgcggacgaggacggcggggaccggtagtaccatgggtaccatggcaggatggggttggggg

SEQ ID NO: 29595 - DNA, 590 bp, Triticum aestivum
  Clone ID: PAT_TA_29595
acttgcctctcacagataacctttgtattcacaacctcgacaacgaacggggcaggcgggaaggagcaaaattctcagcaagcatcacggtcgcctcatgcaatcttagcccgggctaagcgctcgaggccgaggacgttgacaaaggggacggcgtgccggattcctcctcgtagtcgtcgaggtcgtcgaagccccacatttcctccccctcgtcgtccccggccgccggctccggcatcgcccaccgctcctccgtggtctccgcgccctccagcaggtccaggacctctgtcatggacggcctccacgtcgccgacgcgcggacgcagagcgacgccacgaacgccagccgccgggcctgctcggcgtcgtagccgccattgccgccggcgaggatcctcgggtccagcagcgcctccgtcttgccctcgctcagcaggggcctcgcccagccgaggaggctcctgtgggtgccgtccaccggcttgcgggccggccatgagctccagcaggaagacgccgaaggcgaacacgtccgtcttctcgtccacgatgcccgcgcgtgtagtactcgggcgccaggcacc

SEQ ID NO: 29596 - DNA, 590 bp, Triticum aestivum
  unsure (1)..(590): unsure at all n locations
  Clone ID: PAT_TA_29596
cgggccgaccggcatgagtgggatgagtatggagaggagtagtatatatagtgacggtcttctgaaaggaggtgataaagccaagcttgaggaagcggtcaatcagttgatggcgatggcgatggtgacgtcgcttgctggtaagatacttgatgctccggctggagccgacagggtgcgtggagctggtgatcaaggagtcttgtgtgttgctgatgcctgacgctgtgctgtagtttttctgctcctttgaacgctgtggtccattggtctctatatagttctctctactgctttgaactctaatgttgtggttgcagctggttgcaggttttgggcccggccgagtgcttcgatgccgaaacctcggagcgtgttttggacaacagcgtgcctctctagagtgggtagtggtaagtgcgtcagggccctggcgtggtaattggcttccctgaaatttaaaaaccaaagtcccgggaaagaattgaattgattngaccatattacattacnatttcaaagggttngaaccttnnccttaancnatcangagtttngntaattnccngnggatggaacaaatnnctccc

SEQ ID NO: 29597 - DNA, 662 bp, Triticum aestivum
  Clone ID: PAT_TA_29597
gttgaacagatgcagttttattaatccctagagcttatttgctgaaatttacatgatcaaacctgatggttgttgcgctgctatatttatggcctgttttatttcaaatcttgtttgaatttcggccgaatttcggccaaatttcggccaagttttggccaaattttcaaattttgattttgaaatttcgtccgagattttgccgaaattttttaaattcccgaaattcggccatttcggccaaagacgaaataaaacacaaaccgaaaatcaaaacacagactgcactgcaagttcagccatgttctcaagcaccaccataactgcatcatctgtaatttcagtgtccagcataacaaggtgtctcctcttttgaaacatcaagggaaaactatatgacaatgattccttttcgttgaagttgtccgtatatatagccctctttcttgtcatcagctccagaagaaccaccccgaagctgtatacatcacttttgtcagtgagatgacgactgataaagctctctggctcaaggtagccgagtgttccatgaacaaacatgatgaattcactttcatccatggacttaagtgctgatgctccgaaatcgccaacttttgcgttgagctgatcatccaagagaatgttggcagacttgacat

SEQ ID NO: 29598 - DNA, 521 bp, Triticum aestivum
  Clone ID: PAT_TA_29598
ggaacaaagaacgcgaaactttattaatacctcatgtacaacaacatatcccttctctggtgttccgcagatgatgaaacatatggatcgagtggtataaaaatatgcaacaactgatctgctctggttcaaccatcttcaccacagacaagaggggattggcatccagggtttttccacgtcctgtacatcaaacacacggcgattggcgaatgcttctcgcacattggcacggctgacccagcctgtgtggattgactgcatcagaaggaactgttttggcatcccacgtggacgatgaaataggatctcccatatgctttcgtaggaaagttcaagtttgtatttcttccaagtcgtagatcaggcaaaagtaaatcttcttcatagcaaatccaaactcaacagaaacatctattccgctccacagaatagatagaactctttccctcataatcatcttatataaacaaacattctaggagccaatggtttaacaaaagcaaaagaaaattttgggc

SEQ ID NO: 29599 - DNA, 1220 bp, Triticum aestivum
  Clone ID: PAT_TA_29599
taggggccttttttttttttttttttcttaacttgaagatcatcaaattgcatctcatttattcataatttacaaaaaaaaagattgtgcatttggaactcacgtggctgacaagtctgaaagggataaagagaggagcaggagggaaaaaaagatgcaatgtgatcaagacctatatttcttttagtgttcgtggcctatatattgtatcgaactcatacagttcagagcccagagatctacaggtagataccctagatacggcttatgtcacggccgaatatcatcgtggtcagccagttgatagccacatagagcctatttctccagctgacaacacgagtcaggtacgctgagcgccagatgaaccagcttgcaaatcctgcgatggatatgcccttcgagtccttgctttgcctcaggtctaccagagctttgtaccttccaacggttgccatactccctagatgcttatacacaaactttggacctagatcgacttcgacctgggaatttgcgtgccctcctccagctttcatcacacggttgagcaggcgagcgaggtacaagccttgccgctcggcaacctgagctaaggctgggagaacttccttgccagtgctttcaaggaatccacagcaatcaccaacagcgaatacatctgggacagaaggaacacgtaaccactcatctacaccgatccttcctccgtgggacttaggaaatggcaatgacttgacgaatgatgaagcaccaactccagtagaccataccagcaaaccataaggaacctcctctccattgtccaggattagtttgtcaggttgtacatccttcacgattcctcgtacaagtctaacacctgacttaactagttggtttatagcatactgcctgaggcgaacatcaaaggatgacaatatctcatttgcctcaatcagggtcacatggacataatctttcacatgtgagtaacgttctttcacatctctgatgatgaaatcactaagttccccgctaaattcaacccctgttggaccacctccaacaacaacacagtgcaatagcctgcgcttctcaccctctgatatgccgggtacatcagacagcatcagattcagaaggagcttcctgcggatctcttgagcatcgtgaacttcccgaagaaaggttgcatgttcagtaacaccacgtataccgaaagtcgatgcctcagctcc

SEQ ID NO: 29600 - DNA, 856 bp, Triticum aestivum
  unsure (1)..(856): unsure at all n locations
  Clone ID: PAT_TA_29600
gaattcactagtgatttcgagcgcccgcccgggcaggtgagaactagtctcgagtttttttttttttttgctctaagtgacttgatcaactaaaacatagataaatacaaatgtactggcaaacaagttctcgctacccagtactatcagcctacttgatgtacatttcgaaaatgcatatgctgtttcagcgacttttggaagttgagagtcgcgatcaggaattactcttgtggaatgtggattcccatcatagtaatctaccatccagtacgatcataagcagaaggcttatttcatcctctgtttttgccagcgaaagctttatttacattttacgtcccagatgatgtttcttatcgcaagcaatttcaacacacgcggccttgacttggactgctaacccaggtcaggtgtctccaccatcgacatgcgccggccggctcttcccccgttcctcccgtgatagcccatcctctgcttcgagcatacgaacggcctgacccatagtaggccttctgtcagcaacggggtctacacacttgagcgcgactaggagagcacgcttgagagcctgtttagttggtttagcctccatttcagaatcaaccacctcctctgctctcctgctgccaaccatctgtttaagccactccaccatatggaccttattggcaggccggctgtagttaacaggatcccttccagtcacggcttccaagagtagtaccccaaaactgtacacatcggctcttttcatttaacagtccagtatttacgtattcaggggcttacatagccaaaagtccncataactcgagtagttatttgggctcttcccttcacccaagagctt

SEQ ID NO: 29601 - DNA, 723 bp, Triticum aestivum
  Clone ID: PAT_TA_29601
gagttgaaaaggcacaactgttcaacaatgttccctcatgataatataaggtaaatatttgttcgataaaactaaaaaggaaataaattttaattagttctgcaatgatgtgatatcgggtcatgttgccacaaaacacttgtattattgtagcattctgggatcttgttttacttcatcttgtacttttcttattgcacaatgcatagttgtgccctccccggggattggagacctcctcgttcatttgtagctagcgattactgaaacttgctgataatctcctgaatggaaggtctctccttctgatcaatctccatccattgcctggcaatcttgatgcaggcttgcatttgattaaaagaaaccttttctaactaggtctactcactcatactttactctttccagtgtccaactttctttgaatccatcaatatatttgcatgcttccttccggtccgtgctagaacttttcatctctctcgtgtatctctccattatgattaggcctaaactatatatgtctgggcgagccgagatttcgccattgtacagaaactctggggccatgtacccaaccgatcccacgacacttcgtgtgttctttcgggtttgatcttggccgaatattctggagaaaccaaaatccgcaattttcggtgtcatgttgtcacccagtagtatattttgaggcttcagacccaaatggcctcgtgccga

SEQ ID NO: 29602 - DNA, 1321 bp, Triticum aestivum
  Clone ID: PAT_TA_29602
ctctatcttccgcgcagccgtctttcccccatcgaacgagatctcgtcacagtaaagaaaacctcccagggcagtaaggcccaggttacttactctcccaacctttatcttcagctcagctgacagttccccaaggaacaagaaataacctaccattcctgcctatgtctagagatcttgttatacatcagttagacaggagaaggggaaaagggcgccagggcaaaatatttattcaaactactgtgcataataaaagccgtcactcaactcatgcgggatggaatgcgcttgccatgagattattacagcgtgattcgcgcacacacgcgccagtatgctccagggtggaaaagggatctttcaaacacccatatgtctttcaccagcacctcctttgacttgtctcctgacacaacctctctttttgaattataggcttcaaatttctgcttagtgatgaactcaagcgtaagctgtacgtaagctttgttaaggtcattcttatcaagagtaatcatacgagccttcaaagttcttatgcttacagcaggctccaccaattcccagtgtacagatttccacttggattgtcttttccttatttcatttttgacagtagaatgcatatcatctgtgagagctttctggagagatggtatgtctcctcgtgcaataagcttgttaacctccttgtatatattaaacgcttgctcctggaactgttttttgttatatccgattttcttcctcaactttgacacagtaaatgcattcatgaactgcagaatagcatcctcttttgttctactccagccacttggtgtaaacaatcttttccaaaatgggataggttccgggacacggtatggctcaaaaacaaaaccagggctcggcatgtcagctttcaaagcaaccttgtaaccaccaaaagaaacgccttcggacagggatggtggttttggggccgcgcctgctcctgacgacattggtcttgcatgatttaggtggactgcaagctctagaatctgcgcggtgtggacatgcgacggccctccaaacttgccagaaatcacgccgccgccattgtatgctaagcttgcaaagcctcttacagatgtattcgcgtggatcagagctaaagatcgggaaacggtggcatagtgatctggcggcagcggcggaggcaggtggagaggccggtgaaggcggcggaccagcgactggccgaggcgggccagagacatcggcgaggtttcttctccgcgacggcgccggcgacgggggttggggaggtgcgaggagcgggacggaagtgggc

SEQ ID NO: 29603 - DNA, 438 bp, Triticum aestivum
  unsure (1)..(438): unsure at all n locations
  Clone ID: PAT_TA_29603
tctgtcgaggacgacgggtcgagagggaggaggtgggctgggccgcctgctggctgggccggccagctggctgggctgcacagggaggagcccaggtaaggttctcccttttatttatttctgtttttgtaatttctgacatttgttttgatttaataaaatattaaatcatttatttaccttatgccaatttttgcaggagctagatatattattccagagctcctttataattggcataatatttggacatatattaatatatataactaatatatttccnaatgcaaatatttatgcattaattccaaatgcccaaaataaatacctatgagctcttaaaaatattggtttgatttttatctctgtccaatattttcagagagcaacatgagcattttcttggacccttttggagaaatttctatttgggtcatt

SEQ ID NO: 29604 - DNA, 1049 bp, Triticum aestivum
  Clone ID: PAT_TA_29604
actagttctctctctctctctctctgcacagctttaccgatatcatcgctgtttcccttcttgtattttatgataagagatctggggattgctaaaagaacagaagatatcgggttctacgctggtttcgtaggtgcctcatttatgtttggtagatgcttgacttcgacagcctggggaatagcggcagaccgtattgggaggaaacctgttgtcgtgctatgctgggtttctgtggttgtgttcaatacattgtttgggctgagtgtcaactattggatggcaataactacgaggtttctccttggcgctttaaatggtttacttggaccaatgaaggcttatgccattgaagtttgccgacctgaacatgaacctctagcactatcacttgtcagcacggcatggggaataggtctcatcattggtcctgctcttggaggctaccttgcactgcctgcagaaaaatacccaaatatattttcacctgactcattatttggaaggttcccctacttcttaccatgcttgtgcacatcagtctttgctgccattgttctgataagctgcatatggatgccggagacgttacacaagcataaagtcagtgatgatggaaatcaaagtgttgaagctttggaggcccatctgattgatccaaaagaggaggttggacaaagtaatagttcgaataccaagaagagcttattcaagaattggccattgatgtcatctataattgtttattgcgtcttctccttccacgatatggcttatacagaggtgttctctctatgggctgaaagtgacaggaagtatggtggactgagtttatcatctgaagatgtaggtcaaacacttgcaattacagggtgccagtcttctttgtgtatcaactatttatgtacccaaccatcattaatcttcttaaaccgatcccatcggctcccgaagcaactgttctgtgcatacctattctctttgcattggttccttggggccccttacccccttaatttttttttttttgcccttaacccccctttttt

SEQ ID NO: 29605 - DNA, 997 bp, Triticum aestivum
  Clone ID: PAT_TA_29605
cacgagcgcgcagtccaaatggcatctggtgtcaagaccattcccgagagcgtctgtagcttcgaaccatcgctgtggaaggacttcttcattcattacaagccagagccactttcgaggtcagaagaatggatcaaggacagaacccataaactgaagggagatattcatatgttgtttgagaatcatagtaacacgatagatagaatgaacttagtggatgtaatccaacgccttggaatagaacacctctttgaggagcagatagctactgccctaagtgacatccatgaaagtgaattcaatagctcgagcctccaagagatttctctttgtttccgccttctcagggagcatggaatctgggtatctccagatgtattcaagaagttcaggggtgaagatgggacattcgatgactatgtaacaagcgatcccaagggactcttttgtctctacaatgcagcatacgttttaatccatggcgagctggaactcgaagaggccatctctttcgcaaggcatcatttggaattattggcacccagcctcacgtccccttttgcagagcaagtcaaacgtgcacttcatgtaccactaccaaggacctataggaggctggaggcattgcgctacatgccagaatacgaacaagaagcagggcacaatccaataattctagagctcgcaaagctagaatttaacctcctccgggctgtccacttgaaggagctcaaagctatctctgagtggtataatgatctttctggatacgtggaactaacttttgcccgggatcgtgtggtggagtgctacctttggggatactctttgttctatgaggaagagtatgcgcttgcacgaatgatctttgctaagttaacttttttgcacacactgttagatgacaccaatgatgttggtgccaccttagaggagtatcggatgctagacacagccatacaacagatgggacaagagcgccatttatcttgta

SEQ ID NO: 29606 - DNA, 886 bp, Triticum aestivum
  unsure (1)..(886): unsure at all n locations
  Clone ID: PAT_TA_29606
gacccacgcgtccgcggacgcgtgggtccgcataacccgcgaagaggactgggtagaaggggagcctccgagggtctggtcttgttgcctacggcggtgcaaatctgacgaccgcccgccgccggcgatgggctgctggtgggagcgcctcgtgctgccggtgcgcagggcgtggctcggcgtcgcctcccgcttcggcgtgcgccagtccgggctgtggaggctccggcaggaggtgagcacgtgcgagtacgaggacgtgcgcgtgatgtgggagatgctgagccgcaccgcgacggcgccgccgccgccggcggccaggcgccacagcaggttccggcagccgaggccgtgggccgacaggctccgcctctgccgggacatctagaccaggaccgtcgaccgggggccgccgcgcgcttgcttgcttgcggcttactgcttggtcttggtggcctggttaattagcttcttgatctgtattgacctcccttcccttccatgggttctcgatctttttcctctgctaccgccgctgtatgtatgcacgctgcttggggctctgaggtgtactccattcctccccgtgtatccggtcgatccgcttgtagatgggtgatacctctggggtatgtgaatgaacagagctgttccgttcgaataaaaaaaaaaaaaaaaaaaaaaaaaaaaaaaaaaaaaaaaaaanaaaaaaaaaaaaaaaaaaaaaaaaaaaaaaaaaaaaaaaaaaaaaaaaaaaaaaaaaanaaannaaaaaaanaaaaaaaaanaaaaaaaaaaaaaangggggggccccgcttaaaaaacccaaattatactccccgggattggaaagaaaaaatttttttttaggggccccctaaattaa

SEQ ID NO: 29607 - DNA, 1641 bp, Triticum aestivum
  Clone ID: PAT_TA_29607
gctggagaggtcgccggcgtcggccgcggccccggggacccgcgccggcgtgctcgccgtggtggactcgaggaccgggaagcggtacgaggtcaaggtctcggaggacggcaccgtccgcgccactgacttcaagaagattaccgctggaaaagatgacaagggtcttaagacttatgatcctggttatctcaacactgcccctgtgcgttcttccatctgctacattgatggggatgagggaattcttcgctacaggggttatccaattgaggaggttgctgaaagcagttcgtttgttgaggtcgcctacctcttaatgtatgggaatttgccttctcagagtcaactggcagcctgggagtttgcaatttcacagcactctgctgttcctcaaggactcttggatatcatacaatcaatgcctcatgatgcccaccccatgggtgtccttgccagtgcaatgagcacactttctgtcttccacccagatgcaaaccctgctcttagagggcaagatctgtacaagtcaaagcaggttagggataagcaaattgtacgagttcttgggaaggcaccggcaatagcagctgcagcctacctgagactagcaggaaggcctgccgtccttccttcaaataatctttcttattcggaaaatttcttgtatatgctagactctttgggtgacaaagaatataagccaaatccccgacttgcacgggttctagatatcctttttattctccatgctgaacacgaaatgaactgctcaacagctgctgttaggcaccttgcttcaagtggtgtcgatgtcttcactgctctttctggtgctgttggagctctatatggtccactgcatggtggcgcaaatgaggcggtacttaaaatgttgaatgagattggagctgtggagaatattccagatttcattgagggagtgaagaacaggaaacggaaaatgtcaggttttgggcaccgtgtgtataagaattatgatcctcgtgctaaagtcatccgaaagttagcagaggaggttttctctattgttggacgggatcctcttatcgaggttgctgttgctttggagaaggcagcactgtcagacgattattttatcaagaggaagctgtatccaaatgtggatttttactcaggcctgatttacagagcgatgggattccctacagaatttttccctgtgttatttgcaattcctcgcatggctggttggctagcacattggaaggagtcacttgatgaccctgacaataaaattatgaggcctcaacaggtatacacgggcgtttggctgaggcactacacccctgtgagggaacgagtggcatctaaccagggcgaggagctcggtcagatcgctgcatcaaacgcaacgaggcgtcgccgtgctggttcttccctgtagaacagcagcaggcacggatgcatggtgcagcatccagcccacgcaataaaccaggctgctgtcgttgcccctcacaacgccgcagcggctcgagtccgggagctgttatccttctggtgtcaccaagacacttagcagttgccatgcaataaacttctagtaaaaggcacgctgtggacactatctatgcacacacttccagtttccagctt

SEQ ID NO: 29608 - DNA, 1886 bp, Triticum aestivum
  Clone ID: PAT_TA_29608
cacccccctcggtgcgcgcccgggggatcgtcgcccccggtagaagggcggcagtgcgaagaggactgactagaagcggtgcctctgagggtctggtcttttgtctacggcggtgcatatctgagtatctgacgaccgcccgccgccggcgatgggctgctggtgggagcgcctcgtgctgccggtgcgaagggcgtggctcggcgtcgcctcccgcttcggtgtgcgccagtccgggctgtggaggctccggcaggaggtgagcacgtgcgagtacgaggacgtgcgcgtgatgtgggagatgctgagccgcaccgcgtcggcgccgccgccgccggcgaccaggcgccacagcaggttccggcagccgcggccgtgggccgacaggctccgcctctgccgggacatctagactgggaccgtcgaccgggggccgccgcttgcttgcttgcttgcggcttactgcttggtcttgtgtcctggttaatctagcttcttgatctgtattgaccttcccttcccttccatgggttctcgatctttttcctctgctaccgccgctgtatgtacgctgcttggggctctgaggtgtactccattcctccccgtgtatccggtcgatccgcatgtagatgggtgatacctctgggggatgtgaatgaacagagctgttacgttcgaaaaaatctaagttaaaaacaaattgaactgctcaatagcgacttataagcaatctgctctgcagcttagctgaggcaatcagatatctgtgtggtcctttcttagccttatctttcttactcagtgattgctcaaatcggggcgagacatattgggtcacataaattagaactgaaaagcctgttctagattggatctagggagaatattacagatttcagtgaaggactgaataaccggatccggagcatctgaggtgttcctcgcctcgtgtagtggcgatgtcttcaccgctctttctggtggcgttggtgctctatatggtcctctgcatggttgcgcaagtgtggcggtacttagaatgttgaatcagattggagctcaggagaatattccagatatctttgaaggagtaaactgcaggaaactgtagatgtctggttttgcctatcgtatgtatcagtgtgatgatcctcgcgcttttgccatctggtagttgccagtactggttttcgcgatttgccgacgcgaaccgcaaagcgatgttgctgttgcttcgggacaggcagctttggcagacgcgtatattatcacgcaggaagctgggtccaagtcactacacccatgtggagggaacgtagtgggcatcgaacctaccgagagggagctcggccggatcgttgccaaaaaccgccacgacgcgtcgccgtgctggtttcttccctgtacgaacagcagcagacactaaagttttgaggcctcaacaggcctatgcgggcgtttggctgaggcattacacccctgtgagggaacgagtggcatctaaccagggcgaggaacttggtcagatcgctacatcaaacgcgacgaggcgtcgccgtgccggttcttccctgtagaacaacagcacgcatggatgcatggtgcagcatccagcccacacaataaaccaagctgctgtccttgccactcataacgccgcagcggcttgagactgggggcggttacccttctggtgtcaccaagacacttagcggttgccatgtaataaagtagtagtagaaggcacgctgtggacactatctatccacgcacttccagtttccagcttcatctctgcatgcatgcaatgtgagctcatgattggaaaaaataaatcatactcccttcgtctcaaaaaaagaatcacaaattttaaaaaaaaa

SEQ ID NO: 29609 - DNA, 285 bp, Triticum aestivum
  Clone ID: PAT_TA_29609
caacaaagaaccgctgaggcggaaaggaagcagagatcatcaaactcgggaggaagagggagaggcggtgtgatggtcctccccaagggaaggggaagctctggatcaggatggacaggtgctgggtttgagacatgatgctgggatccgtagttatatatacttgaaagaattggcatggttgtcttggtataaaacgatggcttggttgtcttggtataaaacgatggcttggttggaactggaaggttgaaagtgtaatggaatgtcgatcctttttggatg

SEQ ID NO: 29610 - DNA, 775 bp, Triticum aestivum
  Clone ID: PAT_TA_29610
gggtcgacggggatgagttccgacagcacgacggcatggtgacgatcttgatgttctaccgtcgcatggcttcgcctaatcaccgctacaatattatcaaggattatggtggaggggggcaccgcacacagctaaaagatcaatgatcaaatgttgtgtgtctggggtgccccctgcccccgtatatagaggaatcgaggatggggccggccaacgaaggtggcactcccaacggggggtcgaccaatcaacttacacaggcttccaagaccatcccttaggccccttaactctgacgataaatgaaccctgtggagagacaacaagccaaaatcaaacagattgtccacaactgtttcaatgggaatgcagcgctcactattgaaatatcatacacatcacaaaattagctattactgttatatctagataactcataatgaagaaaacctacactaaaggcagcatcacccacaagtataacccttgtcatagactggaatgaaatagtagccattaggagcacattgggtgctttctttcaccaaaccatcaacagtacacagctcaacctttatgtcagagtagtcgaacttggactccgacgccctcttcgacttggccaggcccgagctcgcttcgacaaaaccgccgcatccgtcgatctcgtcggaagcagcggagaaggcggcgagggtgaggaggaggaggaaggggaggagggggtccatagatcggatctagtgggcgcagagcatgccagggagcctcgtgc

SEQ ID NO: 29611 - DNA, 472 bp, Triticum aestivum
  Clone ID: PAT_TA_29611
caggtcgagggctttccggtagcgccggcagcgcgtgcagtaaatgcagcaggggtggccactgtgtggtagggcggtgaagttggattgcgctctcatcccctacggcgaaacggtggggagattgactgcgcccagggcgctgccgcctaccagcgagctcgcagttgctccggcggccatggagttcttaatgcagccgataaacaggtgactgataacaacagcacaatggagcccgtgcgggtcctaatcaccgcgcagccggaggttgagcttccagcaccggcggcttcaagtgcggacgcccagatctgtcctgcagagacgggaactgcggagatggcccaaacttccgagcactccatagagcaattggaccccaaaacacctggttggatacaaagagtgcgtgtaggtgctgctgctgtaggcagggctccttgcctggacagggtcacagcgctggaga

SEQ ID NO: 29612 - DNA, 841 bp, Triticum aestivum
  Clone ID: PAT_TA_29612
atactagcaagttattaatcactcgggctccatgcattcagacatttgggtgcatctcgcatgcaacgcatgaacacgtacgtacacagcacacacggaaacactatatgtacgacacacagagtagtagctagctagatggggatgggcttgacgaataggctcttgatgatgtcgtcaagatgcgagctgaaggtgaaggcatctttcctgtcgccatagtacaccggcagactgagagtgaagttgataacccgttgcaccgccggcagcagctcacggccatgttggaagcgagcttggttggtgatcttccattcatcttctatcatggaatcgatggcagcaaaggcgacatcctctgtgaccttgtgctcgctcatgtaacactccacgcagttggccacgtccctgctgtcccggggtttggatgaagcagcaaggtcattcatcaggcgcccaatcttggcgcatgccatgacgacatcagggtagccaagtgcccactccagtgctctcttaggcatttcatcacccatgcaaaccatcgtgtacacgcagagccctgtaacgcccgtggacatggcagccaaatgcaatttatcttcaaatctgggcttgtgattactgcgtaaccattctgtttcttggacataacaactggactgctgttggaactccttcttgatgtgatcaatcgaatatctcccattgagtcgcaattcatcatcgaactccttaaagcagattagtagtttattatagaatttcttcaggtaccctggcacaagagaaatggcgctctcgtcccatctttgtatggctgcatcgagcttcctgt

SEQ ID NO: 29613 - DNA, 698 bp, Triticum aestivum
  Clone ID: PAT_TA_29613
tttttttttttttttttttttttttttttttcgtaactgcattgtattcatctgaactctttattgcatttccatccattacgagctgttgcgttatttgtagtactaagcaacaaaaaccaccagctaacacagcatcccctcgcatattcacaaacagcgtcactctctagtagcaacagcactcacacgaaaaccattgatttggccagctcgaaggccctttcccttccaaagagcttctccacgatggcaagcgagaattccatggaagtgcccggaccttggctagtgatcatgttgccatccacgacgactctgttctcgcattcgctttggtccgcgagtttgctccacatagcaggataggatgtagccttctttcccttcagcaggccatgtggctcaagggcaattgctggggaggcacatatggctccatacagtttgcttgcctcggcttgcttcttgatcaatccaatcagtttatctgatttggcatatgcttgggcaccaccaagaccaccaggtaacaaaatgagatcgtactgctgcttaagcgcatcatccaaaagcacatcagcaaccatcgtcacattcctggatgcaacaatctccaaagtgccttccaaggatgcaacgacaacatttgctttcgctctccgaagaatgtcaatgatcataactgcctccatctc

SEQ ID NO: 29614 - DNA, 1380 bp, Triticum aestivum
  Clone ID: PAT_TA_29614
cccacgcgtccgcggattgtgcaaatgctgtaaattgccttttggaatcagcggtacacctaaactacataatcgagcttgccgcaaataaacgtttcaccggttgcgtccgtggattagctgccgttgttttaggtgcttgtgtcctcaataatgcaagccgtgagaagggccgagatgcctttgctgttgcagatgctataagccaaaagattggccttactacatactttttgaggttcgatgagctgcggaaaagctttcttcacctaccatcagggcagcagaaccacaagcagctttcacggtcaagtgcaaacagtatgtctgatttccaagagattgaagaggaggaaacaaataaaggcgatcaacatccagtcctttctgaaatttttgattcacaattagttagtttactcagtaagcttgagactgatattagagaatgtataatggatctctttagtcgaacaaagaccgcaactgcagttctacctgctgagttggagcagaagaacggggaggttgatggagagtatatcaagcggttgaagtcatttgtagagagacagtgcaacgagatgcaggacttgctaggccgaaatgcaatcttagcagaagatctagtgagaactggtggtggcagcacttcagattcttccgagaaaccgagcagtggccgagaaagggtccagattgaagccctcagacaagaactggagggcgcagcacggcgaatagaggtgctcaaaactgaaaaagctcagatcgaagccgaagctagcaaccaacgaaatcttgcagtaaaacttgaatctgatctcaagagcttggcagatgcttacaacagtcttgagcagtccaactaccgccttgatgcagaggtgaaaaccttgaggcagggaggcagtgctccctacccggacgtagaagcaataaaagcgcaagccaaggaagaggcagagaaggaaagtgaggtggaactgaacgatctactcgtctgcctgggacaggagcaaagcaaggttgagaagctgagtgcacggctggcagagctcggtgaggacgtggacaccctgctgcaaggtatcggtgatgatgctgccttgccagatgacgacgatgatgatgacgacgaggatgcgacgatgaaaagtaatgtgtttctgcttcactttcatctatggtgtaacctagcatcatttattcaatcatggtgagtgatgtgggcttgtgataacaattgtacagtggaatgttggtgatgtgtagacaaaggtggccatttcatttctaagttatttatggatgccgagactgaactgctgaaccaccttctagtttaatttggttatttgttgtaaattataccatttc

SEQ ID NO: 29615 - DNA, 1128 bp, Triticum aestivum
  unsure (1)..(1128): unsure at all n locations
  Clone ID: PAT_TA_29615
ttntgaacgatcaatactgactggacgctatatttattctgcgaataaattgtccacaggcagaggcagacaaaattaaaataacaagattgacatgtgcaaaacgcaacgtcatcaccagcagccaatccaacagacttacttgatgatatttgaattcttgtcttgttgttctagtacaaaattagtactactacgatagtacagcaaggaagaagaaactaactcaagggacctcccattctcaaccaagctgcaatatgatggcatcgctcgtacagactatgttgcctactccgtattatacacaccgtccatcttgcatcaggagcattccccaaccattcattggcctcgctgcactacccctctgccttcaccttcttatggacattgctgtgtgccatagagcattgtgcccagactgcacctcaaatatcagcgactggcatcttccagtaattccaggtgttgtagtcctcctgctccggtggtgacgatagaggagggaacacccgattcacaagagcatgcagggacatgtatgattttgtatttacccggcgattcacagcaacttcacccttgggattaattatgaagatcttgcccatgggaatcccaaccttgaggtaactaagctcatcagtatctctattcccaaatcccgcatagaaaggatgcgagtcaggaggaaatagtgctttgatatccgctaggcatgagatcttgaattcatgaggagctcttctgataacttctctgtacaaagatggaaagaggccatcaggagatatcacgacagggccgtcaggaagtgcttttccgtcctgctttaggttgaaaagaaactgccttgttaggtgggcctgtgaaattgagcgcgcacttagaaaaagcaggtgatatccattttcctttattgcagaaaataaatgagcaactccattttgagaccaatcaacaccaaccattggcatgaactgacctagaacatcagacttggtgatagttccatcaacatctgatatgacaatgtgtgcattccattcccataaatatatgtgagcatctacctgctgcgtcccaagcagggcagtggagagggggntcaataaggctncatnc

SEQ ID NO: 29616 - DNA, 753 bp, Triticum aestivum
  unsure (1)..(753): unsure at all n locations
  Clone ID: PAT_TA_29616
agactgagtacagatttgaacatactaacatcctaataccncaataacagaaaagncaagtagcaggttgtgacacactgccaatcagtttnccgccactaaaacatcactgaatgtgaagttgcaacctaaaaaacatggcctcatgtcacaatgcattccctgggatcagagttcgatctttggttcccatcaccatcaccaagcccaatgaagaaagtctcatcaccaccagttgcgaaatcggcagcagatggttcatgatttgcgtacagttcagattgtgtactttgcagtcttaagatacgcatcatgacgtcagctgaaagtgtcatttctcctcgggaggcatagaattgcctctcccgcgcgtttgaagctattacctgtcatgcaacaaaacattactgtaaaatacgaaccgagtgcaacaccaagagcaagtacacggacaactgtacgaaccgagtgcaacaccaacaaagtataagacttactttatttgcatattgaggcaattgcatcactttgcttgacgaaggtgtccaaatcttaatggtgttgtctatcccactagtagctaggaagggaaaatgcggatggggttcgatgcaattaacgatatgtttatcgccgcgcatgatcctcatcaattcaccttcctttttcctccaaatgaacacatgcccgcagtctgacccactcaaaacatattcattattgggtccaaagaaactgactcctttaacagtt

SEQ ID NO: 29617 - DNA, 743 bp, Triticum aestivum
  unsure (1)..(743): unsure at all n locations
  Clone ID: PAT_TA_29617
gggtcgaccggcctcttccttacacccagctcgtatgccgggcgaaagcccaaatccatgccggattgagcgacagcggcgctccgggcgtcgtcaccttcttgggggtgtcgttcttggtgagcttggggtggatgtgatgctttggttgcttggcggcggattggtcttcagaagccctgccggtctcggcggagcggtgcttcatcctactcatggatggcggcgtatctcggcggcgtggcgcagtggagattcggcgtccgatgtgtggcgatggactcgcgcaggacgacgaagctgtctggtgtcgtggtgacgtcgatagctgagtggccagacaatggtagaatgcctcaatttgatctgaagacgggacctgtggaagatggcggcgacgacacacgagtgcgtctgaccggattatgccccaagaccaaggcatgtggctccgactgggggcttccgaatgtgtttcggcttccgggctattgatgttagcgattaccgtgagtgggtctggggtaagtggcccgggcctaagctctctttcatcatattgggatagggaagtaagtgggcatatgttgccaaagnatgaatgggattcaaggcacattgggtggtaaatactttggtaangggtcatccgtggaataaatcaaataaaaaggtgggccggtatggcaatccttcccaaaatgccaaaaaggccggggggggtccatcctnccttttctaaa

SEQ ID NO: 29618 - DNA, 802 bp, Triticum aestivum
  Clone ID: PAT_TA_29618
ggtttgcttctccctcttctctttttcttctcggtccatctcgggcacccgtcgcgtggtgttcttccttcccccgccggcctaaaaaaaagtgactgactctgatttggggtcagtcaatcagcccgatcagcccaacaagaaaacaaactgatccaccgcagacactttgtgttgtcgtgttctgccttctgtttaccccaaaagttaaaataggcctaacctggtaagcaacacccactacactaatacaactggatccaactcatgcaccgatcgctaggtcttcttccttcctcctccttcctcgatcacaaacacaaccaccgccatggatgcagaaacgaagctcagactcgagtaccctgtgatgtctccatagatcttcttgctcccatttcttccttcctacctcctcctccgatcacccatagatctgcagatcaagttgcttgtggtcagttcaaggtaaacgacgatctgatgcccttcacaatttttttgtgtcatgtcatgttggtaggtccatcctactgaagcaattgtcatcgagaacaacgtcgaacacctcaggaacttcttcaactggcacaaaaggcagacacggaggacccggacaactacaaagagggcaaaccatacctgatacgacagatagagaagaaaagatacccaacaaactaggaaatcaccgaggccaccacgaagagaagaagataaggcagcgcagcggtgatcgtgctacaaatcctagctctggatcggagaaggaagcgaggaagaggaggcaaacagactgagt

SEQ ID NO: 29619 - DNA, 1513 bp, Triticum aestivum
  Clone ID: PAT_TA_29619
ccacgcgtccgcgcctccctggccccgggcaccagcacgcccgcacgcccgcacgcccgcagcatttgattccctcccgcactgtctccctccctctatcccccgacgagcgcggcgcacctgcgacgagcggccgggtcccggtcgcggcggggacggcggctgctgagctcttccgtgccgtactctcatgatgtaccatgctaagaagttttctgtgccctttgcaccacagagggctcagaatagtgagcatgtaagtaacattggagctttcggtggatccaacataagcaaccctgctaatcctgtagggagtggcaaacaacgtctaagatggacctctgatctccatagtcgttttgtggatgcaatcgcccaacttggtggaccagatagagcaacacctaaaggagtactgactgtaatgggtgtaccggggattacaatttatcacgtgaagagccatttgcagaagtatcgccttgcaaagtacataccagaatctcctgctgaaggttccaaggacgaaaagaaggattcgagtgattcattctctaatgcagattctgcaccgggttcacagatcaatgaagcattgaacatgcaaatggaagttcagaagcggctccatgaacaactcgaggttcaaaagcagttgcagctgagaatcgaagcacaagggaagtacttgcagatgatcatagaggagcagcaaaagcttggtggctcacttgaaggttctgaggagaggaagctttcacattcaccacctaccttagatgactaccctgacagcatacagccttctccgaagaaaccacggttggatgatctgtcaacagatgcggtccggggtgttacacagccagggtttgaatcccatcttattggcccatgggatcaagaactctgtccgaagaccaacatatgcgatcctgcattccaagtggatgagtttaaggcaaaccctggtttgagcaagtcataaagcaaagccttccttacaaaggaaacacttctgagttattaacctccacggatggccgatcgcatgtgaatatatatcgtcttaacaacagattgagcactgtttggaccttcggatctgccccaaccccttcagtcacgactaagtgttgttgtcgttgtcatatttcgccatacagatctttgtaattatgagggtgtttctaaagtccccagttagcaatccccttcttccgaaggataatcctcaactgaaacatgtagcaagaaacacaaagtgcttacacgcaataccaaggccctaaagctacatgaagctatctggtagctgtacattcctgttcagttcagtccttgaatctgcttaccttatattgacccctctgccatagatctgggatgttggcagcaacatttttatttacaaatcaacctgtcttctggatgactctgcatttacgaggttggttgtactatttgccatattgggggatagtcctgtgctatgaatagagcactgaac

SEQ ID NO: 29620 - DNA, 691 bp, Triticum aestivum
  unsure (1)..(691): unsure at all n locations
  Clone ID: PAT_TA_29620
cggacgcgtgggaaacaagctttcccgaacaagaaccaattcgatcggccggggatcgatggagcccgatccgtccaagtcgccgacggggggatcttcgtcgctcatcttcctgggcacgggctgctccggcacgctgcccgacgcacggtgcctcctcaaaccgtcaacgccgccctgcgccgtctgctccatgggcatctccctcccgccggaggggaaccccaactacaggctcaacacctctctcttggtagactattgccatgacgatggaacacacaggtacatcctaatcgacatcggcaagacattcagagaacaagttctccggtggtttgtccaccacaaagttccttatgttgactcgatcattctgactcatgagcatgcagatgctgtattaggccttgacgatgtctgggtggtacaaccaagaaatgaccgaaacgatgtcgagcaaattcctatcttcctcacgcaattcacgatggacagtatcgcgagaagattcccctacttggtggagcagaagccagaggatggcgatgaagatgcccaagccgcaaaaatcgagtggaagatagttcaggatgatgttgagaaaccgtttgtagcatcagcactagaatttgtgccattgccggtaatgcatggagaaggtatatttgttaggcttcttntggggagg

SEQ ID NO: 29621 - DNA, 1240 bp, Triticum aestivum
  unsure (1)..(1240): unsure at all n locations
  Clone ID: PAT_TA_29621
gccggccgggccggaacctttgatcaagtgtcataaacctgacggttcgtgaggcaggtaaaagtagatggcaatgatcggtgaaatggatgcggacagcgttgtaggatactttaggaacaagagcatcctcattgctggttcaactgggttcctaggaaaagtgcttgtggaaaagatactgagggttcagcctgatgtgaagaagctcttcctcttaattcgggcccccaatgttgaatctgcaaagcttcgacttcagacagaggttacagcgaaggagatctttcaactgctgaaaaaaaaacatggtgtggggttcaaaaattttatcgaagaaaagatctgtcctttggcaggagatatcatgcatgaggactttggactagatagtgcccagctgagagctttgtgcaaggacatagacatcatcgttaacggtgctgcaactacgaatttctctgaaagatatgacgcggctttcgacgtgaatgtcttgggagcgaagaacgtctgcgcattcgcaaacaagtgtactaagctcaagatgttacttcatgtttcaactgcctacgtagctggtgaacaagaggggttaataccagagaagccattcttgatgggtgagacactgagggtgggtacacatctagacatcgaatcagagataaatcttatcccacaggtccgaagagaactaagggccaactgttccacagagaaagctgagaagaaaacaatgaaagagcttggcctcaagagggcacgacactttgggtggccaaacacctatgtcttcacaaaggcaatgggggagatgattatgggacacctgcgggggcgctttctggtggtcatcatccgcccgagcatcataacgagtacactcaaggagccatttcctggatggatggaaggaatcagaacaattgactcggtgatgatcggctatgccaagcagatcttgccattcttcatcggcgaccttgatttaataatagacgtgattccgggggacattgtggtgaacgctatgatggttgccatggcagcacaattaaaggatcaacaaccgcagatcatctaccatgtaacttcctctttacgcaacccagcaccctccgctcttgttgtggaatcaatgcaccgttacttcttcgaaaatccgttgtgcaaaggaaggaatggcgagcatgtcccgatgaagaagatgangttcttcagcacgctcgcacagttg

SEQ ID NO: 29622 - DNA, 1094 bp, Triticum aestivum
  unsure (1)..(1094): unsure at all n locations
  Clone ID: PAT_TA_29622
gggataatgctgcatatcaaaaggcttatcttgcatcattacttgctcagcagaagctacagtatggaatgccatacatgggcaaatctggtggtcttagcccaactctttatggcagtgaacaagcatatggcatggacatggcatatttatcaagtccaacatctagccattttatcccatctccccagggtcatgccaggcaaggggataggctaacaacacgtattccatccatggcaaggagcaccactggaggagctatgggatcatggagttcagagaatggtctggtagataatgcttatgagtctactctgctggaggaattcaagaccaataagacccgatcttttgagctgctagatattgtaggtcatgtggtcgagttcagctcggatcagtacgggagtcgctttatacagcagaaacttgaaacagcttctactgaagagaagaacatgatttttccagaaatacttccccaagcacgaacgttgatgactgatgtttttgggaactatgttatacagaagttcttcgagtatgggactgaaccacaacagaagcaattggcaaacctactcaagggtcatgtatatacgctgagtacacaaatgtatggttgccgggttattcagaaggctttagaagtggttggcgtggagcaacaaacacaaatggctttggagcttgacggaaacacaattattctgaaattagttcgtgatcagaatggcaaccatgtaatccagaagtgcatagaatgcatccctcaagaaaggatacagttcatcgtttctgctttttatggacaagtggttgaactttccacccatccatatggttgccgtgttattcagaagagtcttggagcactgtgatgatgaaagcacgcaaaacgccatgatggaggagatcatgcaagtgtgtgggttcctttgacacaagaccagtatgggnaattaatgttatccaagcaatgtccttgcaaacaatggggaaaaccaagaaaggaaacgcaccttctataaattaagncaacctttgctgggacaaaatncgtggaaggatgagcccaacaagaaaattcc

SEQ ID NO: 29623 - DNA, 444 bp, Triticum aestivum
  Clone ID: PAT_TA_29623
ccgggccagaaacacccgggaccacacactcccacagcttcagcagcacagcacacagcggcttcttctccgttggcggcggcggctagggttttaccacctccctccaaaaccctaatctttccacccaatccaatccgtccgtcgtccatgccggcggcctcctgctagattcgaatcgcgccggagttgtacttagtttgagtgcttggtttggtgctgtgcggcggagatgacgtccaaccagttcgatctcctcggcgacgtcgacaacgacgacccctcgcagctcctcgccgccgccgccgccaagaaggccgccgagcccaagcccgcggcgccggcgccggccgccgccaagcccggctccaagccgcccgccaagaccacgccgcccgcggaggacgcgaggggcagccggggggacggcgccgggcgcgggag

SEQ ID NO: 29624 - DNA, 708 bp, Triticum aestivum
  Clone ID: PAT_TA_29624
gccgggtcgggaaaccaatgaaattcatttcatagtgatctagacatggcgatcaagcttataccagtagcatttttcttgctcatcctagcctttgctgagtccagcgacaggggcgaacctccatcttctcaaaaagatggctttggtgaaagtgcgtacgcggtacattgggatcccccttcaaaagaaggaggttctggggcaagtccttataaggtgaattggagcccagaagatgcaccttccaaagaaaaaggttttggggcaagtgcttatgcggtacactgggatccagatcatccaccatctgaagaaaaaggttctgggacaagttttgataaggcgacttggagcccagaagatgcaccttcaaaagaaaaaggatttgattcaagtgcttataaggtaacttggatcccagatgatgcaccttctgaagagaaaggatttggtgcaagtgcttatgcagtacattgggatccagatcatccacctgttgaaaaaaccgcgcgtgacagcaatagccatgtgtcatatgaacacatctgattgggacacgcggtgctctgagctgttggatggagagcgtggcgaacctatttggcactacatgcccaccaattacatcatgttctattagatatatttaaagttcatgttcaactatgtaatcttgttatcttatcaataaagcgtgtcgagtgg

SEQ ID NO: 29625 - DNA, 626 bp, Triticum aestivum
  Clone ID: PAT_TA_29625
cgctttcccctctcccgctttcgtaacgacgaatttctgaacctgctctgcagatccacctcaccgccgacgaagcgccggttccccttcctccaccggccgctccagcggcgggagtatgggggaacctcgtttctcggtgtgtatatagcgtaggctttgttaggttcctagccggcggcgtcctggagatggaggcgcggccggagttggttttgcaggtggcgctcggcatcttcggcgttggagctcggtgtagcttcacggcggagcacctccttcctcgcgctcgcggtccctggtggccgccgtgtgcgtttatccccgcactggagctcgacgcggcagctccagatcgagatcttgaagcgactggtgttcaagcaaggcaacatttcggccggaggagcaggatggaggctctccggagtttgaggaccgacgacttgccgtccgccaggggatatcttctgatccaaggctcgtgtgaagatgcggcggcggcgcgccatcggaacgtgctgttcctcgtcggcagttccgctttacagggggacttggttgtaatttgtatctttgtggaggtcctttctctaaaatccttgctttaatctctactcctaaaa

SEQ ID NO: 29626 - DNA, 1121 bp, Triticum aestivum
  Clone ID: PAT_TA_29626
agccctcgtcctcgagcagctgcaagccctctagccgtacgccatggcgcacgccgccgccgcagccgccgtgccgctgcgccgcccgctcctcctcttcctccggcccgcccgcctcctctccttcgtcgcgccccgctcgtcgtccgtccgcgcctacacgcgcgccctccgccccctcgcccccctcccctccgacgacgaggacccggacgacggggacggcgcgcccagccgcaacgagaagaagcgggaggcccgccgcgccgtgaagtgggtcatggagctcgccaagttctcccctccccagatcaagcgcatcgtcagggccgcgtcgctggagcgcgaggtggtggacgctctcatgctggtgaagaaatttggacccgatgtgcgcgaaggaaggagaaggcagtacaattacatcggaagcctacttcgcggtgcacagcctgaattgatggaagatcttatccattctttgaagaatggagatgaaagcaggatacaagccttattgagtgaagtggcagacaaatcaatgccgattgaagatgaggaagtgggagagttacctcatgaagaagaggatgagggaaatcaagagtatatggaaattgcagatagatggtttgagggcctcgtctgccaagacattccagttaccaacgaagtttatgcgattcataatgttgaatttgatcgtcaggaactacggaaacttgtgagaatagtccaagaggtccaaaaaagcacgcgagataaagatagcggagaaggatctgataaaaagctttccagggcaaagaaaccacttatcatgttccttcgctcccttgcaaagaagacacttgaataggatgtggaggcgcggaaaaggagggagacataaatagttttagcaatttttactttcaaagtgctaaagacatgttaatgcttgactctcatggtaaagacagccttatatagcgatgtgttgtcaagtatggattttgagctatagtttacagggagtggtgctttgtagtgacaggtagctaatttcctatgaacatttaacttttgctgatctaaaccatgcaaaaataagttcatagtataaaagaagcctcatgctc

SEQ ID NO: 29627 - DNA, 1538 bp, Triticum aestivum
  Clone ID: PAT_TA_29627
atgttcatcgagagcttcaaagttgagagcccaaacgtgaagtacacagagaacgagatccattctgtgtacgattacgaaaccacggaggtcgtccatgagaaccgtaacggcacttaccaatgggtcgtcaagcccaaaaccgtcaaatacgatttcaaaacagacactcgcgtccccaagctaggcgttatgctcgttggatggggaggaaacaatggatcaaccttaaccgctggagtgatcgccaacaaagaagggatctcgtgggcgactaaagacaaagtgcaacaagcaaactactttggctccctcactcaagcttcttcgatccgggtgggatcttacaatggtgaagagatctacgctcctttcaagagcctcctccccatggtgaaccctgacgatgttgtgtttggtggttgggacataagcgacatgaacttagcagacgctatggctagagcaagagtccttgacattgatctccagaaacagctcaggccgtacatggagcacatggtcccactccctggtatctacgaccctgacttcatcgctgcgaatcaagggtcacgtgctaatagcgtgatcaaaggtaccaagaaagaacaagtcgaccagatcatcaaagacatgagggagtttaaggagaagaacaaggtggataagctggttgttctgtggacagccaacacagagcgttacagcgatgtggtcgtagggcttaacgacacgatggagaatctattggcttctgttgagaagaacgagtctgagatctcgccttctacgctatatgcgattgcttgtgttcttgaaggcattcctttcattaatgggagtccgcagaacacgtttgttcctggactcatcgagctggctatatcgaagaactgtttgatcggtggggatgacttcaagagtggtcagactaagatgaagtctgttttggttgatttccttgtcggagctggcatcaagcctacttcgattgtgagctataatcatttgggaaacaatgacggcatgaacctctcagcgcctcagacttttagatctaaggagatctcaaagagcaatgttgttgacgacatggtggctagtaacggtatcctctttgagcctggtgaacatcctgaccatgttgtcgtcatcaagtatgttccttatgttggggatagtaagagagccatggacgagtacacctcggagatattcatgggagggaagaatacgattgttatgcataacacttgtgaggattctcttttggctgctccaatcatcttggatcttgttcttctcgctgagctcagcaccagaatccaattcaaagctgaaggggaggggaagtttcattctttccacccagtagcaaccatactcagttacctcacaaaggcacctcttgtaccagccgggacacctgtggtgaacgctctatctaagcagagggctatgctggagaacatcctcagggcctgcgttgggcttgcgccagagaacaacatgatcttggaatacaagtgaacacg

SEQ ID NO: 29628 - DNA, 706 bp, Triticum aestivum
  unsure (1)..(706): unsure at all n locations
  Clone ID: PAT_TA_29628
cgggggtctggacatggtgacagagtcacacacacaatttatatgatatcttgggaagatcagttctgccatagtgcccttgctgctgctgctacttttagcctttgtttccttgggaacatgttcagagtgtagataagaaacttatgctactatagatggatatatggcattcggtacatcgacagcaagaagacggatattctttttctgtaaaacatgaccctttgattgatttgggttcactactaaactttctaatgcttcctcatacgactaccacctctgattaatctcctttggattcagttatgtacttttgtttgtttccaactatttttcactcgggtttttgtgggtgttggtagctggaatgcagagcatgaagtggtgtaaggtggtgttgatgtgggacattgcagctgctcccagatcaattcaatgtccatttgaatattttagttcctttatgcctttgattatatattttactgaataatggggttatacttgtggagagtacctgtttatatttgttatgactattcacctacnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggg

SEQ ID NO: 29629 - DNA, 875 bp, Triticum aestivum
  Clone ID: PAT_TA_29629
cccacgcgtccgcccacgcgtccggcactacgtgcacgcggcgctgtacgagagcatgcggctgttcccgccggtgcagttcgactccaagttcgcggcgggcgacgacacgctcccggacggcacggcggtggccaagggcacccgggtcacctaccacgcctacgccatgggccggatggagtccgtgtggggccccgactgctccgagttccggcccgagcggtggctccgcgacgggcagttcgtcccggtgagcccgtaccggtaaccggtgttccaggccggcgtgcgcgtctgcgtcggcaaggacctcgcgctcatggagatgaaggccgccatcgtcgccgtcgtccgcagcttcgacatcgaggcgatcggccggagctcgcgccggcccaagttcgcgccggggctgacggccacgttcgccggcgggttgccggtcagggtccgccggcgaccgcgtggtgtgagcgggcacagcccaccaacctgatacggaataaacaacagttggtgtcctgacgatcgcgctcttgttggcctattctcgcccgtttcttcctttcgaacagggataaaatcgcgcgctagattgtatgccgctggcagtccgtggccactggtgccgtgagtgcgctggcgtttggcagcaccgagcagcagctgatcgatgatgctggacgattgattagtcagtacgtacgcagctctccacttgagattgagagtcgagatcgatagatctacagatagattcctcgaatcgacagcaaattattgagatcgggtcggagtacgcgcgactgttatgtggtacggataacggaaagactatataaaccgttgggggaaatacctccttggctctc

SEQ ID NO: 29630 - DNA, 692 bp, Triticum aestivum
  Clone ID: PAT_TA_29630
gcgtgctggctgttgcggggcggaccaaattcaagaatcagccggaagttcttgagaaagctaaatcgaatcatgatcccgaaggaagttcttgaacatccaagaaaactaaatcgaatcaagaaccaggacgaagttcttaaaattccaagaaagctaatactaatcactactaataaagcagctaatgcatctggtcgtacgtcgttggcgtttttgcgcaaaacctcctcaatagctttgaatcaagctctcagtccctgtttaagtggctctctcgaaaaacgtttcatgtttgcgcgacatcacagggacgacgccaccgccccggcgcctgccagatccaagcggggaaggggaggagggggcatcacagcggtggtgaagcggggcggggtaggcggcgggtcggccggctcgtgagacggcactggcaaggctcgtggcagggagcccctctcctctgctttgggaggtggctgaagcgctcgggctgcagagctgcggggcaggggccgaaggtggtggcgcggccgctggatgggacttggtgcaggtctccagcgagatggggatggcgtggagggagtcgggcgccgggaccgtgaactggcgctcgagagtgacacccgcagcgccgttgttgtgcggtggagctgctgcttccggcgggggtcctgctgctgctactg

SEQ ID NO: 29631 - DNA, 862 bp, Triticum aestivum
  Clone ID: PAT_TA_29631
cgggtccgacgggaaggcaaaggaagaaagggcaagctttccggacgagtgtgagtcggtcaacacgatggtgtcattcctgtggtggataattgggttctactgggtggtgaccggcggcgatatgctcgaacaaggtgctccaaaactgtattggttaactgtcgtttttctcgtgtttgatgtcttcttcgctgttttttgtgttgttgtggcctgcttcattggggttgcactgtgctgctgcttgccttgcgtagttgcaatactgtatgccctggttggccaggagggtgcatcagatgcagatattggtgttctccccagatataaatattctgatcccagtgagaatggagaaaaagggacagatgagggggttatgattcctatccttaataatagtggaacatcaacgagcgaacgaattctccttcgtgaggatgctgaatgctgcatatgtctctcgtaataggaagacggagtggagctatctgccctcccttgcaaccatcatgcaagtacaacattctcaaaggcagtgaaaactgaaaactcaccgaggacttacactgacgtaacttccatactcaaggcctgtatgcatgaacatcctggagcaagcagcaagtgagaagccttgtgattcccgtctgtttgtaaactgatgatatcaatgagagtctgtttgtaaactggtgatatcaatgagagtctgtttgtaaactggtggtatcaatgagagttttgtgaggattggctgtgctttctgtttaggatgtgagcgtgtacaagcgtacataaaaacattaacacatagtgggcacgctgcataagaagagtctcaggaatgcattagtga

SEQ ID NO: 29632 - DNA, 744 bp, Triticum aestivum
  Clone ID: PAT_TA_29632
gcacgaggggaatttgggccacgtattgatttcagagaatacacatttcttgagaatccatcattgcctaaacaggtgaaagagtcgtttcttgaggtgcggctctgcaatgagcatagcaccagatgctccacagccaatggaaccaataaacacagagcccttctattgccaaggaatagcaccgaacaaatgcttttggatgtcttttcatcgtataagaatatcaagatcatacatttctcgtctatggttgatggcttcagaggttttgctgatgcggctgtggagacgcagtttcggaatcgtgtgaagaggtatacaggaatatggtgttgtgttgagttccgtgaaattgggcacatatactatgacatgtactgggatgataaaccaggttggaagccacaccccccacagaatagggaagaggaccatccaccttgggcctgaattttgaggtcggacaatagatcaaccatgaaaagggatgacattctgtgatgaaggcaagataggtcacacattactgcaggttcatttttaactccagagcaggctgctcctatccgttggaaaaaaatgcttactcgagaaaacatttaacttccagttttgtaggcctgttctgtagattaattcactactgttcagtctgccccttgacctgtacttcttatcacatatgtccagaaaagttttcatgatatagcgtgagacaacatttaaggtaatgatttgact

SEQ ID NO: 29633 - DNA, 932 bp, Triticum aestivum
  Clone ID: PAT_TA_29633
gcctcaccatggcacaatgaatattagtggaaacaaaaaatattcatgcgaattcactagtgattagcgtggtcgcggccgaggtaatcctcgccaggttcaaggctttgttaaagatgctgatggcaccaaggttgcatccctgatgggcaagtgggacgagagcatgtattgcgttgttagtgatgatgcttctaaactgaactctcatacttcacatcagagcgctggcgccaccttgttgtggaagaaaaatgagcctccagcagatcccactcgatataacttgtcatcatttgcgattactttaaatgagctgactccagggcttaaggagaagcttccaccaacagattcaagactcagaccagaccagcgacatctagagaatggggagtacgaaaaggccaactctgagaaactgcgcctcgagaccagacaacggatggcaaggaacatgcaggagagtggctggaagccaagatggttccaaagggacagcgagcatggaacataccgctatgtcggaggctactgggaggcaagggaacagacgaaatgggttggatgcagtgacatatttggcagtttctgcgacaatccaaagccacgggtgtccacgctgtacaccagcgcgagtgtctaaggaggcagtagtaggcgttgacagcatattaatttttcaaaggtacataattgattggttcctctcacatctatggtacaaagaagagctaagatgttctccttgttgtcctatacacatacgcaaacgctgggacattaagcgcaaccaaatccctaatttgatataccggtatacttttgctaacattgttgctaaaatagtcaataatatcatttcccttgtctccggtgaaaaaaataaaaaaaaaaatataaaaaaaataaaaaaaaaataataaacaaaa

SEQ ID NO: 29634 - DNA, 725 bp, Triticum aestivum
  Clone ID: PAT_TA_29634
cggacgcgtgggttcacatagagaaagaccagggggagggaaatgaagagcatggccaccaccatatatgtccttgccttgtcactaaccaccaccaccttgctcttcaccagcagcagtgcatgcccgcgtgatccgttaatgaccatcgcatccgcatgccaccaggtgagcacagggcagcccgggttggagctctgcatgataacattgcatgctgcatttgagaatagtgaggtcaccgagtacgccaatattgctacgggtacttctcaatattcatgtcaagaaacccagcgcattggcaagaatttgttgcagaacccgtcgctccccaaagagctgcgggcagcgtacgatcactgcattggcaagtacgacatggtgaagaacaagatcggagccatcgataatgccgtgcgcacttgctggttcgcaaccttcaagcaggactgcgtggaagttgccgctgcaatcgacgattgtgctcataacttgcagcccgtcggctcatcttcgccattgtacaagatggttttagctgaccgggatctgagcacacttatttgctcgctggcactccacggtgtcgctaagcaatggcattaagaagtgacaaatctggttgtgtaacttcttattgaaaataattccatgtttgcatgtgaagatttctttacttgaataaatatgaatttcaatgccaccaatagatttgatgccac

SEQ ID NO: 29635 - DNA, 474 bp, Triticum aestivum
  Clone ID: PAT_TA_29635
agccgccccatcccccgctgcgctgactcacttcctcacgccacccgccgattgattgctcgatcgagctgcgcggccatgatctctataggcgggtcctcctcgtcgtcgtcgtccgccgcggcgggggtcaggatgggcggggccaagcggcgggggaaaccgggcggggccgccgcgccgggggccgcggggacgccgcagaccaggtggcgaagcggcacgcaggagcggatctacggccggcgcctgctggacgcgctgcgggccacgcggtcgggcgccgcctcgtccgcgcagccgccgcagccgcgcgccgtcaaggccgccgccgactcggcgctggcgctcacggcgcgcgggcagtcccgctggagccgcgccatcctgctggccggcgccgcgtcctgccgacgccgcgtgctcgtcaaggccggtggcaagatccgacgccaccgccgcccgccggcgcgc

SEQ ID NO: 29636 - DNA, 2058 bp, Triticum aestivum
  Clone ID: PAT_TA_29636
cggacgcgtgcgcgcgcgcacacgcttcagccggtcgtacgtcgggggagaggccacacacaaggttgcaacacaatccttccaaggccttcccccgcatgcacgccggcgaagcggccggcgtcctcctcaaaaaccaaaccccccgtcgaacacaaacgcccgtgcaccagtcgagcggcctagcttccctcatacctgcgtgcctcgatctcgccacaccctgaacagagcctcgacagattcctaccgaggcgccgagtcatgacgtccagtccgtccctgatctcgtcatccttctcgtcctcctcccggttgctgcggtcgtcgtcgtcgtcgtcctcgcagtgcagcaccagcggcaggcggagcatggacgaggaggcggaggccgtcgtcgcgccactgccgccgatgcagaagcgagtgctgtcgaggagccacgggtccagggccgcgccgggtcgacaactcccgccaaagaacgtcgtccgggacgccggaccgccttcagaaatggatttgatgaaagagagattcgccaagctgttgctcggggaggacatgtccggcacggggaaaggtgtctcctcggctctcgctctctccaattccatcacaaaccttgcagcctccgtgttcggggagcagcgccgcctggagcccatgtcggccgaccgaaaagcgcgatggaagaaggagatcggctggcttctgtcagtcaccgatcacatcgtcgaattcgttccgttgcaacaggtgtccgaggacggcaccagcatggaggtgatgggcacccagctacgcagggacattctcatgaacatccccgccttgcgaaaactcgacgcgatgctcctcgggtatcttgacaacttcaaggacgaacaagagtactggtacgtgtcgaaaaacgccaacgagagcgagaagggcgatgcaccgagagacggcgagaaatggtggatcccgacggtgagagtccctcccgagggtctgtccgaccagtcgaggaggtggctccagcaccagcaggaccttgtcgggcaagtgctcaaggcagccatggccatcaacgcagatgtccttgcacagatggagatcccagaagaatacatcgaggctctacccaagaatgggagggaaagtctcggagactccatatacagaaccataaccgatgattattttgaccccaacggactcctggactccgtagacctatcgacaggacacaagatcgtcgatctcaaggacagaatcgaggcctccgttgtcatctggcagaggaaactctgcaacaagctgtcatggggccccggcgtcagcttggagaaacgcgagcaattcgaggagcgcgcacagaccgtcctgctcatcctcaagcacaagttccctggatctgcccagtcatcgcttgacataagcaagatccaatacaacaaggatgttgggtttgccatcttggagagctactccagggctctcgagagcttggcgttcgcggttctgtcacggatcgaggacgtcctctatgccgacaccgtcgctcgggatccgaggcgcgcgaaatcgaggcggcggcctagtttagaggacgacagcactgagtctctcgtcgtcgatgccacggaggccacttcggccaagtccagcgattcattttgctggcaagagctcgaggacaggagcttggattccggcggtggcaagctgaggaaaattccccgtatcggcaggaggaaatctatgcacgtagacaaggtcgaggtgaacgtgtgcggtgttggtgctggatcaagaagcttttcccataggtgagacgggcagttggtggtggatcaagaagcttttctcataggtgagacgggcagtttgcgttgcttcgacagggagccatctggtgaagagaggcgcctgtaaaatagctcagagtaagtgagattggggaggaagtgatgtaaatttccttctcgtctcagctgagctgcaataaaattagcatagcattttttgtcaccctaaagcatcaatagcatgcttgttgcttaagcaaaa

SEQ ID NO: 29637 - DNA, 797 bp, Triticum aestivum
  Clone ID: PAT_TA_29637
cggacgcgtgggcaaagagttaactgtcttctacagctttgctaatgcccctaatccaagtcaaccggttgccaccatctcaacccctcggctggtgtcgcttgagtggagtgatgcatatgatccagtctctgttcagtttggcaggatgacacgtcttcaatggctgggcacaagcttttatgttgtatatggaccaagtggcattgaacacaatcgcgatttgatgaggctcttccggcactttaaggtcatccacagtttgagacttacactgaattatcagcgggacctaagtaacaggcaatacttgatggaggatatgacaatgctcccagtcatttcattattgagcattagtgtaatagcacatggacatgcctgtggagccagcttattccatgttctcaggatgtgtaccggtgtaagaaggctgatcctaacattaaatcctcataccagtctggaggtacaaacatgtccactaggttgcatatgtgatcagccactaaactggagatctgaggagctggtgctggattgcctcgaagatgtagaaatcagagggctgagaggaaccgaatgggaagtagctctggtggaacggttattcggctggtctacagcactaaagacggtgaaatataactttcttccgtttaatgactgaaagcagggccaaggagttgcgccagatgttactacgcttctccagtccagacacatgtatgacattttaggtgtatactgcggagtgcggctaatctgcacccgggctcatctgcacccacacttag

SEQ ID NO: 29638 - DNA, 951 bp, Triticum aestivum
  Clone ID: PAT_TA_29638
gcggccggtcgggtccccgcccctacctgcttcggcctcggcctcggcgagagtcggcaccccccgccccgccaacgccaagcccaccactcccaaaggcgcacgcgatcgatcgcgacgggagtgccgatcgcgccgccggaggttcggggcgggtgtccgggagccggcggaggaggcgatggggcggctcttcctgatgcacctcgaggggaacgcctacagctgcaagttctgccgcacccacctcggccctcgccgccgacatcatctccaagaacttccattccaagcacggcaaggcgtatctcttcaacagggttgtcaatgttacatctggtataaacgaggatcgcatgatgatgacagggctgcatactgtttccgatatcttctgtgttggttgtggatccattgttggatggaaatatgaggctgcacatgagaagagccagaggtacaaggaaggaaagtttattctggagaggtttaaggtgtcgggccctgatggtagccactactggggggtgacacatgatgctcatcatgggggtggaagcgacaccgacgacttatgaagcgcgaccggccgacgtgcgaaaacctgcagttcatctctgtaaataaccctggagccgggccttagttactccggggggcgcgcttcgggggggaagcatcccgccggccatgggggtggtacgtctcccgccgactctcccagcgcgcccgccgggcggcctactgccgtccgttctcggtcaattgcccctgtgtccccccctaaagctctttgttggggggtgtttccatttaaaaagcgcgccccccgcgttaaaattgttaattctacgtgatattctcccagcaagctgtctgggaaacctaataccttctgtatatgaacaaatgtatcattgtagcccctaaaagctgtttgttgtgttgctg

SEQ ID NO: 29639 - DNA, 821 bp, Triticum aestivum
  Clone ID: PAT_TA_29639
attcatcttttttagtgtaaaagacaaggtcgttcttgtcactggtggttctcgtggcattggtgaaatgattgccactgggtttgttcaaggtggtgctaaagtttatattagtagtcgttcatcaaaggcgtgtgatgaggtagctgccaaactgaatgctttgggacctggaaaatgtattgctttaccagccgatttgcaaaagttggaggatgtcaaagagctggttgctgaaataagcaagcgtgaagaccatttggatgtgcttgtcaataatgccggtgctacttggggtgcacctcttgatgaatatcctgatgctgctttccaaaaagtaatgaatcttaatgtcaatcgcatttttacattaactcaagcctgtcttcctctattaagggctaatgctaccgcggactctccttctcgtgtgattaatattggttcaatcaatggtatctcgccaccagcccttgaaacttatgcatattcatcttccaaagcagctcttcaccaattaactcgtcatttggcaggtcaattgggcagtgaacatatcctggtgaacgctgttgctcctggttccttcccttctaaaatgatgtcagccacacttaaaaactttggggatatgattattgctggtgtccctgtaggtcgtgtgggtacaccagaagatattgctggtacatgtatctatctctcttcacgtgcaggtcaatatacagtaggtgctattatcacagttgatggtggagcccttcaaaagcgtgctaaattataaaaattgaaataaaaagtgtttcatgtgtatctattat

SEQ ID NO: 29640 - DNA, 1282 bp, Triticum aestivum
  Clone ID: PAT_TA_29640
agctcagcatccttctcttcctgagtggtcaagcaacagaaagcaccgaagcatttattttgctgataaatccatgggtcatattctaattgcagagcccccgagttttttgacagtacatgatgttattgcaattgtcgtcagtcacagattaggggcaccagtaatcttgccggcccctgcggtatttgcatgcccggatggttcagagaaagaagtgcttcaaatactccatcttggcactgacgttggagtttcgaaacgcgaaggaaggtatgactgttccctgggaggagagttattgtcacaagatgctcgccaggtccaattccttccgttgagaccattctacagcggagagattgtggcatggaagacaggaaaagagggggaaaagctcaggtatggtagggttcctgaagacgtaaggccatcagctggccaagcactttacaggtttccggtggagacagcccccggcgagactcgcatgctactctccagtcaggtttactcgtttaagagtgtttcaacggctgacctctcttctgcaccttcccaaccggatgttggtagagtggcagacgttggacaaccgggccactcgtccgtcagctctagaactgaaggcgcagacaatacggctgctgggcttgaatacggcaaagtatcttcgatggagctggttcaagcagtccatgatatgctttcagctgcaggggtaaggatggatgctgagaaggaaacactgctacagactactctttccttgcaagaccagcttaaagaatctcaagtggctctcttggtggagcaggaaaaagccgagtcggcggtgaaagaagccgacattgccaaggcggcatggtcgtgccgcgtctgcctgaacaacgaggtcaacatgaccattgtaccgtgtggccacgtcctgtgcaacaggtgctcgagctcggtgtcgcgatgcccgttttgccggacccaggtgtccaaaatgatgaagatattcaggccatgaagacaccgaggtgcacctgctcgatgctgttcggatctcgcattctttgctcgacgagcgtgtgtaaatatgagcgtgcgtaaatatgagccacagcgcatttttagcttagtttagacttgctgcaaagtcctttttgtcacttcaacagttcaacagaggtgcacgaaagcttgtagaaatacggatgcgaggtgcctaacattttcaggttttcttcagactcgttcgtcgtctagctgctcaaagcgtttgatttcaacctcc

SEQ ID NO: 29641 - DNA, 824 bp, Triticum aestivum
  unsure (1)..(824): unsure at all n locations
  Clone ID: PAT_TA_29641
cccacgcgtccgcccacgcgtccggtgtacaaagcatatcccttcctcattcctctgctccaccatgtttgagaagggaaaaatagatggagagggtgtaccaaattgattggcctactcgtccatgtgatggggagtgccggagtggctgcaccaaatcgagtggcctgcccgtgcatcaacaaagctgggaaggagattatcttggaggccagatctgagcgaggtcggggcacgcgttctagccgcggatttggcgctccctagcagcgaggcaaggcggtcgccggggaggccactgaagaatatgagtgatccgtagttggtaacttccctaatggcgctgctatcctgttcgtgtcactgggccaaggattgtggtgtcgggtttgacggccatgttcttcatagtgttcctcatcttatgtggcagagtagtgatggcagtgggctacgctgggaaggcaacaggatgctgatctccatcgacatgccatcgctcggctcccgcacagtctactcggtgtcccgggccccgtcgcctcctccgtctgctgccttatagggataggcggcctttttggtcctgcttcctttgagcctgcgtgctcgctctgctggctagctatgccatgtaacgcacttatcaccggtctccccttttggctctgcctccaaactgggcggcctcgccgntcctttaatttggccttganntttgttgcacctgccnaatgtggngggttataattaaaaccggactcctactcantcaaaaaaagtaggtagtactagtcggaatntataagcgtgaccaaaaaaaa

SEQ ID NO: 29642 - DNA, 722 bp, Triticum aestivum
  Clone ID: PAT_TA_29642
attcggcacgagcacaaaccctatccccattaacccgcgcccaaaaccctgagctgcgcacccaccggcgatgtcggcgacggccatccgctccggcgagctcctcgcgtttcccgccgcgctgaggcgtggcccgcccgtggcttctgcctcggtggtcgcgttccggttgagggcgccagtggccgggcgcgtggcggtcagggttgtcgcggcagcggcagagggggcaggggcggaggcggaggcggaagggaagccgaagccgaagaagaagagggcagcgagcgggatcatgaagcctaagccgatttctccggagctaagggagtttgtcggaggcgcggcggagctgccccggacagaggcgctcaagatcatctgggcgcacatcaagggaaacaacctccaggatcctgagaacaagaagataatagtctgcgacgagaaactgaagaagatatttggagggcgtgaccgtgttgggtttcttgagatctctgggctcctcaatccccatttccagaaatgataggatttatgtagatgttgcactttttttgtattagcgaagacagttgtatcagcatatttagctgaacctggtatggagggtccgtaattctggtttgagaatggtacctgtgttccctgaacacatcttcatctagtatttgcagtaaatggtctgctggtttttggcttgtcattaaaaaaaaaaa

SEQ ID NO: 29643 - DNA, 1269 bp, Triticum aestivum
  Clone ID: PAT_TA_29643
ctcgcgccgccaccgccggattggcctcaacaccttcggctgctccccccccaccctccggcgggccagccagtctggggcgcctagggaggggcgcgcacgcttgtcttggttggggccgtctttgcttgttgcgagttggcagcccccctccccgatgcccgggtcccactgcagcagcctcaggtggcaactcgcccgccactgaatcaaaagaggtggctgaggagtgtaaggatccagtagacacatgttcaattgaaggattgtctgcttgccttcaggtgtctaagacagcttcaagtggacaattttttatgagtccagaatacagggcagaataccgtaactgttgatgtcaaaacaacatcagatataagtatagcccatacgttgccacctctcagcaagggtgaatctaaaagggttaacataagctctagcagtccaaatggtggagaggttaccctaaatgttgggactgggcattgtgtcttgcgcatcaggcagccagtttatgattggcaacaacaatttcagcagcttacatcttatgcaacgactgtgaagccaatctatggagcctattttggtgttttcacgcttgtcttggttggggccgtctttgcttgttgcaagtttgcagggacaaagcgcgatggtggggtcccatatcagcagcttgagatggggtctcaggctcaagctcctgactcatcaggtgcaaacaacactacaagcacaggagatggctgggaagatggatgggatgatgactgggatgacgaggaagcacctgcaaaaccttcagaaagaggacctgctggaagcatctcggcaaatggcctttctctgagatctccaaccaatagatctccaaccgatagcaaggacggatgggatgtagattgggatgactaagctacaacataatgttggaaggacctgtcctttcttgtgaaacgggagaagataagttcatctgaatggctcgcagcaaatacagtatccaaccttaacctgaaactcgatggatccatgcttgacaaggtgacccttatcctggaatatcaaaggcttgcttgtattagtacggtttgtacaatagtgttccactagtaattttgtttacgagctgatccatgaactagtggtacaaattgcgctgttttggctgtaataccatagctctagttacatgaccaaacacaccctcgctattctttcggagagtatatcattcttttttccccatacaaaaaaaaaaaa

SEQ ID NO: 29644 - DNA, 902 bp, Triticum aestivum
  Clone ID: PAT_TA_29644
ggaatgtcgttcagctggatgccgtacgctggctgaagccaagatacatatagagcaaaagaggagaaaggagtatgaggcgaatgctctgaaagccaaggaaagtggccagcttatttcaaatagtaaatcaggacacaaaacaaaccgtcctatgaaactcgagactgatgggagtttggatcttaagaaaggcagtgccattttggatgctggtggcagggattctccaaaaaccacaggacctacaagcgctaagcaatgggatgattgggacattgttggtcttcctggggcagagctattaagctccagtgaaaaacttctgtgctgtcagaacagattgctacctagtcattatctgagaatgcaggaggtgctgatgcaggagatgttcaagggcaatgtcgtcaagaaggaagatgcccatgtattgtttaaagtcgatcctgccaaagtcgatacagtttatgatatggtgacaaaaaagctgggcaacaacgaggaggctccgatggtttagctatgcaatttgggctctgcctgctctaggcttggcccaaaaccaaatcttggtttctcagcacgacggaggcccaggtgagaacggaggctatacttacatgacttggctgtagcagtgttacattgagatttgtgtcagatttctggagaagtgcaataaggcattcgagccaaattgtaaaattacccggcagtgggaatgtgtagcgtgagttgttgccattgctgttcgattttaaagaggagttagacgccattgttgctgaaagtgtactgtgatgatgatgtgatgatgcctttgttgtaggtttaggggactgagatgatgtaccatgtatgtaaacatttgtccattttatttatgatattgcggattc

SEQ ID NO: 29645 - DNA, 1651 bp, Triticum aestivum
  unsure (1)..(1651): unsure at all n locations
  Clone ID: PAT_TA_29645
tgataagagacttgacaccgcacaagttttcgaggttcatcccgctccctatggcaatggctatacctttctacatagggtcatactttgcgatcgacatgttcctgggcagcttcatactctttgtgtgggagaaggtgaacaaggcaaaagcagatgccttcggacctgctgtcgcttcagggttgatttgcggggacgggatctggaccctgcctcagtccattcttgcccttgccaaggtgaatcctcccatttgcatgaagttcttgacaagaggagacaatgtcaaagtggacaaattccttggtggctagaagggacaacggcaagccatggccacgcatcagcatccgcatgtaattagagccactttcccaggccacttgttttgtagaaaagccagatcttgggtccaggcaagggagaattatccctacgaatcaaatttccgaaacgattgtagctgttccttcgcagtgtaaaaaggaagaggaaaaaatttagaggcagaacgatatagtattaggtgtaacagcatttcacattttgtctgtgtcttgtgtaactgtggcgcagtgagagctgacatgttcctccataacaatgttcgagctggatcgtaaaatggcggtgtgcttgtaggacttgccgcctgtggtgtgatgatgagcatcgtgtcaactgcctctgacctgatgcaagacttcaagactggttacttgactttggcgtcaccaaagtccatgtttatcagccaggtgataggcacagcaatgggttgtgtcatttccccctgtgtcttctggctgttctacaaggccttcagcgacatcggcacaagcggcaccgaatacccagcgccttatgccattgtgtaccgaaacatggcgatattgggtgtggatggcttcaacacgcttccggagaactgcctgactctctgctacatcttctttgctgcagctattgtcatcaacctgataagagacttgacgccgcacaagttttcgaggttcatcccgctccctatggcaatggccatacctttctacataggatcatactttgcgatcgacatgttcctgggcagcttcatactctttgtttgggagaagatgaacaaggcaaaagcagatgcctacggacctgctgtcgcttcagggctgatttgcggggatgggatctggaccctgcctcagtccattcttgcccttgccaaggtgaatcctcccatttgcatgaagttcttgacaagaggagacaacgtcaaagtggacaaattccttggtggctagtcatggtcagtcctggtcttctacggaggacaagggacaacggcaagccacggccacgcatcagcatcagcatgtaattacagccacttcccaggccacttgttttgtagaaaagccagaacttgggtccatgcaagggagaattatccctacgaatcaaatttctgaaacggttgtagctgttccttcacaatgtaaaaaggaagaggaaaaactttagaggcagaacgacatattaggtgtagcagcgcatttcacattttctgtcttgtgtaactgtggatgttgttctgctcgataggctgtgagttgtgacatgttcctgcagaacaaaaaaaaanaaaaaaaaaaaa

SEQ ID NO: 29646 - DNA, 701 bp, Triticum aestivum
  unsure (1)..(701): unsure at all n locations
  Clone ID: PAT_TA_29646
cggacgcgtgggcggacgcgtggggcgccggcgtcgcctcagcaggtatccagccggcctacggccgcactgagctctcgcgggacaggcagagaccacggtcggccgcgatggctgctgccgccgcgccagcctcctcttcttcctcccctggctgggacttcacctgcaactttgaagttgattatggatctgaagaacacgcttccattgtctacaagacattagctgttgacaaggagttgcagccagataaggtcaggagggagatgactgtttctggtggcaagctcctcgtgcgctttgaagcagtagaggctcggtttctgcgagcgtcattcagcgcatttgtcgaccttatggtacttatcacaaagcttgtcgaagaatacggcgtaagcaaggaagagcattcctgataagcgatatgatctagttagtcaaacatgtggtcattcagaccacctgtatttgcccggatcttctcctgtgaaggtactgtgtatttgtgaattctgaatgaaacattttgtactctgtagtatggattacttcccattcgaatttcactgtaatgagaaagaacctccagagccccggttcctcgtagacgatccgagggtgaaaaattatcatgaaatcgggaggagcagagaaacatcagatatcatatttttcttagagaaaaaaaaaaannaaaa

SEQ ID NO: 29647 - DNA, 989 bp, Triticum aestivum
  Clone ID: PAT_TA_29647
tgctttatggtgtgcgatttgagtccttaaccagccatcagatgaccaatacaattcaaaagaagttcaaagtatcatcaactcagctgctgtaccaatcatgcccataccaagcattgaccctgttcattgttggtccattcctggatggatttctgactaacaaaaatgtctttgcttttgcatacacatctcacgttgtgtttttcatcgtcttgtcgtgtttgatatcggtctcagtgaacttcagcactttccttgtgattgggaagacatctcctgtaacttaccaagtcctgggccatcttaagacgtgcctagttttgaccttcggctacgttttgcttcatgatccgtttagctggagaaacatacttggcatcctaattgcggttgttgggatggtactatattcatacttctgctcaacagagactcaaccaaaaaataccgatgtctccgcacagcagtcaaaagaaggtgactcggcacctttgatctctgattctttgagcaaagttgaaaatggaggtgatgacgatgagcctttgaaggtaccgatgtggagctcaaagtactcaagggcgtgagaattttgtctcttagacggcggatggcattatacaggattcaatttagtaggcagatagtagggttggaagccaactttccaacccaagtaatgaagcaatggacatttcagttacaattaaaatgatctgattctttggagggttttaccttccaaaattgcagatcgaccatgaaactagatagcagatattgtaaaattgtatctggatatggtccaaatcttctcactgtaacttcacgttgggacactggtctgcagatagactccattctttttgtaccaaaggtcccgaggtcaagaattgtgcaagactttaaagtatttataggttcaagtttgtaactgtactttcagatttaccttggaccatagtaatgcaagtgatgtacatttc

SEQ ID NO: 29648 - DNA, 1046 bp, Triticum aestivum
  Clone ID: PAT_TA_29648
cttgctggcaattatcacgacttgcatcgctcaaattatgacaaacactattcagaagaaattcaaggtttcttcaacccagctgctatatcagtcttgtccttaccagtcattgacactgtttcttatcggcccgttccttgatggattcctgactaaccaaaacgtcttcgctttcaattacacatctaacgttgtgtttttcatcgtcttgtcgtgtttgatatcggtctcagtaaacttcagcacctttcttgtgatcggaaagacatctcctgttacttaccaagtcctgggccatcttaaaacgtgcctagttttgaccttcggttacgttttgcttcatgatccgtttagctggagaaacatacttggcatcctaattgcggttgttgggatggtactatattcatacttctgctcaatagagactcaaccaaaaaataacgatgtctccggacagcagtcaaaagaaggtgactcggcacctttgatctctgattctttgggcaaagttgaaaatggaggtgatgacgatgagcctttgaaggtaccgatgtggagctcaaagtacccaagggcgtgaaaatttcgtctcttagacggcggatggcattatacaggattcaatttagtaggcagatagtagggttggaagccaactttccaacccaagtaatgaagcaatggacatttcagttacaagtaatggacatgtcagttacaattaaaatgatctgattctttggagggttttaccttccaaaattgcagatctaccatgaaactagatagcagatactgtaaaattgtatctggatatggtccaaatcttctcactgtaacttcatgttgggacactggtctgcagatagactccattctttttgtaccaaaggtcccgaggtcaagaattgtgcaagactttaaagtatttataggttcaagtttgtaactgtactttcagatttaccttggaccatagtagtgcaagtgatgtacatttcagtttaaggagttaaaaataaccaggttcatttccatgt

SEQ ID NO: 29649 - DNA, 1892 bp, Triticum aestivum
  unsure (1)..(1892): unsure at all n locations
  Clone ID: PAT_TA_29649
ggcagcagcgcgacggcgaccccgatcccatcccggccccgcagcccctcccgccccccgcccccgcgccgacctgccccgacattgcccgctcctcggtcggctaggcccagatccgcgctcgcggcgcgcggtgctcccggcggcgggtccgagcggtcgtgattgcgaaggcgtgctcttttttgttggtgccgttgtctggagggtggtggcagctgagttttgcgtcgcaggggaggagtgcggggcggtgggggcggtgggtctcgctctggctgtcgcgtcatgcgtgccctatctctgctgcaaggaagctcagcctctccgtggtctcctcggtctccattgtcatctgcaacaaggcgctcatgagcgccctcggcttcatcttcgccaccacgttgacaagctggcatctcctggtgacattctgttcgcttcatgtggcattatgcatgaagctctttgagcacaaaccttttgacgcaaggaccgtcatggggttcggagtgctcaacggcatctcgattgggcttctcaatctgagtctgggtttcaactctgttggtttctatcagatgacaaagctggccattattccctgcactgttatattggagactcttttcttcaggaagaagttcagtcgttacatccagctgtcccttagtgtgctcctttttggtgttggagttgcaactgtgactgatctgcagctcaatgctatgggatctgtgctgtctctactggccatcgtcacaacctgtattgctcaaattatgaccaatacaattcaaaagaagttcaaagtatcttcaactcagctgctgtaccaatcatgcccataccaagcattgaccctgttcattgttggttccattcctcgatggcgtttctgactaaacaaaaatgtctttgcttttgcatacacacctctagttctgttcttcatcgtgctgtcgtgtctgacatctcccgctgcttaacttcacctgtttccttttgattggggactacttctcccgtaacgttccgtttcgctggacaaccaaagtagtgcttggaacttgccttgggtccatgtctcgctgctcgatccgtttcgctggagaaacttacttggaatcctgattgcagtggttgggatgggactatattcatacttctgcacccgtgaagctccaaagcccactgaagcctctccacaagtcactcaggtgaaggaaggcgaatcagaccctttgatcgcagactccttgaacgccgccgagaatggagctgctgcaaccaccgacgagcctctgaaggtccccatgtggagctccaagtacgcgcgggcatgaacgctgctgctccgacctctgaaggtgcccatgtggagctccaagcgctcgcgggcatgaacgccgcttcggaccttggttcatggtattatatacataattattcagtttagtaggcagatagtagggctggaaggaagccaggccagccctgagtgtaatgaacgttcctttttccatttttgggccttttttctttccccccctttttttgcttctgttttggcttacgatgcctgtggtgctgttgtaaaagtgaatctcaccccaaatgactccaaatggcagatctacctttgttgaagctaagatacaaaatttcaattgctgggaaggggatctcttgtagtattatttttcgcatgttcagcttcggatccgcggttgtaactttggtcgcaagacataaatatcaacacgtagtttacattcttttttaaaaaaaaaaaaaaaaactcctccgggcggggccccgctcccgcttccccgcctgggggctctcgaanagtanatcangnataataanccgtcgttgggcaacaacaa

SEQ ID NO: 29650 - DNA, 940 bp, Triticum aestivum
  unsure (1)..(940): unsure at all n locations
  Clone ID: PAT_TA_29650
cgcaaaccaaaccttccagccagagcaacaagccggcaagaaacacccatcgacccgcccagcaacaacacagctcgggcgactcccttccttgctcgctagctttgcgcgccatggctccggcgacggcggacgcggcgggggttggggcggggccggcggtggggagggtgaagacggcgctcggggtggcggcgtgcgagcgggacgcggagaagctggagctgatcgagcagctgaccaaggggttcgacgacgagcagcagagggtgctggcggcgatcctggcgcggaacaacggcgccgagtacctccgccggcacggcatggagggctgcaccgaccgcgacgccttcaaggcccgcgtccccgtggtgacctacgaggacctccgcccggagatcgagcgcatcgccaacggcgaccgctccaacatcatctcctcccaccccatctccgagttcttgaccagctcggggacgtcagccggggagaggaagctaatgccgaccatcgaggatgagctggacaggaggcagatgctctacagcctcctcatgcccgtcatgaacctgttcgtcccggggctggacaagggcaaggggctctacttcctcttcatcaagtcggagatcaagtcgcccggcgggctcggcgcgctgccggtgctgacagtctactacaggtacgacaagagcaagtaccgcacgtaccgcccgttcgacgcgtaccaggtgtacaccagccccacgccggccatcctctgcaccgactccttccagtccatgtactcgcagatgctgtgcggcctgctggtgcgcaccgaggtgctccgcgtcggcgccgtcttcgcgtccggcttgctccgtgccatccgcttcctgcagctccactnggaaggagctggcccgcgacatcgagaccggcacgctcagcgcca

SEQ ID NO: 29651 - DNA, 1801 bp, Triticum aestivum
  Clone ID: PAT_TA_29651
agcgtccgggaagaaggggagtaccggcgcttcgtcgacagcgacctctacgacctcccgtcggcgcccctgcggcgcctcgcgcagggcgagcaggcccggccgggcgtggccgtcgccaacccgggggcggagggccccctctgtgtctcgcgcctcgatctccccgccgctctcgactccattttgagccaattgggcctgacgaatgcaatgtgcggggagtggaggctaaacactcatatcgaggaaccaaggttcggctcgaacccggcggtctttacggtgctcatccatacggagctcgagtcctcaccggaggcgttgcccaagtcctgtaaatcggtgtcctttgaatcgagccggggatcgctttgtgcggtgaagcccggtgatactcgaattgggccatatgtgcatgttggatttgtgaaatcggatctatcttcagattgtacagctggctccacattggtttcccaggagtaccctcccggaattacccttgtaccaattgaagagtagtaccttacggccttttcgtacgactaatcttgtggtaatacaagcaaccagtggtacatgtggatcgaagcgccctgattattttgcttgtggtgatgttttactgatagatcctggatgttgctcacaggttcatacagagcttgcagatcttgtcaattcccttccaaagaagttactggtccttgttacacatcatcataatgatcatgttgagggtctttcggttgttcagagatgcaatcctgatgctgttcttttgacacatgaaaacacgatgaagcgcatagggaaagggaattggtcaaccggctatactgctgtgactggtggtgaaagcatatgcataggtgaccaagaactgcaagtcgtttttgctcctggtcatacagatggtcatatggggcttctccatgtcaataccaatgcactaattgtcggagatcattgtgtagggcatggaagtgcaatattggacaatagagctggtggcaacatgaaggactacttccaaaccacatacaaattcttggagatgtcgccacacgtgctaattccaatgcatggaagaatcaacctatggcccaagcatatgctttgtggatatctcaagaatcgaaaggctagagaagcctccattctgcaatccatagagaatggtgctcaaactttgtttgatatagtttcaaagacttactgtgatgtagacaggaaattgtggattcctgcatcctttaatgttcgcctccatgttgatcatctgaactctcaacataaacttcccaaggatttctccttagaaatgttcagtggaagttgcgatgaatttatgtctagcctgcagcagtgaccgacttctcaacggaaaagtttgaatcgagctgcggaacacatttcatattttggtggggcgtagcgtatgcccaagccaggagctcgccggccctcgtcatcgcggcaagcgccctcgccgccggtggtctggcgatcgcgtatgccctcaggaggagcaatggcaaccagccctaggattcttctccgagacccggtcatccccatctctgagtgcatgcaggtgtcgtaagatccgagattgttcatgaactgtgaactcccgagattgctcatgattgcatatttgtgaactttgctctgtatacacacaacacaagggagaagctcccggtgctacgttgtgttcctcctaagctacaggaactttcgacctagaggtccatgtgcaggtgaaccgaatacagagacttttgctgaaaaa

SEQ ID NO: 29652 - DNA, 516 bp, Triticum aestivum
  Clone ID: PAT_TA_29652
cccacgcgtccgcccaggggccttgctgctagctgcaccccaaggcgctctgggagatcaccatgccgatcgtgcagaaggcggccaactacggcggcgtcatgctctgggaccggtactacgacgtggtgaacgtccaggaccactacagcagctacatcaagaactgggcctgagctccggccatcctccatgcatcgccttgcatgctcctcccttggcaaacgcctctagctccttaatgtgcttgcgcatgtgtaaatcgaaagtaatctgctgttaatcgtcactcctcgtgtggcttgcaagactagcgccttaactcggttgcgcgtgtgtgaatggcaagtaatctggtgttaatcgtcactcttgtgtgtttgtgcaagaataaagggacgacagtgcagggataagataaagagacagtactacatttcaggtttatcatgttgttccctgtggatgccacaattatctccagattactgcttgattacgctttgaaaaaaaaaa

SEQ ID NO: 29653 - DNA, 1163 bp, Triticum aestivum
  Clone ID: PAT_TA_29653
ggcacgagctcgtccgacacctccttccccatctaaaaaagaccttcttgcccgtcttcctccaagctagggtttcctctgctgacctccgtcgtgcttccggccgctacttgcatctctccgccctccaatcattccactcctctagcctatgagatatggcgagcacagcatgctttgtgattgtcagtaagaatgatatcccaatctatgatgctgaagttggatccgctccaaaaaaagaagatcaggcttatcagcatcagttcattttgcatgctgcattagatgttgttcaggaccttgcatgggccacaagtgcaatgtttctgaagtcagtagatagattcaatgatcttgtggtgtctgtttatgtaactgctggtcatactagatttatgttgcttcatgactcacggagtgaagatggtataaaaagcttctttcaggaagttcacgaactttacatcaagatattccttaatccactctacttacctggttctcgtatcacatcctctcatttcagtaccaaggtcaggtctcttgcaaggaaatacctgtagcatacactcaggtggaagaccatatactcgagcagtagtgctatacacacgacaagttgggacgatctttggacgatgcagcacatccgaccgtacgtacgcagagcaaaaactggatgcaccgtcaatcatccgtcgtccttagttcgtgcgggcaaactgtcgtccgcacagtagtttcgatactcgagtgtcctaagctgagccctgttaaatttaccttgcacatcgatactgcaccattatatctgtagccatggcagtgaaaggagatggtgccgcagtatcatcacgagctgtatgaagcatggaaccacgcagcggcattaatattacaggacactgcaacagaccagctggtagtggtactgtagctccactaaaaggacccctgcagaatctcccgagaaaggtcttcgctcatcacgagctgtatgaagcatggagcatctgagcggcattaatattacaggacactgcaacgctgtcactggtagtggtactgtagtttttttaaagaaacccctggtttctctcccgagaaaggtcttcgctcatcagatgaattccattaataaatgaatctgccattatcac

SEQ ID NO: 29654 - DNA, 383 bp, Triticum aestivum
  Clone ID: PAT_TA_29654
gagaagtggcgtcaattcaagaacctaaatcttggtgttgaacagcctcaggagtcacatgcatcatcctcttcatcagcaaatttttctggaacttggaactggaaaagagattgggatagggagcatgcgtgatgggttatattacttggatagtaatatatttcctgcagtggctgctacagtgtctccctcgtcactagaagaattcctacttcaacatcgtcggttgggacatctttcttttgctattttgggtcagatttaccctaatctctattgtaaaattagtaaagaacaactaatgtgtgatgcctgtcagtatggaaagcaagttaggagctcttatttatcatctgataatagaagtgatgtgcctttgc

SEQ ID NO: 29655 - DNA, 951 bp, Triticum aestivum
  unsure (1)..(951): unsure at all n locations
  Clone ID: PAT_TA_29655
gctcgatctctgcggcactccaggtaggtcctctgctcctcgccgcccggctggtcgtctcgtctcccgtctcggaaggctgctgccggtgtggaacaaggtggcgacacgcgagatttcgccggcgagccgagtcggagacggtggccgcgagaggaggcgggctggcggggtgccttggtgctcgctgttcgcttgtgactcactgtttggtggtgagggccgcgcggttcattcggtgcttggccttggggctctgcgactgccctggcgtcatgcctgagctctggcgagagcctcccgcgggtcaacggggagagggggccagcgtgccagggcctgagccggagcgcgacgcaatgcaatgcggcgaccgtctggatttccccctacctctctctctttgtgtgttgggattttgctgctgggcaagtactctgattcgatattttgctgctgctggcagggcagggcggggtacccactgctgcttcgtcggcctcggcggagtactagcatgatgacgcgaggactttgatgagatgtgaaccggcgcggcgtctggctggccggcatggagcgggattggtcgtcgcagagttcgagccagggcgcgccgttcgaggtcgaccgtgacgcagggtctgtatctgtatatgcttggacagagcctgcgtggtgcggttccgtccatgtcattcatgctcggaatcgttcaacaaggacggacgggaacacatcatgcttatctatctatctatccgtgccggccgtactattgtacattgcttgcttgcgttcgtctcctttctatgccgactgttttggcttttccaggctgccgctgcttgctgcattgtgaagttttggatcttgacctgctgcttaaataactcttcctggttnatttttttataatttattagtaataaattaaataaagagggctgc

SEQ ID NO: 29656 - DNA, 999 bp, Triticum aestivum
  Clone ID: PAT_TA_29656
tttcacaccaatagatgtgtttgccgtacaatggatccaagctggagtgactcattttggtttgacagcttcctactatggtttcgtagctgatgttctgcaactgtctgaaaaattccgcgtgcagcttggtcccttccgttatgttgttgctggccttctgaagtttctttcattacctcagtacagatttgaggtggactatctccctgcatcaccagggagaaattctgaattgagaccactgactaaaaaatgtcatgaacagctttctgatgatggcaaggttaggagaggtacacaaatcaatggtaggattgaagataattgggttaccaggaacggggagtttcttggcatttttgtctgcaatcacttttgcaagcctgcccaggggttactttctccagttattgcaccaaaagctcagcatgacgacggcggtctggacttgattcttgtacatggaagtggaagactcagattattttgcttctttgttgcctatcagttttgctggcatcttctactcccttttgtggaatatgtcaaggtaaaacaagtaaatgttaggccagtgggcagtacccacagtggttgtggtgtcgacggcgagcttcttcaggcggaaggccaaccagaatggcagtgctctctgctcccagtacaaggccggttgcttggccggcatcccagaacatagaagtaggtttgtgactcatccagaagtcagtgctgacagttccgagcaatactacaatgtacccattaaattaagtggttaacaaagtattgttgcactgtaaaaatgtgtcttctgccattattttcacccattctcttaaggttgtagatctgcagatgaactccaggttgtaggcccccattgatgggcaagtgtatattccaggaaaagtgaggcttccttctcttcttggcatggaagtacaatgcagatgtaatgttaagcttaattttattcaaaaaaaaaaaaaaaaa

SEQ ID NO: 29657 - DNA, 920 bp, Triticum aestivum
  Clone ID: PAT_TA_29657
ccgtcctcggtccagggcccggcgggcactggatccagaagcaccgcacgcagagctcggcgggagatcgatcggccgatcgtccatccatccatcatggccaagaaggctggcgctgataggaccgcggcggcgatgaaggcagggagctgctccaggaagaaggctagggtcgagcccgaggccaaggctgcgtcctcctccaagatcactgtcaccttagaccccaagttgctggagtgctcggtttgttgcagcccactggttgctcccctttctcagtgcgcaaatggccatatcacatgcttcgagtgctcctccgatctgagctacagttgcagcttgtgttctgggcccgccaacacccactgcagcgccttggagcgcatcctcggcggcctggccgtgccgtgctcgttccaggagcatgggtgcaccgagatgatcccgttcacggagaagctggcccatgaagagtcctgcctccatgccccatgccactgtcccatcgctggctgctgcccctaccctggtcggtccctgtgcgaccacatcaacgcggagcaccctacgatccagtacacccgccttgtatccctcggcagcaaggtggtctttcttcttgtggttgaccggagcatcccgtcggggctcacattgtcggtgatccacctcatgagcgacccgatcgagagggagggtttcaagtacaagatccaagtgcatacgcagacgggcattctctctctgtccggcgagacacagagtgtcggtcgactgagggggccttaccaggctggcgcgtcgctgttcgtctcgaacaccatgtggtctcccccagattctccagtgtacctcgagctgaaatgctaaatctatactcaatctggtagtagaagaattctgagactccattctat

SEQ ID NO: 29658 - DNA, 516 bp, Triticum aestivum
  Clone ID: PAT_TA_29658
tgacaccgtacccaccgtggctgggggctggggcagagaaggaagtggccggcggccggcggcccggcctggatgggtcgacgacggcgactcgagggagggggcagtctactcgagtcatcccgcactctttctctgctcgagttaacccggatggatggaatttcgttgcagtcttcatatgccaccaacacttttcactggcagagatttcaggtcctgaagtcattgttgaagacatggattgaaccggcttacgaagcacggagagaagaatttctttccattttgctatgcataacaatgcgcgcgcgcgattccacggaaacttccgactttattcaggtggataaaacctcgacatgtggagagcatgcgcgcgcgagattccacagaaacttccgactttcttcttaggaggataaaaccttgacatgtggagagctgcctgataacaaaaattcagtgaagctagacctgtatctaattctaccagtcaagctttcggcgcatctt

SEQ ID NO: 29659 - DNA, 1122 bp, Triticum aestivum
  Clone ID: PAT_TA_29659
gcgtcatcgacggctccggctccaaatggtgggccaactcctgcaagatcgaccggtccaagccgtgcaagggcgcgccaacggcggtgaccatcgactcgtgccggggcgtgcgggtgcgcggcctgaccgtccagaacgcgcagcagatgcacctgacggtgtcgcggtcgcgcggggtgcggctggacggcatggccatccaggcgccgggggacagccccaacaccgacggcatccacgtggcggagtccacggcggtgaccatcaccggcgcccgcatcggcaccggcgacgactgcgtgtccatctccaacgccagcttcgcggtgaagatgaagggcatcgtgtgcgacccgggccacggcatcagcatcggcagcctggggcggggcggctcctacgccgccgtggagggggtgaccctcgacgacgcccgcatctcccgcgcccagaacggcgtccggatcaagacctggcagggcggcgccgggtacgtgcgcaacgtgcgcttctccaacgtgctggtggaggccgtcgaccaccccatcatcatcgaccagttctactgcgacgccaggacggcgtgcgccaaccagaccagcaacgtggccgtcagcaacgtctcgtaccggaacatctccggcacggccacgcgggacgaggccatcaagttcgcctgcagcgacgccgtgccctgcagcgacatcgtgctcagcaacatcaacctgctcggcgacgacggtgccgaggtgcaggccgtgtgcaactgcgccatggggctgggctacgaccccgtccgccccgccgtcgactgcctcaggaacaacgcgtgcggcggcggcggcggagggcagaagttgggcgcggaggagccgtcgacgacggacgcgccgctgcacgccgagctgtgaaaatcatgcatgggatttggcacgtacggatgtgttaaacctacgtgtcggacatgcccttgaattttcaccaagctgtcacgatgctgcaattattaattaactaggtttttttgtttgtgtgcatctatcgtctgatgtatcgacaaagaaattaagatgcacgatgttacatgcatgtccatgaagaaagaactgcttatctatt

SEQ ID NO: 29660 - DNA, 1355 bp, Triticum aestivum
  Clone ID: PAT_TA_29660
gagaggggggaggcccccggcgtcgaggacggcgatgggggactccggcggctccgtggtgtcggtcgacgtcgagcgcatctccttgggcggcaaggaacatcatatacaaacaaatcatggatctgtatctgttgcagtgtatggtgatcatgacaagcctgctcttgttacttgtccagatgttgctttaaattatatgtcttgtttcgaaggattactcttctgccctgaagctgcttcactgctgcttcacaatttttgcatttaccatatcagccccccaggacacgagttgggagcagctccaatttcaccgaaaacacctgtaccatctgttgatgacttggcggatcaggttgcggatgttcttgatttctttggattaggttctgttatgtgcttaggtgccactgcgggtgcttacattcttactctctttgcagcaaagtgtagggagcgtgtattaggtcttgtacttgtttcacccctatgtaaagctcccacatggactgagtggttttatagtaaggtggagtcaaatttgttgtattactatgggatgtgtgggttggtcaaggaaagcttactgcagcggttcttcagcaagtaaggggatgctctgagtcacctgaatcagatatagtgcagggttgtagaagtttgctagatcagcggcagagcatgaacgtgttggcggtttgtagaggcaatgaacgggagatatgatttgacggaagggctgaagcagcttcagtgtagaacccttatttttgttggcaagaattctcagttccacgtggaggctgttcacatgacagcaaagctcgataggagatattgtgctctagatgaggtgcaagcatgcgggtcactcgtgacggaggagcaacctcatgcaatgcttataccgatggagtacttcttcatggggtacggcctctacaagccaagcgagctcgactgcagcccgcgcagccccctgagcccattttgtatatcgccggagctcctttcgcctgagagcatgggagtaaagctaaagccaatcaagacacgagcgcggcttcaagtgtagagcaagtgaataagggcggcataggtctttgccatttagggtgaaatttctgggctaacatgtggatcggtgagatatttgtgttactactgttatatgtagataagaaatgataggttgggtaggttggcggtattctattccattccattgatttttagcctgtaaattgttatactccacttgctacattgttgattaaagcaaaagggaaataatagggaagggtgaattgttccttttttttttgattcgataaaaaaaaaaaaaaaaaaaa

SEQ ID NO: 29661 - DNA, 900 bp, Triticum aestivum
  Clone ID: PAT_TA_29661
caccaccctcatttttcctctcctcacttagcttttctcctccctgctagcttaactccttgccgtgggtagctatggcggcggcgaagtcgaaccaactcagcacccttgtgcccaacatgttcgctgcgggtttgctggacgatcagttccggcagcttgagatgctccaagacgagggcaacccagacttcgttgccaaggttgtcatgctattctgcgaggagggtgagcgtatcattggcgagctcgccaagcaattggaccaaccatgtgtggactacggcaaggtggacacatttgtggatcagctctggggaagcagtttatatgttggtgctcagagagtgaagaacacttgtatccagttccatgagtgttgtcaggagaagagcaaagttgggtgtctgaagacactggattttttgagaaatgatttctatgatccgtgcagcatgttcataccataggcttcagctgcagcagcatgtcctaacctgtagaccggagcaataaagcaggagtgtcatgattactcattgtgtttgaagtcatagaacatgctcaacttagcatatatggcctagagttgtttgcttctgtggggtctatagttcggttcagcgacaagctgctcatctggtgttgatttctgtggtactgtccgtagtttcgttctgaattattggtggtcaaataagaatcatcagcgatcactttgctgattatcggtggttaatctggtgtcgtgttctagccagtttctagctcatagaaattcagtggcagcgtatcttgacaaaatcatgtgtcttcggtcggcgtatggactatggtggtatattgtggagaacattgtaatgttatttcattatcaagttatgtttgttgttgggtgac

SEQ ID NO: 29662 - DNA, 814 bp, Triticum aestivum
  unsure (1)..(814): unsure at all n locations
  Clone ID: PAT_TA_29662
ctgcaggnaattcggcacgagggggacaccgacttctcggctatgatggcgaagtgctgctgcgtcggcggagtggccaacttggatgctgtggccccaatccggagaggcagggatgaaggtgtgcggcgatccagaagaaattcctgcccgtgttcggtgctagcgatgacggtgcccatgggtgtcgttcttctccttggaggcgtcgccaaggtgtgtcggcatctccatatctcgcgcctgggattggtagcggtcttcgggcgaaagcctaggttcggagtcgaatcggcgtgatggcgacgtcctctatgtcgttactctgttgggagcattgcgcttgaagacatggtcatgaggttctatgttgcggtgcttccggcgctcgccgctgtccaagacgatcttcagtggcgcaatgtacgtcatcgccggtgaatccaagacagtgccttttgtggactgatcaagttcctccatttacttgccacctccttttaggcatcaaagggtggatggtacgtcgacgagggaagttcacccggagttggagttggtgttgtcttcggaggtcaccggcgatggtcgagacgcggcgatgttgctctgattttggacaagctatttttgctttgtagttgtgttgttggtggtggctgtcttcggactagccttggtgtggtgtgtgaactacgctcgttttttgcaacaagttgtagtcttcttgtaactcaaattcgcgtactcgaaaaaaaacaagaaaacttggtctttattctgatcatggccaattttcnataaaaaaaaaaaa

SEQ ID NO: 29663 - DNA, 950 bp, Triticum aestivum
  unsure (1)..(950): unsure at all n locations
  Clone ID: PAT_TA_29663
ccccccccccccccccagccgcccccccccgcacacagcagccgccgcaaaagagagcagggagcgaggagcaactcttccagcgacggcatcgaatccgcctccttcttcctcgcgcggtcgtctccgaggcctccgacatggcgaacgcggcgatcgggcatggctgtggacgacgaatgcaagctcaagttcctggagctgaaggcgaagcgaacccaccgcttcatcatctacaagatagacgacaagaagaagatggttgttgtggaggaaagttcggcgagcctgccctgaactatgaggactttgctgccagcctccccaccaatgaatgcagatacgcgatattcgactatgactttgtcaccgaggagaactgccaaaagagcaagatattcttcgtcgcatggtctcctgacacggcacgcgtgaggagcaagatgatctacgcaagctccaaggagaggttcaagagggagctcgacggcatccaggtggagctgcaggcgacagacccgaccgaggtcggcttcgatgtgatccaaggccgtgccaactgagcaccatggctgtgctgctgcttaccttaagtatgagcctctgatgaggatttagcgcgctcgccgaggctggtcatgagctgtttaccatgaggcaattgtgatttgagttgccagtatgtaccacctaaggaagatgtaagctatgactgtcactgggtgcgacgacaaatgtatcctttctggttgttgattcgtgggttcctgatatccccattcttgcctgcttaacaccagatgcatctcgatggtacccattttgggagacccgcgctcctgcgctcgccttctgggatccccggtcctcggggcatatcatgccccgccgtcccctgcggcttcctctgcgacacggtcccccttacggccaacccggggtttggtncc

SEQ ID NO: 29664 - DNA, 560 bp, Triticum aestivum
  Clone ID: PAT_TA_29664
gccggccgggttgggagatccaacgaactcgtaaacacgtctgtctatagtgtacgcattctcctcaaagaaaaaaaaaggtctatagtgtacgcatactctcccactcacccccgagaagttaggaggcatggcgaggaaggcagcagcggccatggacggcaagagctccgagctcgcgagggccgtggcggaggcggaggcgcgggaggagcggctgcggcgggagctggaggcggcgctggcgcgggtggccgtggcggaggaggccgaggagcggctgtgcgtgcagctcggcgagctggaggccgaggccatgacgcaggccatggagtaccagcagcacgtcagggcgctctccgagaggctcgccctcatggacggcctgctcaggtcctccggcctccacagcggcgtcgtgcaatccgggcttcactgacgaaccgaatctcatcatgcgtttccttgcttattactactattatgtgcgatcatgcaaggctgtacctgtacgggttactaaattttccgccggcgtgtgtttgatgccaactcgtgcg

SEQ ID NO: 29665 - DNA, 670 bp, Triticum aestivum
  Clone ID: PAT_TA_29665
gccggccgactagttctagatcccagcgaactcgtaaacacgtctgtgcatagtgctattacgtatactcccccactcacccccgagaagtcaggaggcatggcgaggaaggcagcggcagcggccatggacggcaagagctccgagctcgcgagggccgtggcggaggcggaggcgcgggaggagcggctgcagcgggagctggaggcggcgctggcgcgggtggccgtggcggaggaggccgaggagcggctgtgcgtgcagctcggcgagctggaggcggaggccatgacgcaggccatggagtaccagcagcacgtcagggcgctctccgagaggctcgccctcatggacggcctgctcaggtcctccggcctccacggcgccgtcgtgcagcccggccttcactgacgaaccgaatctcatcatgcgttcccttgcctgttattatgtgtgatcatgcaaggctgtagtggttgttaaatttttctcctttccgccggcgtgtgtttgatgccaactcgtgcgtgctggtggcgtgtagtgtaggatgtacatttcttttcttttctttttgagatgtactgtatataacgtcgtttgtgtagttctacatatctcttgagaacatcttaatgttgccccaaaaaaaaaaaaaaaaagggcccta

SEQ ID NO: 29666 - DNA, 692 bp, Triticum aestivum
  Clone ID: PAT_TA_29666
cggctggggattcggcattcgggaggagcgcagcagcccgacgaactcgagatcgcagccgacgcaggccgccgtctgcgtgacgggcctccgcccgcacctcccaccgtagcacgccggtgagccgcgccttgcgccgcctctctctctcctatgctctcctctctcatatatctccctggcttttcttgcagcaatggaggccaagcgcccatggaatcgcctgagctctcctcccagccgccgttctccttcaaattcgtcgggatccggttggatctagacgctggcgccccgttcccgatcttcccgccttgcttgggtcgtcggccaccgcgacgatgtcaatatcgctcgcgggatccagcgccaccgctgctggccacttcctcgccggagatgcccccacatccgcggctccccacacgagcagcagcagcgaacacgtcgctaaggccgtctccggcggtgtctttttctttttatagaagtttgccaaatctgtgccagaacagccatggcgatgaactccagctcaaggcccgcgagcgcttggtggcgtttgatgcggtgcctggagaatatctctggggagagtagtagttaagatctagtttaggaaaaaaaatctgtaattccaagttttcttgggtatttcctctttttgggaaaacaaatttaagttagctggt

SEQ ID NO: 29667 - DNA, 1373 bp, Triticum aestivum
  Clone ID: PAT_TA_29667
ccggcccctcggccggtccaccaacccccgccccggccgcggccaccctcccaccgctgctactccccgctcttccgcgactcgaacttcatgcgcggatcagatcagatcagatcaccatgggctcctacgttcagggtgaggatgaagttcccgtctatgaatcgggtgcacatgccctgcagaagctgcaggagaaatggaagtccacggcggcgccgtacccggccatgtactcgagcttcttgggcggcatcatcctggacccggccatgatggccctccccatcgacgaccacatggtccaccgcggccacggcgtcttcgacacggccatgctcctcgacggccacctctacgagctcgacacgcacctcgatcgcttcctgcgctccgcggcgcaggccaaggtgggcaccccgttcccgcgcgacacgctgcgcagcatcctcgtgcagatgacggcggcgtccggctgccggaagggctccatccggtactggctgagctccggcccgggcgacttcctgctctcctccagcggctgtcccggcccggccttctacgccgtggtgatcccgtccgactacgcgcagtgccgcgacggcgtgcgcgccgtgaccacgtcggtgcccatgaagccgccgctgttcgccaccatgaagaacgtcaactacctccctaatgtgctgtccatcatggacgcggaggagcgcggcgcgttcgcgtccgtgtgggtggacgagcaggggtacgtcgccgagggccccatggtgaacgtcgccttcgtcacccagggcggcgagctcgtgctcccggtgttcgacaagatcctcagcggctgcaccgccaagcggatgctggcgctggcgccgaagctcgttgaggccggcctgctcaagggcgtcagcacccagcacatcaccgccgacgacgccaagcgctccgtggagatggccttcgtcggcagcggcctgcccgtgctgcccatcgtcgagtgggacggccagcccatcggcgacgggaaggtggggaagctgatgctggcgctgtccgatctgctctgggaggacatgaagtccgggccggacagggtcgccgttccatacaagtgatccaggggaggggaacgctagagagatggcgtgtgcatgcgcacgagcatgttcgtgcgtgtacaagatagtgtgtgagccgagccgcagtttgttgcccgtactgtttgtcacttgacttgtaagtcatgtataactgtggtatgtgtgtgccggatggatgactcacgaaataaataatacgagatcttgggtcaaaaacggtaaaaaaaaaagaaaaattttgaagaaaaataacaatacaactgttatcaaaaa

SEQ ID NO: 29668 - DNA, 742 bp, Triticum aestivum
  unsure (1)..(742): unsure at all n locations
  Clone ID: PAT_TA_29668
gaatccacattttatgccgccacggccacaagacaacctgtctcctccccctcatgtgcaccatgtggaaaagcaaccgcactatgggatttcttcatatggacgtgatgcaaatccaactgctgctcctacctcagggaatcaacacctatcgcatgggtcttctcaaatttcgcaaaaaatgcaagttcctctttcctatgctgatgctgtgattgggtctgctggtgccaatattagctatatccgcaagcatagtggtgcgacaataagtattcaagaaggtgttcctggggagatgacggtcgagatcgcaggaagtgcctcacaagttcaaactgctcagcagctgatcaagaatttcatggccgaagcttctccccaagttcctccaccaggtcccgctcctccctctcaaccagttgactcgggctacaactcatacccgccgtatggaggaccgtcgtatgcaacccctccaggcggcgcaggtcctacccctcacaatggaggaggctatggggcccactaccctccgaactatgggtactagctggacatgaaacactaggatgtagtgacgaattcgggttttgttgttcggcctgttaatctgttgagcacgtgagaccattattaggatttccaaactttcggtggtgtaaactctggagcacagctgttctctgatgtgctgtttaattttttggtgctgtaaactnatcagtaatctacggctctt

SEQ ID NO: 29669 - DNA, 1030 bp, Triticum aestivum
  Clone ID: PAT_TA_29669
gcacgatagattgctcgcctcctcttttgccctccaaggcgggcggaggaacgggaggacaaaatctatctcgcacccgccccttgtttacaatagcatagaattattattattattactatatttccactttgacaacaagatgcctgtggcacgaggcgccaagaagccgggtcccgtcgactccgactctgacgacgatggtctcgtctccaaaaagccgaccaaatcgtccacctattcggttcctaccggcaacaagaagcagtacaaggacgggttcaaggactccggcgggctggagaaccagtcggtggaggagctcgagaactacgcggcgtacaaggccgaggagaccacagacacgctcaacggctgcctccgtatcgctgagaacatcaaggaggatgccaccaacacgatgataaccctgcagaagcagggcgagcagatcagcaggacccacgagaaagccgtcgagatcgatcaggacctcaccaagggtgagggtctccttaatagccttggagggttcttctccaagccatggaagcccaagaaaacaaagaagatcaaggggccagtgtcgcgagacgattccttcaaaaagaagacgagccgaatggaacagagggataagctagggctgagccctcgagggaaggggaatacccgcgagtacggcgaagccacaagtgccatggacaaagttcagttggagaagaaaaagcaggatgatgccctcgacgatctcagcggcgtgctggggcagctccagggcatggctgttgacatgggatcagagcttgataggcaaaacaaagcactcgacgatatgcacggcgacgtggaagaactcaactccagggtgaagcaagcaaaccagcgcgcccgcaagattctcgccgattagtcgatcgtcaaacatgtctgcaagcgttattatgagtagtcgacaaacatgtctgcaaatgttattataagtatcaaccattattttcagagaaaacaaaaaaaaaaaaaaaaaact

SEQ ID NO: 29670 - DNA, 814 bp, Triticum aestivum
  Clone ID: PAT_TA_29670
cccggaacggggctagctctcgccatggagctgccgctctctgcgccgcgcgcgcatgccgccgctgccttcccctgcagccccacttctatcttccgcctccacggggcagccactccccacagccgcgcgcgccctctgcacgcccgcaggaacaagaactccaggggcgacgccgcggagcccaaagtcatcaccatcggccggcccgggaagaagagcaagcggcgcggcgacaagaagcaggatcagcagcagctcccggcggaccaagaagacgaagacgacgaggaggacgatgatgaggaggaggacgagagggacgtggcgatcccggaggtggtgacgaaccggatgatgcggcgggtgggggcgtcggtggggatcccgctggcgctggggctggccttcttcccggcgttctactacctgaagaaggtggcgaaggtggacgtgccgagcttcatcccctacgggctgtccttcgtcttcttcggggcggcgctggccggcgtgagctacggcatcgtgtcagccagctgggatcccgccagagagggctccctgctcggctggaacgaggcccgccgcaactggcccgtcttctgggagtccttccggggcacccctcctccgagccctcctcgccggggacgatgatcataggctgtggtggtaactcggttaagcttaagtactcttgtctcccacaatttcttcttcttgctgtacgcctgtacgtagctgtagatgttcttgtgagcgtgtgtgtgtaatacaatgagattttgttggccagtcactcaaaaaaaaa

SEQ ID NO: 29671 - DNA, 472 bp, Triticum aestivum
  Clone ID: PAT_TA_29671
tgtaaataccccttggcggaaaaggaagaggatcctaatcctagggttaatcaattttagctagttgatgggaaaatacgaattaatggtaatggtcttagggcgatttagttcggggaaaggggaaggggaagaaaattctatgaacctttccttttttttcgttaagttcaagtctgacgagagtaatattctacgactaacaactcatttattttgagaccgacccacttcctatctaggattttatttactagtcctttatattccaacgtgtcaatcgccaaatgctttggcaatttccccgggtccgatgaagcaatataattttgaaccagaccttttgatctttggttatctttcgtagtaataatatctctgggtttgcaacgaaaacttggtatattgactatacgaccattaactaaaatatgtctatggttgactaattggcgggccccaggaatggttg

SEQ ID NO: 29672 - DNA, 1622 bp, Triticum aestivum
  Clone ID: PAT_TA_29672
cccgagcgcgccttgcagtgtacaaggtcgcatttgagggcccgaagaaggtgcagcttgctagtgccgcgctgctagcagctctggatgatgcaattcatgatggagtagacatcctatccctatcagtccagtataatgacaattcatttggttcactccatgcagtccagaagggtattaccgttgtttatggcgccggaaatagtgggcctagaccacaagtcatttctaacacagcccccacgcgtccgacagtcgcaacgagcaagatcgaccggtcttttccaactgccattacccttggaaacaatcaaaccatcgtgggtcaatcactctattacatgataaaaaatgaatccaagagtgggttccagccacttgtacaaggtggaagctgctcaatcgaggcactaaatggcacggaaatcaacggaaaaattgttctatgcattaaagaaacttttggcccaacagcagacattctcccagacgccataacaaatgttaaaagtggtggggcatttggtcttattttcgcaatatataccatagataagcttttgagcaccgaagattgtgtgggcattgcatgtgtcattgtcgacattgatatcgggtttcaagttgcaacatacattggaagccaaggctcgcccattgccaagattgagccagcaagtactataacaggaaaccgagttcctgctccaagagtcgcatttttttcttcaagaggcccgtccgccaagtaccctacagttcttaagcctgacatagccgcaccaggagtgaacatcttagcagctacaggagacggatatgtgttcgactcaggggcatcaatgtcaaccccacatgtagcaggcgtcgtagcattgctaaaggctgtacatcctgattggtctcatgctgccctaaaatcagcaattgttaccactgcatcaaccaaggatgagcatggcatgccgatgctagcagaagcactaccccggaaggtcgccgacccattcgactatggagggggaaacataaatcccaacgcagctgccgatcccggccttgtttacgacatcgatccgagggactacagcaagttcttcgcttgcacgattcagaaatacgctatctgcaacatttcaacatcgccggcatatcacctaaacctgccttccatagccattcctgagctaaggggtccaattaaggtgcagcgagcagtcacgaacgttggcgaggtcgacgcggtttaccgagccgatatacagtccccctcaggagtgaggatcaaagtcgacccaccaaccctagtcttcaacgcgacaacgaaagtgcacgccttcaaggtcagcatgacgcctctgtggaaggtgcaaggcggctacacgttcggcagcctgacttggcgcaacgagcgccactcggtgaggatcccactagcagtccggatcacaatccaagatttctacgccgatgttgcatagtaacgaggaatgtcatatgaaaaataaagattggtgatgttacggattttagcatgaatcacaagattatttgtagtacttacgatttgtagtttgtacttgaagaaatttgtttgcaatagaacactactgttattg

SEQ ID NO: 29673 - DNA, 847 bp, Triticum aestivum
  unsure (1)..(847): unsure at all n locations
  Clone ID: PAT_TA_29673
ccacgcgtccgccactctccacctgcgcggccactggaggagccgcctcccctccccttcctagggttccgcccccctctccactgaatccatccagcctagggtttcgcctcccacgccgcgcccccatcccgtccgcatcgccgcgccgcgccatggccgacgccgacgagctgtcacgggggctggcctcggacgccggcaccaacaacctcttccaggtgatgcgcgccgtcgaggacgccgaggccaccatccgacaccagcttgaggagaacagccggctcaaggaggagctgatgcgcaagacccgggagctcgacgcaatcaggtccgaggctataaaccaaacctctacaagtagtcttctggatcaggaccgggccgtcgagccctacagagactcggtggggaatcagacggtggaggaccaaagattgcttggcacctcgtcttcgccgccaggctctcagggcactctgcctggtcaccagaatgggcctgccgagcagacgctgcacgacgccgtgatgaagcaaaagtacctggacagcgaccagcccggtcgagtgtccagaaagccatcgggggagcacatcgctgctgaggctggcgtgcggtctcacttctctaccccgtcgtctcgatccctctcacccactaggaaccgcagggaaggagactacgattctaggctcagtttagctggccaaggcatggagatgagctcaaacatcatctggaagcangatcttcttgttaaggtcaaagaacatgaagaagagattgcacatttaagaaagacacctgctgactactcagtgaaggaaagccaaatacttaatga

SEQ ID NO: 29674 - DNA, 610 bp, Triticum aestivum
  unsure (1)..(610): unsure at all n locations
  Clone ID: PAT_TA_29674
cgnaaacagagtccaggggaaaagtttgatgtatacaagcttcaacttcctgttttcaacatgtcatcactcagagttgtaaatgaagatcatcgcacttacccatcaaatgcagatgttgatgttaatgaaagcatttggcaggagctggaaaaagaattgatcccatcatcatctgttgttagaactaactggcttgacactcagccaaaatcttctccttttaaaaataacaaggcatgtatttgtgttgctggagaggcagtaaaactgaacgttgagctgaagaatcctttacaaatttccgtcaatgtgtctggcatctcccttatatgccagctttccaccaatttgaactcttcagagactggtgcattaacaacagctgccgaggaagagatagctaacacaaagccctctatttcgacatttgaaagtgatggaaacaatttcacagtatcgaagcttgacattgtattaggaggaggtgaaaccaaaaaaatacaacttgaagtgactccaaaagttataggtattctgaagttagttgggataaggtggaccctgtcagattcggtagtaggctatcagtacttcgaagtggctacac

SEQ ID NO: 29675 - DNA, 1504 bp, Triticum aestivum
  Clone ID: PAT_TA_29675
cggagcgtgggcgagtcgacacggggggaaccctcaattgccgccgccggccgaccctcgtccctcccatccccctcgccgccgccgagggccgctcccgggcaaagcccgggcagggccggcggcggcggggcctctccaccgcgcgactccccaccccatggccatggcgcatgtctctgtctccagcggcgcttggtggcgtggtgctgcgattcgcggcggcggcggcctggcgcggtggctgcgggggtggtttgagccccgtacggtggtgttgcctgtggcagtgatggctgctggtttcgagtccgccccgatcctcttctttggatctggatctggccggcccgtactcggtcgtggctgccggcaggcgtggtggcgccgggcctccacggctgccaggcacggtggtggtgctggcggttgcgttgggagcttggtgtggtggtggccgacgacagagcacagcgggcggcatggagttgcaacggtcttggtggggtctgcggcggtgtggtgtggtgcgacagcttggtggcgacgacgcgtgctggagatggcggcgcgaaccaccgtccagattggtggcggagctgcgatggctcggctaggatggagttcctggcgagcagcgagcgtccgggccacctctgggcttgtgtggtgagtgatggtgctctcccggtggtgccggcgtgggagttgtccgcggcttggtgttggatcgccgcaaggctgtcacttggagcggatgatagccttcagtggcggtcctggcccttgctagaggagttgggtggctgcgaatccttggccaggttgtaggtgtttggtgggcggtgttttcctgctgtgcggtctgtcggcggctctcggctatgcagctacgacggcgaggcgctgcggtggcggcggtgcgaagcatcttggatggtgctgcccaattccttcgaggtggtgaaatgtgtgatgctcggatgaaaatcttgcacggctcttgccgggccggcggcgatggcgcccgtgggtgtcattcccctccttggaggcgttgccgagtgtattcgacatttccctcgctcgtttggagttggttgttgtctccgggcgaaagccttgattcggtcggatcggcatgatggcggtgtacatggcgtcgttcctctgttgagagcatcgtgtttggagacatggcctggttcctcgttgctctcctccggtgttcgctgtggcccaattctgattatcggcggcgctatgcacgaccgtcgtcggtgtgtccaagacggtgttttcctcggatcggatcaagtcctgccatttacttgccacttcctcttcagcattcagggtggatgggtgcgttgacaagtgaagttctgtgggagcagttggtcttcggaggtgccgacatgggtcgagacgtggtgttgttatctgttgggcaagcacttgcgctttgtagtgttgtatggtcgttggtggcctgggtgtggtg

SEQ ID NO: 29676 - DNA, 1314 bp, Triticum aestivum
  Clone ID: PAT_TA_29676
ctcacacagcgagcgagccagcattccacagcgagcgagcgagcgcagcttagcctagcctggcccgagaagggactcgcgagcttgcacggatactcagctgtagcgcggcgcgatcggcatggtgctggagggggaaaagacggcggcggcggcggtgcacgggcaccggctgtcgacggtggtgccgagctcggtgacggaggtgggggggtacgagctgggggacgcggacctggcgttccggctgcactacctgcgcggggtgtactactacgcggcgggggagctcatgctccccttggaccaccaaggtgctcaagggaccccatgttcccctggcctcgacgcctacctacccggtggccggccgcgtccgccgccccgccgacgaaaatgaagaggcctcgcgccgcccatccttcaagcccaacgactgcggcctccgcatcgtggacgcccagtgcgagcgcgcgctcgacgactggctccgcgacgacgccgtcgaccgcgtccggcagtcttgttaccaccactgcttcggccccgagccccaaatctcccggctgcagcgatggcgctcgggttcagctgggcgcacctcatcggcgacgtggccacggcgacgacctgcttcaatcactgggcaaagatactgggcggcaagacgccagacgccgtcaccgtgaaccccaggaacgagccgcaagaccgcgcgcctgccgacgccgccgtgccgcgctccgtgaagtcggtcgggcccatcgaggactactggtttgtccccgccggcgtcgacatggcgggctactccttccacgtcaccgagccgatgctcacgaggctgcagcagcaggagccagcggctgccggcggcgccttcgagctcatctcggcgctcctgtggcagacggtggcgaagatcagggccgccaaggaggtgaagacggtgacggtggtgaggaacgacatgtcggccaggagcggcaactccctggccaacgagcagagggtcgggtacgtggaggcgggctccccgccggccaagaccgacgtgtccgagctggcggcgctgctggccaagaacgtcgtcgatgagaccgcggcggtggtcgcgttcccgggggacgtgatcatctacggcgccaacctaacgttcgtggacatggagcaggtggacctgtacgggctggagatcaaggggcagaggcccgcgcacgtggagtacggcttggacggcgtcggcgaggagggcgccgtgctggtgcagccggacgccgacgggcgcggccgcgtcgtcaccgcggtgctccc

SEQ ID NO: 29677 - DNA, 1059 bp, Triticum aestivum
  unsure (1)..(1059): unsure at all n locations
  Clone ID: PAT_TA_29677
gctggcagcaaagacgaaatcctacttcgccaaagccgtgtccatgtgggatgcagagtacttcgtcaaggtggacgatgatgtgcatgtaaacatagcaactcttggaggcatattggccaggcatcgttccaagccccgagcttacatcggctgcatgaaatcaggcccggtcctcgctcaggagtaagctcgctcgccactgctacgacgcctttcttggtccccttgcaacagctgctgaaaccaagttattggccgtttcaggggtgtgaaataccatgagcctgagtactggaaattcggcgaatggggaaacaaatacttccggcacgcgagcggtcagctttacgccatctccaaggatctggcctcctacatatcaatcaaccagcatgttctccacaaatatgccaacgaggatgtgtcgataggagcctggttcatcggagtggatgccgagcacgtcgacgatcgccggctctgctgcggcacgcatccagaatgtgaacggaaggctcaggcggggaacgtatgcgctgcgtcgttcgactggagctgcagcggcatctgcaagtcggcggatcggatcaaggaggtccatcggcgctgcggtgagagtgagaacgccatctggaacgcaaccttctaaactgaagattctccaggcttaaagctgctgaaagaagaaattcacatatacaattcatgctttaacggagggtggccggatattataacgatcaactggaatatgtgaaagatggtggatagaagaaaattcgttggtggcccattcagagcgtgagatggttgcacactcatgtacaagcacggcccgacagcaggagtcttgttcctcttttgtacgttcattttttttcatttaatctcctagtgggttgattgactaagactgtatccagtgtacgtaggggaactttcctgttttaaatcctttaaaaattcgcagcaatacttatnaaaaaaaaccnacagggggggccccggtaccatttcccctatatgagncctattacgcggcnnacggctcctttn

SEQ ID NO: 29678 - DNA, 762 bp, Triticum aestivum
  Clone ID: PAT_TA_29678
tagaaagaggtagacgaagcctcggaacaacacagagaagcttcggaaggggaagggggagcgatcggaaggggagggcggagagatggggatccggttcgtgctgctggtgaacaagcaggggcagacgcggctggcgcagtactacgagcacctctccctcgacgagcgccgcgccctcgagggcgagatcgtccgcaagtgcctcgcccgcaccgaccagcagtgctctttcgtggagcaccggaactacaaggtcgtctacaggcgctacgcctccctcttcttcctcgtcggcgtcgacaacgatgagaatgagttagccatcctcgaattcatacatcttctggtggaaaccatggaccgccactttggcaacgtgtgtgagcttgacatcatgttccatctggagaaagtccacttcatgctcgaagagatggtgatgaatggctgcatcgtggagacgagcaaacagaacatattggcgcccatccagcttatggagaaaacctcgtaaatagtgtgtgaactcaagagcgcctatgtgatgcttagccttttcctcccgcctttgccatagattcgccctttgtgtggggagaaatgccagacaagtgctgtatgcatgggtggctgtgttcacccgactggaaaatgtgaaatgtcctgtaatgttgaaaatgaagaccccgtcattttacttgtcagttcttacctgtaactacagttctgtaaaataatagtgctcgtgctgcttgctct

SEQ ID NO: 29679 - DNA, 815 bp, Triticum aestivum
  Clone ID: PAT_TA_29679
cggacgcgtgggacaggcggtgccgtagacgaagcctcggacggaacgatacagagaagcctcggaaggggagcgatcgggctagtgaaggagcaggggcagacgcggctggcgcaggctgctggtgacctcgcccgcgccgagcgccgtgccccagtactacgaatagcccgccagtgacgagcgcggcgccctcagcagcgagctcgcgcggaacgtccctcgcccgcactgaccagcagtgctctttcgtggagcaccgtaactacaaggcggctctaccggcgctacgcctccctcttcttcctcgtcggcgtcgacaacgatgagaatgagttagccatccttgaattcatacatcttctcgtggaaaccatggaccgtcactttggcaacgtgtgtgagcttgacatcatgttccatctggagaaagtccacttcatgcttgaagagatggtgatgaatggttgcatcgtggagacgagcaaacagaacatattggcgcccatccagcttatggagaaaacctcgtaaatagtgtgtgaactcaagagcgcctaggtgatgcttagcctcttcctcccgccttcaccatagattcccccgttgtgtgaggagaaatgccgaacaactgctgtatgcatgggtggctgtgttcacccgactggaaaatgtgaaatgttctgtaatgttgaaaatgaagaccccatcattacttaacaacagttctgtaaaataatactgctcgtgctgcttgttctaacagacttggtgcaattgccgcgcataaaacatgagtcactgaatgaattttt

SEQ ID NO: 29680 - DNA, 417 bp, Triticum aestivum
  Clone ID: PAT_TA_29680
tcgacccacgcgtccggcaagaaataccagcggccagcaaatgcacaagatgcagagagatgtgctaccagcaagcgcactcgcttctgtagtatatgccgggagccagggcacaagaacagcacatgcccactgcgaggagatcttcgtcgaaaggaaaggaaagaggcaaaatgctcaaactgtggtgtcggtggacacaggagaaacacatgcaacaagccgaaagttgttgtgcacgtgatcgagaaaatagctttggaaacgaatttaccttagtttgtgtttctgcaaactctgttcttgagggctctgcagccaatacttaggaatctgtgtaataaaaaccatctaccgtgctatgtgttgtacttggcactattgtcgttttaaggactgaatcattttcacctctct

SEQ ID NO: 29681 - DNA, 1575 bp, Triticum aestivum
  unsure (1)..(1575): unsure at all n locations
  Clone ID: PAT_TA_29681
aaattcgccgaaccacatgccttgtccttggacacatgaatgaacaatgaaggcaacactaatgatgccataatggacatacctgaacatgaaccgaatgcaatatacagagtccccacgtttcaaaacaaatatacagagttcaaacgtcaaactggcaaaggctcaaagcatgtccgtgtgacagcatatagtagtactatttaacaggggatgacgatgggactagatcactagatgccatttgataaacagactaacggaggataaaaactttgcacaggggaaactactagtagtacttaagttcacaggttgctggcagctacatttcagaacctcatgttccgaccttcacgccttccagttccatactctatggaaggaaccttcacaccgtgtgtgcctgagaagaggatgagtcaacagaaagtccagtattctcgttgctgtgcatctttggtgccatgtcggtttgaagagacagcttgaggatagcttgcccagtgctaccatcagaagcaacggaagactcagactggaagtcccctgcatgacggaactcgacaaccgccttgaaattttgccacggcttcacccagacctttgccttgtacatacttttctttccagaatccactacctccaccatcaggtcatgcaaggtcccagcaaccacttgccttttcgcgttcacaacccgtgtaaactccaatgcagaaccctgcttcctgttgtgctcggcgacggcgaagcgcgcggcgtcctcggcctcggcccgctcgcggacggcggcgagcatgccccgcacgaggccgctctcgtcgccgccgaggtggaacccggcggccccggggacggccgaggcggcgaggaggacggcgagggagagggcgaggagcgtggcgccgacggagcagccgcagcggcgggccatcgtcgctcctcccgagccttcgattggtcggcgagtttggcgtcggcgtgtggtggctggctgcctggctgcgtgctgacgtcagaagcaacagaagactcatactggaagtccccagcatgacgaaactcgacaactgccttgaaattttgccatggcttcacccatacctttgccttgtacatacttttctttccagaatccactacctccaccatcaggtcatgcaaggtcccagcaaccacttgccttttcgcgttcacaacccgtgtgaactccaatgcagaaccctgcttcctgttgtgctcggcgacggcgaagcgcgcagcgtcctcggcctcggcccgctcgcggacggcggcgagcatgccccgcacgaggccgctctcgtcgccgccgaggtggaacccggcggccccggggaccgccgaggcggcgaggaggacggcgagggagagggcgaggagcgtggcgccgacggagcagccgcagcggcgggccatcgtcgctcctcccgagccttcgattggtccgcgagtttggcgtcggcgtgtggtggctggctggctggctgtctgcggacgcgtgggtnnnnnnnnnnnnnnnnnnnnnnnnnnnnnnnnnnnnnnnnnnnnnnn

SEQ ID NO: 29682 - DNA, 961 bp, Triticum aestivum
  Clone ID: PAT_TA_29682
tttttttttttttttttttagtacgttgtgtagcccgtagagggcaccactgatcattccatttccatagtccataccacaacgctagctttacaggagcagagcatgcagcccacttgtctatcttgcggctaccactggcgtccccggccccggcaggcgtgctcgccggccggcgcggagcactacacgacctcgagaggaggaggacgacgacgacacaatgatcacagtactttactacatgatggagcatgcgttgacgtcgtcgtcgttgaacatgttgctgacggggtcggagccgcggtggggctcggggaggtggccgtgcttgtcgccgttgtagccgtggcggtagtagttgtagctggggcggaacgactcctggtcgtggaagtagtccttggcggtggtgaagtgcagcggctggtccgggttgggccagaactcggccttctccccggcccgccgcacccgtacgagctcccggtgcccttctccatctccacctccacctccacgctgtccaccccgcgcagcctccacgctgtctgcttcacgcaccttccgcaccgcgtgcttcacctcccgcgcgtaagctccaccgtctgccgggaccgccagctcctgcgccggcagggacagcggccggctgctacggccccttgtgcggactacggggtgccagcgctcgtgggggggctgctgtgctactaggcccccgcgcggtggtgggggttccgcccgcccgccgggttgaagcagccgtacaggaacgacgacagcgccgacgacacagacatggccgccgactccgccaacaacttataacagcgagaaggagagtgcagtgcacgtacggcaagcttgggaaaatgctttgctttgggctgctggagcgtttgcctctgtgagtgtccttgcctggtgcatgcgcatggtttatagaggaggtggaggg

SEQ ID NO: 29683 - DNA, 819 bp, Triticum aestivum
  Clone ID: PAT_TA_29683
caagtaagtaacataacgaatgagcagtctcactaattatatacgtccaatagagtaaacaaactgatcaagttaacatgaacggcatacgtacgagactattccgtgcatatttattagcggaaacgtctattatacatacatatgtaccggccatgaacacatctacgaatacaacggagtgatgcgcatgcacatgacaagggagtagtaggccggccggccggccggctggcctttcctagtgtcaggaggcgacgctgctgttggcgttctgcagagactgtagctgcgccttgccgctgaggccccgctgccggatgtgggcccggtactcgtcgaaggtcatctccgggtacagcaccgggcgtcccggcgccaccagctccgccatgggcgccaccggcacgtcgctccgcgggttgtagaagaaggcgagcgatagccgctcctccgctgcgctcacagtcacccggtgctccacgctcttatacgccgcgttgctcagcacctggatctggtctccgacgttgacgatgaaggcgtcagggaccgggtcgacggtgatccactggccatccttcttcacctgcagcccccgaacgtggtcgtcgacgagcagcatggtcatgccaccggggtcggagtgcgccccccccccccgccgcgccccccgcggcgggctcctcccgcaggcgtgccccctcgcccccccccccgccccgccctccccgccgccccccgccggcggccccccgccctcgggccccacccccttgcacaacacctttgataccctccggcacagcctcgtgccga

SEQ ID NO: 29684 - DNA, 1082 bp, Triticum aestivum
  Clone ID: PAT_TA_29684
ggtaacaatggcgggtttatttttattcggaacctcaagtttaggttcaaataaaacatatttaactcacttaaatactaggaacactgtacattattgtagagcaagctttttgcagcaatgctttcttttctggctggggtgggcacatatatattcgcgccaacaaaagaacatacatatattgcaagtggctcaattcgacgttgagccagctcatgtacacaagacctgacaatttcaaccatccaattcttccatgtgtcaggtctcaatgctgagttgctgaccaaagaaatcatctttcttcacagcatcccagcaaaccatcttccttcaaagccactgaattttgtaatatgaaactgcgcttcctgcatcagtgacacccttcctttgaactttgaagcctgaatttcaggctacctctttcctagggaagatgttcatcgcatcactgtatagggcaacacagtttgagatggcagcaaggatgatcatgggtacacccaatatcgggtcaccgtgggttgcgattccatcgtgttcccctaatatgacgggtataaggatctccatcaccacgccctggaactcgttcatgcccgccgacacggcgtgcgtcgggatagcctttccgtgggtgacaaacttgaggaggaagcatgccacggtagagccgagcagctgggcgacccagtagaagagcccagtgaggatggtgatgtggccgccgacggcgaagccgaacgtgacggcggggttcaggtggccgccggagatgttggccgccatggccacaccgacgaagagggcgaaggcatgggcgatggcgatcgccacaaggccagcggggtccagcgcgccaccctgcgtcagttgcccgtaggaaatggcggacccgacgccggcgaacacgaagaggagggtggcgatgaactccgcgacataggatctgacggacgtggcgctgaacgagtcgcccaagcttccaaatgcaagcttcaccatcttgcactcgactgttttctcaacgaggtcttcaggctaagagttcgcggacgcgtgggcggacgaatggg

SEQ ID NO: 29685 - DNA, 666 bp, Triticum aestivum
  unsure (1)..(666): unsure at all n locations
  Clone ID: PAT_TA_29685
ttttttttttttntnttgattatgtttgctcttccgggcccctttttttttttttggaaaaacgcagaaccgttcatgtaagatcgagtggttgtcttacatttttacatttttgaggtggatttgtattaaaatcgaaaagggaaattcacacaaggggaaacagcaacgagccaagagcccaggaagctaggttcggatccgtgcgcttcacgggtagtcctggtggccgaccggctggtaggaggcgatgaacacgtcgccgtagacgagcccggcgaggccgccgccgatgagtggcccgacccagtacacccagtggccggagaagttgccggccgccacggccgggccgaaggagcgcgccgggttcatggagccgccgctgaagggcccggcggcgaggatgttggcgccgacgatgaagccgatcgccatgggcgcgatggtgccccggcccaccctctctccgccgccccccgngcttcgctgcaaangangaatctctgcctgttcnaaggatcctggacaacttggggcgttgaaccaacantacggctctccaaagggcggcaacaagtgctcccgttgatcaaggctacaaagacctganggacananccctatcccgcaacctcatgctctccaactcacggnaagtangcc

SEQ ID NO: 29686 - DNA, 2036 bp, Triticum aestivum
  Clone ID: PAT_TA_29686
tttttttttttttttgggaaaaaaaagttcattaggcacttctttttctttttttttcttgaacaaaaacgtaggtttttccgtaatgcaaaatattttaatatgttatgaatcgaattaggatagacagagacacagacatggtcactgaccttgatgtacgggacacaccaatatataccgacccttaaataacaaattcacacaaccaaagagcagagcaatcaagcgtttgggacacgggttgaacgacgggcacacgcggttcttgacacgggctcatggtcgacgaatggcacatgcctcgctaagagcatgtcggcgtacacgaacccgaccaggccgccccacatgagcggcccaacctcgtcctccaagttccgggcgaactttccggcggtgaaagcgggcttgctggaaggagcggcctccgtggcgcccgacgttgagggtctgaaggtcaggctacatgcttcttacgatgaagacgatcatgaccgtcgctgtatagggccaacgggcagcttgagctcgacagccaccgtgccgcacccggtggataccagccgaagatcttgtccactcaccaggccgcgcgtcctcgaacagattcccgtcaagattcacccatcgcagggaagtgcaatccaaatgagaaacgcatgaggagggcacagaggaagctggagatgcatccctgggtgccccagtataaaagccccaggagtatagggaaataggcgcgaacgggacgggcaaaattgacagccggttattgggtggacgcctgtgcctttgacctggaacggagtagccaacgaagagggcgaaggcatggccgagcgcgatcgccacaaggccagccgggtcgagcccgccatcatccgtgattttcccataggcaatggcggacccaacgccggcaaacacgaagaggagggtggcgatgaactccgcgacatacgagctgacggacgtggcgctgaaggagtcaccgcagctcccgaatgcgagcttcaccattctgctctccactgttcctgctatgctcgggacaaattggtttagtgtgcgttttatcctcagagctcaattgtcaatgctgtgaacattatagtggcagatatatgcagtgacaaggacagggacagccgtaaaaagcttccagacagaactaagatcatctatttctggaaaaagcttgggcattgctacagttccattgatgactttgattatggcaatcccagcagtaataacaacaaaaaccacagcgagagcaactgatagggcagatgtgtagctcagtgaatccaatcgtttaaagctcaccaatggagcaaacacgaaaagagttgtcacaagaagaacaatggcgcgagaattcccacaaatgtgctccaaaccagccctccaatatgccacgatgatgaataccgcctgacgacgttccagataatacatcaccaatgataatcatgtaaacaatcatcacgccgatgttgtttataaccacagaggcctgcagcgcaatcctcccccattgtccatatgcctcacccatcagccacccatatgacgtgatctttccttggtggctgcacctgataagcatgtcaatggatgcctctgtgagcagtgccacaaagatgatcatcagaaggccagggatgaggcccagcatcttgatgcttgctggcaaggccatgattccagcaccaacgatggtggtcgagagattgaaaactgccccggagaatgaagctccattaaactcatggaatccctcctcctccaccttgaccggaagaagcggcgcggtctcatctcgtatttcattgcgcgccgtctgctggttcacgtctgctgatccattcccgacacccattttctatttcactctcctttccagcagaagtctctccgggatccgaaagccagaagagcagacgcgaccagagccagacaaaagcagagaagaacttgtggactgtggtctgcggagggagggccgctctctcttccggacgcgtggg

SEQ ID NO: 29687 - DNA, 974 bp, Triticum aestivum
  Clone ID: PAT_TA_29687
tacacccacttttgggcggagtgggtcccgccccccccctttgtttttttttttttttcttttttcagattgggacgggtgcgagttcccgatcagaatccattgctgatgtgtacataatatcaggttgggcaaaaccctcaaaatacatgatgtgtacattctccattactccatacagccaaaatatttcagtgtagcgcgacgacggtaatacctatgcgggcggagtatatgctatgaaaaacgttcttatttgcagacaatcatcaaccatcgaaggagaagacgcaaacaaaggttccttcagcttatgtgttcacgaatctgcaggtcttcctgacctcgccacctgcagggttggtgatattgcccatcttaaccatggagtccgagaactgcttgaagaacagctccgggtcagcccagtacttgttgaccgtgtcggccgtcgagtacccggcgatgctggaccacatctcctggtcggagttcgaggaggccctcacccttgatgagcgtctcgaaataggcgttgtcaaaggtccctggaagtgtggctgtccatggcactgatgttgtcgtcgccaccatccaaggggcagatctccttgagcttgctgaggtaggtcgcagacgcagggttgtacttggatgtcatctcgaagtcgccgtatatcctgtcccggaagtttgcgcaccgggcgaatccgatcgtgtgggatccgacaagggccaccatgtcagtggcatcaaggcccttctcccagaacttggaaataagggtgacgaggccctgctcagcggtggggatgtccttgtttgctaggtcaagacttgcctccttggagtccagtcttcctactggaacatcccagtaaggcccaccaaccaagacaactgcgtccctggctgcaatggcaagcaagtcagcacaggaaactgttccaggacactcagcttcccggacgcgt

SEQ ID NO: 29688 - DNA, 2144 bp, Triticum aestivum
  Clone ID: PAT_TA_29688
gtatcaatgaaggaatgcatatttgcaagcaagggcaagtagcatctcctaagttttggatggcgaataggggaccaagtctctcacacaaactactaagcaggttttaggacaacaaatacagattcttatatgtgaccttccaatacataggttcagaacatttacggcagggcatcacacacaggcccggaggaaaagataaagagtaaatgtattctactagggaaatcagagggtttatggcatccagacaggtcctcttaagcaaagcttccaggttgggccatactctcagtcatctggtttgggtaggggctccaataagcaggctccaaacttcattggtcttggctgttttcagtaaaggattgggcaggggtgcaaatgtgaaacggacaggttcatcggaagagagctgagctgttggattcgacaacctgcattttaatagccatagcgttttccagatgaaagataggtagagccagataacccgctgctgccagaaccaccactgtaagcaccatagccgcctccgtagacctgggagctgccataatttgcataacggtcaacaggaagcacatcgtctgatgcatgatatccactagaatatggataatcgtgcccagcagacttattgtctctgcttagatactttggctcatcggacacactagcaggcaaagggtgatatgggatcacaggtggaaaacctgataaagcaccttctctttcaaagaagttggctttcagccttgtagttatttgcacaagagcatgccttgcaacatcaagatctccgctgatctggaccatctcttcgtcgtccgatgctacttttggaacatcctccttcgaaatgatccgtatgtttgctctcgatgttcttcgtatctccgtaatgattgaaccacctttgccgatcaggcaccctatccgtgatgtcgacaccaacaaacgtgtagtatatgatggctcccccgattctgcatcaattttctcactgcatcttggctgtaaacggactgtagcatcgattgttggagagacaggatcttcaaagaactcctttgctgaaactgtaattatgcagtcatcttcagcactcgaactatccactttgataaaagctccagattcttgcctaatctgtttgataataccacctctttttccaattacacctccgacattcgccgcagcacaaagcagacgcaggctaaactcttttgcagagctcacctccctccgttgttggtatatagaaggccaatctcccaccatatcacctttgtatcgtccataaggactaaccataggagtaatccctacaactggtgcagtagaggaactaccaaggcgggatcccgctggaaaaggttgggttaagctggacgcaaggagatgctgtgacctggatgggttgccatggaggcgagatgacacttggagaagagcttttctaactaccatcggatccccaattatcaggagaagttcatcaccactagtagcacatgcaggaaggtgttcattactaagaacacgtatttgtgaaccagtgtcgctgcggattccctggatgatatgcccaccttttccaataatgcatccaatctgatcagatggcacaagcaaccgaacagtaagttgacctaaaccctcttcattttcttcgttcacaggaccatcatctgtggcaagcttctcatgaaccctaaagagagcatcttgagcagcgcaaaccttatcttcggtatcttcaatggtattagtctccctgcttgagctaaatattgttatgactcggtcatcgcagttaggtacactctcaccaatcctaatcttagcttgagtatcgctcctcagctgtttggcaatttctccacccctcccaattatactccctattttcctagacgtgcaaaggtagcgatagacagtgtcatctggaccaggagcatatgtatcatcaccaggatttcttctcttgccacctccattttcagcataatcagactgccgctttccatgactgttccggtgcccaggcccgaccatgatcgcggcggccgccggagaagggtaccagatctggcgtagggagacgaggagagaacgacaagtctatgagtctc

SEQ ID NO: 29689 - DNA, 906 bp, Triticum aestivum
  Clone ID: PAT_TA_29689
gggcactgagatatatagccagttctcttctatgtacaacttcttctttggattattttttgataattttgttcggagtgcacaaccaacttgagccatcctttgcaattgccttacactagctagactacaatgtacaacccccaaattacaatcgagaacagaaaaaaaaattgcttaaaagttaagagatcacgatcaggtgtgaaagacgcagaaagcaaaaccaaaaaatgtccatttgattaatcaatcaccggtccttctcggtgctggcgtcgttgccccgcccgttcgccgacgccgtgtcgtccaccggcaccacgccgccctccttgcggctcctgatcttgatcagcccgtacagcttcttgaactccctcatcggcgcgtccttcccgaaccccccgccgcccccggcccccggcgactggctctctcccgccgccgggttggactcgtcgaggtgcccggacgttcttgaggtcagcctgggcggccgcgcggcggagctcgtccgcggcgccaccacgtgctgcagcgcgctgatgacggtgcggagcgcgcggctcggggacccgcggttggcgagcatgatctcgccgagctcggccgggctcaggcgcgcgccggcgtggaagccctcctccacctgcgggtaaagcttgtggtccttgaggcccaggtagttgctggccagcgccttgaagccgtcgaagtcgcacatggtgaagtggatgtgcacgtccagcctccccggccgcagcacggccgggtccacgccctccttgccgccgctcatggtgaacaccatcacgcgctcctcgccgcagcacgacgacagcccgtccatgaatcccagcaccctggcggcccgcgccgccgacgtctccccgtcgccgccgc

SEQ ID NO: 29690 - DNA, 732 bp, Triticum aestivum
  Clone ID: PAT_TA_29690
gcacaaacagcaaacaatgaggcacgcaggttcattcctgtcttcctgaagtaatgcaacaatgtctgacaaaaacagtttttttctttctgtaagcccaaatatcattcacacgacacacccatagcagtctactgtaatgtttgcttagagattgattcatgaatttccgatatttacctcagctagtagattatctcctaatctttcttgctgggaagaatttaacaagcttacagaaacatatcgagagatgcgtccaagataactaatgccgactctgatttcattgcattcatattcatggcgtccactaccacacagaccgatggaacagcagctggcagagactggacggagcagcagcagcagatcagccgccgaagccgtagagggtgcggccctgtcgcttgagcgcgtagacgacgtccatggcggtgacggtcttgcggcgggcgtgctcggtgtaggtgacggcgtcgcggatgacgttctcgaggtcgttcttgagcacgccgcgggtctcctcgtagatgagccccgagatgcgcttcacgccgccccgccgcgccagccgccggatcgccggcttcgtgatgccctggatgttgtcccgcagcaccttccggtggcgcttggcgccgcccttgcccagacccttcccgcccttgccgcggccggacatgatggtggcttggagcgccgagcagatgcaattgggtggagacggcg

SEQ ID NO: 29691 - DNA, 676 bp, Triticum aestivum
  Clone ID: PAT_TA_29691
aggaataaaaaactgtataattatttgaacaacgctggggtacaatacatagtgtaaaaaattaaagtgcagagtacaaagtaaactgtgtaatgatcaaagacataaattgctcgtcgcaatttcaaattggtctggaaacaatagagttgtcacaaaatgccaaatgctcgcaatgttggattattccacaattcgcaataaagttccaaatcatttgacgatgttgatgcatttggtggtgaacaaaaagaacaaggaagattgaataaatttctcgaatagtataataataactgaacggaaataagtaatttacgtgaagcttacgaagttacgaatttaaactttgctaaaactgctcgagcgtccacgaccaactcgtaatgaagcatacatatcatgctttttggaaatatcatcaagtttattttgtcgttcacgtttagggttcaacaaccacagcataaccaagacgcaacacgtgttaagcaccaaaaggtcaaagcaactgctaaaagaccagctacaataaaaatagcgtaccaaacccctacaggtaaatttcctggcaggtcatccatagatttaggcatatgaatatcagataattgcatttttgtggatacgcgaatggaattgtgatgtatataaacaaatcgaaacgaaatttaat

SEQ ID NO: 29692 - DNA, 658 bp, Triticum aestivum
  unsure (1)..(658): unsure at all n locations
  Clone ID: PAT_TA_29692
ttttgtttttgttcccccttaaaaaatcactcttgacaaatataattcataaaaaagagacaattataattcgtaaaagcttctcgctaaggagctctcgcatactacgtctcatttgcctacgtgtggccagtaaaacacaacaaccatctctgcactctgcttttctggtgtgattttgtaggctcagacctatatataatgctttaccctcaagaaaccaggtattttatgtcaaactgctagactaactatacccatggccaagcggcatgttgcctgcctccgatgcaaaggccaggaagatcttctcccgtgtatctattcttgccaccattatatcattctgaggtccgacgagctatgtctactgcgcagagcaaagctagctattcacacatttggatcaccgctcgtcttgatctggatgatcagacgatgtgcacaccggattgtggaggttgcccttgttgctgcctatcaccgctgttctcgctcacggcgttactcccggactctggatgctgtccttcgttcgcaggctgaggctgcgtctgagctaaccgctggctcctcctagatctccacctcatgcactccaccggacgtgagtttgtactgatagcaatccccgacccggtggaatgatgacagtann

SEQ ID NO: 29693 - DNA, 615 bp, Triticum aestivum
  Clone ID: PAT_TA_29693
gaaaaaaatgatgcttctaaattacggacagcaaacctaacaacaaggtctaaaaatataccaaagagcaaaacccactctaccaccaaacttaatttcgtgtttcttctttcgttatctgtttttctctccatgtcatgtaccgtgtgttgtgtggatcaaataccgtgcttacccatctaccatggaagacttccagtctgtggatctgtgaattctttgtgcacaaaatctttcagaccagtgtcatatacttcacagaaccgacttggccaatcctcaggttccaccggtttggtccctagacctggcgccctgtccctggatccaacattctcctcgtcctgccaatcggcaacataggtcgccacgcggccagcaaacttctctttgaacacctcccagacttggtatttgtagtgattgatcagcatcactccctggccaacattcgcatacttcatcccttccttcagatggaaatggtgcaccacgttgatcaagtgatggattcaatgcatctggcctgacaattgacttgtgccgctccggcgcagccagcccggcaggtgtagcctgttgtgacgcctttcttaggaatcttatcccggcctg

SEQ ID NO: 29694 - DNA, 394 bp, Triticum aestivum
  Clone ID: PAT_TA_29694
ctgcaaactatcaagttatatacatatatacataaacggtcgcacgggaggcatcataatactttcaggcaaaagtataaacacagcctttataatttaataaacattgttcttacaatgggaatacatgtcactagaacataatatttttcgagcaccgagcctctattaaacgagcgccttcaaggacttctttaaagtagtgctcggccgatactcggcccacggctgaactctgggtcgcaatagcggtggcctccatctctgcccagtatgtcttgacatgggccagagccatccgcgcaccctctatgcacgccgacctcttcatagcgtcgatgcgcggcacagcaccaaggaactgttgcactaaactaaaataactattcggcct

SEQ ID NO: 29695 - DNA, 1311 bp, Triticum aestivum
  unsure (1)..(1311): unsure at all n locations
  Clone ID: PAT_TA_29695
ttttttttttttttttttacctcggcaaagatccattttttaagttggggtaaatgtgcatgacacttcacatcctttcggaaccagttcgacatgatgacacaagcttctgcaatgccacaagaagctgagattttggtggctaatggtaagtaggagctagtacagagctaaagaaacaaaactgattcctggatatttccccctcattttcaaacaatacaattacagaagagaagtaatcctccatgatacaagctacattgcgcaacagtcatcaaaggtcctgctgcttcttgtcctgggcaatcttcttccggatctcctgtgccgcattgaagatgccaagcgtcggtttattgcagacgaagcatttcttgttcttcgagtgatgctttaatgcgcaatgctcgcagaaataatgcttacactttgtgaccaccgggtcaacaaagggttccctgcatatgaagcaggcaaagggcagtgcctcctcgtcgtcgctgtcctcctcctctgcctcggcatcactaccatccaactcacgcatcgctatgcgccgtttgcgggctttctcggcctcatcccactccctctcgagctgccacccagacttgtagtcacctctgtcgtgcatgaacttgcaggaatcgccgtagccacaatagccggtctccttataatccttgcagatgtctggttggtagtcaaaccgcgtcgagaggcgtatgtgcgctgacgcccgcagggggccgtgcgcgccgccagccttctctccggaaaccgtgtgctcccgccggaagccggccttgtgatctgtgtagccgtggatccccttgtagagctccccggaggaggaggacgcagaggggttcttcttgagggactcctcagcctgcttgagctgccgctcgcggatggcgcgcgcatcacggtcgtacgccgtctccgtctcgagcgtcgcagtggcgcggttgtcggtggaggactgaatcgtccgggacgactcgaactggaaacggcggggctcgtgtgagttgtcggcggaggagaagaagagcttgctggtagtagacggcggcttcttagatcgcgccgccgcgatggccccggaatcgtcgccgccgctaccttcttcgtcgtcagagccgacggaggcggcgggacgcttccggatattcttcggcggcttccgaacaaagttgcacaccggcgccgagccgccggccccgggctcgccgccgccgccgtcggacctgggggtagcctcgtgccgannnnnnnnnnnnnnnnnnnnnnnnnnnnnnnnnn

SEQ ID NO: 29696 - DNA, 300 bp, Triticum aestivum
  Clone ID: PAT_TA_29696
ctcaataaataaaaaatttgtctttcgttctgcatccaatctgaattgtttttgttctacttgaggctgatttagggcttctctcactcctccctagaaagcattaacagccatccagtttccagattttgtgtacggaaaaactacttgccacaggcatgtgccatgcagacaccattctacatatgacaatcctaacaactggggtggaagttgacacgaaaggtagtgtcccaacaaagggagagaaaaacataactcgtctatcaaaaattctatcagcacttcggcaggttccag

SEQ ID NO: 29697 - DNA, 751 bp, Triticum aestivum
  Clone ID: PAT_TA_29697
ttgtctgagtgccgttaaggactggaattatcagtgcttagcaagcatttgagtacttgagtacatgtggcatacagatcatttttagtatatggccggcaagaacaagtggtaaagactgaaattatcatcgcccaacaagcatcttgctggtacaagaacgaaaatatctatcattttgcctcgtgttagtgcttcctggcaatcgagcttcctgctgggagagagatgacaacctccatggacacttgatcagttcgatcgctattctcacacctgatagtgttggtgcacatgctgcgatcattggaattgagggctctcctagcggagacatcgcactgctaccctccattactggatcctgcagaacgaagaaccgtggcggcctgttcgcagaaccagagagcggccggctgggaaggaggcgaggatccacgagcgttgagctaggaccgaatctcgagccggggtgggggtggaggaggacggccgcgagctgatctgggagcctgagagtggggaggaggtgaggaatccgatctaatctgcctcaaactgcgccacctgcgacgaaacggctaggacctaggagccatcggagaggagatggatcagcatctttgctgctcgagcccgcctagcttggctcaggatcttggtcgtcgccgtcgccgccgccgccgagaaattttcgatcctgtgtcgtcggtgtgtaaggatttggtacagactagggagctcgtgccga

SEQ ID NO: 29698 - DNA, 674 bp, Triticum aestivum
  Clone ID: PAT_TA_29698
agccatgccaaaaaatgtttgtcattcggcaagttttcatacagtaatcctccacatgtgtgttacaaaattacaaatcatagagaaccttgtattctacagacgagacaagctcggtaagttttgaacatgaatttttggtggtggcaattggaggttgagtgtatggacctcttagcagaccatcagcaatggccttgtatgacgtttctgtgggatgcaagccatcccaagatgcatacttttgtgggttatcacacaccttgtattctccatgtccacactttgtggttattgacacaccataaggcccttctacaccgcagcaagccaccaaaggattcttgatcccaaactgagaaggggaaacaaagatctccatagcagcaccatagtaatcagcatagatgatcgacacactacgatgaagtttccgtaacttttccagctcatccacaagaagtttgttgtggtagcgtgagaactcgttcatccaacggatacagcctgtgtctgactcatagtcccccgtgtcatcactctggtacatcgtgaggtacaccggcaagcacccgattgggaggttgccgggaactaatagagttttggctcccaatccaatcagatcggtgattatagatgaaattttggaaataacactcggagcgaacgag

SEQ ID NO: 29699 - DNA, 715 bp, Triticum aestivum
  unsure (1)..(715): unsure at all n locations
  Clone ID: PAT_TA_29699
ttttgctggaagcccatgctgtgaattcatcatttcatctgcaagatttctcaaactttctacacagcttatttgcacgcttgcactccacagacggagaatccgcgagagatcacccggaggagcgaggaggggcggtcggggttaaagaatcacaggtaaaataatctgaataaataatactattgcccgggggtcgatttccatttccagaggacaattcatgaccccccacgggaaaaaaggacaaaattgagagaaagaaaaaaaaactcagtgtaagcagcaaccttcctccttttcctttttgttttcgccacatttacttacataaactccatttccaacactgttcttctccgcggaagattttgctcctgttcagtcccatccccctcctccctaccttcttctatggtgggttttcggggtggcggttttggttttggttttcggagtgttggggctactaggcacatcatactgccacaccatgatctgggagcagtcggaggggatccccttcagctttgtcctgtccttcagcaccacctcttgcacaaacttgatcgagtcctgtggaagtgtccggtaatgacgtcggtcgtccccaccgctcagggtccacaaaatagaactgttgaacgcnaatcctgatacatcgattgttgtggcttcgcgtgccaacagcaccggcaggattcaagtcaacctc

SEQ ID NO: 29700 - DNA, 1334 bp, Triticum aestivum
  Clone ID: PAT_TA_29700
tttttgactgcgctcgagccccccacggtaaatggtctccgtgagcgataagatgtctcagacttgctacacagcttatgtgcacgcttcatctccacaaacggagaatcggacaaagatgacccggaggagcgaggaggggcggtcgggcttagagaatcacaggtccaacaacctgaataaataatactattgcccgggggtcgatttccatttccagaggacaactcatgtcccccctaggcaaaaaaggtcttaatcgagtgaaagaacatcaacacccagcctacgctgctcccttccgccttttcctttttgctttcgccgcattggctttcggagtctccgggcccctgggcacgtcattctgccgcaccatgatctgggattaggtggaggggatctccttcctacttgtcccgtcctccagcaccacctcttgcagaaacttgttcgagtcctgtgaagtgtgcggtaacgaggccggtcgtacccccccctcaggatcccagaacatgcaacgggtaaacgcaaaccctgatacctcgatcccgtgggcccgcgtgccagcagcaccggacaggattcaagtcaacctcagttgttatatgtcactgaacgggtggtaccatcattgaagttcctcgagaaccagccgactaccttcgaggcgctgcacagtgggccctcaaccactactttcttctcgcccgcggacatcgttgccaccggccatgtgccaaacgcctcgatctggcggatctcctcgaagaagtgggtgtcgtagacgccggcggcgtcggcgaagtggacgacgccggagaggcggtgcttctcgacgtgggcgagcgcggcgttgcgctgcgcgtgggcctcggcggcggcggtggtgaagttctcctcggggcggaaggccaggtgccggtacatgaccccggtgccccggagcacctcggccgtggcgggcgcgtcggccgccggctccaccaccacccagacgaccggcgggcgcaccagccgcagcgtgtgggcgagccgcagcagctccggccgcctgcgcctccgctcccctgccccggaccgcgtcgtggtgaccacaatcagcatccggcgcgggccgctctcctcgtcgtcctccaggtccaccaccgcgccgcccccgccggccgccgccgcgccctccggcgagggcggcgccaggctgatgtgctggtccctattacccgcgacgcgggacgcggcgagctgctccgccgcgagaatcggcggcggcgtgccgcccccgccgccaggcctccaggaggaggaggaggagggcgcgaagccggtgaaga

SEQ ID NO: 29701 - DNA, 716 bp, Triticum aestivum
  Clone ID: PAT_TA_29701
acggtgctaatgcttaataatgaaagaaaagatacaccagtcattaaacaagtacttgcacatttacatcgaatggaacttgattactttctttctaaaatgtgataaacacaaatttaatctaggctttcttcttctgagctgaagatgcaaccgatgttgcagcagctaacggcgctgaccatgagcagagaccacgcaaaactgcaattacagcaaccacgatgaacggaacatacagctgaagcagcctcagcgttgcttttcctgagcccaacatgtcgccgagtatggcggacaagtaggtgagcatgtagacccccgccatgagcgaggtggtggccgaccagcggcggcgcgcgaggatgccgtagaggttggcgacgcagacgggccacagcaaggccaggtcgagccagacgaggccgaggaagaaaggcggcgggtaggcgacgaggtagtgcccgaacgcgacggcgaaccaccggtggatgtccacgagcggcgccgggtagaggtcgcgcgggagcacgacctgagagtcgaacagcggggccgccaccgccatgatcagcgagaagagcgccaccacgacgtccgccgtcgccgagacggcgcccattggtttgttgtggtgcggccggagggagcggagcggagctgtggaggaccgcgctctgttcctgtttttctacagaggagctgctctgtatctt

SEQ ID NO: 29702 - DNA, 1122 bp, Triticum aestivum
  Clone ID: PAT_TA_29702
aagcagacatgaaaaacagtatgcaacataaattttctgcagcagggaggccaatatccaggcctcacacttgccagatccatcacaaattccttatgttacagcaagtgggatgagaggacatatatatgcacacgatattattactgactgactgactgacaagatcttttccaaccatcactggcaccacctgtaaggccgccatttacaaaccaggtgaagggtagtagggcaatgaagaaaattaacgaagccatggagatcaatcaaagacctcttattattgctagctgtccagtatctcaaactccgaatcctgaatgagatcccatgattccttcttcgacagcgacacgggcggggtgggctgcggagggcggcggctgtagtcgggggaggaggcggcgggcttccttcttaccgaatcgcttctcacggaggagctggcgtacgggaggcttctccggtccggcagcagcgagtccatgtatttgtccatgacgagcacattggagttgtcgacgtcgctcatctcctcggcctcgctgctgaagtaccttttatgaccttctctaaaggattctacgtctgaaggtatttcggaccactgatccatgctctgctccgactttgactttgcaaacacccactggtccatgctttgctcggatcgtgtcttggtcaaagcatggctccctgaagattggtaaccctcttgagtgcctttctcgctttctatctcacagacatgaggtggagactctatctcatttacacgatgcacagaaacttgcacattctgggtatcttcctctgaagtatgttcactcaggcttgactcaagtaatttgaagtatatcttccagaatgcatcttcatccatgtaagaagggcagagcgtagcccgcagagatgctaaatcagggacaagcttttcaatgacttccatatgatctctctctacatcagagattgtagcattctcgtctatcgcgagcatggggaagtcaatccaggcctcgggcctggcggcgagggcgcgggccgccccgaggatgccatcggcgacgcctgcagcggaggcggcgtggggcggggagtcgaccgggctggggagcg

SEQ ID NO: 29703 - DNA, 658 bp, Triticum aestivum
  Clone ID: PAT_TA_29703
cgagttttttttttagtcaacaacaagggcagaattttgttgagtttctgagaagataacgcacagaaatagtgtcaaaattaacatagcaaataactaccgcgtaattcctggttacaacagctcaacacttctcaaaacaatctcctcttccaggatgatatgaaggtaagactaatacttgtgcgaggggaggtggacaaaattgatggggtttacagcaagaagtagacttatcaaaacaatctcctcttccagtatgatgaagctaagactagtactttgcgaggggaggtggacaaaattgttgatgggtttacagcgagaagtaggcactgtaacgatacagaaagagtccactagttaagaaggataatgtcctcctcgaggatcttgggcagcttaaagaagcgacctcgctgagctttgatttgcttttgtataagcttcgcctcatgtagatacatctcaagcttgtcgtccaggaagatggcttcttcagacctttgccttcgcagaatcagcatcttgataagtcttctgcgtatctgagctgtcttgttgtagattgtcactagtcccttgttctttagataaacatcaggtgcctcatcctccagaaaatctggcatctcataatcatctaactcctaaagaa

SEQ ID NO: 29704 - DNA, 632 bp, Triticum aestivum
  Clone ID: PAT_TA_29704
aaacgtaattttttgtggatagtataatatgcacaatgtatatatccatatatatatgtaggaaaatgcaagtatgttcatataagctaagaacatgggactgatgacaacatgacgaaacaaaagatattgtacaccagtgcagataatttgtctattgatcattgcttccagcaccgtcctcgtcctctccaccgtcaagaatggagcccatgtgacttctctgagtggtcatgggctagttcaacatagggccactgcttcctccgcaacatagggacctttgcatgatgccagtgtgccaaatgttccaagcttggtgtctttggacagattcttaatgcaggaatcaatctcttcctgtctcttctcagtacaaaccatagccagatctgggctctcacaggcaaagaagacacgacatccacgaaagaaagaaggtggaaacagaaagggcacctcgccgctgcaaggaacgtcttgggatgcgtcttacactgcattctcgtctccaccttgacagcgagcaaagggcccagatcaagacaaagcagacgggagggagatgtcgtgacgccttggtgccgggatatcatcgcggcggcgagcagacctagggcagaggtcgcgac

SEQ ID NO: 29705 - DNA, 388 bp, Triticum aestivum
  Clone ID: PAT_TA_29705
atgaacgcccgggcgggctactacagggcctactgcaggcagttcggcgtcgacccggggagcagcctcacttgctaggtgctttgcgcctgatcgagatgggcatgcagagaacatgcatgacttatgtagaataaacgttcggcatgcgtatacgcgtcttaagccgtccaaacaagaaataaagggtgaggatgtggtctagcacgtaccaagatccttgcagtagtactgctcacgagctctactccttttcctcatcaacaagcaaaaagtgttactcctatgttcttgtttattactcatgtctaggtacatctgtatctaaaaaaatctaatacgagtaattcatgacggaggtaacattattgagacaacgggaggaaaa

SEQ ID NO: 29706 - DNA, 970 bp, Triticum aestivum
  Clone ID: PAT_TA_29706
gccggccgggctgggacagtcacctcgtaagcaagcagctacgagggcctcaacaagcaaaccttgattgttgattcgacatggcgaagtcgcccatggcgatcctggctctcgggctagcagcagtagtcctatctggcgccggactggcgagcggcgatcccgtggagagcgtcgtcaccgacgcgttcttcgacgggatcaagtcccaggccgccgacggcgggtgccccggcaagagcttttacacgcgccagtttttcctggacggcgcccaggcgaaccccgacttcgggaaaggcggcaccagcgacgacggcaagagggagatagccgccttcttcgcccacttcacccacgagactggatacatgtgctacatcgaggagaaggacggggcgagccagaactactgcgacacgaattacccgctgtggccgtgtacctcggggaaggcgtactacgggcgcgggccgctgcagctgacgtggaactacaactacggggcggcggggcagaagctcggcttcaacgggctcgacaacccggagaaggtggcgcaggacccggcgttgacgttccaggcggcgttctggttctggatgaccaacgtgcatcaggtcgtgccgcaggggttcggcgagacgagcaggaaaatcaacagtggcgagtgcaacggcgggaacgcgccggcgatgaacgcgcgggcgaactactacgtggagtactgcaagcagttcggggtcgacccggggaacaacctcacttgctagattcttgatcgacgcgcgaaaacattatttcagacgatgctcgtacttacagctctacctccctgtgtattctgggatcatctctatattctgtatatgtaatttggatttctgtattcatatatcggtaatataaacataataaataaacatttcttgacagcatacaaaaaaaaaaaaaaaaaaaaaaaaaaaaa

SEQ ID NO: 29707 - DNA, 1046 bp, Triticum aestivum
  Clone ID: PAT_TA_29707
gccggccgggccgggacctcagctcgtaaacaaagcagcttgctagagcggaacaagtttggccaccgttaaccttatttcgaaatggcgaggtcgcccatggcgatgctcccgttcctggcgctcggggtagcagcactagtcctgtctgccgcgggaatggtggccgcgcagaagtgcggctgccgggcgaacgagtgctgcagccagtacggctactgcggcactaccgacgcctactgtggacaagggtgtcagtctggcccgtgctcggggagcggcggcggcggcgggagcggcgtctccgtggagagcgtcgtcaccgaggcgttcttcaacgggatcaagtcccgggccggcaacgggtgcgccggcaagagcttttacacgcgccggtcgttcctggccggcgcccgggccaaccccaacttcgggaaaggcagcacgagcgacgacggcaagagggagatagccgccttcttcgcccacgtcacccacgagaccggacacatgtgctacatcgaggagatcggcggggcgaggcagaactactgcgacaggaagtacacgcagtggccgtgcgcctcggggaaggggtactacgggcgcgggccgctgcagctgacgtggaactacaactacggggcggcggggaagagcgtggggttcgacgggctcaaaaacccggagaaggtggcgcaggacccggaggtggcgttcaaggcggcgctctggttctggatgaacaacgtgaagcaggtcctgccgcaggggttcggcgcgacgaccaggaaaatcaacagtggcgagtgcaacggcgggaacgcgccggcgatgaacgcgcgggcgaactactacgtggagtactgcaagcagttcggggtcgacccggggaacaacctcacttgctagattcttgatcgacgcgcaaaaacattttttcagacgatgctcctacttacagctctgcctccctgtgtattctgggatcatctatatattctgtatatgtaatttggatttctgtattcatatatcggtaatat

SEQ ID NO: 29708 - DNA, 1227 bp, Triticum aestivum
  Clone ID: PAT_TA_29708
cgcgcgaggccacccggcccggtggcgagcgtcacctcgtaagcaagcagctactacggcctcaacaatcaaaccttgattcgacatggcgaagtcccccatggcgatcttggctctcgggctagcagcactagtcctatccggcgccgggctggtggccgcgcagaactgcggctgccagccgaacgagtgctgcagcaagtacggttattgcgggaccgatgacagctactgcggacaagattgtcggtcgggcccgtgcacggcgagcggcggcgggagcggcgatcccgtggagagcgtcgtcaccgatgcgttcttcgacgggatcaagtcccaggccgccgacgggggtgccccggcaagagcttttacacgcgccagtttttcctggacggcgcccaggcgaaccccgacttcgggaaaggcagcaccagcgacgacggcaagagggagatagccgccttcttcgcccacttcacccacgagaccggacacatgtgctccatcgaggagaacggaggggcgagcaaggattactgcgacgagacgaacacgcaatggcccgtgtaccccggggaaggcgtactacgggcgcgggccgctgcagctgtcgtggaactacaactacggggcggccgggggagagcaccgggtttcgacgggctcaacagcccgggagacggtggcgcaggacccggcgctaacgttcaaggcggcgttctggttctggatgaccaacgtgcaccaggccgtgccgcgggggttcggcgcgacgaccagggcaatcaacggcgacgtggagtgcgacggcaagaagcgcagacttggtgagcgcgcgggcgggctactacacggactactgccagcagttcaacgtcgacccagggaacaacctcacttgctaggtgcttgggtctgaattgatcgacgcgcaaaagcctttctagcgatgctcctactgctctacctccctatgtattctgggatatctatatataatgtatatgtaataaatttgcatttctgtattcatatataggtaatgtaaacatactaaataaacaattctaggcaacatcccaaagattcctacactacaacaaaaaaaaagaattactcttttgtttaataaacaagcaaaaagtgttttgtttctacaaaaatcttctacgacgagttctgcacggcggtggtaacattattgagaaaaaaaaaaaaaaaaaa

SEQ ID NO: 29709 - DNA, 732 bp, Triticum aestivum
  Clone ID: PAT_TA_29709
acagtgattcaaatctccagtgcaacaaggcgaagccacagcagcatatttggaaattcaaagagatttctgaatttcttccatgaacatgaacaacacaaggtacatcaacagctagacagaacacaccttcactctgctattcagatgaacactacacagcacacagcctaaacgatacagatcgcatctctcttaagccttcttcggggtggcggccttcttgggcgacttggcggccttcttgggggacttgggcgccttgccctccttctccgccgtcttcttggggagaagcaccgggttgatattggggatcacgccgccgtgcgcgatggtgacgccggccagcagcttgccgagctcctcgtcgttcctgacggcgagcagcaggtggcgggggatgatgcggctcttcttgttgtccttcgcggcgttcccggcgagctccagcagctcggcggcgaggtactcgaggacggcggcgaggtagacgggggcaccggtgccgacgcgctgggcgtagcggcccttcttgaggtagcgcccgatgcggccgacagggaactggagcccggccttcacggaccgcgtcaccgacttcttcctggggccgccggccttgcgcccggccgcacccttcttccccttggcgccggtggccgtggcgtccatggcgtgcgagagaggacggtaggtcgggattgcctcgggccgagccagtctgccgga

SEQ ID NO: 29710 - DNA, 723 bp, Triticum aestivum
  Clone ID: PAT_TA_29710
atagaatagaggggttccttattcattaagcaaccgaacgatgccaaaagggatgacatgatagtacacatgaccgaagtggaattgcaacaaagcaaacccaaggcagcagtaggcactaatggaaacatggagctcttatttctttcttccttacttatatcttacagcgacgcctttccaaaccgccgacgatattttcccaatcatcgtttgttcatcaccttacacagctagaagaactactgagcgggcagcaccatagttcgtccattgcctccttccacccaccctcccccctaataacccctatatgtcaccacgcacgcacgcacgcacttatgtacgcctgacgctcttccgttgatgctaccgccaccgcctcctacctctagctaacttctacctagcgctaaccatcgatgatgagtataagacatagtaaaactggtatttggccgtgatcccgggggacgggcgggcaaggcgtcgcacggcctacgcatctccgggcgtccgatccggcaggccacggcccgcgcccgccacggcgagccggggggagcgcgcggggggggctctggctttgggctcgtccgcgccgcgctgccccggccggcaaccgcgtcctccggcgcaccggagcgtccggcgcaggccgcgtgggcgctgcggtcctcggcgcgcttctggctcgcctgcatcgcgttgccctcgtgccga

SEQ ID NO: 29711 - DNA, 1068 bp, Triticum aestivum
  unsure (1)..(1068): unsure at all n locations
  Clone ID: PAT_TA_29711
gacggaaacccattaatggcagttgccatcttngattttggtgacaaagnttctcgagcgcccgccccggctggtgcgccaacgggccccttccattgtccgacgctccactccgcttcaaccaatttatcgcgttgttgcttcaccaactctttgtattagtagagatttcaatagtagaggcaagatgcaaccgtcaagtcttgagctgtccggcatggacccactgtgtctgtccgagtagagcaaaactagcggaaacgtgaaccaggggatttcaaaatcgagcttcaccaaacattccgccgcggacaccaaacaagtaaagagggagaaaaggagtggctctggtttacgtcctcttcctcctctacaattacattgtcacttgagagagaaaccacagcgatgggatgcgtgtcccctacaaaattgcagtctaactattccagcagagatctcgactcggactccgttgccttctcactgagcgatctctccaaagctttgtcagccatcttctgccagtcggtgaaaaacgtgatggcggagagaagcgtggtctgcgagatggatccacagacgacgccaatccaaagccccttttcccccatcttgagcacaaaaccgaggagcatcgccatggggattccgagcaagtagaaggagccgaggttgacgtacgcgcccacgtgctgccatccgcatcctcgagcgacgcctgagagaaccccttgcaagccatcggtgaccacggtgatgcagacgaggggaaccatggcggcgacggcggatgcgacctcctcctcgctgctgtaagcgcggcccaggaggcgccgtgacagcaagagggttccactgacgatcaccgcctctgtcaccgcgaccgacatgacgacacggaccgccgatcgagctccttcggggttcccagcacccaattcgtttgctactcgcgtgcttccagcagctccaagtccataaggtatagtaaagagcaatgtgatgctcgtgaggcatattgagagcaccgaggtttgaagctccgggttgggcagaagccccgac

SEQ ID NO: 29712 - DNA, 1148 bp, Triticum aestivum
  Clone ID: PAT_TA_29712
ggctgttctttttttttttgttaacatgacaatttttggtcactcaagattcaaataatgaaacatctaaatgaataattgaatcaacaacatcaaaggcacatacatgcataccaactactctgaaacaatccatgcaaaatgtgctttacacaaggttcatatatcatatccactgttggggtctatatatcctggttgccacataacatggatgactgctttctggccattattcatggttccctaggatccggtccatggcactttgacccttttgtaagagagggtgcctcgaaccgggagcaaaggctgtcgaactccatagcaaaacttgaaatggcgaccagggaaaattgaaggagaatgcccaaatggctcccaacaaagtttcagcgcctcaagccatcgtcaaagaagcatcattggcgacagaatcacacacacacacacacacacacacacgcacgacagtttgaaccaacacggccgatagaagctagcaatttatacagtcttccctcaacgggaaccgaaagtgcctgcctaaggagaagattcacgccatggaaatccttcattgcttttcagaaccgggtaagcagccagaaggcattgtccccatacccccacagcctgggggcattgtgaatccagatttggcaccccccatgcattggatgtttgcaatatccccagtgccttgcccaaatacctgaccactcatagcaccatcatcacccattgctctcatctgcattcctggattgcaatacatctgatcgttgcatctgaaatcacacgagttcataacctgggcactgccaagaaagcccccctgatcaacgccagaaaccaaatcgacgttcttcacaggccgcttggtaagggaaagcgccaatctccccgtcgatcctccccctgacatcgacgagcaggcagcggagcctggcggcctcggcctcgagcgccgcgtgattctggagcttcttcagcagctgcttgttcagagccttcagctgaaccacctcttcctccagcagcgccgtgtgggccttcttcttctcccggacttcctcacggccgcgcggttgccggacggccgccgcttcttggaggcgccgctgttctcggccggggagtcggcg

SEQ ID NO: 29713 - DNA, 728 bp, Triticum aestivum
  Clone ID: PAT_TA_29713
atcttcctagatgatgataggcgcttcagcatcaagctggactagaacttcaaagtggatacagtaagtcacaacgacaagtcttttttcgtaattaagcatgacatctgcttcatttgcttcaacttatattttttactattctactagcgtatcccctgccatgcaagagtttttgtattggataagataggtttcagtcatagtatggaggaaaagaaagtttacttgaagaccgagcatggttatattttccatgcgaagttatacaattcagacgactacacctattttggatgcaaaacatggggagcgccggggtcaacttttttaattattatttgaatgcaaaacttatgcttcatttgcttcaacttataattttaaattttcactattctactagcgcatcccctactatgcaagaatttttgtcttggataagataggttctagtgctatagatgatatggaggtaaagagagtttacttgaagacggagcatgggtatactttcaacgtcaaattatataatggagacacatacacccattttgaatgcaaaacttggcaagcactatgcaaggcttatgcatttgagcctgatatggttatcacctttgatattcgtccggaagatgatattgaaggtaatatagacatctgggtcgatgtgcaaacgcctccagttctaccatttggtgactttttctcaaccatgcatgcat

SEQ ID NO: 29714 - DNA, 923 bp, Triticum aestivum
  unsure (1)..(923): unsure at all n locations
  Clone ID: PAT_TA_29714
ggacgagaacttcaaagtggatacaataagtcacaatgacaagtcttttttcgtaattaagcatggcatttgcttcatttgcttcaacttataatttaagcatgacattaagcatgacaagtctttttttactattctactagcgtatcccctgccatgcaagagtttttgtattggataagataggtttcagtcgtactatggaggaaaagaaattttacttgaagaccgagcatggttatattttcaatgtaaaattatacaattcagacgactacacctattttggatgcaaaacatggcgagcactatgcaagacttatgcatttgagcctgatatggttatcacctttgatattcgtctggaagatgatattgaaggtaataccgacatctggctccttgcgcagccgccgccaggcatgccattatcttatttcggtgcaagcaaacatgtccaagtgcttgataaacaggaccgtatactgtcccggggctgaactcaactgcgaagagctcagtcattatgtttcaagggcttgaggatcttgatactgtcaagacaaattcctcctgcatttanaaatgttaagtactgaaaatgtgcgaccaatagtgttcgtaatgaactacgtcacatctattnagaaagatgggaccccgatgaatgttgtgcctaagggatcagacaaagnacatgagtattacagcntacggcaagataccacagattacttagtgaatcagattacgacaatgctatatgcagactggncaattntatggggaccaanatncagggnaaaacaatccnccctatnggnaangtaacggcagccaactnttagggnacanctttttgtntttcaaaacccggttncncaaagatttgggggntcncatccangaaancnggnggagca

SEQ ID NO: 29715 - DNA, 1083 bp, Triticum aestivum
  Clone ID: PAT_TA_29715
tgtcaagaaattctttccctaggcgttcctcaatgcctttctccaaataaaatcggccggataggttaacaaccatacggacatcgtcatatagggaagcataaagaacaatagttccacatattttacagcatacttttacaactatttagtaaataaaataacgcaaacctaaagccttgcaatgctttattgcttattacatcctgggactaagaagtagaatgaccatgatctagaattgcgttgttcggaggggagcttctgtaaagcagaactgttgtacaaaatcctacagcagaaatccatcagaattcattgatcttctagcgtggtatccctggccttgttggatgtaatgaaacccactacagcatcagaaagttctttacgatgtctagtgtagcagtgatctgctccctcgacgacacacagtttgtgggtcggtatatgctttgcaaactcatatgcatcttccacaggaatgatctcatcagcagaaccatgaactgtgaagaagctgcattccttgctaatggagaggcttgttgcacgcatgtcagtgttcagtcgttccatcaagctctcttttgttaccctgtataaaacatttcctttgctgtgaccaacaacagctgctacatcatacttctcctgatacagatatgagacaacagaatgcaagtcttcagcctctttcctgtagttgccatactggaaaacgccttcgctctctccgtttccactgaagtcaaagcgaaaaacactaatcccttgttttattattgcatctgctagatcaacaataacgccagaactcttggaggccgtaaagccatggcacaagactataatcctgttcaaacccgtgggatgcagcagccccacaagtttctctccatgcttgttcgttatcaataccctgtgtgtagcagggggattggaagcatcccgggaggaattgagcggctgcgacatggacgacagatggcggcggcaacctcgtggggtttggggtgggaggaacccgaggctagtcgacccgccggcggtgtcaggagtaggatgaaggttagattcgcc

SEQ ID NO: 29716 - DNA, 968 bp, Triticum aestivum
  Clone ID: PAT_TA_29716
tctgtttttttttgcttgtaggaccatgggtccaacaggtaaagatatggcaacaccagttgtgtattgaaaggaaattgctctaaaacaagtggtgatatatagtaccaccagatcatacaataacattacacgatggcaacaaaacagaatagtactaattaggacaactgccgacagcttgaaaacgatatgtagctggtacaagtaaaacttaatttgggacaatagtattagctattgccactgattatttctcctcactgcaacactcatacttccatgacaacaattcaaggcacacacttgagtatgttagccaggaaggaaggagtgtagcaagcaccgctctggcagccggtaccacaataatccttgccaagcccacaagacccatactggctgcaacaatagttgttggtgcatcgtgcaccattagccttattgccacacggcttgtccgtgctgcaggcgccgttttggcagctagcaccgcagaactccggtcctaagccacaataaccatattggctgcagcaaaggttattggggcattgcttaccattggccaggtggccacacttgaggtcagcccagcaaggaccgctctggcagccgcggctgccactgcagtattcactgccatagccacaacgaccgcccgagctacaacaatggttgttagggcacaatgcaccaccggcctgcgcaccgcagatcttgttgtcgtagcaggcgccgctctggcagccggcggcagcgctgcagtagtcgacgcccaggccgcagtacccatccttgctgcaacagaggttgttggggcactccatgccgtcggcctgcttgccgcagcgcttctcacagtactgcagctgggcgtgggtggtcaccatcgcaaaggcaagtgcaagtgcgcacaaaaagaggcccttcatctctaggtttcttcctggatgtgtgctttactg

SEQ ID NO: 29717 - DNA, 381 bp, Triticum aestivum
  unsure (1)..(381): unsure at all n locations
  Clone ID: PAT_TA_29717
cgaaatgataagcttatacattggtaaagtgatagagaaatgtgaattagacccaggggcaccaaccagcccaagccatgccgagaatgtgaggattggtggcctgttcgatgagacgttctgcttgatgtttgatggaggtgcactgttttggttggccaggtttgggtgaaacgatcttgatgagggtatcgcagtaatcttcagcgtggtggatggataccttgaggagttgagcggtgatgaagccagggtcgaagagagaaagtttgtgctgaacggttttgaggcggtctctggtgtaagcatcaatgctagggcggccagggagtttgtcggncgcgtggttttacccgggttttttggaccggtctttttggg

SEQ ID NO: 29718 - DNA, 674 bp, Triticum aestivum
  Clone ID: PAT_TA_29718
ggacgaagcactatatatagatgatatctttagtaccggtttgtgtcacaaaccggtattaaagggcaacctctagtcccggtttgtgtcacgaaccgggactaaagaggcacgcagggccccagcctgaccaaaagcccggcacgccatgtttagtcctcgtttgtgtaacgagtcgggactaaaagtgccgttcgaataggtactagaggttgccctgctccaagccgttggagccggcacgaaccgggactaatagcctcattacattacaaccggcttgtaaccggaccgggactattgggtaaaacgaaaggtttgttttctactagtgcgacacaggcaaatacaccaccagctagcagtgcctagctattcagtaagacaatgtgaccttcacatccacctgaccattcgtgcagtcaaagtgcaacagaggtttttcccagtcgaagttgtcggggttccactccaccgagtatttcacagtctcctccgtggaagggatatgcagatccaccttgatctctagggacgaatacaatggcacggcaagaaccgatctagccagtgggatgatcatcggttcctgtggcgacccaatgattggcttcttaattgtggatttgaatagcacgacctctcctacgctggtgcaagcaatgatcttttct

SEQ ID NO: 29719 - DNA, 750 bp, Triticum aestivum
  Clone ID: PAT_TA_29719
gcaaagcagaagtgattgtggtgatattaaccaagctgtttgcagaataaaatatcactgctagttaagcagggcatttgccacacatggctgctcctccggttattccagttattgctcttacttgatcggtccccccaccccttggtcacttcagagctgccacttctgatcgttcttgtgcagaagaccgtcctcggcgccgtcctcgaagacccgaagcgtcgcgagacggatgaaatcggtgacctggactcccacaggccacgggaagcaggccttctccggcagccgcattccgagcctcgggccctcatcgtagccctcgcagacgagctcccccttgtcgtccctgtagcacacgatccctctcacctggtcctcgaacaccttgttgctggttggtgcagcaaaggagaggtgcgaggatggctggttgcatccatgggctgcagaggttctgaagctcaaggctgccgccgggctcctcgcgccgaatctcgggccggtggtggccacggaggaagaagggtgaggatggcagtagcctctgaacgccattttctggttggtttctggaaaggaggatggggttcagcagagtagagggccttgtgttgcctatatgctaaaattctgaatgattttcttgggaggaggaagggagggcggtaccagttacagaggctccctctccggaatcgaaccctaattctccgtcacccgtcaccaccatggtaggcccctatc

SEQ ID NO: 29720 - DNA, 1540 bp, Triticum aestivum
  unsure (1)..(1540): unsure at all n locations
  Clone ID: PAT_TA_29720
cccgtagacgcagcgtcctttctcccgtccctaccgcccgctcgtgccattaccctccgagtccgcctgccggcgacagccgctgcttgcggtgagaactcttgcccccgggtcctcttgtcgttcgggtcgtccgtcgcccggtccagacacaccggcgcagcggcgcccacgccccctcgaaggtgatgccgcacgcccacaccggcagcagtcggagcacgcacttgagctcctccacctgcgtcacggtgcacagccgccacgggctcgccggccgcgccttgtcgcccgccgtctccaccgccgccttgtccaagaacctgaactcgtcagtgtgcgcgaggcggcggctcccctgaatcactgacatgccgtcgtccccgtcacactcgtgcagcagcgtggcgtcggtcgggatctccacgtcgcacttcctggcggcggcgaccaccacctgcgcgatcctggtgagcgggctgccgccggggggctggtggcggcggtacgcgcccgtgccggcgaggaacagagcgacggcgagcacgctgagcagcgccgggatgccgtagccgagccgccagccgtgggcggactgcacccacaccaggacggtgccgcccacgagcgagcccacgacaatggacaggtagaaccagttgaagaaggagctctgccgccggcgctcctcctcgtcggactcggcgtcgaactggtcggccccgaacgacgacaggaccggctgcagcgcgccgcccagcgccaccaggtacagccccgcgtagaacaccgcgctcgccgccacgacgccgtaccccgcgacggagatgaagaggaagagggtgatggtccagtacctgccgaggaaagagtcggcgaggaagccggccgcgagcggcgtgatggaggcggtgccctgccagttggtgacgctgttcgccgcggccttgctgccggagtgcagctggaccttgaggaagttcaccaggttcgtcgacacgccgtagtaagcgctgtactggaggcagttgttcacgaggatgaaaacgtagccccacgaactccggcgatccctcgtggacgtccggcgatcggggtcaccctgcaggccttttgattcgaaacggaaccagctgaagcaaaagagaggaggaacattagcctgaatgagggtcgaacctgtacacgctcccaggcgtgagacctcttcttctgtccttctttggtctccgccgccgcatggtacagtggttgcgttctctgacgccgctgtttgtgaggggctgggcatgtccagtttggagtggtggaagcgccgtcggccagagattcagctgttgcaagacatcttttgagaaggacggcatgaaaggctctagcaaacaagcgagaaggtagacaactccaactgaagttttcatcacagtcgcgcaactnnctggatcttgttggtaaagcttccaaaattgactctcttgannntaagcatttccctcactnnngatgnnnattgcaattttcagccctnnnnntagtttga

SEQ ID NO: 29721 - DNA, 1197 bp, Triticum aestivum
  Clone ID: PAT_TA_29721
cggaggatacggttatcactaagagtgagcaaaagtgttgagtacatgaagagcgctcgtacatgaattactgattggccaaaatataaaataaataaagtaaacgtggtctgttccaaaggaattactgatcgaccacctttgggttcacgcatcttcaacggagacgagcgcctgcaccaccgcgctcatgctcggccgccggttcctctcctcctccaagcacgacaaggcaacaccaaccaccaccttcacctgtgcgcggttaaagtcgccggcgagccggccatccacaagatcatccacgctgccggaatgcatcttctcgcccacggccttggccacggccctgacgtccgtattctggtcgccgtccgccaccctgacccctttcaccagctccagcagcacgacgccgaagctgtacacgtcgaccttgtcgctgatggccaggctcgacacccattccggcgccatgtaccccctcgtccccctgatccgccccgacgggttcgcctcccgccctgcgcgagaggcggacccctcagggcggcggtccagcagcttggcgagcccgaagtcggtgatcttgggctccagatcacggtccagcagtatgttctccggcttcatgtcgcagtggatgatccactcgaggcactcgctgtgcagataggcgaggcccctggccacgccgacggcgatccggaaccgctggctccacgcgaggacgtcgtgatcatcgccgccgtcgccgtcgccgtcttcgtccgagaacaacatcgtggcgagcgagccgttctcgatgaactcggagacgaggatgcggtgcttgccttgggagcagcagccgatgatcctcaccaggttcatgtggtagatcctgccgatcacgctcagctccgcctggaactcctcctccccgtgggagcggctcacgctcgtcgtcagcgccttgacggccacgacccggccgtcctcgagaacgcccctgtacaccacgccagacccgccgcggccgatctcgtcggcgaagttccccgtggccttcttgatcgccgcgtagctgtacctctggaagcttgtggtgaggaggatgagtctgtagccttcgtccatggggtacaccggagaggaccgcgtgaacagtcccttcctggagaagagcaggcagccgagcccgatgacaagggcctc

SEQ ID NO: 29722 - DNA, 1183 bp, Triticum aestivum
  Clone ID: PAT_TA_29722
tacatttctgcttacaaatttcagtccattgccctaatttacaattctctgtcggctaaattcacattttgtcaatcaagtgtagtagtatcaattttacaacaacaacaacacagtaatacacacagttaaggcacctcaccagtacaagctgaccggcggcaccgtgaagccttgggcctcgtcaaggaacggcaccatctccggccgcgcctggaggtcgccgtagaaatcgtactccgcttggtagtcgtgcaggtccagttccttcttctggttggtgtgataatggtgcttggcccctgccggcttgccgaacccgaataggctcagttcctcgcacacccccagcgccatcaccaccgcctgcatacctgaggaatagtggaagtacctctcgtcgtgcttccgggtccagttgctcgccggagcacccgtgtcggacacgaatcgccggatcgagtagtacttggcaatgcgcgccgagagtgcgtccaggcgcgcgtcggtgacaaggagcgggaatggggaggcgtgggtggcggttgcgttgcagatgagggcgtccaggaggtgcgcgggctggcagatgtacatggccatgggcacggtggggccatacgggtggcacccgcagcctgcggcggtggcggcactgcgggacgcgcagaggtggaggatgttggagttgacgaaagagagcgaggttttggcgccgacgtcggcgacaaagccggccacgcgtgcgttgttgaggcggatgacgagctcgtgcgcgtcgatctgcggtccgcggccggagccgaggagcgcgccgctattcccgacgaccgcgcaggtcgggaagcgccgtccgaggacgccggcgagctcgctcatgacgctggccacattactggttccgccccggcggcggcggtggtgggcgaggaggaaggagtggagggacgtgcggaaggacgcgagcagggattcgtccgaggggagtgcctcggcggggatgcggaggcgggacacggtcctcggcctgggcgggccgcgggcggtgcgggcgaacgggaggcggaggtagaggaggcgctggcggttgccaaggctggggaacgtggatatcgagccattcacgagcagtgcagctgcgtcggcgaggacttgctcggatcccacaccttccaccgcggcg

SEQ ID NO: 29723 - DNA, 1004 bp, Triticum aestivum
  unsure (1)..(1004): unsure at all n locations
  Clone ID: PAT_TA_29723
gaaaggggagaaggaatagtaagatcattgccaaacaagcaactcaagctttttttttacccgaaagttcatttattcattacttagatgttactgtaccagcaacttcgtaaaccaaacacgtaacagtgactcgatagttcattaaaccaacataggactgatgcgaacaatgaaacagttcaaatgaaacggacacaacgaacgaccaagcataaaccagcaggtccaacgccagggcaattactgaccaccacggaggcggagcacaaggtggagggtggactccttctgaatgttgtagtccgcaagggtgcggccatcctccagctgcttgccggcgaagatcaggcgctgctggtccgggggaatgccctccttgtcctggatcttggccttgacattgtcaatggtgtcagacgactccacctcaagtgtgatggtcttgccggtgagggtcttcacgaagatctgcatgccaccacgcagacgcaggacaaggtggagggtggactccttctggatgttgtagtccgcgagggtgcggccatcctccagctgcttgcctgcgaagataaggcgctgctggtccgggggaatgccctccttgtcctggatcttggccttgacgttgtcgatggtgtcagaagactccacctcaagcgtgatggtcttgccggtgagggtcttgacgaagatctgcatgcctccccgaaggcggaggacaaggtgaagggtggactccttctggatgttgtagtcagcaagggtacggccatcctccagctgcttgccagcaaagataaggcgctgctggtccgggggaatgccctccttgtcctggatcttggccttgacattgtcaatggtgggacacgacttcaccttaggggggacaggtcttgccccggngaagggtctttacaaaaatctgcttgccaccacccaaacccaggaaaaggtggaagggnggacctccttttggatgttgnannnagcnangg

SEQ ID NO: 29724 - DNA, 448 bp, Triticum aestivum
  Clone ID: PAT_TA_29724
ggtttctttttttttttttttagattggaaccctgattccatttattcgagatcatcaatacattttctcgaatgcacacgagtgtgcgtatcatgagatcattgatacatgattcaaaagtattaaagaaagatcatgcatgctatgtgaacccacaaagccggtacgccacatgtacgggccatttctccaacgataagacaccaccctaaatttactggtcgtgtgcattgttattatgcagaggctgaggccatacccttttcgaaagaaaaaaatcaccctaaatacatgtttctaggataagacgctatagagaagtgttggaacaatatgtagccgattatccttggatccaacagtttctttttatgggtaactagatgtgacaataatgattgcaagtatcatgaatcttctctcagggtgtgggcttggtcgaccggc

SEQ ID NO: 29725 - DNA, 1157 bp, Triticum aestivum
  Clone ID: PAT_TA_29725
acgtgaaccaagcggactgtccatcggccacgccacgcaagaacacaaacacagccctcacacgcgagtcgccaagaagaaaagtcccaaactttttccccctgatcgatccgccctcctcctcctcgtcgccgcaggagtttctcccgggattcgccgccccctccttctctctccggcgaccgatcggatcccgccggccggaggcccgagccccgcccgatctacccacccgatggcggccaacgccggcgccggcgccggcggcagcaagatccgcaacgccaagctggttcttctgggcgacgtcggcaccggcaagtccagcctggtgctccgcttcgtcaagggccagttcgtcgagttccaggaatcgaccatcggcgcggccttcttctcgcagaccctggcggtcagcgacgagacggtcaagttcgaaatctgggacacggccggccaggagaggtaccacagcctggcgcccatgtactaccgcggcgccgcggctgccatcatcgtctacgacatcaccaacgcggcctcttttacacgtgcaaagaaatgggttcaagaacttcaagcacaaggaaatccaaacacagtaatggctcttgctgggaacaaggctgatatgttggaggcaaggcaggtgccagtggaagaagcgacgacttacgcacaagagaatgggctcttcttcattgaaacgtctgccaaaacagcaatcaatgtgaacgacgtgttctatgagctcgccaagagactgcttgcggggcagcagacgcagaacccgcaggcggggatggtgctctcgcagagaccggccgagaggatggtgagcagcacgtcgtgctgctcatcataggacgcttggccgtggagagacggccgccatggatggccgcggaagccacaggaggaagaaaaaaatgtatgcgctgtggacgattgctgccatcccagcttgctacactacagtctagcccttgtttcttgtcatatgttggttctgtaaatgtgaatagtagtggggtgttgctgctgcagatgttcagatgtgttgttgcagtgcattctggtgcttaaatatatttctggatgacctttgtgcttcaattatatattttatttctaacgttaaaaaacggacgcgtggg

SEQ ID NO: 29726 - DNA, 1229 bp, Triticum aestivum
  Clone ID: PAT_TA_29726
ggcaaccaagcagagtatccatcgcccacgccacgccacgcaacaacaccacaccacacacccgagacgcaagtcccaaactctttcccctctatccatccgtcctcccgctcttcgcctcaggactttctccccggactggactccctgccctcccctccagcccgcccgccctgggatcccgccagccggcgagccaagccgcgaccgatcggctcccgggcgtccgaggccgcaagtggcgcctgctcgatccgagatcggcgccaacaacgtcgcccgtgccggtgacggcaggatcggcaacgccagcctggttgttccggggggtgtaggccccggcacgtcgagcctcgatgctctggtccatcggtgcggcagtttgcccagttcccggagtcgaccctaggcggggccttcttctaggttcgaactggggggtcaacgatcaggacggtcaagttacgaaatatggggggagaccgccggccaaggaggagggtcaccacagcctggtcgtcccatgatagtaccgccggcgccgcggccctcttttacgcctgcgaaaaaaacaactccaacactttcaaacgcaaaaagaaatgggttcaagaacttcaagcacaagggaatccaaacacagtaatggctcttgctgggaacaaggctgatatattggcggcaaggcaggtgccagttgaagaagcgacgacttacgcacaagagaatgggctcttcttcattgaaacgtctgccaaaacagccatcaatgtgaatgccgtattcgatgaccgcggaaggagactgctggcggggcagcaggcccagaacgagaaggcggggatggtgctcgcacagcgactcgtcgtgaggatggtgagccgcttggcgtgctggtcacgacaggatgcgtggccctgaagagacagacgcaagaaaaaaaaatatatgcgctgggggggatgactaatatccgcgctttctacgatagcttccatcccatcttgcttcacttctgtctagtctttatttcttgtaatatgttggttttgtaaatgtgaatagtagaggggtgttgctgctgcagatgttcagatattttattgcattgcattgctggtgcttaaatataattaataaatgaccattgtgcttcaaatatatattttaatttctaaaaaaaaaaccacaacgcgtgggcgtcgcaataatccggcaaaaaaaaaaaa

SEQ ID NO: 29727 - DNA, 544 bp, Triticum aestivum
  Clone ID: PAT_TA_29727
ttaatggaacttttgataatggcaacattttgttctcagcacaccgcaagcttagtgtttgacctcaaggggttccataaccaaatttatccaaagaggatgacaacatgacctgcattctccatttcagtgttgtcaacataaggagacctatctgcctaatagtatttgactcaaacacaaacttcatatcgtagactctccttttaagaccaaacttcatatcgtagactctcaagattgctccatgtcatcatgagggcctcagagacttgatctgctttaatgtacccaccatccaagtgttccacctctcaggagcaattgtcctattgtaaaacaacagttagttgtttcatcttctcagatagtcccacgaatccacttgtcggaccgcccgcccaatccaaaagaaagaaaaatcatttcataattagtgaacagttacagtgggaaaaagacaaacaacaataggatcttaaaaaaactccatgcacaaatttttataactgcagatcctctcccattctccacattcgtttac

SEQ ID NO: 29728 - DNA, 586 bp, Triticum aestivum
  Clone ID: PAT_TA_29728
gggggtgcagctggaggagctgccatcagaggagcagaaccccggcgccggggggccccccgcccgccggggaattgggagatgctcttcccaccggaagctcaagcggggtacagctacggcggcattatagatactcggatgaacgcaagggaaaactggcaggcttttccgatccagtgaattagtgctggctgccaaacgtttgaaagagtagattattttttcaaaagagtctggctgccgggttgagcccctttacttttgccggagggttattatagtggtgtgggattcgatgcaacgataggttagagagactttatatgatacggttagttttcccatttgcatttgcaggactagttatgacctcccctgtgtttcttgggagatttcctttctttactgttgtagaagtgcaaaaatgtcttcgtatgtactagctacatataggtagtagtagctcgtacaatgggtttagtagaacacaccattgtcatgtgctgttacctgcactttgagatgatgtggtatttgaactacttatgacagtagacttggccttgggcaaaaaaaaaaaaaa

SEQ ID NO: 29729 - DNA, 965 bp, Triticum aestivum
  Clone ID: PAT_TA_29729
tagtaccgtcacagcacctgtcggccgatggatcgcaaccgctctatgattgcgtgttgcgtctcctcggagctcgcgacctcccttcgagcctcagtctttctttttccttttggctcgcccttcattttaacatttgcaatcacacatgccatccgcttatttccactggcagattccttgtttcctaccttataatcatcaatgagtctcctacctactaccgaacaatgtggaccatctttttttttacacaaccgggaattgtcccggtgatcactcagtgctgaagcctcttgtggttgttgttgtaggtgtaggagctggcgagccacacgaagagcacgagctcagcggccgagagcccggcgagcagccagtagaagtagtcgaggtgggcgcggttgaggttgtcagcgaaccaaccgtcgccgccgccgcttctggtgacacggtcgatgaaggagatgagggcgctgctgatgaagccgccgatgcccatgacgctgaagtagagcgccaggccgaggctgcgcagctcgcggggcatctggtcgtagaagaactcctgcaggcccaccaccgtcagcacgtccgccacgcccatcatcgcgtactgcggcaccagccacgcccagctcatcggcaccgtcgcgccggcgtcgtccaccagcccgtgctcccgcgccgtctccagccgccggccctccaccagcgctgccgcgatcaccgcgcccatcgacaccgccatgcccgcgcccacgcgctgcagaagcgtcagccccgacggcttgcccgtcgcgcgccccagtgccggcaccagcaggcggtcgtagatggggacgaacaacaggatgcttgctggccctagcgtctgaagcgccgccgggggtagctccaggccgccgaagacgcgccggtctagggtgcggccctgcttgttgaagagcgtcatgatctgcgct

SEQ ID NO: 29730 - DNA, 539 bp, Triticum aestivum
  Clone ID: PAT_TA_29730
acgtaactctgctggcacatgaaccgaaacgtatacacaaaacacatgtggcaggtcgtgttatcttcggcttcatcactggggtatcttcggtacacaccccggccggcatatcatacatttggaacgcagcgagctaactggaacggattggaacatatcatgctgacaaacttggattcgtagcatagcaagctctaacagcccatggcgaaacattaaggaggccgcccctccattgcctcgggccaatttgcttcggacgatctgtgttatagtgcacttctaaaacagaactagccatttgtctgagcctgtctgttcatgacatcatggtagtacaagagaacacacattggttgcccaactatgctgaagaagaaccaaaatatcatgttgcccaccattgtattcttgaacttatcttgaagatatttcgtcaagaatagcaggggaatttgaaacatgattccagaaaatgcccataatttgaaaatgtggcacggaacagcaatacatagctgcaagttgacaaagac

SEQ ID NO: 29731 - DNA, 1149 bp, Triticum aestivum
  Clone ID: PAT_TA_29731
tcgcggccgcgtcgactttttttttttttttttttttttttctacgacacacacaaccaaattcaatcaattggatgagtcaacctcggttgaccatgctgcagtaccacatttcgagcacggaggctctaggtagcgtttacaagcaccagctttcacaccatgctgacggtctacaagacgtagcatagcacctcccaacagccgctacactattcttaagggcaacgccggttcattgcctcgggccaatttgctgcggacgatctgtgtcgcacggctcttgctctttttatccaacagggcatcatgtacataatctgccggcacgtgaaccgaaaatatacacaaaacacatgtggcaggtcttgttatcttcggcttcatcactggggtatcttcggtacaaaccccggccggcatatcatacatttggaacacagcgagctaactgtaacggattgaaacatatcatgctgacaaccttggattcgtagcatagctagctctaacagcccattgcgaaacgttaaggaggccgccgctccattgcctcgggccaatttgcttcggatgatctgtgttatagtgcacttctaaaacagaactagccatttgtctgagcctgtctgttcatgacatcgtggtagtacaagagaacacacattggttgcccaactatgctgaagaagaaccaaaatatcatgttgcccaccattgtgttcttgaacttgtcttgaagatatttcgtcaagaatagcaggggaatctgggaacgacggacatgaacatcagtcaaatgatacaagtggatatgtagagataccgacaacagcagtctagaataactaaacagataccaatcacaaatttgcgtagtaacagctcatcagatttaaagcaacaatggggctgatcctacaccgacatatggacaccggccccctgcccagtgatggcccaagagcagtgctacctgtcatagtgtcgggcctgaacaacagccaaaatctgccttttgtaatgaatccaataggcataggcatgtatatgggctgttattgtcaaataagctgcagtgttgctatccctaagtcttgatacacagatttttttgcatgtgacaaattttatgtactaaaaagtcta

SEQ ID NO: 29732 - DNA, 917 bp, Triticum aestivum
  Clone ID: PAT_TA_29732
cctttttattatgtcaccaaaaattaacaccatttggagaagccaaacacagtaccactataataaaatttcatacattatcttgtggcatgaatgcctattagggggaaaacatccctcctccgcaagctatgttttgcagatgtttaagtgttaactggcggggtatcatctagctaagtgaaaaatccagcccatctagcagccaagaagaaacaagaatgtctccaaacaatgacaccgtttggagaaagcccaacacggtaccatttataacaaaattccatatatcatctgtggcgctgaatgcctattaggggggagaacacccctccccgcaaactggaatgcccagcgatcaaactgttaaccgacattgttcgtcgtttagaaccaagacgggagcaagtttagagcgctctataaacgtatcagacgttgaacccttcggctctcaagcataggcgatgggcttcgatccacttcccgcacgcatcctcgccatgctccacgatgcactcgtccctcagcctctttgtgtcggggcaggcgcagcatatcttcttcttcggcttcgtgtcaggcgctggagcttgcccggttttttcttctgcagttggggcgacggttgtcgcagatgcactgttccccatctcctcgacgaacggagctccgggattcggcgggagagggcggcgggagctggaggccccggatccaaaatcgctcttgccttctgaacgaccgacccagcccgccgcgcggcagagggttctggaggaacaagaccactttgctccgtgtgaaccgaaccagatttacttggccccgtccgatcgcgaccgtcggttttagatcgaacggtccgcaacgcttcgactggacgcgagtagagacttccgacccgcgccgcacgc

SEQ ID NO: 29733 - DNA, 1179 bp, Triticum aestivum
  unsure (1)..(1179): unsure at all n locations
  Clone ID: PAT_TA_29733
ctggaaaatatatatgaaataacaccaatttctcatctctgaatgaatggtttgaaaataagcatttattatttacattgatccctgcatgcaggttgggactttcaatttctgcaaactgggactaccagacatgaggaaatggtcacgtatacactgggcaaccctcaacaaatatacctttagcagtggggcaagaagccagggggcatccatccaagtcattgccccaccagttcaaactgatgttctccaagcctaggcacaggtaaattaacacggccatgaatgccaggccagcatctagtgcacctgaaagcagataattgtgccgctcccaccagtcacgtcggtacctatagaccacatagcctgacaaaaacccaacaaatatccatgtgatgtagttgaccgcagtggccggtggcatctggccagtggaaccaatcaacacgggcatgttgataagcaagatccagttctggcctgggaatgccttgtgtgcaaaccagacgaggagtggggcaatggctccccccaagaagaaccagttcaccgccgagtaagttcctaagtccccaaatattctgcgtgggctaataagaccccatatgactgatgcgtcatagaacacatgatcgccagggcaggtccaagggctgcctgctgggaggagctcggtgtcgcagatgttgggtattgagtccatcagccaccatgccgttccaaggtacacaaacgccgcaatcagagttcccaccacctgagccatgaacatggtccttgggggaatcttcatgtagtgccccaatttgaaatcttgcagaaatgtcagagcttggctcatgctgatgtagccatataccttgaagcacatatttgcgacgggccgtccagggtacaagtaccccatgatgtactctgtgatgatgttcaatcctggagtctggttcgtagttgctgtgataattccgattgggagggtaaagaaaaatgcaatggcacatgccagcagtacgccccaccagggcagctggagttgctcgatgtagtattcacaagcaaatacagttacagcaatattaacagtaaggatgcagatgaaccaccactcgggcacctgcttatatctccgtcataagcgtttgtantgtacatccaccctcnttcctctttgaa

SEQ ID NO: 29734 - DNA, 825 bp, Triticum aestivum
  Clone ID: PAT_TA_29734
aaaaaacgtgctggcgtgactatgttttgtatttcaatcatcaaatacatccttttataagttttattcatgtgtaaaaaccacacacacataagcaagcagcaacatcatcaaacaaaaccactctttgacacttacaaaatacacagcctcttaacttcaagcccacggtccacgtcctttctcactgctctcgcgtcaccagctgcatacctgaaggctggagcagcctagccttattggattgggaagaaagcacacaaagatagtatgtagttgattcagttgtaggcgtccgggttggcgatgaggtacgcctcggcggccttgaagatggcggtgacggactccttggccttggcgacctcgtactcgccctcctccacgcccggcagcagcttgtacgtggactccaccttgacgacgctgccgccgccggccgccggctccaccttgatgcacgacgtggacgtctcgatcaccgtgccgacgtgcccgccctcgaggagggtcgaccggcactcgcacccgtccgcgtccaggaagtcgagcctctccttcacgacgctgaagggcatggctgaggtgaagttgaactgcctgacgctgccgacgccgccctcgccctcgacggggtgggcgctggcgacgacctgcggggcgagcttgggcgccaacgtgtgccagtccatgacgccggcgcggaacaggcgtggcgccgccacggacgcctcgatctcgtgcgcccagctcttggtggaggccatcgcgcgctgttcgtgcctgcgtgtgtgatgatcacccgaattttgcagcccggccggc

SEQ ID NO: 29735 - DNA, 796 bp, Triticum aestivum
  Clone ID: PAT_TA_29735
cccacgcgtccggcactacataaaattgacagagtcagagaagaaccgaaaattgaacgatctcttggatgctctcgatttcaaccaagttgtgatatttgtgaagagcgttagcagggctgcagagctgaacaagttgctttgtgaatgcaacttcccttcaatctgcatccattctggcatgacccaggaagagaggctgacccgatacaagaacttcaaggaagggcacaagaggattcttgtggcgacggatttggttggcagagggatcgacattgagcgtgtcaacattgtgataaactatgacatgcctgattcagctgatacctacttgcacagggttggaagggctgggcgttttggcaccaagggactcgccataacttttgtttcatcggcctcggactcggacgtccttaaccaggtgcaagaacggtttgaggtggacatcaaggagctgcctgagcagattgacacttcaacatacatgccgtcgtagacccgcgccgacattgcaaggaggacggaaggagaagatggaatccttgaatgttttgcttgaagtgatgctgttttttgcctgccctgccctgccctgctgccaagggagggaggcagcaggagcagcagctgtaccctatttagtctgttatttagtctgagagatgttggtttgttacttaggccaaatgatgaaatgattttacttgtgctagaattggatggatggatgaatgtatgatgcatggtttgctttgaaattttaaaaatcatgattattaccgtagttttc

SEQ ID NO: 29736 - DNA, 2490 bp, Triticum aestivum
  Clone ID: PAT_TA_29736
cccacgcgttcgcccacgcgtccgcccacgcgtccggaaattttaaaaatcatgatttttaaaatttcaaagcgcaccatgcatcatcacatccatgcacttctagcacaagcaaaatcatttcatgatttggcctaaggaacaaaccgcacgcccctgccgtccaagttctctgccccctcccgcagagtcgcagcagtcccaaatacgtgctacctaggtcgtaccaaaccactcccccgcccaggagaaatcgatcagcaccccccccctatcctctcctccccgcagccgcccacaaagctcgaacgccctatctctctcgccccctaccatcccgaatcccgcacagcacgcgttagacccctgcgcatgcagccgtaaagctctgatttctctctttgcagccgcctcgctcctcgacataccacggttcttcctctactccttgtctgagtatcccgagccgggatgggagaaggcaagggacgccgaggtgtacgaggaggatctcgtcgactacgatgaggagggtggagaacgccgtcgacggcgcagccgccaacccttccgtcgacgtcggtcaagaagggttacgtcggaatccacagctcacgggttcagggacttcctgctcaacgccagagctgctccggtgcgatccaggactgcgggtttggaagcatccttccgaagtggcaacatgaatggcatccctcaagccattctcggaatggatgttatctgtcaagcaaaatctgggatgggcaagactgctgtttttgtcctctcaactctccagcagattgatccggttgctgggcaagtagctgcacttgtgttatgccatacacgagagttagcataccagatttgcaatgaatttgagaggtttagcaagtacctgtcagaaacaaaagttgctgtcttctatggtggcgttcacataaaaaaacacaaggatttgttgaagaatgaatgtcctcacattgtggttggcacacctgggaggatcctagctctggctagagacaaggacctttctttgaagaatgtgaggcatttcattcttgatgaatgtgacaagatgcttgattcacttgacatgcgtagagatgtccaggagatcttcaagatgacaccccatgataaacaagtgatgatgttttcagcaacactcagcaaggagattcgcccggtttgcaagaaatttatgcaagatcccatggaaatttatgttgatgatgaggctaaactgacccttcatggtctagttcagcactatattaaactaagtgaggcggagaagaatcggaaattgaatgatctcttagatgcgctcgacttcaaccaaattgtgatatttgttaaaagtgttggtagagcttcagaacttaacaggctgctctgtgaatgcaattttcctgcgatctgcatacattcgggaatgacacaggaggagaggctgacccggtataagaacttcaaggaagggcacaagaggatccttgtggctacggatttggttggcagggggattgatattgagcgtgtcaatattgtcataaactatgacatgcctgattctgctgatacatacttgcacagggttggaagggctgggcgttttggaaccaaagggcttgcaataacatttgttgcttctgcctctgactctgacgtcctcaatcaggtgcaagaaaggtttgaggttgacatcaaggagctgcctgagcagatcgacacttcaacatacatgccatcttgaagatccaagtgggggctaggagggtttgcttttcagacacagcacctttacatttctattgggttacataaactttgatgtaagagatgctctagttgtacttaatcagcgattgaatctgctgagtattttgttgtagtactcagacttatggttgttaaggaacctattggaaatgttggtgttcatcatgtttgtgagcatattattaggacattcttatgttagttttggaaggggggccttggcgcagctgtaaagttgttgccttgtgaccatgagtcatggcttagggtcctggaaacagccttgctgaaatgtaggaaaagactgcggacaggagacccaggtcggtcggacatgtacccggaacctgcgccatcaggagttacgcgcaccggttttccccattgttatgttatgtttcttttagcactttcacttactaattttctttgatactaacatctgattgaatttcacgtgaatctgtgctcgatccaaattaattgtcgcagctctagctacaagattaattgtggatgtaatgcaaagctgcttgtatgtgaatgcttgagagaatggtttcagattggctctcaaagttggttaacgtccgacccgaaaatacatgccgtcgtagacccgcgccgacattgcaaggaggacgcgaggagaagatggaatcctcgtatgttttgcttgaagtgatgctgtttttt

SEQ ID NO: 29737 - DNA, 1086 bp, Triticum aestivum
  Clone ID: PAT_TA_29737
gtcctgttgcttttgttcggggctacgctcatccatggtacttccagtaccaatacatgtttatatttgagagcagaaagtaccaatacatgtttatatgcaacagcaagtaacaaagcacccagtacatgtttacattcaagagcaagtaccatgattcatatgacacaaagtacagaagattcatgattcagcttcaattggcttgccatcttgagcagcttctagattggcaccttccacaactgtttgttcggcaacttcatcgtcaataatactactatgtaacacggattcggctcctgcttcttcagctagatgcttctacatctacctcttcggtcgtaaaagcatctgcattctacttcaggtccgcatcatgttcggaagacatctatgatgaagaaaactttggaaacaaccgctacaaaagcgggggcgcaccttcaccccacgtttggctctagtttcaggaaacaagcacaaatgcattactgtgtatgcagtatcaagtattgaacctgctgacatttgacacaaaacaagcacaaatacagtgttctatttgttgtccccaagtgctaacatttgacacaaaaagcaagggcatgtacggcctacaaaacacattctgcaggagcgctcacaggattacaaagaggtggggggtagctcaccttcagctgcgatgtggagaaccgaaagtgggcaggtcgtcgggaggtggagcaccgacggcggacgaaccgtgtggaagaggacgggtagtggtgagtagtgacgaactgcagtggttgtactggtcgtcaggaggtggagcatctgcggcggacggccgcgtcgtaggcggtggagcgaccgatgggagattggggttggtggcggcgcagggcgacagtcttcacggtcaggggctcagggcccgccgctagcggcgcccgtcttcacctgccaaggccgccactcaggcgccggtcttcaccggccagggccgccgctcgggcaccggtcttcgtacaggggcgtgcggcgcgcatcgaggcaagcagcaggcggcggctagggttagtagtgggagaacgagag

SEQ ID NO: 29738 - DNA, 1138 bp, Triticum aestivum
  Clone ID: PAT_TA_29738
atctgctctggtcaaatctagctcggtcccgcggcaccagcgggggcaggatgttccgagctgtgaagcacgccgtcgtctgggcgaagaagagccgagctgagcccgcggccttgtctgccttcgccagccacttctccgcggcttccacctcgcagaggttggccggtaaggtggccgtgatcactggcggcgccagcggccttggcaaggcgactgccgcggagttcgtccggaacggcgccaaggtcgtcctcgccgacgtccaggaagacctcggccacgccgtcgccgcggagctcggccatgactccgcatgctacacgcgctgcgacgtgacggacgaggcgcaggtcgcggcggccgtggacctagcggtggcgcggcacggccgcctcgacctcatgttcaacaacgccggcatcagcggcgccctcacgcccgtccccctcggctccctggacctcgccgacttcgaccgcgtcatggcggtgaacgcgcgggccgtgctcgcgggcgtcaagcacgccgcgcgcgtcatggtccccaaccggcgcggcagcatcatctgcacggccagcacggcggcgggtgctgggaggggtggcgttgcacccgtacagcgtgtccaaggcggcggtgctggggctcgtgcgcgccgcggccggggagatggcgcgctccggcgtgcgcgtcaacgccgtctcgcccaactacatcccgacgccgctggtgatgcgcatcctggagcagtggtacccgaaggccagcgcggaggagcaccggcgtatcgtggagggggacatcaacgagatggagggcgcggtgctggagccggacgacatcgcgagggcggcgctgtacctggcgtccgacgaggccaagtacgtcaacggccacaacctcgtcgtcgacggcgggttcacggtggggaaggcgcccaacatgccggcaccggcgctgtgaaacgaagcgagctctttgaaataaatttacgtcgtgttgcattgcaccagaagtagaaccaccgagcattacgtttttgtttcagaattgaaacaacgaattgtcctcgatgtcgaggacgtgcatacgctgaccccatgcggaaatagatgagagcagcccggttgttgtt

SEQ ID NO: 29739 - DNA, 1131 bp, Triticum aestivum
  Clone ID: PAT_TA_29739
ccaagatccgcaccgataatccgagcggtgccggtcgtaaccagggaacgccggggttggtttcgaaggaggacggcgtccgtgcgccgaggaccccagggcttggtgtggccgcgcgtgtcggctccaggggggagagccgccgggctgcgctggcgtcggtggccggctacgtcagccaccgcggctactccacggcctcgagctcgcagaggctggccgggaaggtggccgtgatcaccggcggggccagcggcatcggcaaggcgacggccgcggagttcgtcaggaacggcgccgacgtcgtcctcgccgacgtccaggacgacctgggccgcgccctggcggccgacctcggcccggacgcggcatgctacacgcgctgcgacgtgaccgacgaggcgcaggtcgccgcggccgtggacctcgcggtggcccgccacggcaagttggacatcatgctcaataacgccggcatcgtgggctccctggcgcgtccccggctgagcgatctcgacctcgcggacttcgacgccgtcatggcgatcaacgcccggggcgtgattgccggggtgaagcacgcggcccgcgtcatggcgccgcgccgcagcggcagcatcatctgcatggccagcgtcgccggcgtgctgggcagcgtgacgccgcacccgtacagcgtgtccaaggcggcggtggtcgggatcgtgcgcgccgtggcgggggagatggcgcgctccggggtgcgcgtcaacgccgtctcgcccaactacatcccgacgccgctggtgatgcgcatcctggaggagtggtacccgaaggccagcgcggaggagcaccggcggatcgtggagggggacatcaacgagatggagggcgcggtgctggagccggacgacatcgcaagggcggcgctgtacctggcgtccgacgaggccaagtacgtcaacgggcacaacctcgtcgtcgacggcgggttcacggtggggaagccgcccaacatgccggcaccggcgctgtaaaacgaagcgagctcctgaaataaatttacttcctatatacgtactactagtacgtagtagtattgtattgcaccaccctcaaaaaaaagagtattgtattgccctttttgtt

SEQ ID NO: 29740 - DNA, 600 bp, Triticum aestivum
  unsure (1)..(600): unsure at all n locations
  Clone ID: PAT_TA_29740
gtactgggaccacgtcatcgggtactggcgcgcgcacctggcgaacnccgagcgggtgctcttcttccggtacgaggagatgagccgggaccctgcggcacacgtgcggaggctgncgcagtttgtcgggcgcccgttcagcgcggagcaggaggaagatggcgcggtggacgccgtcgtcaagctgtgctcgttcgagcacatgaccgggctcgaagtgaccaagagcggcaagacggagcttgtgttgggcgctgtggagaacagctcgttcttccggcgcggcctggtcggggattgggagaactatctgtcgccggagacagcacgaaggattgacgccattaccgaggctaagtttaggggtttcggtctctctgtctagccagcattcggtatccacgtgtcattcaatattcgcatacgtgtgccgctagtatatgtcaacaagggagtggcatattgtgttgatattgaaattgtggccgcaagtttggaattatggattggggccaggcagtactgattagagcatctctccaacgctagccccattttagaacaagaataaatagagatgcttatacattttcagcctct

SEQ ID NO: 29741 - DNA, 1238 bp, Triticum aestivum
  Clone ID: PAT_TA_29741
gctgcccctctcgccaccgccacctcttccccccccatgcctttccttgcaccgtttgccgtacgatgtcctcctcctcctccaccccagcctttccgccgcaagagggcgatgccgaaaccaacgaggagctctacgggcagttcaccgagctggtgtcctcctggccgtgctcccggggcctctccagttaccagctctaccgccacgagaagggctggcacagcaccctgcctccgatggtcggcgcgatggtcgccgacgcacgcttcgccgcgcgcccctcggacatcgtcgtcgccacgctgcccaagtccggcacgacgtggatcaaggcgctcctctactccacggtccaccggagggagcaccccccggacgcctccggccacccgttcaacacccatggtcctcacgagtgcatcaactttctcgagtaccagctctacacgcagaacagggtcccggacctcgacgagctcccggacccaaggctcttcgccacgcacgtccccttcgtgtcgctgccgaggtccgtcgtcgcgtcggcctgcaagatcgtgtacgtgtgccgcgaccccaaggacaccctgatctcgcattggaacttcgcgaacaaattcagggtccgggacggactggagccgctctcggttgagactgccgccgactacttctgccacggcgtgtcggcgttcgggccgtactgggaccatgtcctcgggtactggcgcgcgcactccgcgaaccccgagctggtgctcttcttcaggtacgaagagatgaatcgagatccggcggcacacgtgcggaggttggcggagttcgtcggatgcccgttcagcgtggaggaggaggaagacggcgcggtggacgccatcgtcaagctgtgctcgttcgagcacatgaccgggctcgaagcgaccaagggcggcaagacagagctcacgtttggcgttgtggagaacagctcattcttccggcgcggccaggtcggggactgggagaatcatctatcgccggagacggcacgaaagatcgatgccatcaccgaggccaagtttaggggctccggtctctctgtctagcaaagctggggtgtaatattattcgacatagcgtcactcatatcatttgcaaatacattcctcgtgagtttttaccgtcaatgtactatgaacttataagtaataatcatacgtttccgccgtggtggtggcgctgccacgacgctaggg

SEQ ID NO: 29742 - DNA, 1497 bp, Triticum aestivum
  unsure (1)..(1497): unsure at all n locations
  Clone ID: PAT_TA_29742
tcagataaagtgattcagctntgtattantagtgagggagtagcagtctttgtagaccatcacgtacaaatattattgtttgcatgccgtagccacacacgttctgacagactgcaccatgtatactttgactcatagggacagtatgtgatctatcaacttgtctaccgccagctgaattgacccggcgctgctcagagcctccattgctttgatgtgaagctccttcgctctctccctcatggccgcgccatgttccccgtccatgaacctcgcgatcgccacctcaaccttgccccgttccagcttgcccaccagcaaggctcccgtccgccacacctcctcgacgtacctcccgttggccagctgatcgccgaagagcggcctgcacagcatcggcaccccctcgcagatgccctccagcgtcgagttccagccgctgtgcgtccagaacccgcccaccgcacggtgggcgagcacctcctgctgcggcgcccacctgaccaccttgcccctgccctccgccgcccgctcgaacccctccggcagctccgtgtccccggagccagagccgatgacgaggccccgccggacgacccacaggaatggcntgccgctgttggcgaggccccacgcgacntcntcgaagttttcccggntcaccggggccacgntcccaaagntcacgtacagcacggagcccgcggctgcgcgtccagccactcgatgcagctccggtccgcctccagcaggctgctgccggcgccgccgatggtggagagcttgtggagcgggccgatggcgaacaccccgacgccgctggcggcgagctcggaacggatcgcctccagctccggggtctcgagcgcttcgaacgtgttgatcacgacccccgaggagttgtccgtgacctcggtggccgtgtccaggagcctgttcgccatctctgggttgggatatttgctggggtcgaacaggtccgacacccggatcggcgccagctccttcaccggcttgtccagctcgtgctcttgcgccggcaggtatcccttgtcgtggagcatggcgtaggaccggaacaagcggatggcggccgcgctgccggtgtgcagcacgaccgtcggcatgcccagctcggtcgcggccttctgcgcggcggggaggctggtgtcgatgacaaggcacgacgggcggggctccaaggccgcgagcgcgtcgcggacgcaccctgactcctccatggcatcgttcatcgcgaggatcttgccgatgccgtccttggcgtccggcatgccgccgtcggccacggcgacgaagccgaactccgggtgggcggccgggtcgagggcgttgaaggtggtgtggaggacggtgatggcgaggcctcggccgtggagcgcgtcggcgagctgcagcgccgggctgaggtggccctggaacggcagcgggaacagcgcgacgtgacccccggccatcgtttggagcagctgagtattc

SEQ ID NO: 29743 - DNA, 1241 bp, Triticum aestivum
  Clone ID: PAT_TA_29743
cttcttcggttacctcattattgctgccttcccatccgcccctcatctcctccccatccggccccatctcccttcctccacccctccacggcggctctccattggtaatggcgatggcggcgtcgtggtgggcgctgctggcggcggcggcggttgtggcggcggcggcggggtgcggcgaggcggcgcccacggcggcggcggaggcggcgcacgacgtgctgcagacacacgggctcccgcgcgggctgctccccgcggggatcgcggcgttctcgcacgacccggccaccggccggttcgaggcggtcctggagtccccctgcacctcgcgcaccgaggtcggcctgcggtacaacgtaaccgtcgccgggcagatcacgtacggccggatcgccgagctatccggcgtggacgcgcaggacctcttcctctggttcgccgtgcgcagcatccgcgtcgacgtgccctcgtccggcgtgatctacttcgatgtgggcgtggcctacaagcacttcccgctctagttctagatcgcgagggccgcccttttttttttttttttttttttctcagaataagtgattcaactttgtattattagtgagggagtagcagtctttgtagaccatcacgtacaaatattattgtttgcatgccgtagccacacacgttctgacagactgcaccatgtatactttgactcatagggacagtatgtgatctatcaacttgtctaccgccagctgaattgacccggcgctgctcaaagcctccattgctttgatctgaagctccttcgctctctccctcatggccgcgccatcctttcttcgaggcgccgccgccgcgcgtgcccaccccgctcatcctcctgcaaccacatcacattaggggccacggatcggtggaggaataccgcgccgcgttgccaatgatgggcggattccatgatttcagtggagacgcaaaccaagaaatcgcagttttgagaggtgatcggccggccggcgggcggacggccggctagtgtgcagatagatagacgtggtcattcattgtttgctactcgtcacctcatcactctgttcctgtcgtcgttcttgtcctctgcggccaaagtcaatcggcggccggcgggagctgcctgcgtgtactcctccggcgtccggccgactgtcatatttttcacggtaatggatgatgtgtagtgtatatgttaaaagttttttggggagacc

SEQ ID NO: 29744 - DNA, 1511 bp, Triticum aestivum
  Clone ID: PAT_TA_29744
aggaggaggagaccccagcggagacaaaaagcacccaaaaagaggagaccgcggtaaccaagccagatggtgccgataaaacagaagaggccaaggccaagatgacctgcgacgagaacgccgtggacgagggcttcccctacgcgcgcccgtccgtgtgcgagctcaccggcgacgtccgtgtcagccccaaggagaagaccatgttcttcgtcaacccgtcgggcgccggcccgttcgacgacaacggggagaagaagatccggccgtacgcccgcaaggacaccttcctgctcccgggcgtcgtggaggtcaccatcaagtccgtggcgtcgcccgtgtccgcgccggcgtgcacccggcgccacgacgtccccgcggttgtcttctccacggccggctacaccgacaacttcttccacgacaacacggacgtcatgatcccgctcttcctctccacgtcgcacttcgccggcgaggtgcagttcctcatcaccaactacaagccgtggtgggtggccaagttcgcgccgctcctcaagaagctgtccaactacgaggtgatcaacttcgacaaggaggcggacgtgcactgcttccccggcgggcagctcgggctgtaccgcgaccgcgacctcatcatcggcccgcacccgacccgcaacccgcgcaacctcaccatggtcgactacaaccggttcctccgccgcgccttcggcctgccgcgggacgcccccgcggtgctcggcgacaagacggccgtcaggcccaagatgctcatgatcgagcgcaagggcacgcgcaagctgctcaacctgcgcgccgtccaggccctctgcgaggagctggggttcgaggtcaccgtggccgaggccggcgccgacgtgcgcgccttcgccgcgacggtcaacgccgccgacgtgctcctggcggtgcacggcgccgggctgaccaaccagatcttcctgccgaccggcgccgtgctggtgcagatcgtgccgtggggcaagatggactggatggccaccaacttctacgggcagccggcgcgcgacatgcagctccgctacgtcgagtactacgtgtccgaggaggagacgacgctcaaggacaagtactcccgcgaccactacgtcttcaagaaccccatgcagatccacgcgcaggggtggccggcgctcgccgagatcgtcatgaagcaggacgtcatggtgaatgtcaccagattcaagccattcctcctcaaggcgcttgaccagctgcaggattaattagagcgtttgtttgggttgtttcgtctatgtggcaccgtttccataggcttcagtggagttggggtatagctgatgatgagtttcgttttgtaacttcaaccaaagtcaattcatttcatttctgttgtatactacacttgagttacattgctgaccagagcactcgagatgtactacctgtactcaactgggaacagcatataagttcatactgatgaattgatgaaactaaaaaca

SEQ ID NO: 29745 - DNA, 620 bp, Triticum aestivum
  Clone ID: PAT_TA_29745
gaccaccgagcgtcgcggcaggacgagcgggaccggatcgaggcgctgaagggcgggctggtgctcaactgccgcggcgtatggcgggtgcagggctcgctggccgtgacccggggcatcggcgacgcgcacctcaagccgtgggtggtggcggagccggagacgaggacggtcgacgtgggcgccgactgcgagctgctcatcctcgcctccgacgggctgtgggacaaggtgggcagccaggaggccgtcgacgcggccgccgcctcctccggcgacctgcccgccgcgtgccgccggctcgtcgacatggccgtgtccaggggctcctccgacgacatcagcgtcctcgtcgtccagctccagcgccgtcctctccgataagactgcagtagtagtagtagtagtagtaagagtttaattaacacgcgagaagatatgcatcggcggcgccatggatgatcaccctacgtgtagatagagagctttttgacgtcgtctttctcgtccccggccgctcgatccggctgctggtgcttgtaacaagatcaagcactgttagtgctaataatcatcatccggttgagattgcaaaaaccctagacgggaataatcttctg

SEQ ID NO: 29746 - DNA, 814 bp, Triticum aestivum
  unsure (1)..(814): unsure at all n locations
  Clone ID: PAT_TA_29746
ggacgccgcgggcgagcagggcgacggcttcgcggccttctgccggagggggaagggccggaagcgggtcgagatggaggaccgccacgtcgccgccgtcgcgctcggcggggaccgcgcgcaggccctcttcgccgtgttcgacggccacggagggaagagcgccgcggagttcccggcggacgacatggccgggaccgtggcggacgagctgcagcggtcggcgcgccgccgacgggcagggcgggcggcggtggagggcgccgtgcagcaggcgtacctgcgcaccgacgaggagttctcctccccctcctcaaagtgtcgggagcaggcgggcgggggcacccgccgcgtgaatgcactgctccgctaggggtggcggcagctgttggtggccggcggcggcgactgccgcgcgctcctaagccgcggcggcagtgctgaggcgcacaatcatgaccaccgagggactcggaaggacgagcgaaaccggatcgaggcgctgaaaggcgggctggtgctcaactgccgcggcgtatggcgggtgcagggctcgctggcggtgacccggggcatcggcgaccgcacctcaagccgtgggtggtggcggagccggagacaagaacgtcgacgtgggcgccgactgcgagctgctatcctcgcctccgacggctgtgggacaagtgggcaaccaagaagcgtccaagccggcgccgctcctccggnaacttcccgccgctgccccggntctccanatgcntntcaagggctctccnacaaataactctctctcaantcaaggcntctcccaaaa

SEQ ID NO: 29747 - DNA, 861 bp, Triticum aestivum
  Clone ID: PAT_TA_29747
ggtgatcgccctcgtgcatgggtggactggctctcgtgggcggagtactgctacaacacctcttttcactccgcctttcgtgatacgccctttgaggtggtttatggtcggccacccccgccgatcctgccggtggatgcggcctcggcacggaccgaggcggccggggctcttctgaggaaccgtgatgagatgctcgtggaggtccagcaacgacttctccaggcccagcagttggccaaacgatactatgatggccaccatcgcgaggcgaaactcgcggtgggagattgggtctggctgcgtctacttcaccgctctacgcagtcattggaacccagcgcacggaagaagctcggtcctcattatgccggtccctttgctatcctggaacgcattgggaaagtggcgtaccgtcttcagcttccggccggcgcgcgcattcatgatgtcttccacgtcgggctgctcaagccattccgcggtgatccacccgcggcaccgccggccctaccgccggcctcggacggacgtctccttcctgcaccggagaaggcgctcaaggcccagctgcgccgaggcgcctggtacgtgttgattcggtgggctggactaccggaggaggacgctacttgggagcagcgcgaggaattccaccagcactaccccgactttcagctcgaggacgagctgtttgcgcaggcggggagagatgttatgaccggccaggtctatggccgccgtgggcccactgggcaggcttaaggcccaagttatcttaggtttattttcagattatggttatatatactagttgtaaaactattttgagaatcaagcaataagactattctattgccc

SEQ ID NO: 29748 - DNA, 893 bp, Triticum aestivum
  Clone ID: PAT_TA_29748
gatttgtgggcagagaatcacaacaagatttgttcaatctacttggagccacttatgctgctgtcttcttccttggggcttctaattgtatcacagttcaacccgttgtggcaatagagcgaacagttttctaccgagaaagggcggcagggatgtactctccattatcctatgcattagctcagacaggcgtggagatcatctacaacatcctgcaggggtgtctatacacaatcataatctattcgatgattggatatgagtggaaagctgacaagttcttttatttcctattcttcataattgcaagtttcaactacttctcgttgtttggcatgatgttggtggcattgaccccatctgcgctgcttgcaaacataatcatatcctttgtactccctctttggaacttgtttgctgggttcctcatcgtcagaccggccattccaatttggtggaggtggtactattgggccaacccagtatcctggaccatctatggcgttgttgcatcacagtttggcgagaacaacaattctctttcgatccccggagggagccccatagttgtgaagaaattcttagaggataatttgggaatcaatcatgatttccttggctatgttgtgctagcccacttctcctacgccattgggttctacttcatctttgcctactctatcaaagtcttgaacttccagaaacgttagccaaatgtccagtctttttttccttcatgaagtagtctagtttgtgtgtgcgtgtatatttatatcataaagactagaagtattcagagacatgcatggtgtatgttattattaaagagagtttctagcgataagattttttttactatcattattaagtatggaaaatttattttggtgtct

SEQ ID NO: 29749 - DNA, 1172 bp, Triticum aestivum
  Clone ID: PAT_TA_29749
gccggccgtgccgggatacactggcagtaccgcgcaacacacctacacacacagagataggcgaggacgatggcgaagcaaggtgttgcttccatgcttgcagtggcgctggtccttgttgccctcgcagcatttccagcagtgcactccatcggcgtctgcaacggcgtgatcggcaacaacctgccggcaccgagcgacgtcgtgaagctctaccaaaccaagggcatcgacgccatgcggatctacgagccggagagcaacgtcctcaaggcgctcagcggcacgggcatcagcctcctcatggacgtcggcaacggcgcgctaaccagcctcgccaacgacccctccgccgcgcccgcctgggtcaaggccaacgtccagcccttccctggcgtctccttccgctacatcgccgtcggcaacgaggtcatggacagcgccggccagaagaccatcctcccggccatgaagaacgtacaagcggcgctcgcggccgccggcctcggcggaagcatcaaggtgtcgacttcggtgcggttcgacgtggtcacagacaccttcccgccctccaacggtgtgttcgcggacacatcattcatggggcccatcctggacttcctcgcgagcaccggcgcgccgctgctggccaacgtgtacccctacttcgcctacaagggcgaccagcagaacatcaagctcgacttcgccaccttcgtgccaggcagcaccaccgtgaccgacaacgggctgacatacacgaacctgttcgacgccatggtcgactccatctacgccgcgctggagaaagccggcaagcccggggttaaggtggtcatatccgagagcgggtggccgtcggccggtggtttcggggcgacggcgcagaacgcgcgggcttacaaccaggggttgatcaaccatgtcggccggggcacgccgaaacagcccagcttgctggagacgtacattttcgccatgttcaacgagaatcagaaggacggggagaagagggagaagaattttgggctgttcaatccagacaactcgccggcctactccattactttctgagtccgacaaacaaacgccagctggaaatttcctatattcgaataagctgcctgttaaatgcaaaatgcatgcatttcagtcaactactcgtgtgtctt

SEQ ID NO: 29750 - DNA, 1313 bp, Triticum aestivum
  Clone ID: PAT_TA_29750
gggatgcaaataaggtgatagtaccgcacaaggccaccccaagacacacagaaaataagcgaggacgagggaggaggaagatgcagagggtggaggggccattggtccttgtgctccttgccctcttgccatctccacgctccgcactccatcggcctccggggccgggcaccgggctaccggcgaccgcctccccgcgacgggcgacagccctaccgctccaacagcaccaacgccatgaggaccgaccagggggagcgcagcccgctaaaggcgctccgtcggccgggcaccagccggccctcggtcggcggcacggcgctaccgacgccccgcctccggctcccaccgctcgcgaccgcctcggccaaggccaacggccccgccttcccgcgccgccccgtcctctccttccccctccgtcaccaggccagtcgaccgagccaagcgacaaggaccggcctgaccggccaccacgcacttacaaggagccgatcgcggccgccggcgtcggcggcaggcgtgaaggtgtcgacttcggtgcggtctcggcgtggctcaccgacaccttcccgccctccgacggtgtgttcatggacccgtcgttaatggggcccatcgtcgagttcctggcgagcaccggcgcaccgctgctggcctacttctacccctactccgccacctcggagaaccaaccgaccctccggctcaccttctcaacttcgctgccctccagcaaaacagtgcacgagaaaaggataagatacagaaacctactcgactccatggtcgactccatctccgcatcgatgcagagctggggcaagcccggagttaaggtggtcaggtcggagagcgggtgaccgtcggacggaggtatcggggcgacggcgcagaacgcgcgggcgtatagccaggggttgatggaccacgtcggccacggcacgcccaaacggcccgggccgttggagacgtacattttcgccatgttcaacgagaacctgaaggaaggggagaaaagcgagaagcactttgggctgttcaatccggacaggtcacccgcctactcccgttactttctgaaacgcgccaagcgcgtgcatattttgcgttatgaataagctgacctggaaatgcaattgcaggactgcacgcgtttcagtcaaccactcgtgtgtgttatgttttctttccttataaaagacccataaaacaagtcagaaataaaaaaaaaaggagtaaatttcactttttctaacttttaaattaaaatctccaaaaaaactagtaaaaaagaaaagaaaaaaaaaaaa

SEQ ID NO: 29751 - DNA, 1160 bp, Triticum aestivum
  Clone ID: PAT_TA_29751
gtacggtcagggggtcgacggggatgatcctgttgtccttgacatgacttctatgtgcaagggtatgatatacgtgaacggcgaaggcatgggtcgctactggacgtcattcataactcctggcaaagtcgcttcccaggcagtgtaccatattccacggacatttttgaaatccaagaacaacctattggttgtatttgaggaggagcttggcaagccggaaggcatactcatccagacagtgaggagagatgacatctgcgtgttcatctcggagcacaaccctgcacagataaagccatgggacgagcatggaggccagatcaagctcatagccgaagaccacaacactcggggattcttgaactgccccccgaagaagaccatccaggaggtagtctttgccagcttcggcaacccggtggggtcatgcggcaacttcactgtaggcacctgtcacgttcccaatgcgaaggatatcgtcgcgaaggaatgcctcggcaagaaggggtgcgtgctgccggtgctgcacacgttttacggtgcggacatcaactgccccacgacgacggccacactggcggtgcaagtgaggtgccacaaaaagggcgatccagaataaatagagagatcgacaccttctctgggctcctgcactcactgtctcttcatcccgtttggtttcgaacttgcgtcgatgcattgtgtgtcgcttgttgtgattatagcttcattgaggcgtgcgtgcttgatctggatcgtagggaatcgatacgtaaatgtgaatgaaactgctgggcgccgatcggctcgaagatgtattttcctttcctcacctctttcttcttttgttgtgttgtgtgctgtttcatgttaaccatcacagtaggtgctgaataaccacgagggatagtttagcgaactccaaatttggtgcaaaagaaccgttgtgctgaccgagtggatagaataattcaatgaccatgtcctgtaaatgttttatcatgtttgtggggcatcctcaagccttctgctgcttgatttgtacatctcatcttgacaagtttatattgccaaatttctgatacagctgtatgtaagtgttgtatttgttaaacaatttgtaatgcatatctcttgttccattatcaaaaaaaaaa

SEQ ID NO: 29752 - DNA, 1636 bp, Triticum aestivum
  unsure (1)..(1636): unsure at all n locations
  Clone ID: PAT_TA_29752
gcgagatattctgaaaatctatcgatttatttgtatggataatactccattattttatcagtgacactataacaacacaattatgtgtaatacaatgtacagattaataactgagatcttttctgatttctttcaatgataatatgatacagatcacatgttacatacaattttgctaggtgaagatttgttagtgcattgcatacagtagagggatgacatctgcttctagttataccgagatcccaatgaaatatttcctgaaatcttcttcgtccttgcaataaactgacatgaccttgtacacttcaatcagcagcttcggaaatcggcttgagaaataacgatcaaatccctccggcagtgacccaagtaactccttgagatcagctggaagctctctgtaatgtcctgacttgtttctaatcaacctgagaaggtcacgagttgactcgaaattatatttcctataacgacccacatcagcaaccagaccatcatccaacttttctcgccattttccaccaaaagcttgatgccctatgctttccaaagcattaaggaggtcagtttcagtggttttctcaattctatcgctggtatctcttagaaacaaaagccgcaactcagggctccaaaagagaggatgatttatcgcgtacaccgccgtgggtctctcatcaggttttggttgtaacaacagagaaataagatgcaccgcttctggaatgtgatccaccacgaagagatcaaagtgaccgtttataatgtttatgtcccgttcatagtactcaccaaacggatgcttgcctttagtgatacaatagaaaataaggcagcccaaactaaacaaatccattgcacgagtctgactagcacgacaaagctgctcaggtgcttgccaaccggagcttccatatccagtgccatggtgactaagagaagtcatatcctcttgcaaacgcttactgatacccatatcagaaagctttgcactgagagatccctccttacttattaagacattctgaggcttcaaatcgcggtgtatgattcctaaactatgtaaatgcacaataccagcgacaacatctctcatcagctttaggagttgtggcgaaggaagtccatcctgcgtccaaagttctacatctattttctcaacatctgaaaaagatggatctgtatgctgttggatcagatcagccaagctgcagcagcacctctcaagggaaatataaacaaaattgtcatcctgatcgcagccatacagtctaacaatattaggatcccgatccgatgcaatcagattctcaatctctttcggggctatatcagtgtgtgagcgcagcaggcgtttcactgcaacttcccgtccctcatatgaaccctcaaagacaactgtgccattgctccctttaccaatttcctttttgtgaacacgaagttttccaatctggcatccgtcaaggccatcagggagtgcatacagcatctcatttgacccaccagttccactgctctctttgtcagaggctgaaccgatctctgtgctattggcccttccatctttcttccgtgttttccttctcttagatgttccctctgacttcccnctaaggtnncggacgcgtgg

SEQ ID NO: 29753 - DNA, 1105 bp, Triticum aestivum
  Clone ID: PAT_TA_29753
gaaaaaatggaattgctacgcattcattttggatcgtgtctttcacatgtgaaaaatcctgctgtacttggagaagaacgaaatatactttgggatgcaaaaaaggtggattcaccgctgaagaagcgaacgcatctctgtttgtcagtctacagaaaaactgcagattctttcctagtgctaacagagagctactgcgccgtggcgcccaatatttctctgttgcaacccaaccgtcctatcaccggtttccggatcaggcagttggtcgatgtcatcttctgcatctcccggtcctcacaaatgaacctggcttgtcctccttcaactgaaacctgaagctacggcggcacgggagaccttcgggctaggattctgaactagcaccagcaacggctgtgaagagtagcatgcgtcggcatgagaagtcctcactccaacatgccattggtccgagacgagtcctctgaaatcggctgcgtccatttccacgctgtaaatgggtggcatggtaatctcccagtttgacttcatcaggggcatgaccggcaggtggagtgatgcttcagggatcctgaagttccacccaatgtacatgaagatgcagaactgcacccattcgcgtaccaacacgcggaaccagtagttatccggcgtatcatcagccctcatgtacaccatgatgaatgccactgctgccacctgcattgtaccctgaaatctcttgaacattgtgtacttggtgttgagtgtcccatgcagtgaatggatgtcttcctcctccacgaaattaagctgctcacgcagaaccagcaggcactgcgacgtgcggcggaatatgatgtagaatgacgcgaagtagttcatcagaagaaaaccggtgaaataagggactgcggctttatagcctatgaggctaaggtagaggaggcatccgagccccgcagtcgtgcgtctctccctgatggagaggcgctcgtacatgatgcagtaaccgtgggagatgagcatgaaggagacgaaggaggccgtctggaagaggatccccgtcacgtacacgccgaacgacatccacagcgagcatgtgtgaaggtgtacgcacgag

SEQ ID NO: 29754 - DNA, 860 bp, Triticum aestivum
  unsure (1)..(860): unsure at all n locations
  Clone ID: PAT_TA_29754
tttttttttttttttgcacgctcaaagcctcaaaaccatcgctcagtttattatttccatttttattctttgagcacgctcaaatcctcaaaaccgtcgctcagtttattacatccatttttattcatagatacacacacgtacaactagtggccttaatttatcagttcatggcagtctcgtcctggatgtgtgtgtgagtgcagcgatccatctccagtcacccatctcccccgccgtaggtaggttggttggttggatcagcagtgggcctcgcagctggtgcagtcgaagctgcacccaccgccgccaccacctcccccgccatttttcccatggtagctgtacgagctgaagcacttggacgggcatgtgagccgctgctggtagcagggaccctgctcggagcagaccaccgacggctgcaccaccccgcgccgcgcgaacccgccccctggcccaacgccgccggcgccccacccgccaccgaacccggcgcccatgcctccggcacctcgggcgccactcggctgtccgccgcggaaccacggtatgccactgaagaatcccccggcgcccgggctggggtgctccgggtagctcccgtccgcggaggaggcgaggacgaaggacaggaggagggcgagcaggaggagatgggtagtgcgtcctccggctggcgccatggtcctagctttgtgtgcgtcggggaaagcgaggaggattcctggaaccccacgcgggcggcctcgagcgccgcacggaggaggtgggtatttatgactttgggcgcggcgactccatcgcggggaaaaggaaantgggcggggaaggaagaaagtgtggggggcggtnntgcg

SEQ ID NO: 29755 - DNA, 1290 bp, Triticum aestivum
  Clone ID: PAT_TA_29755
ctgttttttttttttccgtaataatacatggcttatctgaattaaaaccaaagattctgtttcggtccaaaccaaggatccgaattaatacatggcttatgcttgtaactacacgcccagcatcagtgcacctaagcaaggcaccgaagggcagcacaagcaacagactgccaccagcagcaaaggcagccagtgcttacaccatcgcacgacacacaatacagcactgcagcacacttctatcatctcagcgggcgggcgccagtgccgcagaggttgatgaggtccaggagggtggagtagagcacctccagggacaggtaccccaggaacctgcgcttctcagcccaggggtcgtccgccgctggtgccttcccgggagcctccgccggctggtcgacagtctggtcccatgagatgcacccgtattcatcgtccgggtccacgtgcgccaccaggcccagcatatcaccgtgctccaggtcgaagtagaggcacaggaaatggcgagtcacactcatccccacgcccaacgccacctcgtggagccagtttattatctggctcgcaacctgctgcagaaccatcgttgggaggtcctcctgggcgctcctccaactctctatcagataaccatcagagggcttcctagtcaacgacccggcgatgctcggagaaccctcgcccaacaaacttatctggccgtccttcaagacaatcttcgtgttgaactgtgtcctggaagatttgtacttgggctcgccattgtccgaaggcttcgtgggccgatcagcagccaaaatgggttgcggaactcttaagcagagagaccaggaagaagttctagagtgccatgtaggaagggaccgcagctggagataaggaaccctgctaaccacactctctagctccagctgcactttttttgaatatgttttatgagccactgtcatgcagaaatgacttagcaagccacaatcttcacttgcagactctgcggactgagcaggactctggtagcgaacaatattacgatatttctccctgacttttctgagaatgttctcatggaacaggtgtagcaagtaaatctccagacttttcgggttaagaaaccctgaggtgtccctttttgaaggctcctgcttcccattggtggtggctagcacaagattcgcctctgaattattatgctcttcatggcctgccatttctgagtcaccatcctgtccagaatccacaagtgaaaggcacaacaaactctcccccacgcgtccgcccacgcgtccg

SEQ ID NO: 29756 - DNA, 883 bp, Triticum aestivum
  Clone ID: PAT_TA_29756
gcgatcttatcatcagagctttgatccagaatcacagtgatacagcatgacgtgctcctctgttttgggtacaccacacactccacggccttcatccggcagagccacagccacccaacccagctgacaccatcaaaatcgcggttacgggtctgttcattcatcccgcaccccacctacacgcagacgcagctctcggccgccgccgccaccagggcaatggagcccgagcccgaccgcggcgtctccctcctctcccccgccccaagccctagccaccaacccagcctccgggcggccaagtccacggccttcaagcgcgaggagcgccgcaagcacaaggagcagaagcgggagcgcaagcggcaggagaacctcgccctcgcgctcgcgcagtgggagcccctcggcgccccaccccgcccggccgccacccccactcccggcgagccactcgacgacaagccctggccgtgtgacccgccatctcccgcggacgccgcgccctccgccgcctggggctggggccctccggcggagccctccgccgacaggggctggggccttccagcggaaccgccggcgcagccgccggtcgcggcaaggtgcccccaggccgacgcggtgagggcgtgccgcgcgttgtttgaagagcacgccgataacgacgacgacggcgacgaggagggggaggaagaggaaggcgatgtggcccggttcttcgacgagctgctggagaaagacgcggaccttagggggttctaccaggtggagcgggagacggggtggttcctgtgcctggtgtgcgagggggtcggcgccagggcggggaagcggttccccggctgcgccgccctggtgcagcacgccggctcggtcgccc

SEQ ID NO: 29757 - DNA, 837 bp, Triticum aestivum
  Clone ID: PAT_TA_29757
gcacgaggcccccctccctcccccgccgccagccatggcctccccctccccaatgctgccctcctccccctccgcccaccgccaaccctcctccccccaccccggccagctccacctccacccccgcctccacagccacaatccctcctcccgcctcgccctcctacgctcgctcccgctccgcctccgcctcgccattccccgcccccgcctccccaccctccccctcgccctcccctcctccaccggcggcaacaacaacgacgacgacaacaacggcggcggcggcgggaatgatgaaacaggggacggcggcggcgagtggggcgtttaccgggggaggcgatgttcgtgctggcgcaggcgagaggaagatctccagcctaccggcgtacctcgccacggccgtggagggctgccacatcacgggcgacatcgtgcggcgcttcgcggagatggagctctcgccgctgctccgttggctgctgggcttcagagggtccagggagcgcctcctcaccgacgacctcttcatcgccaagctcgccatggagatgggcgtcagcatgatcgccaagaccgctgccgagtacgagaagagacgggagaacttcgtcaaagaaattgacatcgtcatcgctgatgtgggtggggtcgtcatggcaattgttgcagatttcatgcttgtatatcttccaccaccaactgtatctctgcagccaccacttgcaagaaatgctgggcttatcactagttttttccacaactgcccagacaatgctttccaaattgctttggctcaagggatggacctttccctcaaggtaagggccttgt

SEQ ID NO: 29758 - DNA, 1041 bp, Triticum aestivum
  Clone ID: PAT_TA_29758
cttacacgtgcttctggtctggtcatcatctaccttaacaaggcaaaaggggacgaggaggaggattggggtgaggagacggaggaggggctcacggggcaaggaggaggaggaggggctgatccgtcaggcatgggcatcgccggcctcccttctgacatcctcgtggaggtgactgccagaatcgccggggagtcgacgacgcccctggacgacatcgtcagcctcaggcgatcatgcaaggtgttccgcgacgtgacggcggccagggaggtgggccggtgcatggcggtggacaaggagtggcgtctgcactggtgggacaaggagaggttcctctcggtgctcggggagtgcgcggccaccggcaaccccgaagcgtcctacatcctcgttgcggcctaaaatctgcaaccggtggggaaaggagagcggtacaaggcaccagcaatccgccatgaagcacgataatgccgtcgcggcctacaccatcggcatgagtacgctgcgcgacgcctacaatcccgaagagagcgaggaggcaatgggataactctagggatgctctgcagcaagaacaaagagcaacatcaagattgcctccgtacgcggtgcggccgcttcggtcatgcggaggctgacgatgcgccgctcgaacacaggagggcctgcagcggcctgcgcagacgcgcgctgcaaggagatggagacggcggaggcctgggacgaggacgacgaacagaggaggttctgcagccggctgtgcaaatggaaacatgaataccgcaaatttgtgcagtggatttaacgatttgattcattagtaggctgtcggccactctgccggcagtaaaagttgtgagacacaatttcagatttatcactttatgcttctccaattctagatctgccatcccaatttttctccttcctaatggaaagctcgcttagcactttgccatcccggtcaggtggtttggtagtgatattttctggcttgcgtgtattttttttggggctgcgatatgcttgtattttgtg

SEQ ID NO: 29759 - DNA, 1738 bp, Triticum aestivum
  Clone ID: PAT_TA_29759
aagcttacctataaattcaccattgagtggaccgttttaaattgtgtgtctttttcacgagaataagcccaagctgattgctgtctcaaacatggtcacctttgcaaacccaaaggcacctgtctacccacgtttggcacaagggaagtcttgggatgaaatgacaatcacctggacaagtggatacgatataaaagaagcagttccttttgttgaatggggtgcgaaaggcgggtctcagtttctttccccagccggaacattaacattcaacagaaatagcatgtgcggagcacctgctcgaactgttggttggcgccatccgggttacattcatactagtttcttgaaggatctgtggccagactccaagtatacctacaggcttggccataggttaccaaatggtacccacatctggagcaagttatataactttaaagcatcaccttatcctgggcaagattccttgcaacaaattgtcatatttggagatatgggaaaggcagaggcagatggttccaatgagttcaatgacttccaacctggctcactgaacactactaaccagatcattaaagacctagaaaacgttgacatggtgcttcacattggggacatttgctacgccaatggctacttgtctcagtgggatcagttcacctcacagattgaatcaattgcatcaactgtaccatacatgattggcagtggtaaccatgaaagagactggcccgggactggatctttctatggaaatcttgactcaggtggagaatgtggtgttcctgcgcaaactgtattctatactcctgctgagaaccgtgcaaaattctggtatgcgacagattatggcatgttcaggttctgcattgctaacacagaagaagattggaggccagggaccgagcagtacaagttcattgagcaatgcctgtcatccgtcgacaggcagaagcagccctggctcatctttctggcgcaccgtgttcttgggtactcatcctgcacttactatgagacagagggcacattcgaggaaccgatgggacgagaagcgctgcaggagctctggcagaagtacaaggttgatctcgccttctacggtcatgtccataactatgaaaggacatgtccagtctatcagagccaatgcgtcgttgatgcatcggatcattacaatggcccgttcaaggcaacaacacatgtggttgttggtggtactggcgctagcattgcagattcagcattcaccacatcaaatatccagtggagtcacttcagggacttcgacttcgggttcgtcaagctcacggccttcaaccattcatccttgctgttcgagtacaagaaaagccgtgatggcaatgtgtatgatcatttcacaatctcgcgggattaccgagatgtcctggcttgctccatcgacaactgcccaaggactacgctggcttcctgaagccccaacactttcaaacggggaatcagttgatctgctaatggttgctggtttgtgtgtggcccaatacaagtgtctaagatatttacgtatcttagaaacttgtattggctacctgaagctccagtacattcagacgggggaatcagtcgatgtgctactggttactggtgtgtatgtggcccaatacaagtctgtaagatatttaaatattccagttctgtatacgaaataaaataaaatacacggttcttaagtttcagaaaaaaaaaaaaaaaa

SEQ ID NO: 29760 - DNA, 632 bp, Triticum aestivum
  Clone ID: PAT_TA_29760
gtcatgagagcccgcttcaaacagggagataagcaagccacctaaaaaaaccctggagctcccgcgatcgcaaggtgatctggcggcgacggagatagaaaggagggagcgatggcgttggtgaatccggcggaggacccggcggatcgagtccccatcgggggaggggcatctgcgacgccccaggcggaatcagtggcgcatcgcgatccctttgggagggggatttccatcgggggcgcagcgagcgagctggattggggaaaaatcaaggcggaatcaaggcggatcctgtggcgatctagagatgctggaagcagatgaagaggcgtgcggaggagatgttgcgcgtgcatccagcaaaggctctacccgaggcagggagcgtgaagacgggcggcttcaacggcaacaaatccgaggtacggccatgtggtgattctctggccttgatcccgttcgggataggggccccgattttgggcgctagtaatttggaaacgaggattaatgctcaggattacagaaaagtttactctttgagagatttggataaggaagagagaaatcaggggaggagcgtttcttgtacatcaaagaaaaacagagaaattagtgggattttattatgg

SEQ ID NO: 29761 - DNA, 306 bp, Triticum aestivum
  Clone ID: PAT_TA_29761
gacgggagcaagtagaggaacatgttccatggcatttggagcctgcgaccttgattgtgtccggcaccagttcttgatcgtgccgtctgcatgggtagctagcacacatgttcactccatattttgttacagtgaatgaacgagtgaatctctccagtgtaattcgagtgctcggcgatgtgttgctcctgacgcagcacacaccctgatgcccacacgcgctggcactctcctctgtacattgcccgtcgctgtggaataaaagtataatcattcagaagagaagagaaaagcagaaacgcgaaa

SEQ ID NO: 29762 - DNA, 1140 bp, Triticum aestivum
  Clone ID: PAT_TA_29762
agctccgcctcccccacctccttcctgccccgctccaccgccctccgcccgctcctctcgctccctttccggccggatctttcccgccccaggcccctcggccccccggccaggtcgctctctaagaaggcggcgatgacggcggtggcggccaaggctcgggtagacggccgtggttcggcgatggaggcccgggaagcgcagtccggcgagattcacgtcatcgtcggccccatgttcgctggcaagaccaccgcgcttctccgccgcgtccaggccgaggccggcaccggcaggactgtggcactcataaagtctgacaaagacaatcgatatggattggattctgttgtgacccatgatggcacaaagatggcatgctgggctctaccagagctttcaactttccaagataaattagggagagaggcttatgataaggtagatgtcataggtatcgatgaagcccagttcttcgatgatcttcatgatttttgcagcaaagctgctgatcatgatggaaaaatcattgtggttgcagggctagatggtgattacaaaaggaacaagtttggctcagtactggacatcattcccctggccaactcggtcaccaagctgacagcacggtgtgagttgtgcgatcgccgggcgtccttcacattgaggaagacacaggaaaccaggaccgaactcattggtggagccgatgtgtatatgcctgtgtgcaggcagcactacttggacgggcagattgtcatcgaggccacaaggattgttatggatattgaaagatccacggaagtagctcgctgctagttaggggtgtgtgtggcttatccagaatatccctctcttcagtgtgtcattcatccaacagcgtgttgagatgtgctaccagtgtgtacctgttattgatcatctgtggcagcatgccagcctgagtttcagattatgaggcgttgccatattaccataggagaacttaattaagttgcgatttgagcagattgtaaatatttaccagttgggaatgttggtgcaaatagctcttctttttagaatacccaccttttaattcgcaatgggtgacctcttgtgccaaaactgggaacgcatgagaaaaaaaaaaaaaaaaaa

SEQ ID NO: 29763 - DNA, 1112 bp, Triticum aestivum
  Clone ID: PAT_TA_29763
cacagcgttgaggcttgtaccttgtgggtgagagagctagccagctgaagccgcaacagcaaggcgaagcaagctcgctagcaaggatggggtccttgccggcggcgggcgagaggccgcacgccgtgatgatgccgtacccggcgcagggccatgtgacgccgatgctgaagctggccaagctgctccacaccaggggcttccacatcaccttcgtcaacaacgagttcaaccacctccgcctgctgggcgcgcagcagtcgcaggccgccgtggacaggctctgcagcctgccggggttccggttcgccaccatcgccgacggccttcctccgtccgacctcgaggcctcgcgggacacccccgccctgatctactccaccatgaccacctgccgtcccaggttcaaggagctcgtcgtcaagctcaacgaggaggctgaggcctccggtggcgccgtgccgcctgttacctgcgtggtggccgatagcatcacgagcttcgccattagcgtggcgcgtgagctcggcctccgctgcgccgtgctctggaccgccagcgcctgtggtttcatgggctactaccactacaaggatctactcgatcgtggactcgtccctctcaaagaagaggctcagttgagcaatggatacttggacacgatcatcgactggatcccggcgatgcccaaggacctgcggcttggcgtgacctcccgagctatttgcgcaccacggaccctgatgacatcatgttcaacttcttcatccacgaggtacccgccatgtcgcaggcgtcggctgtggtcatcaacacctgggacgagctcgacgcgcccttgcttgatgccatgtccaagctcctgccgcccatctacaccgcggggccactccatttgacggctcgcaacaatgtgccggaggagagccccgtctcccgcgttgggtcccacctgtggaaggagcaggacgctcccctccggtggctcgacggccgcccgccgcgctccgtggtgcacgtcaatttcgggagcaccacggtgatgtccaaggagcatatgctggagtttgcgtgggggttggccaacactggttatgccttcctatggaacg

SEQ ID NO: 29764 - DNA, 1034 bp, Triticum aestivum
  Clone ID: PAT_TA_29764
ctcaaaccttggtaatctccgcgccgcaaaagaaaaccctagccgccgccatggccttcctcgccggcgcagcctccatccgcagccccttcgccctcgtctcctcctcccggcgccggtacgatctacccacggccgtgaaggccaccaccaattcgaattcggttcctccccacccaatcatctcctccctccgcctcgccgcctccgccgcggtcctcctcgcggctacctcaccggccatcgcgtgcacaccgtccccgcctccgccccccgcgctcaccgtcacggtctcacccgaggacgccatccaggacgactcccaccccttcgagaagctcatcgtcgagaccgccgccctctcccgtttcggcggcgcggaggccgcgcgggcccgcctctctgccgccggaggcggcgagcaacatgcccggctcctcgcggcgcagtcgctcttcgtggacggcaaggccgacgaggcgatcgccgccttcgaggagctcgcgcgggaggaccccggcgactaccgccccctgttctgccagtacgtcctgtactctgttctgggcagggcggcggagtcggagtcgatgctcgagcgctgccaggcgatcgccggcgacaaattaagcgccaatttgacaatgccgatctcggcgaccaaggaggtggaagcaggagaggaggcagatgctgagcccgtgacagagaagacggaaacagaggcggagggggagaagctgtgagtgcagtggatttggaatcgccaaataaggtaggcatttgctcccttccattgaaggaaaaatataggatggaacgccatgatgctctaatggtacagtagaatcatacaaacggagagaaattcgaaacggcaattcctgttttgcagttctgatatgtaggctaagaattatgcaatttacatggtttgagaataagttgaagcgatcatggcaaggtgatcgattttgatagtgttgataagtacagtctatgcttatgctgtacaccactaatttgtggaatgg

SEQ ID NO: 29765 - DNA, 957 bp, Triticum aestivum
  Clone ID: PAT_TA_29765
catccgatggctgattaatactggtaaacgtggttttttttattccatgacatgacgacctggggctctgggctacaatatcttcccatgcacgcatccacttcgacatcaacatacatcacattattttggcagcattgactttgccatggccatgaacatctccttgttggccgtgaaatgggcgagcatttgcgccctgtccggcaggcacgcccggaccttctcgtcggaggcgtactccttggcccagcggcagaggcgagggaactccttggcggtgaccagcgtcaccccggacacctcctcgcacacggtgagccagtgcgcgaacccgcaggcggctatgtcgacgaggccaattgtgtcgccgccgaagcaccttttcccctcgagctgcggcaccagcagcgcgaagttctccttgatctccttcatgaaacccttttgcgcctcgccgtccgtccacatcgccagccagaacggcttcgagcactgctctccctcagccaaaatgagtccgtgcataaccacgagtaagtacaggacagctgaaacaaggtcgctactagagatactagttcaatcagggcatgtacgtaccttgtcgtcgatgaagcgggcccagaagcgggccatggcgcggtcatatgggtcggacggtaggagtcgtggtccgtcgaaggtctcgtcgacgtactcgacgatgatgagtgactcgcagacggcgcggtcgccatggaggagcacgggcaccttcttgtggacggggttgctcgtgagcagcagctcgctcttgttgtggagctcctccagtataagctcgtagggaacgcccttgaggcgcagggcgacctcggcgcggtggctgaacgggctgtcgaaagcgccgatcaccctgacggccgccggtgcgctcatcttcgctcgggtagctgtgctggaagtcaaatatag

SEQ ID NO: 29766 - DNA, 638 bp, Triticum aestivum
  Clone ID: PAT_TA_29766
acaaactcaaagcagcggcaactccagaaatatcaagcaaaatgtacaatgtttgtttacaatgaaaattagaaaaggagaaatcaaggaggctgtgaaggcgagcatttggtaggacataaacagctgatgagacacaaagcatttcctaagctggcttaaatatcctccatggtttggatgttggatcccaacaagaacggacggtggggatatcgtccatttaagcggagggcatccaaactgtgatttctttgaccttcaaacctctctttgaacagcgcgtaactgccgagagactaccggaggagccactggaccaggccattctggtagatagtagagttaccggccatgagttgcccttcggggcaaccatggacggcgaggtcgctgcccccgcatagaccagcaacccatcgaaggagccgcacgactgggccttcgtcattagtaaggtagataacagagttactaccggccatgagctgcgcttctgggcacacgccggcggcatggacttctcgatagcccgtgcgcacgcagtagtcggcggtcggtccctcgtgtatccatggcgcgttcactgcactgtctaccgtatgggtggatgcgcagccgccagtgcacgggctggc

SEQ ID NO: 29767 - DNA, 1055 bp, Triticum aestivum
  Clone ID: PAT_TA_29767
acattcagtgaccaataaattacacatttacacaatcacatttctttccactagattacaaagaaatacacctgcgaagaaacttacaaactcgaagcagcggcaacaccatagaaatatcaaggaaaatggacggtgtttatttacagtgaaaagaaaagtagaaatcaaggaggctgtgaagcgaggatttgctaggacataaacattgggattttaggcagacgtgttctgtgattgacctcacctgatgagactcaaagcatacccaaagctggattgaatgtccaccatgtcttggatattggatcccaacaagaacgaacggtggggattttaaactgtgatttctttgaccttcaaacctcactttgaactgcgcctaactgccgagagactaccggaggagcaaatggaccaggccattctggtagatataagggttattggccatcatttgcgcttcagcgcaggcatggccgctgcccccgcatataccagcaacccattgaaggagccgctcgaccgggccttcgtcgttgacatagataacagaggtaccggccataagccgcgcttcttggcacatgtcggcggcacggcccctgcagtcgccatcgtacagcaggacttctcgatcggtggtgcgcacccagtcgtcggcggtccgtccctcgtctgtgcatggcgcactgactgcactgtctaccgtgttggtgctggtgcatgcgctgccgccggcgcacggctcagcctcgcttccctgcacgtcggtgaacactgtgggctggtcctccatgaatctgtacgtgaacatgacactcccaatcccgtctgccggtggcgtggctgcttgcagcaccttgcgggtgccaggccatgggtcggcgcggctcttgccgatgagagagttgtcggcggcgaccgtgatcacgacggtgtcgcacattgtcggggcggtggcttggccgtcggcggttgacttgcaccccgggaactccaacttccttgctgctaccagtcccaggagccaagcggactcgatcttcggaata

SEQ ID NO: 29768 - DNA, 1393 bp, Triticum aestivum
  Clone ID: PAT_TA_29768
agggacttcgggtacaatttgaagtacctcttggctcttgccataaaaatttacagtaccagctaaactgcaattcatcagaaaattattatattccacgaaaacaaactacatgctttttgctctaaaagaacatagacccagaattccatctcgcagacttctctatagcttctacaaacaaacatgatgttttacaccaccagtttccatacaacaatttgtctttgcttcaagtcaataatatgtagactggagcttcaaaaatctgatggtggtgggcgaagaagcgttcttgtttacaacagagggtgcgggtttgtgcaagaattcttgagcccaagtacaactaacttgatccatgtcgttgaatcgcgacgacaacctcattacagcgttcacatctgtaagaacttgtagctgcagaccgcgtccgtaggcaataataacaatacctgtgttgacatgggagagctacaaagggaatgctaggactagagacacatataggacagtttgcttcgtcaccagaagaacttgctgatttatccttagagaaaggaagcaggaacttcttcactgaggatgagtttaagagggggagaagcaaaagcaacatttccgaaaactcattccagaccagctgccgattcatgtactcaaagcttacggctctgttcatattggggctcccatacacaagtcttgctttcagaatcctttccacgagagttttataccttccaccataaagaaacgacaacagattaaagaatgaaacagctctgtatagtccttcggcgtgctgcaccaagccccacgcacgacgtgctagtggtctctgttcagaatcaccccatcgacggaaagcagaaaaagattgcaatcgggacaataggtattggccaccaacagtgctaatacagtataagatcttctgagaaactgaaagtccaggtccttccagacctgttctgacctcttttcctgcgatgggtgctgcccgttcatctctatacctcaagttcatgagtgcattccctggggttggcttgtctacccaaattgagaacctccagatgaggaactcaaggaacgcatcgagttcaggctcatactgaaataagagtcctggcttcatcaaagagaatactttgactaactgctctttcaacatggcggacatttcaacatcaagcctcgcagcatcaaactggttgactctagatattgtaatcggtatcatggtcgcgccggcgctccggccgccggagaagcaggaggtccgctttcctaaccgggatcatggtcgcgccggcgctccggccgccggagaagcaggaggtctggccggatgaagagaagggtgtccgctttcctctcgtggaccaga

SEQ ID NO: 29769 - DNA, 258 bp, Triticum aestivum
  unsure (1)..(258): unsure at all n locations
  Clone ID: PAT_TA_29769
agctctcacaaaatattgctcaaattagaattgacaaacataaaagttaatatctcttggctacccccccgatatggcaaatcttttaccaaagtaacccgtaggaaaaaaataggagccacaaatcaacaaaaagtcacgatactcaaaagtggtatgtggtgggtgcagtgtccccatagaatctctacttatttgcaaaagcattgccctcacttgggtgtacttctatctcaatccaacctcttatatcgagcn

SEQ ID NO: 29770 - DNA, 512 bp, Triticum aestivum
  Clone ID: PAT_TA_29770
ggcgaaagaaccacacgaagtggctagaagagacgagatggcctgataggctgatacaacaaacatacaatcaagctgcagcaacaacacgcagcaagaagagaaagagaagatacaaccccatctccacgagaaacaacacaagggaattacaggaacaaaaccctccttacctgagcgaacgacgtcgaactagaaagccaagaagtgtgaatgggggaactccatgcgaggacgacgacgacggcctctcctccccctcctacggcatgaggaagaagaggaaaagctcccgctgcatcgccatcgtctcgcctctgcgtatgatgcttctccaaagatacttataccccaagcatctccatctccatctccatgccctttccaagtatctcctctgctttgaaactactcctcatcatctgggtctgtacttagaacgacgacagggatcgagtgcactgaacctggacacctagcttgtagctagcttttcgctttgttgaatggcc

SEQ ID NO: 29771 - DNA, 1203 bp, Triticum aestivum
  unsure (1)..(1203): unsure at all n locations
  Clone ID: PAT_TA_29771
tcggcacgagggccgagcccgctcgccgccgtcccctcttccgccgaggtcgttcgctccccaaatcgtcgtcgtgctgccgtgcggagatggcggcgtttgcggcgaaagggtcgctgcgggggggctgcttcacggcgagcggcctctccgggaagaaccctcctccaagtaacagcttctgcaaccactttgtgccgtcgcggagcaacgctgttccgtccatggcctggggcatgggctgcgacagaaggcaggtgaagctgaaggcccaggtgcctaagtgggttttgctgaacgatgattatctgtatgatgatcaagcattacagatcgacacaattgtttccaagttcagctgtgtacatcgaccttctcaacagggaacgttatcgggatccagtgttagggagaacaaagccggaggtaacatatcagcacaagcagcgcctggaggctgatgagaagcgcttgagagatcttgtggatggcctggttgagtccatctcatcggacagtaagaactacagatacgtcataatgtccatcaaagagaatgctaatatgattatggaggagggttttatttcctcttatgctcgagatgaaattttagaaggtcttgaaaggatagagaaggacattgaagtgggaaaattccattggagaaacaataaagatatccggtctaacattgttgaagcactcattgacatagttgaagggccagcaaaaaggctggatgcagtaataagccgttacgctcaaattcttacagtcctccaaatatggtgtcatgactccattgataaatttgttgcccagataaaagaactccaggttgagcttgttttgctagcgataagaaatgagggattggtcctaccttgcaccgctaggagtgcagactgtattctacttggcgatctggtattatcaaaagttgaacagctagaaaatgatgtctctcagctggttagctgcaaaaacaagattggctctacactacaaactcttccttcaggccgcaccgatgattctatgaacagcttatcaaagggtagtttgcatcacatatgcaattctattttgaaatttggaaaccgatcgttggtgacatccgcacatgtacagntttgaacaggactgcatcatgatgcggatttgaacaaatgatgaagtgnccaagttattgctagtggg

SEQ ID NO: 29772 - DNA, 2122 bp, Triticum aestivum
  Clone ID: PAT_TA_29772
gcaacagaaccgaccgagaacgcgaaagtgcatttccatcgagcgatcggtcggcgcatggatccgcggtgcagccagcagtgggagagctcgatggaggacgtgtcgacgccgctgctgcctctgcatgacgacggcaggacggacgggcgctcgtgctcggccctggcgtcgctgctcgccaacaagtacctcgcgatcgcggcggggccgctggcgtcggcgctcatctgcgcattcgtggacttcggccacgggcgcgccgcggcgcgcaacatgctgggcgtgctggcgtgggtgttcatctggtggctcaccgacgccgtgccgctcggcgtggcgtccatggcgccgctgttcctcttcccggcgttcggcatctcctcctcggacgccgtcgccaaggcctacatggacgacgtcatctccctcgtcctcggtagcttcatcctggcgctcgccatcgagcactacaacatccaccgccgcctcgccctcaacatcacgtcgctcttctgcggggacccggtgaggccgccgctgctgctgctgggcatctgcggcaccaccatgttcatcagcatgtggattcacaacacgccctgcaccgtcatgatgatgccggtggcgacggggatcctgcagcggttcccgcgcggccgtccggcgtcctcgtccgccgacgcgcacgaggtccggcggttctccaggcggtggtgctcggcgtcatgtacgcgtccaccatcggcgggatgtcgacgctgacgggcacgggcgccaacatcatcctggtggggatgtggtccacctacttccccgagcagcggcccatcacctttagctcctggatgtctttcggcttccccgtcgcgcttgtactgttcgcggcgctctgggtcacgctctgcctcatgtactgctccagcaacaccggaagagcgctgtcggcttacctcgacaggacccatctcaggagggagctcagcttgcttggtccaatggcttttgcagagaagatggttctagccgtttttggaggcctaattgtgctgtggatgacgagaagcctgacgaacgacatccctgggtggggagtcctcttccacggcaaagtcggggatggaacagtcaccatcatgatgaccactctgctcttcataatccccaacggcaagggcggcggcgagaagctcatggactggggcaagtgccggaagctgcagtggaacatcatcctcctcctcggcgcgggtttcgccatcgccgagggcttcaaggcgagcggcctgacggacatactctcggaggggctgggattcctgaggggcgcgccgccgctggtgatcgcgcccgtggcgtgcgtcttcagcgccgtcatcacggagttcacgtcagacgacgcggccaccaccctggtcctgccgctgctggcggagctgggaaacaccatcggcgtgcaccctctgctgctcatggtccccggtacggtcggcgcgcagctgtcctacctgctgcccaccgcctcgccgcccaacgtcgtcgggttcggcaccggctacatcaccatcaaggacatggtgctcaccggaatacccatcaaagtggtgggcgttgcaactctcgccgtcctacttccaactctaggttctgtggtttttggcatggatcagaagttgtaggaactcaagcaaaattcaagtgctctgcgcttttcaaattgtagaattggttatccactttgcctggaaagaacaggagctcggcctattgctatgagagggggaaggagttctcctgtacatttttagacaacagactgtgtagtaggatgtttaggttgtactatcatataatactccttcgtctcaaaataagtgtctcaaacttagtacaactttatactaacatttattttgggacgcaaggagcatacactatgtatagcaaacaccattgcctcatgtgttttttgaacagtgcccctgtgcactagattgggactccacattgcctcatgtggttgtacactgttccaatcccacgcacgtttcaacatctgtatggatcacctcagagaggggtcggagatgtgtactgaattataatttctcagatgtcctgg

SEQ ID NO: 29773 - DNA, 885 bp, Triticum aestivum
  Clone ID: PAT_TA_29773
ggtctcggcagcacccaatggcaggctgaatgatgtggtggcatctccaaaccctcaggtgtcgtccgcagggcagtgggcaacaatagggcagcaggagtacaagaatgccaacatgtatgctggcgctgacccctacgtagtattactacagaggctgggggattattcagtctatgtgggcgttgacggagcagagtcatttaaccctggaaatgtgctagcaagggtatgatcgagcatgatggacatgatggatggcaggaaatagaactatagaaagggagatctcgtgaagtgttttggcgaatggcgatgcaatgcttgtgctcctggtagcaggccaatgtggttggatgagctcagcacatcaaatggtgcaatcgagttgtatgccaaaaaatgattgtcttcgggatgccaagttgtctctagaggagggtggatcccttaactgtgagataatttcaagccgcaagataatggcacagacccaagcatgttgtgcttcaagatgaggagccaggcctgacgacaaacacatgaagtggtggtgcgatggaagaatacggcttggacaattccagcgagatgtggctcgcgtggatgtcggcgatgcagcaatcagaagatcctttggtttgactgctcccatgtcctccaatccttctgttttcctagaatttttttctctttcttccatgagtagggatttaatcttttgaagtttgtacaaggggtttgctgaccacctgattgccattcctcttctccttgcctatcttttggagcatgttaggctttgatttcaatttaatgttgtgctctatcatccaccttgtaagactgtcacatactatatgataatatggacctattaacttg

SEQ ID NO: 29774 - DNA, 794 bp, Triticum aestivum
  Clone ID: PAT_TA_29774
gagctccagatcaagcagctacttgatcatttgatctgtgcttagtgatcactcggcagcaatggcaggcaaggcatccatcgcgctgttcctcgccgtgaacctggtcgtgttctccgtggccagcgcgtgcgggggaaactgcccgaccccgtccacgcccaccccatcgacgcccaccccgttattgggctcgctcggcaggtgcccacgcgacgcgctgaaggtgggcgcgtgtgtcaacgcgctgaacctggtcaaggtccaggtgggcaggccgaccgcgttgccgtgctgcccgctgctggatgggctcgtcgacctggaggcggccctgtgcctctgcacagtgatcaacgccaacgtcctcaacatcgtcaagctcaacctccccatcaacctcagcctcatcctcaaccactgcggcaagaaagcgcccaccgggttcatgtgctaagcgatctagcaaggcgtgccatgcagcccacgcatgcgttggctgcatgcggccatgcggattagtggtgcgagaggggcattatctcattattctgctcgatcagtcgttttgtttcagccggttacgttgtttgtttggttttgctacttgacgtgctagccacaagtctgcatatgcatgcatgctacggagagtacgtatgtagactgtttaatcatttttaatgttctttttattgttaatctctttctttctttcttggcgagttctttcatggcttatggcttgtattcgttttgtacgatctgcatgatgaataaagtttttccttact

SEQ ID NO: 29775 - DNA, 917 bp, Triticum aestivum
  Clone ID: PAT_TA_29775
gagccctacagccagaactccagatcagctacttgatcatttgatctgtgcttagtgatcactcggcagccaatggcaggaaaagacatccatcgcgctgtttctcgccgtgaacctggtcgtgttctccgtggccagcgcgtgcgggggaaagctgcccgaccccgtccaccccccaccccatcgacgccccccccgaccccagcctcgctccgcaggtgcccacgcgacgcgcggcaaggggggcgcgtgtttaaacgcgctgaacctggtcatggcgcaggtgggtcaggccgcccgcgtggccgtgctgcccagctgctgggatgggccgccgtcgacctggcgccggccctctgcctctgcaccgatgatcaaggccccaacgtcctcaacccaacgttcccagcaaccacctccccctactcaacctcagcgaccagactccagcccacccgctcgatgaggtaagcgatcacccggattcgtgtgtgcagcccatgtagaaaggtgtgccaagcggccatggcaagatgtgccatcgtggccaggcatgcgttggctggattcggctttgcggattatgtggtttctaataggtgcattattttgcttgttcagtctcggtcacgttgttttgatttgtttgtattgattttacactaccttggcaagcctccaagtcttgcatattcatacgttctactgagtatacttgtttggatcgttttttttattttcatttttactgttaattaatttctttcttcccttggttactttttttagcgagtactgtcatgattttatggctagtatccgtttggtacaatctgcatgatctataaaccaattttctttacaacgtgcttccggtggaagctgtaaaacaaaaaagccgtaaaatccgcccgatt

SEQ ID NO: 29776 - DNA, 590 bp, Triticum aestivum
  unsure (1)..(590): unsure at all n locations
  Clone ID: PAT_TA_29776
ggccggaggtggcgccgctcctcccccgggacccctacgcccgcgcacaggcgcggttctgggctgactacatcgacaacaagatcgttgactgtcagacccgcctgttgacgatgaagggggaggcccaggagcaggccaagaaagacatgattggggcgctcaagaccctggagtccgagctcggtgataaggactacttcggcgacgagacgttcggttttgtggacatcgcgttcatgactttgaccccctggtttaacacctacgagaagtacggtgacttcagcgtcgaggaacactgccctaagattgtggcctgggccgcacgctgcagggggcgcgacagcgtggccaaggcacttactgatcctgagaaggtgtatgagatcgtccaggaggagtatggcaccaactgaacaaaataataggttatctatgtaggcatgcatgtaatctggttatgtgccggctgtggcatttatctcccacgtgtgtgttccctttgtcactcaacttgaccaaactttatgaaaatatacacactatataaaaaaaaaaaaaananannnannnnnnnnnnnnnnnnn

SEQ ID NO: 29777 - DNA, 381 bp, Triticum aestivum
  Clone ID: PAT_TA_29777
ctcacggtcgacgggaaactcaacgtagactcggtttgcggtgagtggcatgccgagcgaccgtgtggggtcgagccgtggaggagggtgagacacgaacacgacagacgtgatttaaatgttggttttgctcgatggcgcgatccaacaaaatgaaacgttggtttctctccatttccattttttctacggaaaaacggaaactatccactccattttcattcctattccaaggttgccccgttacaacattccatcaaatacaaaggaaaactaaccactacaagaaatatgtcaacttgtgaccttgactattggtcactgaaaggtcattgtttttcatttgcgacctttttgttaccaaaaatagaaggtcaaaag

SEQ ID NO: 29778 - DNA, 1311 bp, Triticum aestivum
  unsure (1)..(1311): unsure at all n locations
  Clone ID: PAT_TA_29778
gtactctgcaaaagtctcctcatcaaatgtttctgcggcaacatctgctaatccatcagaggttagcaggatatttacaatggggttgccgtatacagctcatcatgcaggacaaatactttttggacctacagatgggtatctgtattttatgatgggggatggtgggaacaaaggcgaccctttcaatttctctcagaacaagaagtcacttttgggaaaaataatgaggcctgatgttgacaatgtacaaagccagaagcaaattggtaaccagaccttgtggggcaactattcaattccaaaggacaatccatttgctcaagacagtgacttgcaaccagagatttgggccttggggtttagaaacccatggagatgcagttttgattctgagaggccttcctacttctactgtgcagatgttgggcaggatgcatacgaagaggtagatttgatctccaagggcggaaactacggatggcgtgcatacgagggcccgtatgtctatcatccagaatggacacccggagggaacacatcacttagttccataaatgccatcttccctgccatgggctacaaccattctactgtgaacaagaacgttgggtctgcatcaatcacaggtggatatgtgtaccgtgggtctacggatccctgcttatatggaaggtacatttacgccgatctatacgcatcggcgatgtggaccggcttggagaccccaccgagcagcgggaactacacgtccaccctgacgccgttcagctgctccaagaactccccgataccctgcgagtccgccggcggggccggggccggggccgctctcccgtcgctgggctacatattctccttcggcgaggacaaccgcaaggacgtgttcgtcctggccagcaaaggcgtctaccgggtggtccggcccagcctgtgcggctacacctgcgccgccgagaagccggcgaccgataatggaacttcgccgccgccttccggccctccgtcgtccctagcctcggcgacgcgagtagggacgccgatggccgtagccctggcgtccgttgtatatgcgctgtacttttgagctccctccatgcgtttttgtaagattgcagcatttttttcacgcaaacgctcatagcacacacgcacgctctcacccgtatgaatgcacgcatgcacatcctatcctatgagcagctccgagaaaccaagccggtttcatatcaaggcaagatgtgtctgtagcctaataaatgaagtgttgcatgttaccananatnagtaannaaaaactcccaggggggg

SEQ ID NO: 29779 - DNA, 853 bp, Triticum aestivum
  unsure (1)..(853): unsure at all n locations
  Clone ID: PAT_TA_29779
ggtaacgcnaggtttccaagctcccccctcccccaagcgtccgcccacgcgtccgttcttcccgttgccgccccttcccttccttccttccggcggccctggtggccggcaggaggatggtgtaggtggtcgtgctcttcttgtacatattaggtctaggtttagttcatgtcttcggctatatgctagtctttggctacatgccggtcatcggctctatgtcgggagggagatgccaggtctaggggcccggatctggtattgctttgtctctctgctccttgttgcggcgctcccatggacggagccagaggtgatgaggaggagagcacctgaaacctccaataataaaaaggttgttgtggtggagcttgggttctgggtgcctctccgcgatctcgtcgtcgcggtggcggaagatggagaggggtggtcgaatatgagttggagatcaccacatgacagccacgatctgccgccatgacctttggctgagaaggcggcctttccagacgcctttgagagcgtcatctcaacctcctccaagacggaggccctctgtgggattcccagcggcgcgcagcggccttcctctcccatgtggtttcgtccccggcgagaaggaggacggtcggcggtggagtccctgttgttgtggtggagaaggacttgattgcttttcgatgttactttttagggtcctttgtgttaatttccaggactgttgtgtaacttctagttctttcgggatcctgtttgtgtattgtactccaccgacgatgaacgaaagacagcactaggcccttctgggcctttcccctgttcaaaaaaaaagattcggcaattgtnaaaa

SEQ ID NO: 29780 - DNA, 662 bp, Triticum aestivum
  Clone ID: PAT_TA_29780
ctgaatgtctcgacggcggggtcaatgctgtacggcgccgcatggccgctctccgggcagaccaagatcacgctgacgcccgccccggggtcgccggtcgggccggtgatcaatgcggcggagctcatgatggttgttccgctcggagggaggacgcatcctagagatgtgatcggcatggaggggctcgcgagaggcttcgccaacccgccgtcggactggagcggcgatccttgcttgcccgtggggaactcgtggaccggtgtttcctgcagccaaggcgcacttgctcgagtaactgctctcaacctcaccaatttcagtgttgaagggtcgatatctgaccgcattgctaatctgactgcaatctccagtgtctggcttgtggggaacaatctgacaggacaaattccagttatgagctccctgcatcatttggcatctctgcacctggaggacaaccaattggcagggccgattcctccgtcactcggagaccttccaagacttcaggaactctttgtgcagaacaacaatttacagggcagcattccgatcggcctcaacagaacgagcattacgttcaagtacacacctgggaataaccttaaccaacaataatgccgcaaggaacagaacatgagatgtttatgggatagtga

SEQ ID NO: 29781 - DNA, 2210 bp, Triticum aestivum
  unsure (1)..(2210): unsure at all n locations
  Clone ID: PAT_TA_29781
gggtcgaacgagtttagccgcagccgcagcctcggcctcccttccgcctccggtctcctcccatctatccggatcgccgcggcctcctctccccggatcagcgctgccgtcggtcggagagcctccccctttcccgcggcggctcgaggatggacggcgccgggggcgggggaggagggccgcacccctcccggaggagcatctcctcggccgccggccccaggaggagggggccgtccatggagaacggccacgacgccgccgccaccgccgccaggaggtcctccgccaccattctcccgcaccacctcgacggtgactggggagagaaccgttaagagactgagactgtccaaggcactgacgataccggaccacaccactgtgtacgaggcctgtcggaggatggccgcgcgtagagttgatgccgtgttgctgacggactccaacgcgttgctctgcgggatcctcactgacaaggacataaccacaagggttattgctcgtgaattgaagctagaagacacaccagtttctaaggtcatgactagaaaccctctctttgttcttggggacactctcgcggtcgaggcattgcagaaaatggtgcaaggtaagttcagacatttacctgttgtggacaatggggaagtcattgcgctactggacatagccaagtgcctatatgatgctattgcacgaatggaaagggcagctgagaaaggaagagcaatcgctgctgctgttgagggtgttgagaagcattggggaacatctgtagctggtcccaacacgtttgtggaaactcttcgtgaacggatgtttaggccatcactgtcgacaattatatctgagaattcaaaagtggctactgttgcaccaactgacactgtgttgactgcatcaaaaaagatgcttgaactaaaagtaagttcagcagttgttgcgattgaaaacaagcctggcgggattctgacctcgagagatatattgatgcgtgttatagcccaaaatcttccacctgagtctactacagtcgggaaggttatgacccagagtccagaatgtgccacgattgacaccccgatccttgaagccctacacacaatgcatgatggaaagtttctgcatttgcctgttctagacagggatgggagtgttgtaaccgttgttgatgtccttcacataactcatgctgcaattgcaacggttggaaacagcggagcaacaggctctgaggcgacttcttccatgatgcagaggttctgggattcagcaatgtcaagtgggcctcttgatgatgatgatgattccagaagcgaaggatcaactaaagtggcatccgaggcagcagatataggaagatcagccttctttccgccttcaggcttatcaaacacttttgggttcaagattcaggacaaacaaggcaggatgcacagatttaactgtgaaacgagtagcctggctgaattgataacttccattctgcaaagacttggcgacgacattgataaattgaacctacctcaaattctgtacgaagatgatgatcacgataaagtcatactctcatcagacactgaccttatagcggctgtggaccatgcaagacaaatcggttggaagagcttgaggttgcacttggattacgccggtgttggccgccggaagcgaggagccgtctcgtcagacttcgaatatgccggaagggacgcgtgggcttccgcgtacggcaccgtcgctgccggcgcggccctggtggctcggcctcggcgtgatggcttacctgaaaagagcgggctaggcgcgacgaacacggttgtcttggtgatacatacaggatgttactacattgaaatgaacagaattggacctagaaaaaggaaatttacgagagtgggtgtgcgattgattcttgcgaggaaaaatgggaacctgtaataatgtcacggcagcggatggactgtggatcaaatcttggttgttgagtcagtcccgagtctccacggggtgccacggttgtcccccccagccccgcccctcgccttcgcctttggcatttgaaacataatngcatcggtccanttntanaaaaaaanggggggcnggtancaatncnccaaacngatcgataccgngccanggcgtcgttaaantcggacggaaanccgggttacaantaaccctgnanaatcccntcncactgg

SEQ ID NO: 29782 - DNA, 1432 bp, Triticum aestivum
  Clone ID: PAT_TA_29782
ctttttttttgtccgcacataacagatgcgtgatcgcaacacatgcaacaggaaaatatatcacaacattacagaggaaaacagtcgcgattgtgtgcaagattctacttattctacatgcttccataaggatccgaaatgtgccaaccgcggagatattacttgaaagagctctctatgtcgattacaaaccggtacctcacatcccggttgaccagcctctcaagagcctcgttgatgtagtctatttttatcaattcaatatctgggtagattttgtttgccgtgcagaagtttatcatctcctgggtatccttcgtgcctccagttacactgccagatagagtccgtgcacccagattaagtgtcgcaggatgcactctgatttctccaggaaagccaactagtgccattgtgccacgaactttcagaagcgcgagtatacgggtcaaatgggtggtcaccagaggcagtatcaacaatgaagtccagagaatttttcagggactccatctgacttttatctgatgataccacaaaattatctgcaccaagaaggttgattgcttcatctctctttgattcacttgtgctaagaacagtcaccttcagtccaaaggctttcccaaatttcactgccatgtgacccaacccaccaagaccaatgaccccaagtgactttcccggctggttcatgttatgtcgcatcatcggagtatacacagtgattccagcacaaactaacggtgcggccttctccagtgggtagccatcaggtattttatagcagtacctttcatgaactacaatgtgactggaatatcctccctttgtgacagtaccgtccgtatcaacaccattgaaagtgaaaacaaattttgagcagtggttctcgaggaagctattgcagttgtcacagtcgcggcatgagttgacatatgtcccaacagccacatggtcgcccagtttgaagcccttgacatctgaaccaacctcagttacaactccagcaatttcatgcccagggactaaagggtacaccgagtcattgtgcctattttttgtccagataacatcagcgtaacagacaccacaatgcgtgatcctcaaagaaacatcgtcatgtcgtacagtcctacggttgaaactgtgtggggagagtactccagaaggatcttttgccgcccaggcactgcagttgccactctcggtctgggattcagcagccatgccaggcaggcaacaaaactcgggaggggatcgggagaagcgggcagtggggggacggcggacggaaccaggagccagccgatgcgcgcggggagtctctatcttttccggtgccggtcagtgcagcggagagcggcgggggaagaggtgtgaatgaatagatagatcccccgggccggcgcacccgcagctaggggagatc

SEQ ID NO: 29783 - DNA, 1089 bp, Triticum aestivum
  Clone ID: PAT_TA_29783
caaaatatcagttttctgcaaactggagggagtgtgatttctgcctttgattctagcagattatgtcaatttatatttacacattgtcaaacaagctattttacacacaaaaccgtcaccatacatgatccctcttttttttcatctgatccctcttatttatttaggcaaacaccccaatgcaaccttaggttagcaaaagagagatgcggtatattagcccccagaacaaacacaagaaaaaaaacacgaaaagatggaaatgcctcttgaattccttgttaatcaacctccggctctttttccaggcaaacagatgagcagcggctgtgcaaacgttgcagattcaccatcgaaaacgacctcattggcaccggcaatatcttagacatgcaagacccaagccgaggtgtggtgatcgctggagaagcaaattgtgcagtgttatcaggtgactgaacaaaaatgaactgctgaggcggctcgttttcgtcgctgctgaggctgctgctactgctgctgttggagctcataccatccgagggcctcaacctgcttaaacccgcaagcctcttagtgataccgttctcgtaggtctccggcacggtgatctgtgactgattgtacatgatgctgtatgcaagaagatttttccgtttcctggaataagcattgtctgccttggcaatgacctttgcagaaccagatggcccgatagcttccttgaggaatgtgaaagatctggacttgccgttatagaatttagagatgccacgccggatgggaagcgactcctccaatgcggcgaggccgtcgagccccgccccgctgtaggcgctctgcacctccccctccccgtcctccttccccgtcggcgcgccgccctcgtcgctgtcgttccccagcgacgacgacgagctgcacggctccggctgcggcggcatccgcctgatctggaaccggcgctgccgatccgcccggcgacgagaagaggcggccgtgtgcgcgcgcgtgcggattgattgatcgccaacgggaaggagaagaaacggcccctctcgcgtcgtcgtcgtcgtcggtttaaggaga

SEQ ID NO: 29784 - DNA, 563 bp, Triticum aestivum
  Clone ID: PAT_TA_29784
ggcaatgttctggggctcttactcgagcacttgctctcaaactttctggaaggctttggctgaaaacaaagtaaaaaaattctgttgacacctgtcgcttgggaggattctgaccgtggacaagctgatccagagaggatggcaaggaagcgagatttgttcgatgtgcagttcgcgggaggagtcagtggagcatcttcttctgaacttctattttgctcgccaattttggaggaggatcgcggcttggtcttgtttcgatttgagacattatgacgtgaagatggcctccgggagggcacggtttactcttggtggctggagcgagcctgccaaatccttacgaccaactagcgaaagtttgatgggactgttgcttacactttttggcagatttgaaaagataggaatgagagagtttttgacaatgcttatgctggtgtcgaggacactttctttggaatttaggagtccatcctaacgagagagttggcatttgccacagtgatactgtatgatggaggctaaggccatcatatcgaattgtaaccaggtttcagcct

SEQ ID NO: 29785 - DNA, 779 bp, Triticum aestivum
  unsure (1)..(779): unsure at all n locations
  Clone ID: PAT_TA_29785
ctccaaaccctaaaaaaaaaatacttgtggaattttccccgagcggaagggggaaaatgcttcgaggcgactgaagcggcggcgggtcggagtgggcggcggcggcgcgacctacccggaggaggagggcgttccagcttccacggcctgccacggatccccatccctctcctccgccgcctcactccggagaagcggaagctgccggcgtcgagatctccaggttggctggatatggatctaattcttccatttaaaattggagattttgccgaggcaaagtgctttgatgaaggtttcaaaggcgcatggtttcgctccaagataaaagatatgcgtgtcacagaatctgggcatcttgagtattacttggagtatattgactatactgaagaagccaacgaatggattggagtcttccaaaagaacccattcaaccaggcatgcctggaagggaaatcaaatggcagtactgaaataatgttgcgtctttcctttcctcggtggtatagggggcaacaagctcctaagcactttccgaagagcgaggtgatagcacgtgtccatgatacctggaaagtaggtgattgggttgactggcataataaagattgctactggactgggcagattattgagctgaccagtaaaaatgtggttgaggtaaaattcttggaccatcccatgggtgaaggccagcagtgtcttgctaagaaaaaggacctgangcctgcgcttgattggtccatcattaaaggctggactgtacctctttcggc

SEQ ID NO: 29786 - DNA, 839 bp, Triticum aestivum
  Clone ID: PAT_TA_29786
atagagtaggaacctctcctccccgcatctacgctcagagaagcgccggaggcagtcatgaacgcgattcggtcggccctcgcgagggcgctctccgccccgaagccccggccgctgctagcgcgccactacgcctccgtcggcggcacgcagccggagagggtggcggcggagatggtccgctacgccctcggcggcgcacggcatcagagcccgtcagaggacgcgatgcggatactggagcagggggcgtcgaacctgcagggcggcggcgagggcgccgccgaggccgtgagcatgctcatgctcgccatgtccacgctgctctacaggagtggaagacgtgaagatgcaatggaaaagctcaaagcaacccagcaagtcgctccttctgcagctttcagagttgctgcatgggaagcactaatgggaatacgcatggaagcaagccaggatgtctcctcatcgatgtccccgaatgattcggttgatttgtcaatcaaagaagaagaaatcaaatggtctgatcaggaccatctgaaatttcgggttgatgcaatcagaggacttgctgctcttctaaatggagagatagactcagcccagacgctctttggtgggcccaacagctgctatgctgcagtaggcaataaccaaacagaaaatgctgtctttacatatggtgaatatctgcactgtactggggattttcctttggcaacacaaatgtatgaaaaggttcttgaggcagcaagcagagaagatatatttggaaatctgttagcagctggaaatatggctcctgaggaggtttctctggggtgcacttgctcatacgg

SEQ ID NO: 29787 - DNA, 1843 bp, Triticum aestivum
  Clone ID: PAT_TA_29787
cccacgcgtccggactgttactactggggaagagtgacagtactgtcgatgttttgaagtcttggctaaagaaatcgcttgactacctgaagagtcaatgataacaaaattttgagacaaaatggccatgcatttgtgcgaataaaaggctttgttctgtatattatgctttcatgggagcatataggtacctgctccattgcatatgcatggtttcaactctatgaacacaccactgtaacttttgacactgttaatttctaagaaacgcttgttaacaccaacaaacgaactggtcatagtttattttaccttttcaagggatgtttgagcataaactttttttttgatgaccccattttttgacactattttcattggaatcctctaatcttacccatattttctcttgtccacaatggcagcgtggtcgcggccgagtaaggtcgcggccgacgactcggtggagcccgcgtaccgctcggacgttcgctcgccgccggggtcctggattgacaggaagctgctggtcgatcccaagatgctgttcgtcggatccaagattggggagggcgcccacggcaaggtctacaagggcaagtatggtgatcagattgtagccataaaagttctcaacagtggcggtacccccgaagaaaaagtaacacttgaagatcgtttcatccgagaagtaaatatgatgtgtaaagtgaaacatgataatcttgtcaagttcattggagcctgcaaggaaccattgatggtgattgtgagtgagctgctaccagggatgtcgctgaaaaattacttgaacagcatccggcccagccaactagatatccatactgcattaggctatgcactcaacatagctcgtgcaatggaatgtttacatgccaatggaataatacacagagacctgaaacctgataatttgttgcttactgcaaaccgtaagaagctgaagcttactgattttggacttgcacgagaggaaactgtgactgaaatgatgacggctgaaactgggacataccgatggatggccccagagttatacagcactgtcacacttcaacgtggtgaaaaaaagcactacacaaataaagtggatgtgtacagctttggcatcgtcctctgggagttgctgaccaataaaatgccattcgaaggcatgtcgaatctacaagctgcatatgctgctgcttttaaacaagtacgcccagctttccctgaggacaccccccaggagctcgcgtccattgtgcagtcatgctgggtcgaggaccccgcggtgcggcccagcttcagccagatcatccgcatgctggacgctttcctcctgacgatccctccaccacccctttcggaggcagacgaggacacggcggagtcggaagacacagcgtcgtcgctgagcagcaagagctcctcggtctcctccatcgtttcccgcgcgacaagcaagctctcggtcgtccgccatctgtttgcctcgaagaagggaggcagcaatgggaaggcatgatccgcgtccgcgggtcatgcccctgagacgtttttccttggtgctgtaaaggtgttagcctaggttaatgatgatacagtggtggggatgatgatacaagaagagggatcttgtttagcctagggtttagtttgcttgttttgtgttttgatgatacagacgaaaaaagatgaaatgcaacttgtgcaagctatgtgatgtatagctggcggctgctctaccataaacttttgtatgctgccattgagcaatccaatcccctcttgttttcaaaaaaaaacctcggccgcgaccacgctaatcactagtgaattc

SEQ ID NO: 29788 - DNA, 614 bp, Triticum aestivum
  unsure (1)..(614): unsure at all n locations
  Clone ID: PAT_TA_29788
gtggcgctagatgctgcctgtgcttngaccctttgtccatccaggacatgtcattcatcgtgttctattgctgccatgcgtatcatcagtcttgcctcgaaggcgggctggactcgatgaaatcaaacagcaacgcccgggacagcgacgatgggtcggaggacgacgacggttccccgtcgggcgagtctagaatgcggtgtgtgctgtgcaccacagccgccgcataagttatactccctcattgagctgtccatattctgatgtgttgtgttgtaagttttgagccctgtaattattgcattgcgctcttctggggttgatgcatatgtaacaacagtaggttgttgattctttgagggggagctgtgtgcgtcctcggcatgggttttctgtaaatttggcgtgctacctgagtttgagcaaggttgtaacggcatttcttttttcctcaatgccacgcttgccagatcatgcaatgttcatgaagacttgttgttttgaagaaagtgggatgagcaattttatttttggtgtaatatatatttgttttcctatttgcaaacaactttttctcccccggaatgtttcaagctgaagtgtgatnctggtgt

SEQ ID NO: 29789 - DNA, 1021 bp, Triticum aestivum
  Clone ID: PAT_TA_29789
aaacgctaaaaaaatgcaaaaacaatattaaaaaaactgggatatgtttcaagtttaatgatttttcaaatttcaggttagcattcaagtttaattgttcagggtccaggtggatcaagcaccagggttaataagtataactgttatctatttagctagtgcttgttgtggtttactaatgagcattcgcgtccggggactttgatccaacttcagccgatggggaaacggcaagggatgcaccggtatctggacacgtgatggacccagtagtaaatattcctttgtggaaggctttggttatacctgggtggcaaagcgaagtttctggtgggtaggtgtctaaaacaaccctctgcaaggaagcacgcccgtatcaatcctttaatcggagactactaaattagcacaccagaatgcagatttaggtgttcctttccaaagttacatactggtgaatttgttcggattcttgatcatataccttgaaataaaataaactgatgaatctgcccttgtttctcggttctttcatttcttgaaaattcttcaacttgtgagtctgatctcaagcatccttcgttttacacttgaaatgcagcatttagtacttcggttgatggcctcgcctgcagcagcagcagcagcagctgagttcactcgggaaactgttcgccggtcgctaatcgcaatctctcagtgctaatcgccggtcgctaaccccaaggccaacccaccaagccccacccctggggcaaacgcatatcgcgacgatggggcggcgaagtgcagatcgaagctgatctcgatctcgtacccgtccactcctgatgccctatccacgccgtgccccccgaagaacgctgcaaccgtgttatcactgacgcctaattaagcgtgcatacataagtgtttttcttcttctgaagttcttcacccttctgctttcttggtctgggtgtggaatggatgtactccggtgcttgtgtttcctgtattcaaactgaaacatttgggaagg

SEQ ID NO: 29790 - DNA, 814 bp, Triticum aestivum
  Clone ID: PAT_TA_29790
accactagcttcgttggagatccatcaaaggaactaacgaggctagaggttggttcttctagcaaacttaggggccgcaagtgtctggccatttcctggccttgcaccatatttccagccgcttggacgacgatctctcttcgcctctccgtcccccccagcccccaggtctcctcctccgctcggctccgtgccttgccgaagacgacgatctctcttcgcctctccgtcctccccaggtctcctcctctgctcgtctctgcatttagtacttcggttgatggcttcgcctgcagcagcagcagagttcactcgggaaactgttcgccggtcactgatcgcaatctctcagtccctccctgagacttcgctcctgaaccccaaggccaacccaccaagcaccacccctggagcaaacacatatcgtgatgatggggcagcgaagtgcagatcgaagctgatctcgatctcatacccgtccactcctgatgccctgtccacgccgtgcccccagaagaacgctgcaaccgtgtgatcactgacgcctaagcgtgcatacataagtgtttttcttcttcttctgaagttcttcacccttctgctgtcttggtcttggtgtggaatggatgtactccagtgcttgtgtttcctgtattcaaactgaaacatttgggaaggaaatggagacaattgtacagtgaactgtggtatgatacacgaacagctgctgtaaacgagtttgtggttccaatttcttgcaatctcatagtctgtggcgattaaaaaagaaaaaaaaaaaaaaaaaaggccccta

SEQ ID NO: 29791 - DNA, 430 bp, Triticum aestivum
  unsure (1)..(430): unsure at all n locations
  Clone ID: PAT_TA_29791
cccctggcaagggtatcctcgctgctgatgagtccaccggcaccatcggcaagcgcttcgccagcatcaatgttgagaacgttgaggacaaccgccgtgccctccgtgagctcctcttctgcacccctggtgccctccagtacctcagcggtgtgatcctcttcgaggagaccctgtaccagagcaccaagggtggcaagcccttcgtcgacatcctcaaggcgggcaatgtcctacccggaatcaaggtggacaagggtaccatcgagcttgctggaaccaacggtgagaccaccacccagggctttgatgaccttgggaagcgctgcgccaagtactatgaggctgggggccgcttccccaagtggggntgcaatccttaaaatcggggccaacgggccatcacaagtctccaatcgaacaaaaacgg

SEQ ID NO: 29792 - DNA, 1001 bp, Triticum aestivum
  unsure (1)..(1001): unsure at all n locations
  Clone ID: PAT_TA_29792
ctcgttctttcccacgcagctgccgccgccgctggggttggcttgccgccgatgaccgcaccaccggagaccatgggcactcgggaaacggcggcgatgaggagggtcggcccttggcgcagactcccgtccccgatcgatggcagcgtcacatccctccgtctcgcggggcagggcctcccgtccgcgccacgatgccgccggcatggaggcccggactcgggcagccgccacggtgtcgggtacgccaagtcgaagatccgactcaccgatccgcaagtagcagctggattgggggtcgtgtctgcccaggggcgccgtcatggggtgctggtggtgttgccgtcgagggcggcgatgaggctccgcggccaggatgtcgccttctccctcggcttcttctgcgcccgattcattctcgaccgccttgtctacaaggtttgcgggttagtcggcgtcgtgcccgtcaagcccgccgcttggtacggggacgaggaggaagaggaggcaagagatttgttcggctccaacaacaaggagtacgtcaagacccgcgtagcaactacctaattccaggtcggcctctcgttactgaattagccgctagattctccggggccaagttatctcctcaatatttggtgagcaaaatttcttaggagattgctacacaaccctacccagtttgtgtgtgattggctggttttgttgctcgtggggctctgggagctgcagtgaacgttttgtctgtggcagaattaaccttctcgcttgagtacatgatgaactcttcatgctgcagacttgtgtttgaattattgttccaaatttcagcagtgtatgtcaggctaagtagagcataatgttggattaaattctctgctagcatcttctggttcttgcttgattntctagagtcagagagactttgttacanaagcattaagcagaactactgaagagagtagaagacaaaccctgaaaccattatataattgggt

SEQ ID NO: 29793 - DNA, 925 bp, Triticum aestivum
  unsure (1)..(925): unsure at all n locations
  Clone ID: PAT_TA_29793
tcgttcatagctacttcatgtaagcctcctcctctccacctacaaagcaggagctcagtctcaggtgctgggatagctctgctagttcgtcgactttggaaatggccaccaactcgaggtcgaactccagggccaccttctccagcgagatccacgacatcggcacggtgcagaactccaccacgcccagcatggtgtactacaccgagcggtccatcgccgactacttccctcctcacctcctcaagaaggtggtgtcggaggtggtgtcgacgttcctgctggtgttcgtgacgtgcggggcggcggcgatcagcgcccacgacgtcacgcgcatatcgcagctcggccagtcggtcgccggcgggctcatcgtcgtcgtcatgatctatgccgtcgggcacatctccggcgcgcacatgaaccccgccgtcaccctcgccttcgccatattccgccatttcccctggattcaggtcccgttctactgggcggcgcagttcacgggcgcgatctgcgcgtccttcgtgctcaaggcggtgctccaccccatcaccgtgatcggcaccaccgagccggtcgggcccgcactgggcacgcgctggtcatcgaggtcgtccgtcaccttcaaacatgatgttccgtcaccctccgccgtcgccacgggacaccaaagcggtgggttgagtttggctgggtttgntgtccggtcctcccgtttgcattactccatcttccgncaagggcgtgtcaagtggttncatgaaccccggcgaaggacnctgggccccggcgctgggcaacaacgctacccgggctctggtctattcccnggggcccntctcgggacctcaacngggctggactacactanatcgctcnaggaccgcccaaggangcccaanaacctctcctnaagnccggg

SEQ ID NO: 29794 - DNA, 1454 bp, Triticum aestivum
  Clone ID: PAT_TA_29794
ctcaggtgcggtggcaggccgtgtgtggtgggcgtgttcgggtccgggcgagaagatccgcggctggtacaaggccgtctgtcggggatggacggcgagatgggcgaggacctgctggcggagatcctcgtccggccgacgctcaacgcgctcgcgcggtagcagagggtctccacgccgtggcgggtgttcgtccccgtacacgaccaccgacaggtagttccgctcatcccgtcccgcgtaaagatccataacgccaagtgcgaagacggggtggggaatccgctcgtcactttcgctagctgagggatgcaacgcttatcgggatgggagggcggtcacttggcagtggtggactagctgtgcttcttcccgtacaaagccgagtccagcatcatcgacggctgcaacgaccttctgctcaacaatgcgtcctgcccggcggcgttccacgtcgtgaacccgaccgggcggcggtgggcggcgcttccggagccccgcaggaagacgctgctctccgtgctgtccttcgatccctgcgcctccccgcactacaaggtggtctgcttcaccgggtggctgccccggggcgcctccgtcgaggtgttcgactcggagaccggcgcgtggggcgagcacgagctcgacttcggcctcgacacccgacgccatgtcggccaccatgcactgcttcgccggcgccgtccacgtgttggcatactcgggccacgtcgtccgcatcgacctcgccaccatggcgtgcacggtcaccgcgctcccggcgcccgtgagctaccgggcgcgcgcgggccactgccgcggccggctccggtacgcgtccagcgacggatcgcgcctcacgctgtgggagctggtggacgcgggcaagtccgagtgggtggcgaagcacgagctgggggtcggcgacctcgtctccggcggctcatgccaccccgctaccgcgacctttgtgttcatggcgttccacccggagagggaggtggtgtacctgtggacgccgtcgaagctcatcgcgttcaacatggagcagatgcgcgtcgaggaggagtgcgtgttcgggtccgggaaagaagacgcgcagctcatacaaatctggctgtttcccttctcgcgccatttggccagctgcttggcctgagtggcgatgccgcacgccacactcagcagctgaggatgtgatcgcctccaagaatgtgggtccgtttactagtctacagaaatgtagttgcgtccaacactgcacaaaaaagatatgtagcaaagtccaaatgtgggatgcacggtacgattatcgttttctatatttgattgatgcaatgcttgtttagtagggcaatctatttgcattctgtaataacggccttgttcaattacttgcctatttgatatactatattcattttcttcacatttaattgcctaaaaaaaaaaaa

SEQ ID NO: 29795 - DNA, 660 bp, Triticum aestivum
  Clone ID: PAT_TA_29795
gcgtacacgaaaacacatcacaaagaccaacttgttgattacaactcgagatatggtgtgggaaaacgacccaattcctatccaaacacctttggattactccagcatatacatgtattcaacacaaactcaacatattacacatgataagcgatagtttacatgagacaattgggtattacatggtatccacatcaacaaacatcacattctggctgtagtaaccgtgaacatgatacacagaaaaagcacacagtgtgctttagtacttaaccgaatggaaattttaccgaccggaaagttacctagaatgcatgacacccatatgcataacactccatatgctcgctcgtaccttgtattctccttgaaacatacctgacaaagtaagacaatctccatagagcacatcttgtgaaccaaaccacaacttataatacgtaattttgggcctgtctcatgggtagacctcaaagacacctcgagctccgagtttcttcacaagtttgtagtcattgaatcctgccttggtgaatatctcgctccagtcagtttcatctcgctgccggccattggtcatcaccatcatggctacatccatcaggagctctgctagaggcgttgagcccgaaaaaaagtgtgcaactgtggagggagacc

SEQ ID NO: 29796 - DNA, 1647 bp, Triticum aestivum
  Clone ID: PAT_TA_29796
acgcacactaaaacgcatcacaaagacaaatttgctgattacaactcgggatatggtgtgggaaaacgacccatttcttatccaaatacatttgtattactccaatatatacatgtattcaacacaaacttgacatattagacatcataaaattacattttaccctcatacaagagacttacacattcttgtcgtacataaacgtcacataatattcttagtaaaaagcacaatgagtgattaaatagtaaaccgactgattatgttatagatcgaaaagaaatcttgactatatgaaacctacctggaaagcataccacacattggcttatacctcgtattcttcaatggtaccttatctccacctagtaacgtatctgccacattgagacattcccccatagagcaaaacttctgaaccaaaccacaatttttagtacctatttttaggccttactaacggcataggcccttaaggacacctcgtgcccccaatttcttcacaagtttgtagtcactgaatcctgccttggtcactatctcgctcccagtcagtttcattctcgcttggccggcccattggtcatcaccatcatggctacatccatcaggagctctgcttcgtgcgttaggtcccgaagaagagtctacaactatgtcgatcacaatctctttccctccctcttccgccctgtagggttgggcttcttgcattgagcaaggatcttcatccagtcctcatcactccgagtggtgcagcacaagcttgatcaacacagcatgagcaggtgggacggacttgaacatgtcaccggccacgtagttaacgacaccgtcggctgggacattgtcgatcacccgcggaaggtcgagcacgggtgcacttcatctggggaaaggtctccacgatggctctcgccgtcgtgccgtcgccaccacagcagtcggtcagggactcgagcccatcgaagatggcgccgcactcccgcaagaccgtgaggaacccggaattatcatgggacgccagaccctccttcaacacggcgtcgattgttgggtcatgttccgccatgctcgcgtcgaagagggtaactccatggagatcctcgaaaggcgacgcctcgacgtccttctggaaccagtcggagagccccatagcagcctcaaggcagttgctcgaggttgcggcgagcacaagggaggtttggcttgggtggccatctacggcgacgccgtcaaggaggagccaggacaggggggtcaggcggtagtaggtgaccacgtcggcggcgttgtcggcggcgaagacgccggacgtggccagcagccgcatgatgcgacggaggtaaggcagtttggcgggtggaagggacagtgcggtgaccagatcaggcagcgatgccgcgccacccaggctgtggatggtggtcgggacgccgagcttgacggcgcactggaatgccatggaggtcatgtagtagaggctgtggcgccaaaggtcggcctgcccctgcagaagctccgcctcggtgggaacggtcaattgctgagcctgggccgccattgttgctaccttcatcactctccctctagctatctgagatgtttttatatatgcctcgtcccgcggcggcgccgtcctcgtgc

SEQ ID NO: 29797 - DNA, 658 bp, Triticum aestivum
  unsure (1)..(658): unsure at all n locations
  Clone ID: PAT_TA_29797
ccccggtatccgaagnggtcatccatagttgcannttgaggcnacgtgggctntgtatcccantgnaaagggtttcgctggcgtgattgggctcctacaccctccaggcactattttaaaacatcctctagcatccctatcggctctcgagatgcatgtgttaccggccatagctttatcagcatcagaatgacactctctcacaaagaattgttcccttctcttaacaagaggtacatctgataaacaagtatgtaagtacatatcaggactacagggcccccgcttggcggaggagcggcacgagatggccgccgaggtgcagctccatgacctgcctggtaccgccgacgagtgcgccacggatgaataccgcaggcaccgccgggctctggcccaccatgccagcgagcgccctctccagatcctttctctgggggtccttgtccacctcgtgcaccgtagagctcacgcccagttgcgcaaagagccccgtcatggtgtgggacatgcagcagtagctcgccccaaagatcaccacgatgccctgcgacgccatcgcggtcaccctctccgccattgctgaattgcctagctctcgatctctcctctgtatatcttgatcgctcagctcacttgagttgagctagctataggc

SEQ ID NO: 29798 - DNA, 622 bp, Triticum aestivum
  Clone ID: PAT_TA_29798
gttcttgcggcggcggcgcgacttcctcccccctcttgcgaaggtctagggtttggctgagtagagaagagagacttccccctcgtccagtagggagccgccatgagccgatcggggcagccgccggatctgaagaagtacatggacaagaagctccaaatcaagctgaatgcgaaccgtgttgtcattggcacgcttcgtggatttgatcagttcatgaatttggtggtggacaacactgtggaggtcaatggagatgagaagaccgacatagggatggtggttctgagaggaaatagtgttgtgatgattgaagcccttgaaccaattgccaggtctcagtgatattttggcttgcctgcttctggtttagtactacttgagctaatagtgtttggtcaaaacctatgcgcatgcaattgggcaaattgtatcctaatatttgtattgtgtgagattcagcacttattgtatagtttggagtttgaactgtctttagatgcttgccttgctcactcaaacttacattgttgggattcaatgctattttggtccaaactggacccaccatttgtgcaatgtttgtgcttatatgttttgtgtgaaccggaagagtggcatc

SEQ ID NO: 29799 - DNA, 702 bp, Triticum aestivum
  Clone ID: PAT_TA_29799
ttgtacgtcccagccctccgggacgcgtgggctcgtcttatatctagggttcagggttcttgcggcggcggcgcgacttccttccccctcttgcgaaggtctagggtttggccgagtagaggagagaggctttccccctcgtccagccgggagccgccatgagccgatcggggcagccgccggatctgaagaagtacatggacaagaagctccaaatcaagctgaacgcgaaccgcgttgtcattggcacgcttcgtggatttgatcagttcatgaatttggtggtggacaacactgtggaggtcaatggagatgagaagaccgacatagggatggtggttctgagaggaaatagtgttgtgatgattgaagcccttgaaccaattgccaggtctcagtgatattttggcttacctgcttctggtttagtacttaatagtgtttggtcaaaaccgatgcttatggaatcaggcattttgtgtcctaatatttgtaatgtgtgagatttagcacttgttgtatggtttggagttcggactgtcttcagagatgcttgccatgctcactcaaacttacattgtttgggttcaatgctattttggtccagactgggcccactatttgtgcaaaaaaaaaaaaaaaaaaaaaaaaaaaaaaaaaaaacactaaatcaacaaaaaaaaaaaaaaaggcccctaaggt

SEQ ID NO: 29800 - DNA, 793 bp, Triticum aestivum
  Clone ID: PAT_TA_29800
ccagcccgtccggtacccctactggtgcagagtttaggaagatcttagctgcactgctggtggagatggcagggaatcgtgcctgcatgttttcggtggcgttggcccttcttggagtgctcctggcatccattcctacaacggtgcagtccatcggcgtgtgctacggagtgaacggcgacggcctgccctcggccagcgacgtcgtgcagctctaccagtccaacggcatcaccggcatgcgcatctacttcccggacgccaacgccctgcaggccctcagcggcagcaacatcggcctcatcgtcgacgtggccaacgaggacctcgcctccctcgcctccgaccgctccgccgccaccgcctgggtccagaccaacgtgcaggcctaccagggcctcaacatcaagtacatcgccgccggtaacgaggtgggcgaccagggcggcgacacggggaacatcctcccggccatgcagaacctcgacgccgcactctccgcggccgggctcggcggcatcaaggtgtccacgtcggtctcgcagggcgtgaccaccgggtaccctccctcccaaggcaccttctccgccggatacatgggtcccatagcgcagtacctggccagcaccggcgccccgctgctcgccaacgtgtacccctacttctcgtacgtggacaaccaggcccagatcgacatcaactacgcgctcttcacgtcgccgggcaccgtggtgcaggacggcgccaacgcgtaccaaaacctgttcgacgccctcgtcgacacgttctactc

SEQ ID NO: 29801 - DNA, 837 bp, Triticum aestivum
  Clone ID: PAT_TA_29801
gccggccggtttcaaatgtaaccgcacgcacgtacgacgtacgtaccaggtgcagagttttggaagatctagctgcactactggtgcagagtttggttgcaggaagacgtactagtggagatggcagggcatcgtgcctgcatgttttcggtggcgttggcccttcttggagtgcttctggcatccattcctgcagaggtgcagtccatcggcgtgtgctacggcgtcaacggcgacgggctgccctcggccagcgaagtcgtgcagctctaccagtccaacggcatcaccggcatgcgcatctacttcccggacgccgacgccctgcaggccctcagcggctccaacatcggcctcatcatcgacgtggccaacgaggacctcgcctccctcgcctccgaccgctccgccgccaccgcctgggtccagaccaacgtgcaggcccaccagggcctcaccatcaagtacatcgccgccggcaacgaggtgggcgaccagggcggcgacacggggaacatcctcccggccatgcagaacctcgacgccgccctcgccgcggccgggctcggcggcatcaaggtgtccacgtcggtgtcgcagggcgtgaccaccgggttccctccctcccaaggcaccttctccgccggctacatgggtcccatcgtgcagtacctggccaccaccggcgccccgctgctcgccaacgtgtacccctacttctcgtacgtggacaaccaggcccagatcgacatcaactacgctctcttcacgtccccgggcaaccgtggtgcaggacggcggcaacgcgtaccagaacctgttcgacgccctcgtcga

SEQ ID NO: 29802 - DNA, 1562 bp, Triticum aestivum
  Clone ID: PAT_TA_29802
cttgggcaactcgggggcccgtgcccgcccaccttcgcgttctatctatggttcagggtttgtgcgaccgagggtcgagggttcttgcggcggcggcgcgacttcctcccccctcttgcgaaggtctagggtttggctgcgtagaggagagaaggctttgccccctgcgttctagtgcggggagccgccatccgagccgaatgccgggaggcgagaccagccgagcgagtctgaagaagtacataggaacaaagaagctccaaatcaagactagaatgcaggaaccgtgttgtcaattgggccacgcttcgtggactttgatcaagtttcatggaattctggtcgggtggattaacaacgtggttgggaaggtccaaatggaggagtgatgaagacgcgacataggggatggtgggtttctagacgagtgaaatagttgtggatgatgattgaaagcccttcgaacccgaattgccatggtcgtcatgatgatattttggcatacctgcttcgtggttttagtacttaatagtgtttggatcaaaaccgatgcttatggaatcaggcaaattgtatcctaatatttgtaatgtgagatttagcacttgctgtatagtttggagtttgtactgtctttagagatgcttgcctggctcactcaaacttacattgttgggattcaatgctattttggtccagacttggcccactatttgtgcaatgtttgtgccttttgtgtgaaccgtaagcggagcaaaagcgccggcagcatctacgtgacggtctcgtagacacggtggacgtcgggcggcggcacggcggcgacgacggagaccgcgcagaggtggccctcagccggcggcaaacaggtcgggcaagggacgcccaagaggcccagtgccatcgaggcctacgtgttcgccatgttcaacgaggacaagaagggcccggctgagatcgagaagcactttgggctcttcaacccggacaaatcgccggcttaccccatcagtttcaaatcgggcggcgcacatctatactcgtacatacgtagcaagacaacaaacatttcctgttgctcagctaaaataaactactgcgggctttgtacttgaagaaggtgcctctactgtagaatgcgagcatcatgctttgcatggatggcggaaaaggtcccaaattatttggatgacgaaaacgcccaaattcttcaaccggagacaaaacaaataagaggcacaccggcaagtactgtgatctttcttttaccacttattttaggtgagccctaagtgccgggcgggtaataatttcactggatcaaccgctcccttggcccgtggatctgaacataagtggacgatcccttagacgtacctgctcatgaatttggtggtggataacactgtggaggtcaatggagatgagaagaccgacatagggatggtggttctgagaggaaatagtgtggtgatgattgaagcccttgaaccaattgccaggtctcagtgatattttggcatacctgcttctggtttagtacctcggccgcgaccacgcta

SEQ ID NO: 29803 - DNA, 1318 bp, Triticum aestivum
  Clone ID: PAT_TA_29803
attagacaccacaatagggattttgggggcttttttgcaaaaccgggaataacctttcaaagctaaccttgaacaaacttatataaatcactaggacaggatatacaggtccaaacagggtcaaacaaactattaagtgttacattgtcaaaaaattcaagccacaatcctctaagcggtcatgcatgatttatgaagctttttaacgattatgtaggtccatcaaacaccatccaaccgctgtttgcaacttcttcataggtccatcagcttcatgtctctgcttgactactgcctttggcacttctcttccgcttccgaaccctctttcgctttgcctcgccatcagtcttcgggccctgattttgagcagctgatggttgaggctttggtttctttttcttgcaagagagtgggtttggaccctttgctctgtttcttttaaacttgcttttctctgccactccgggagcgtttccacagacggatgtctttccttcagatgacgcctttaatagcttcttaaattctgatttttccatatgtatacgcttctcctcatccaactgagcaaactgacgttgctgcacagagggttgctcaataaacagggagttcttcagaccatatatcacaggaacacaaggaacctcccgtagctttgcccggagatcagaatcctgggtggcaacaaagtagtgctccggattcttatcaccaacaagtgacagaatacagtccaccgcactgaccactttgtcatgctcacagctggcggtggcgacgagttgggcagcgtcgaacgcctcggagtgggacttgccgaggcgcctgagctcggcgacgacgcacttggaggtcaagagcgggggcgccctggacgcggagaggagctcgcggagggcgtcgtcggcggggaggagttggtggacgaggaggtggtgcacgaaggtgccatcgatgagcaccttgtagggctcgcggaagccgaagcaggtggagtagaacttaaccaccttgcggtgccgcgatcgcctcttcaccctcatcgcggactggcgtacgcgggcaggcagacggcgtccgcggtgagtcagcgacggtggctctcctagacgagcggcggcagacctccaggacgtgcgggcgggcggacggggtcaccggaccagcgggcaggcgaggacgcggtgtcgccagacgggcggggtcgctgggctggcagacggcgagccggcgaccctcctggacctggaagagcggcggcggccctcctccgggtcctgcacggctcgtgccgaattcctgcagcccgggg

SEQ ID NO: 29804 - DNA, 679 bp, Triticum aestivum
  Clone ID: PAT_TA_29804
tttttttttttttttttgaacgaacaacagtgacgctgttttattaaagtacaatacatagtttaagcatagtaacatacatgggataatacatactttatttaattccgcaaacatcacggccagggtaccgttcacgcatgtaagatgatgtattcataactaccatggacatgggtggttacttggcacagtcatccacaaccacaaagagcgtacccggtgactcatcgcgtgcaagccacctattcacgttgaatgtcttctccttctgggacaaatttttttgctcgatttgggtgaaggcgactttgtccacaaaccaaccgggtttgttacctttgccattagactcgagcaacatcctgcaaggtttggacggtaagcacttaccgctgccttcaaatttgtcggtgtggcctttctcgaagttgttgtggcccttctggccccaaggtttcaggctctcgataaccagcttcttgccatttgcggtgctcactgacagagatacacgagcatcggtgcccgcatcttctctatctcctgtcgtgaccaatataatgaatttgcactgtgcataggcactagttacagtgagagcgaggagaaatagggtgaacaaaatcttcattctggccagtgcgtgtaggatggcgctggtagtactgtagtagtg

SEQ ID NO: 29805 - DNA, 1641 bp, Triticum aestivum
  Clone ID: PAT_TA_29805
catataaataaagtttataatgaccaaaaaatgaggaaactgcaaacattgtttcaacaacaacgaattgagccaacccgtttgaaaacacatgctccctccctataagatcgtttgaaaactaacatagcttgaaaaacgatcttatattatgggacggtgggagtaaatggaggaagcattggtacttttcccgattgtttaactggtagagcaagcgtgagtcacaattgtatacaatgaaacaatatgttcatcacatgcttcgcaatgtggattttggttatacaggcacttgcacaaatatttacatttccatgaaagataaatgtcctcgttctccttctcataagctcgaaaattgacccttctgttatgaaactggagatgatcagaacgtagcagcagagaccaaaattgctcccttcctggtagttctcactatcgacgaggacttgtggagcacgcgctttatgtccaatgaaaagggccccttgaaccataccatgtcccagcaaagcaaatcacaccctataggttcctggcttcgttgcaaatgacatgcagcagaactctatgtatagcgtttcttaaacagtgtatgcctcttagccgggtccttcttcttgggctcccttgccctttccagtgttgtactccatgtagaccattccacccgctccagaaaatgcgctcatcaatccagcagagcgccgagccttcaggagagccttgccatcagaatcctcttccaagtgctcaacaccaatcatgtcatcccctgcgctcaacactttgcctaaaaggtcaagctgttcatcgagcgtgtgaaaactcaggttaggtccttcttcaggtggcggcaagctagtgatcaccttgaaactatatccctgatcgataagaaattgttgccttttggttgaataatacatttcctgtgtgtcagttgatacaagagaatagaaaaaggcattgtattcctcttttccacctgccatcctatcttgatgcttaccctttgccctgagaatacgtcccaaccgttgagcttcttgacgccgggaaccagcatgagacgatatttgaatgatgacatttgcctctgggatatcaatggagttatcaccctccttcgagaggaaaacagtgttgacttctggactgttcttgaattggtacaaaattcgtgtcctctctgcatggcttgtggcaccataaatcattggtttacggagcttcattgcgtatgcagttagtgcaaataaattatcagcaaatacaatcctcgtctccccgcgctgctgcgcggggattcgaattagaaactcacaagccctgaacttgtttggattcatcacatagagtacctgcttcttttttgaattttcctttttcaaatactcagcaaagaactctttggtcatgggacaccatacttccgcacgcggcgcgcgtgcaataaatccacctttcactaaatccaaccaatttgcttcatacagctttggtccaattagaaaatttagatctgtgatacgttcatcctctctcacaagcgtagcagtaagaccaagcttgcagtgagacttcgtaatgctgatgacctttctgaacatatgagccggacgcggggtcgac

SEQ ID NO: 29806 - DNA, 1608 bp, Triticum aestivum
  Clone ID: PAT_TA_29806
cacaacgtccactacggcgcgcactacacttccttgccgcatcgacgacctgacagtacttggaccaatcacgattctgatctttaagattcggcattcaagctgccacctgctgcagcaactgacagtacatggacctttgcaggtctgatccatcagattcagcattcaagctgccagctgccatttgcagcaccccattgtcgagcagacgaatcatagcaatgatgttacgttacatgattaccttcaaagctgacaagaattaactccttcccctcctgttctagtcgtcaatacgtacagacctagagacagcatcacatcatatgaatgaatttcagtacactaggcgagaatcgccatccgccagaataaacagctgatcgtctagttgcgtcgatttacttagcactgggcataaactagatgttcagaaacagaagtccccgagatgctgattcaaagtcagccgtggcatgcgaggctttaagactcctggccacgtcgtctctgctgacattctttgtggtgctctcggtgatgacccagcttctgggcatgttgccaccacatggcttcagacgcgaccgggtttcgacacacatcgtcttgtgtgctgaaattctttgtgatgctatctgagaaatcacgccagttaagcatggcacgcttcagccgggacgttctcttgccagtgacgaggtatctcggtgtagtccctagcaaggcggtacagctcctctcctctgatgatgtggatgtacgtgagtacaaaagcaacagttgctaacacaacttggaccacttcatacaacgaatccgtgaaagattcgtcatccgggccatcagaaccaccaccgctgcctccataacggttattatttcctccatttccaccagacccctgtcctgtaatcttagccatttgctccatcaggaagccttgtatagactgttgcttttttgctccatccattgctttgttcaaagattccatagagaatggatcaaggtttcccttcccgcttgaggcatatacaggaccaagcctcttatggcaagcagcaacaacaagccttggatatactttctcttgcagcttgcaagatctagaaaaatgttgccatacaaaatgttcaggaagtattttgcaagttctcccaagacctaatggtctgtccaaagtgagcccgccaagaggcttgtacgttgtagcttggcagtagctcatgtttctaacttcttgaattctagaattaactggagccaaatctcaaaacccaatggccaaagactgcggacggcgtggatacagcaggaacgcgacgtccggcgaggaagaacggtgacggcgggtcgtgtgagggcggggacgggatcgaggcgtcagctgtagcctgtggtatatgctacagaagagattcagagccgcgtcgggtaggccgggaggactcgggagggagaggaaagaaaggacgggaagaggagtagggctccgctccgccgcgccgcgccgcaacgagctctccggtgggcggtgagcggggactgcggcctgcaatggggcgcgggccggatgcattggattgcgtcgcggacgcgtgg

SEQ ID NO: 29807 - DNA, 1411 bp, Triticum aestivum
  unsure (1)..(1411): unsure at all n locations
  Clone ID: PAT_TA_29807
ttttttttttttnttntnaattgcaaacccgggaacagcgtttcgtggcaaagaaacgagatactccatttgttagatgtgtcgtacgtgcatgttgcttcgaagcgtgtgcctacgtacgagaacgacctttcacctacactacactaccaacaactactgacggttcccccttgtgatgtgacacacttgttgggaacaagaatgtcgaacccgctcagcgtccactccgcctccgccttcttgctgacatatatctcggtgccgacgtcaagcgacgaccaccgcctcctcgccggcggcgtgccgggatcctggtagaaatacagcgcgtgcgacaaggccccgacgtcgagctcccatgccctggggtcgccgatccagccctgccccttggccgtggggtacccgaactcgccccacaccgggtgcggcacgatctgcaggatctcctgcggctgcgggttgctgtaggggtcgcagtacgtcgtcggctgctcggcgtgccgcgcgttccccggcgagcagtacacgtggtaggcgccgtaggggaaccgcgcggtgtcgtcgcggtgcacgcgcgtgccgttgcggaacgtgtgccacggcgggcactggtccctccgccccggctggcaccacgccggcgtctccgggttgatgatcatctcgctgtaccgggtcacgtccgtggccgtgtcgccgtcgcacggcgcgccgtcgttcttccagcagctgcccatgtccatcaggtagaactggctgttgggccccccgccctgcttcacctccagcgtcagcctcaccttgaaatccggcgactccggcactatctttgtcatgcctctggtgtcgtagtggtagccgccggagaagcccctggtggcgtcggaccgcaggtacagcatcagccaggggtacttggccgacgtccgcagcttgtggtggaagacccagccggcgccgcccgccggaccgatctgcttctcccacaccaccgagtagtaggacacgtcgctcctcccgagatccgtggcgtccagctcgtacgtgccgaacagcccgccgcggagccaccgtccggcgtcgtccagcgcggtgcggttgtggaacaccagcggctggttcatgcaccccgtgccgccggggcaggggaaccgggaggtctgcgggaacgggcgcgccgggcggccgttgtcggggcagatggccgcggtcgtgtccaggttgccgttcttgagcatcaccatccagaactgccacggcaccgggctgtcgggcacctggcaccggtctccgaggtagagctccttggccgccgcgtagcggtcggtgtcggtgacggtggagttcgccgacgtgccggggaacgggtcgccggcgcggagcgcgttgtcggcgtcggtcacgc

SEQ ID NO: 29808 - DNA, 540 bp, Triticum aestivum
  Clone ID: PAT_TA_29808
agatggatatttcgacacggcatccgttaaatcggtaaatatgtgtcacaaatgtacaattaacttgtagaaagtgtaattcacacgacgatttattacactcaggccatgctatcgcacgcacggtctaccgattattgatcaaattaaagggaagtataacaaaaatagtaatttagcattatcacaacgaaacggaagcaattccttagatatcacacatagtgctgcctgtggtcaagccgtggggtagaagggcgaggtggcgaggccacatgtgcccgtggacgagggcacgtcctttgcgaggtacacatatccttgttcaccccagtcgttgctccatgagttcttggcaatccagtacttgtttccctggccaggaccctcgcagtagccgacgatggtgatggcgtggttcacattggcggagcaggggccacggtagatgccgccggagtagaactggaactcaaaaccgctggcgtcaatgtagaccgtcacgggctgcatggccacggcaatcgccggacaaaaagg

SEQ ID NO: 29809 - DNA, 1441 bp, Triticum aestivum
  Clone ID: PAT_TA_29809
ttttttttgttttgatcgcgtatttcgactcgtcatcctttaaatcggtaaatatgtgtcagaaatgtacaattaacttgtagaaagtgtaattcacacgacgatttattacactcaggccatgctatcgcacgcacggtctaccgattattgatcaaattaaagggaagtataacaaaaatagaatttagcattagcacaacgatatcgcaagcaagttcttcgttttattgattaaattaaatggtggtataataaaaatattaatttagcattatcacaacgaaacggaagcaattccttagatatcacacatagtgctgcctgtggtcaagccgtggggtagaagggcgaggtggcgaggccacatgtgcccgtggacgagggcacgtcctttgcgaggtagacatatccttgttcaccccagtcgttgctccacgagttcttggcaatccagtacttgtttccctcgccgggaccctcgcagtagccgacgatggtgacggcgtggttcacattggcggagcaggggccacggtagatgccgccggagtagaactggaactcaaaaccgctggcgtcaatgtagaccgtcacgggctgcatggccacggcaatcgccagctgaccttcgttgttgggtggcacggccttgaagcccttgagggacgcctggtggtcgaagaggagcttgtccatgtcgcactttccctggaatccggcgtatgggtacctctcctccgacgtgatgccaccacgggcggccacgagggccatagccgagtctgagtggccgccgccgcagccgccgctccgtgtgtcgcaatccacgagtacctgctcggacagcgacaccagctcccctgtcctaatcttgttcatgccttcgatcgccgccaccgccgcgaatgcccagcatgatccacaagtgccttgattcttgacgccggtgacagcgccgctggagcgccagtcaacgcagcagggcttgaaggagtggtaggggaggtaggtgggtgacgtggcattgaagctggtggtgttgagcccggtgaactgctggatgacctccctggggctgaggtcgccgaacctgttcatacggaccccgcccgagccacggacctgaaacccagttggtcggaacccgcgaccgacgacggtgccaggattctgttggtcgaattggccgatggcgttggtgttgttcttgaagacttggaaccgcatctcctcctcctcatggcacgagtagtgctttgagtacttgatcacccacttggagaacctctccctcacctcggactccggcagctcaaacggcgggggcggcggcggtgggtaattttgccgcagcaagccatgcctgcaggaaagtggtgaggcacaagagtaggacaaggtaaggcgtggaggaagccatcttgattagctcacgaat

SEQ ID NO: 29810 - DNA, 820 bp, Triticum aestivum
  Clone ID: PAT_TA_29810
ggtcgcgccgagccggtccgcccagcggagccatcctgcgtctccgggggacttcccctcctccggcgcgcccagccgcggcaggacccctccgggccggtgccggccgccgccggctcggcctccggcgacgaccgcccgcagctcctcccccaccacccgggcccccgccaacagcagaccataacgctgtccgggctgctcaacttgatcgacgggctgtggtcgacgagcggcgaggagcgcatcatcatcttcaccaccaactacaaggaccgcctcgacccggcgctgctgcggccggggcgcatggacatgcacatctacatgggccactgctgctgggaggcgttcaagacgttggccgtaaattatcacctcgtggacgaccatgctctgttcccagagatacaggaactgcttgccgcggtggaggtgaaggtgacgccggccgaggtgtccgagatgctgctgcggagcgaagacgccgacgttgcgctacgggtgctgacggagttcctccaggacaagagaagcaaggcaagaaaagaggcaacagaaatcaagatcggcgtagcagagaaggcaatgtagcagtagtagtagtattcagtgtcagtatccccttcaacgggaccgttttattggaggagtagatgaagtgatcgagtatgtgtcacacaggtcatcatttatgtcgggaataatcatcaatcgaacaagctgatgtatcggatttgagctgttttgttcaaaaaaaaaaaaaaaaaatgattcagatgcttcactgatgggaagcaacccaattttaatttgagaa

SEQ ID NO: 29811 - DNA, 1455 bp, Triticum aestivum
  unsure (1)..(1455): unsure at all n locations
  Clone ID: PAT_TA_29811
cttgtctcaaaaaaaagtaaagcacccacgtagataaaacatatgtccagagtaatggcacatttaggactcatacagatttataaaacctaccaaacatgaatagaaaaacataagacaaaaactgttgtgcagtaggctaatagtaaatatatctgattaggcatcgacatagacatcaacatcctcgatgcttcaccaggaaaacaccaccaagatatgcccaatccagattgatgttcttattaaaattttgttttatcatacattcctgttggctaatccaacagggatatcttcttatgaagcttcaagaaggctggctcatctctcttgcatcattgaccaggggagtgcagcaccagacaaagttctcagagcgggtacacgttttgcgatcaagaaggcctcgttgagacgtgctgcgcggtctgcaaactgggaggccctcttatcatcaaatgcgatcttaatctggggaaggccctgggtcttgcgcctcatcctatacatcctcctcccgagcacaactatccccagcaacgctgcagcgatggaaatcggccaaaccggactcactttccaagcacaataatggatgaacctgaacggcagcctccaccatacaaccacttgcctctctccatcaccggtgcccggggctcctgctgcaaccagaggggaagaaccatccttgtcatcgccaccaggttcagcacaaccagaagcggcactagcatccttcccttgctccggctcttcctgcagagtctgcattgcatcgcttgttgcagcagcttgaagaacagagctttcgctaagggcatcagcccctccatcttccaattgcaaactagacttctctgatatttctatctggagtcttacaccggcgaccgcagttgcatcggagtccaaaattccctccaacccttgaagcgcggcttgcggaatccaatcaagctcaccacaacttaaccccgcagtttgcttctcatgtgcgtccccaccacatgccacggaggctccaaaaaccggcgaggcttgtgcagtcacatcaatccagcctaattgcaactgtgcgctggaatccaccaccccaataagatccgtctgctcttgcatagcagaaccaaatctgtccactgatcctaacccggattcaatttccacgtcgtcggaggcagcctccgaccacgagccctcgccggagaagccagtggaggaagaggagtcgagggcgaagtggtcgtggaggacgtcgccgccttccccggacacaaggacggcgtcatcgcctccgacccccgaggatgcagatagcacctcccagtcgctgaaatccgaagccccgtcctccatggcgcgctggcgctggcgccctgcctactggggttgagacccgagaggcggagaggggaaacactttgagacagnggnttgcgtccgggtgtt

SEQ ID NO: 29812 - DNA, 1029 bp, Triticum aestivum
  unsure (1)..(1029): unsure at all n locations
  Clone ID: PAT_TA_29812
nnnnnnnnnnnnnnnnnnnnnnnnnnnnnnnnnnnnnnnnnnnnnnnnnnnnnnnnnnnnnnnnnnnnnnnnnnnnnnntctgtgaacctccacggttgaatcaagaaaagctggtaacagagtactatttcagaggccagccgagcaaatgtaacagggcaacagatttcacaaatgcattttcgtggtgatggccgtcaccagagtaatcaatgttcaggaaatcagtatcaacgaatctttagctacacttcgcagtcgcgaatgtctgcttttgcagactttgacagcagaccatcatttcccaccagctaacgtccttctttcagcatcatgttcttctctagtatgaactttccttctttgtacttctggtcttcgttgtaggctttcgcatatttccagccaaggagtcgttggcagcagctacagtagatatcgttcactgtatgcaatccagtcaagagatggcgatcctcattgggaccaaggctcacattcaccacgctatcgaagaggtaggcgcggccgtggcggccacggaactccttggacacgatgtcgtcaggcgacgccgagtcaaccctgcagaacttgcacttgaacaccttgggccccgggaggtactccacgaacagcatccccatccctccctccccccgcctcccggagagcaattctaccgaagcgttagccgcagaagactcccttcccccgaccaaatcagcaatcgagcaggacgagctgcggggaggcggacaggccgctaaaccttatcaaattccgaatcgggagaatgggaggtcggggaggcggctgccgggcccgatcgccatgagaatgggaggtcggggaggcggctgccgggcccgatcgccatggacgggggagggatcggcggcgcggcagcggaatccggcggtggatttggctggggggcagtgggggttgggaaagcggaggcgacgaggaacaaatgggaggccacttgcttgtccttgcgcgtttgcttcgggcctccctcgtgc

SEQ ID NO: 29813 - DNA, 1003 bp, Triticum aestivum
  Clone ID: PAT_TA_29813
gcggcttgataaatatcatcaggtcataagcaaagatcaatagcctctagctcaatcagatctgtctaaagacattgcccattaacattttcatggcttctggagcgagatctttcaaatcaaataaacaacatactaagatgactaaacagaggaataattagctacatggctaacctactgttaattgaacagctactggcgtcatgccacaacctaaaatctatctaatactacagctgctgataaaaaatagctctacaacttcaaaccccatctacaacctcgtacaacattcacctgaacctcgggagcatggcaaataaagccaactgtgctcatcgatccgccgggttccatggcaaatccaaactgaaagtgtggcggctcggaatcccaaaaacagtgtggtgtaccaattggggtaggaccacactaataccatatgagggcacgaaggtctgcatgacttaacagctaatcgccttccaaattctctgcgcttcgaaaaccatcttgtctccagtagccaggaaaaccttggcagtccaccagatggaagaattcactttgcaagttgataggtctccaactaaaaccccagtgtccggacacatccattttgtcactctgctcaaccaaaatggcctttgatcctggaatatgtaccatggcaatacacatcctttctcgaaaacaccgctcaaggaacatggccttcgatttctccgaaactctgctcaaggaacatggccttcaatcctggaatatctaccataaggaggcctttgcactgcccgggggaaatctggcttgaagcgcttattataattgggcgccaaagaccttggagaactagaccgtttctgagcaagttgaccaagcatggatctcaaagttccaagagcctcatcagccgcctgaagcttagcttcttcccatgttattccaactcctttgccaagagtttgcccaccaacttctacctgagcgtaagtctcct

SEQ ID NO: 29814 - DNA, 778 bp, Triticum aestivum
  Clone ID: PAT_TA_29814
gaaacgtaacacatagaccagctcaaaaaacaacagtcgttgacagtacaaatcagatcctgttcagacgcacggacattttagaagcaaaacaaagacgcacacgtatgctatcgtggaaccatcgagaacccgtagaaaacgtaaaccaaaacgcgagaaccgatcattccagcgcgaagagatgactcgatcaggagcagctcttgtcgtcgccgtcgacgtcgcactgcggcacggtggcgtagtagggccctgccgagtagccgacctcggtggaggagaccttcgaggggcgcaatagattctcgccggtcctgccgttgttgaagttggtgaacacggcgcagcccttgtcccccgacctgacgatgcggacgaggcagtgggccgggtcaaggcggcagctgccgccgtcgtgggcgtacggcacgtccaccttgaaaaccccctcctcgtccgtcgtgtccgtgcggtggatcaccgtccgccccgtgtgctcgtccaggcacgtcaccgccaccacgctgccggcgatgggcttggcgttgtaggcgtaggcgttccagttcttggtgcagtcctggcacagcacggtgcccgtcaccgtgaacttggacgcgccgtagctgtcaccggcgtcggcgcacgtcgccgcggccaccagcacgagcgcggccagcatcgacgccctcctccaagccattgtcgaccaaagaccaattagcgagctagctcgatggaatggaatggacgggccggtgagatcgcgtgggct

SEQ ID NO: 29815 - DNA, 2051 bp, Triticum aestivum
  Clone ID: PAT_TA_29815
tagggcataccagacatgggcagaagtcctgtcaggacctcccgagcaccatctaagctctgccttagatacacattatgaagagaagaggaaatcccatgtggaatactcagaagacgaaaagaaagcaatgatgtgtcactgaagaaaaaggcgatgaacgcctcacaaaaactgaggcattccatgaagaagggaggaggagcagcaaggtgatgtccatttcaattgaggacgagcgcgaccctgaggaggtgcaggctgttgatgccttccgtcagcttcttgtgctcgaagagcttctaccgtcgcagcacgatgactaccacatgatgcttaggtttttaaaggcaagaaagtttgatgttgagaaggcaaagcaaatgtggtctgatatgctgcagtggagaaaggagttcggcacagatacccttcttgagggttttgaattcgaagaagctgataaggtcgcagaatgctaccctcaaggctaccatggagtggacaaggaaggaaggcccgtctacattgaacggctcggacagatcgatgtcactaagctgatgcaggttaccacaatggaacgtttcgtcaagaaccatgtcaaggagtttgagaagaactttgctgataagtttccagcttgctcagtagctgccaagcgccacattgatcagagcactaccattcttgatgtgcaaggagtcgggatgaaacaatttagcaaagctgcaagagatctcatcggtcagcttcagaagattgatggtgataactacccagagacgctgtgccggatgttcatcattaatgcaggccaagggtttcgacttctctggagcacaattaagagcttccttgacccaaagaccaccgcaaagattcatgtattgggtaacaagtaccagagtaagcttctcgaggtgatcgatgccagtgagctgccagagttttttggtggaacctgccagtgccaaggtggctgcatgacggctgacaaaggaccatggaagaatcctgaagtcatgaagatggttcatagtggtgccgggaggtgtggaaagctcaatctggaatctcttgatgccggggagaaaatgatctgtgcagataacaccgtttacacgaagaagcaagatcctttgaacggacaagatgaatggaggaaccccgcacgtgcccaaattgagcatccccaactgtcgcctgttcatgaggagcttcttcctgcattgtttcctaacccaggatcaccatattcctgtgatgttccaatggttgagaaggccatagatgccatatgcaagagccatgggttaacagatgataatcttgccctcactaaagctgtggcaaacgcctctaatgcatccaatccaccaatgatgggcggcatcatggcccttgtgatgagcattgcgacgatgctccgtctgagccgtaacatgcccaggaaggtgattggtgctgccataggagcccaaagcacaccgaaaactcaggcgcagcagcaatccaagatgttggccgaggccgaatacacagtctctgcaaagcgctttgctgatcttgaggagaagatcattgcactccttgcaaagcaagcagaaatgccggcggataaggaggagctgctgaaggctgcaaccagccgtgtcgctgcattggaagaggaacttgcacggaccaacaaggctttgcaggaaactcttgagcggcaacaggagatcatggaatacattgaaaagaaaaagaagaagaaagccaagcgcaagtttcactggtagatgcgaagaacggaatgcgatgtgtccgcaagaggctttggcttgatgacagtgagctggtttttttgtcagcaaaaagtgattctaagtgtaacatataatgttcttttgttattttccctgtgttgctatatttcatgggtcggagcttctcaaccatgacatacattatgccttgccatacattgtgaccatgtggatgtggtgccaatccttttcttgttgctgtcaatggtggatggaaatacattaggcattgacttt

SEQ ID NO: 29816 - DNA, 1472 bp, Triticum aestivum
  Clone ID: PAT_TA_29816
tgttttttttggagaacccggcggaccctcctgaagctcctagcgtagttaagacagcggggagcaagagaggagccagaaaaccttgccgtcgaggttccaccgggcccaaatgagggccccgtccgatacaaatacatccaataatattcctacagaagaattcacatatgcaggtagaagactagagaaagaatgaggatcatttgatgcagtttatgcaccgagggcgagaggcttacagcaagagaatgggaggacgctacagggtccgacgagccgggaacagcaccacctgcctccccaggtcctggcgaaggtgatggagcaaggtacgagtcgtggattgccgcggtgcacggctccatgagtggaggaacttgatgcggtccagggcatgtaggttgaagacccgaggacagcgatgtggtaatgcttccgttaacgaagccagcatagttgcaagacgagacaccgcagccaccgctggtgggctgggtagtcacattaccaagcattagactgctattggagcactgcatacttgaacatgacgttcctaatgaagctggagtgcagtacagattgagatcccctggcccacagctgcattctacacagttaccagcagttagtgcataggtcccgtttgccacaagcaatccatagtccgaagcaaagttaggaaatgtagacgcacatgctgataatggaactgcaaggatgtcgccgggtgccacgacggggctccccatggcattcacattgctgagatccgtgacagtggtggcgtgggtggcggcgatggattgcacggtgtccccgacccgcacgacgtaggagaggtagacggcggggaggttgttgtcggtggagttgaggcagacgcaggggtagcgggcggcgggactcgggcccgccccgcgcggcgccgcgcgggccgcctcggcgagcccgttggcgctgcggatctggtcggcggaggcgaggcccgcgaagacgacgtcggcgacggtggcgagcgtgtcggcggggcgcgcggcgtagcggacggagacggacttgcggacgccgtcggcgcaggcgcagcgggtggggacgcggaggaggagccccgcggggaggatccggttggcggcgccgggggaggcgaagtcgagcgcgttgccggccagcagcgccgccgggtccgcgccgaagagcgccgccacctcggagaccttcatgtcggcgtagagcgagtagccgagcagcgccgcgcacgagtcggcgctggagcagggctcgatcgtggtcttcgccgccgcgccgcccgccgccgcgaggatcaccagcagcgccgctgcggccgcggccgccggcctcgacattggggcccggcgaggggcttagggttgccgcctcccggggatggggggagtggggagctgagctcgagctctctctcggcttttggctgcacagtgtgcgaa

SEQ ID NO: 29817 - DNA, 507 bp, Triticum aestivum
  Clone ID: PAT_TA_29817
aagaaaatggcaatttttataataagatcattacatggaagtgatagatggacatactaatgagtacgaccaggataaaataactggctcgagcatctaatggaacgtccatagtggaaatcacaagcccacgtgcatgcatttctctccctatagcttctttgctcgaaccctgcccgccatggcttaagtgcacgcatacatcataggcatgaacgcatgactgcctagacttgctcgacgtaggttgccttgtcaacaccccccttggtctcgtcgctggcgcatgccaagctgttttccttcatcagcggtggcatctctggttcgatgggattgtgtgtgttgagctcgatggcagccgctgggccaagcttggagatgttgaccacatgctcgggcaccttgacagcatgatcatcgttcacctgcttgggcgccggtgttggtgtggcgtttctgtttagggcgtttagccccatttgaatcacaccgtaggcgaaccca

SEQ ID NO: 29818 - DNA, 802 bp, Triticum aestivum
  unsure (1)..(802): unsure at all n locations
  Clone ID: PAT_TA_29818
aaccgtgnttatntnttggtaggnataaagggnatatagagcctcggattgtaatatngccccntgaaatatnaangttgctgtctagagtaacattcagagtacattgtagcgtggtcccttttactgtatgcttctgccttgaaagaattcaagccagtgttcaatgggagagaatagttgtaatcctcaaataactgtcgtacctattcatcagctgacacaattgccaccgagatcattattttccttttttttcaggttttcaacatcacgaatttcatacttatggagtggagctaccaaaatatctattgaggaaatatgtcgaagcacagaatatattccatatgcagtggactaacagaacgacacaacacataaaaagaggagtataagtggaaacctttctttctctttaaattcttgaggactgtaacattatgatgaaggtggaaccatagagagatgtgtatttttaattgagatattttcaggagtacctttgcaaagctgatatatctttcttttacaagatatggttgcacttgcttcatctacataggccgtctggaatgccatgaggccgggatttgtgtaggaaatcttcaaagctattatattggtctcaagaaggaagccctttgcaaatactatccaaatttttgctgttaatttttcattctttttgtcggaaaatgacaaggctagccagcaactgccaattaaaagatttaataataggttccctctccaacctggcaacattgggaaaagatttactgctctcaaatattcacct

SEQ ID NO: 29819 - DNA, 913 bp, Triticum aestivum
  Clone ID: PAT_TA_29819
cactcaaaattggagctgggactgtctgatggtatgtgataaacaactgacgagcatcttcccaaatctaattggaaagagctgcattacacgattaccaccggcatgtcgacgatgatagtacatcttatcttaccttcctttttcaaatctaattgaaaaaggatcagcatttcccaaattctttcccacatacgaacagagggcgggaactgattcagacgaggagcggagcttccagcgcgccggcggcggtggaagccctggccctccggtcggcgcgggcaacgtcgtcgtcctgcagcctgagggtggaggcgacgaggatggcgaggatggcgaagcaggtcgggatgagcccggtgccgtacctgctgacggtgttgagcccccgttcctcgccgcagctggaggcgacgtcgtaggactcgagcacgaagagcgcgaggccgcaggacatcttgtcgaggaagctgagggagccgtagacgaaggcgcagccgttgaggtcctcgccgaccagcgcgctctccagcccgatggtggtcaccatgaccagcgcgttggcggcgccgatgaccacggccagcgggtacatgaggttgtgcatctggctcgggaggaggaacaccgccgcgccggagatcacccacagcgtcgccccgatcgtcagcagcgacttgagccgccggctgttccacctcatctcctggagcaccacggagaccaagaagctgcagcagaatatgatggccggaatggtggctttggagtattcgttcatcttcagatctctggtgacgtagaacgcgatgagcgactgagagacgttggtgatcaatctggcaagcatgtagaggagggcgacttggtagtagagggtcttgttgaaccagtagctccacgcgatccg

SEQ ID NO: 29820 - DNA, 1009 bp, Triticum aestivum
  Clone ID: PAT_TA_29820
tttcgtgataaatcacaagctctatatatactttaatacagttggataattacatcttgagccacttgaccaaaggtttctttctcaataataaccggacaaataataaccggaaaacctgagggaaatagctctggtgagcctccaaagccaccaaattaggcacaaaattaatcatctcaaagaaatgatttatgtgccgtgggatgcctttcactgggcactcatctactgctacaaagtatggatttatccatgcatgaaaaaggaaaagaaaaggggtaaaaaaaaaaagagaagttactgccaaagtacacacaggaaaatattgtactatccggcaaaaacccggcaacggagtgggagagtcgtgttgctagacgcagtcaaccgccatggtgccggtatccaggaactggtggaaagtgtacccagcggcagctgcgtcgtggccgcactcgtcgtcgctctcgctgccggcgccgtactcatcgcaaggtggatggttcaagtcgagccacagcccacgcttcatgccgacaacggcgtcgtcgctgctgtcgccgtgcttcttgatcgctgctgtcggcggcgtcatggccatgacgccaccgccctccgcccgcggccatggcacggtgacgccgcatgtggccaccgagcgcctggccgatggcgaactccagcccgcagacggagcatccgtgcagcttaggcttgaggtcgccgccgttgtccagccgcggcttcttgtggctggcccggtgcccgcccagagcctggaacgacgggaacacacggtcgcacgtcttgcagacgaacacccgctccggggcgcggtcaccgggcaccgccaccggcatcggcatgggcatcgcctgctcgcgcgaaacgagcagaagcatgcgcgccatctccttctcctcgaaagcaaatcttttcgtcattcctctgaacccaactgcttgatccggacgcgtgggagatgatgatgatcctcgtgccgaat

SEQ ID NO: 29821 - DNA, 593 bp, Triticum aestivum
  Clone ID: PAT_TA_29821
ataactgaagttgatctctctcttgttttggggagggtttcccgccacgcacgggaggtaaatggaagaacaatggagcgcgcgcgccaaaacgaagcatgcatgcacgatgcaacagaaaaacacggggagagggggaaaggagacgcatggggaagggggcggagcgagaggagcgcagacgaatgacgtgagacggcgagcggcagcatgaaatgcacgcattgaagctgctgttctccatgcggccatcgccgcgccatgaatcgtcgccgctgctgctgctgctatcgccgctcaccgcccgcactgcgtatttcccgcatcccgcatcccccgttcatcgtgacgctgcatgctggtctgggcgcgctgcaacagagcgcatcgagcgagcgtgccgcgcgccgatttagcgcagtcgtcgcgcctcgcgctcagactcgagcagcacgaggatgtcgccctcgcgcacggggcccttcacgttgcggatgatcgagcggttctgctcatccaggaactcaacgcgcacctgcgtgacgccaccgcgcgatccggtgcgtcccagcagcttcatgacgcgcgccatg

SEQ ID NO: 29822 - DNA, 2101 bp, Triticum aestivum
  Clone ID: PAT_TA_29822
cggagtgctagtgggtctggaaattttttgccggttttttttccttggttatttagtcgctattttaaccaagttcaacggagtctatatacacaatgggcgaaacaggcagaacaacaaccaagcagaaacacaactatggtgccgtttacgacggcacggtccattatgctgtcttattcaggccggaggctgccctgctcccggtcttctctgccagcttgccccctctgtcgagccaggtgtcgtcgctgctggtgccgtcgcctggcaaggaaagggtaaggcaggctcttcgccctccaccctccccatcgcccgcctcctgcgcccaatgtcggcgtcagagacgctggggacggcccggagccgtgccgcttgatgtcggcgggttcgtcccaggtagtacttgggccttgctgggcttttggccaacggtgcaggcgaagaccagtcgcgcaagggctcaggtaggggccgtccaccgcggtggtgatcacctcgaacatgtcctcgtcggagcggtcatccccgacgcagaggatgaagtctggctaggagccccagctcctgcattgtcgacagcatccgcttcgccaccagacccttgctcacaccctgtggcttcacctcaacatagttcaggtcagctttgactgataccggctcgttggagaggacactctccaggtgatcatggagctccttggcctggcaagatccaaaatcacggtcggcgtccttgtagcaccacacgattgctgtctccttgtcctcgatgatcgacccgtccgttgtctcggtgtaggtcttcatcaccggctccgcgatttgcttccagctgaagtctgttgccaggccgcatgtctcccattctgcatctctttccagcctgatgaagtagccatgctcagcagcaaggcctaggtcctcacatgctgagaaccattcacttaaggtcgcccgggtctttgtgcttgcgattaggaccaagttcttctcatcgcgacagaggctgttcaacatgtttattgttttggagctcggcatcttacgaaacgatgactcaggcatgagcgtaccatcatagtccaagagaatggcacgcgtgcttgccttccggtaggctgagatgagctgctcagccgcgagcttcttgaagctcgtatcaagggccacaaccctgaaccttagcccaaatcctatgccccagcagcgcctcttgttatggtcttggcagtcctcgccagatcctgcaggaagctgtttgcccagtatccgacatcatgtgtgctcacaaatttgtgatgcttctcgtgcctcagcgcctgctcaccttcacctgtgtgcaaggccttgtccattgcctcggccaccgactcaatgttccaagggttcacccgaatcgcgccactcagggagggtgagcagccaatgaattccgacacgacaagcatgctcttcttccttgtgaaagggctgagacccaggatcctgtcaatcttctcattcccttgcctagcaatgatgtactcatatggtataagattcatgccatccctcaccgcggtcaccaagcagcactcagcaacaacatagtatgccatcctctcatagaagtgcagcggcctgtcgatcaatatgactggctggtaatctggctgcccaaatgcctcattgatgcgcttcaccatggcatagctctcatcctgtacctccttgacatcctttcccttccccctagccggattggcaatctgtaccagcaccacctttcctcgatactctggatgctgcgtcaagagctcctcaaatgccaaaagcttcagactgatgcctttaaatatgtccatgtcatccacaccaagcatcatgatgcggtgaggatcagggaactccttcataagctcggcgaccttgagcccggtctccgggaggttgagcactgcctgcagctgcgtcaaatgtatccccaccggcagtatcttgacagtgacagtccgtccataatactccagtccaatgtatcccctctgcgactcgtatttcattcccagcatgcaccggccgcagcaccccgccgtgcaccggcagggtctcg

SEQ ID NO: 29823 - DNA, 575 bp, Triticum aestivum
  Clone ID: PAT_TA_29823
gacctaccgtattttgatccactgttggggaaatatagtacataagatgtgggctcataatgatatactagaggaacatgtatgttgccattggctggagtaaaatactagaggcatccaaaacagaaacaagatcaaagacatagttgatctaggagataatttgaacacccaaagggaaggtaactttgtttcttctctgaattctcatgctttccgagttgagaaactagcactacatactttctacagtcagggcatgcaagcaggagttcatcacacaatccctggcccctctttgccctttttcaacacacatattacacccaaattcataccctgccatgccactgcatctgcaccccaaagcctgaaacctgctggtttctcgtttgtcatgtggtaatgattgttgtagtttctgagctgctgtgcagggagaagagaaaaaagggcggagcggctggcgtatgtacagaaggcaggggcaggcacatttatggttcaaccttcatgtggtttactgtcgtcgccggctggccactgcctgcattcaatgacatggaacgggccaa

SEQ ID NO: 29824 - DNA, 753 bp, Triticum aestivum
  Clone ID: PAT_TA_29824
gccacgaacaacctcaaaaaacgtcagtcttaatctacactctcaacacaatgacccagcccagcctagggccctaggcacgagaccagacctgctgctggtcttggaatacaacttgcggtggaaacagaaactagtagctagaaagcattacaagtcataatcagcccaagagatcatcacaaaacaaaacacacagcattcgaccggccgatcgatctactccttgtcaagaacgggcatgcagcatcctatccacaagtgttcaggcgacgcacgagttgaggcccaggcactccatccacaggctcctcttccgtcttggccggtaccggcgggaggcgagctccggcggagtcacctggtacaggtcctcgtcgaccggccgcaccaccctggacgcggaggcggctctggacgtggctcgcgccaggccgccgccttccggcgccttcgcgcgcctcccctgcttctcccgggccacgtcgctcctcgtcttcttgggcgccggcttgcgcggaggcggcgagtacttgaaccatacgtcgctgcagtcctccggctccggggcgtagcgctcggccggcggctcgtcgtagccgtggcagtagttccactccccgaacgccggcacctgccgcctcctcgccttatccatctggcttgcgcggcacggggtgcggacagaatgaggtggagaagaagagaagcaaagctggggccggagggggtgaggtgagtaggaggagtatt

SEQ ID NO: 29825 - DNA, 489 bp, Triticum aestivum
  unsure (1)..(489): unsure at all n locations
  Clone ID: PAT_TA_29825
ataaaaccataanncannnnnnaannnncnnnnnnnagatatcggaaaactttccccccattctgaacaccgtgtgacacgagggatttattctcaatactactcaagtcagcacaaagatacatgtaaaagcttcaaagaaaataaggcaagcttcggcatagcatgactccgaactctggatacgggtgggccgatgaagccatctggatagtcccaatgtagggctgggcaaactgcatccacatggcgcttggtggcgccatcatcttcgtcagctcttggcacatggagacaccgccggtgagcatcgtaggcatcgttgtcatgatcttgccccctgtggtgtacagagccgccccttcatggatttttgtggtgagggcggtgaggtccggcgtgtatgagccaccggatgggggtctcgcagccgtcacagcttcctctgcgaccatatctcggccgtctgagctcccacctcgccctgcg

SEQ ID NO: 29826 - DNA, 681 bp, Triticum aestivum
  Clone ID: PAT_TA_29826
gatattggaaaaactttccccccattttgaacatcggggcacacaagggatttattttcaatactactcaagtcacaaaaaagatacatgtatcttcaacaaaaaaaatgatacaattcaccgtagtgcaagactaaactctggacgcacggggggcaagatagtcacatttatagtgtcccaatgtagggctgggcaaggtgcatccacatggcgctcggtggcaccattcttctcatcagctcggcgcaggtagagacaccgccggtgagcatcagaggcatcgtcgtcgtgatcttgccccctgtggtgtacagcgccgccccttcatggatttttgtggtgagctgggtgaggtccggcgtgtatgagccaccggatggggatctcgcagccgtcgcagcttcctctgcgaccacgatctcgtccatctgagctcccacctcgccctgcgccgccgcccggaggccggcgtaggggagcatgacgtggcaccccgcgcagacctgcatgaacaccttctgcccgcgctgtgccgcgtcctgcggcgcccacgagcaggccgccgtcggtgcagccatcgccgtggttggtgccggagtactaccactatacttttggttccgccggtggtggtaatttgctgtgtgcgatttgcgtgtacgagtaggttttgtgtgg

SEQ ID NO: 29827 - DNA, 1172 bp, Triticum aestivum
  Clone ID: PAT_TA_29827
tttggtgaacttttgtttttttcgcgattatttatctcactccccacagtacatactccagacagatatccacggcatcgtccacttacaataaataatcaaccaacgctaattgtgggcggtacccttcttcctgatctctccctcggccccggtgaccacgccgacgtcgcccatcttgatcatggacgcgctgaagtccttaaagaactcgccgtcgaacttgccggtggcgatgcgctggacgtactccctggtggtgttgtcgaagaggagcgccgcatcggagcggaagaggcccctccgcttggcgacgtggcggtagtagctggtgtcgaaggtcttgaagctcccggggtccatctccgacagcatagtgcggtcatcaacgctcttgcacttgagcctcagcttgtcggcgtactcgctgtccagagacgggtcgacgaggccataggcatcgttctcgccggtgctgttgtagagccggtcggcgaaagacgggcagtgcgccgtgccgagcgtgtgggcgccggagaggacgacgaggtccttgaggtcgaggcccttggaggcgaagatcttggcgagcagagggacgtcgccggaggccgggggcagctctttgctggcctccgtggcactggacaccctgccgtctcgcctgcccagggccaccggccagaaggggcccttagccagcacgacagcgtcacgggacatgagggtgagcacgtcggcgcaagagacgatacccgggcacgcggcctcgagcttggccttcacccgctccacggagccgaaccctcgcaggctcttgttcggcttggcgtccttctccgccacgttgccgtcggtggattcgagcaggacagaggcgtcacaacccctgacgaagcagtcgtggaaatgcagccggaggagcgggccggcgaggctgggcgcggcggcgatgatcttggccatctccccgcggacgatcttctcggcgtccgggcatgtcttgctgtagaagccgatctccagctgagccaccgctgccgagctagctgcgagagccagcagggccagagggagcagcaaatacctgaccgccatggacctcaaccagttgcacgatcgaaccctcctccgatttcctcgccccgggcgagaatgtttcagtactagca

SEQ ID NO: 29828 - DNA, 668 bp, Triticum aestivum
  Clone ID: PAT_TA_29828
attaagtactttacttatggtctgatttattgctttatttagtcaaatgtacagcaagcaattggtcatgtatagatgaaattaaattcaccttttctacatcaatttgtacatctacaaaaagtaaactttcatgagacaatgcttgtctgctaggtacgacctgtagcttgccgtgataagctctacccgatcgttcttcttgacgcaatattccttcccattctattatcttcatgctgagaaagcacactttctgtcagctatagcggtacgccgcgctggtgaatatgcccatgaacgcagccactgattatggtggtacttaacagcagaacttgtggaaagtcctgtagattccaaattgacgaggactaacccggcgacctcgcgctcgcggtcctgatgtagctctgcatctcccgctccttcatgatgcggcctggatgtcctcgtccagcgcctcctgcggctccttcacaagcccgtccaccactgcctttgatccgcacccgtgtgctccgaaggctggaccgctggagggggtggagctcgcagccggagttgaagagggcacgagcgcgggtgagggcggcggcggcggcaaccctagctgggagatccggcaaagaaatcaaccggccacccatcctgcttgcccccttggc

SEQ ID NO: 29829 - DNA, 707 bp, Triticum aestivum
  Clone ID: PAT_TA_29829
gcacaaaaaaagctttcgaagttttagccattatagggtaaaatctatatataggatttattatgtactcccttcgttccaaaatagatgacccaactttatacttaagttagtataaagttaagtcgtctattttggaacggagggagtagtatgaaacagaatggttttgtccaagtttcaagttaagaatatgcaatcggcaggaatcatcaaattagtacttctgctagctgccaactatattaaaaccaggaaggtgcaagaaacctaagaatatgtaattgaagagaatatgtggttcaagattcagaatccagatcaaattagcagttcaccggcaaagaaggtcaattagccattagaggatgtgtgaacgcttcaagaatatgtaattgaagattccataataatccatatcaaattagcagtttgacggtaaagaaggtcaaattatccattagaggaccataagatgtgtgaaggctatgaaattgtatatttaataaaaatatgtaatggaagattccataatccagatcaaattagcagtttgctgtaaagagatcaaattagccattggaggaccgtagagatgtgtgagcgctttgtgactttaaatccaggatgaagtacaaaacaaactgccatatgttgaaagtaatcagcaggattcatcatcaaattagccagtgtgttcaggaatc

SEQ ID NO: 29830 - DNA, 1561 bp, Triticum aestivum
  Clone ID: PAT_TA_29830
tttttttttttttttttttaaacaatacaagactgccaagtgccaacatatttcatgcttaccggcagtgcccagttgaagtatagttttatatctccatttgcatcttctattggagttgctcttttgaagttgcctcttttttcaagatgtaaaatgcattttttaaagatgtaaatttttacatatactgttttacatctccaaatttgcatcttccatcggtgatgctcttacagagcatgtagcagcagcagtggcacggccaacctgaccaacgacccacctgcagttcactgccctttgctccggcaagcctgcctcaggggcatgggcgggtccgagagcccgccgccgacgatctgattaaagacgaacttgttcgctgcctcggtgaagtggacgccgtcccagctcactctcctggccgggtcgtcgcaggactttcccagcaccacccacttccccttcaccagcaccttcccgccacaaccaaccttcgggtcgaagttgtacgggccagcgtcgtgcccgcagcaggtgagcagagcgtcgtcgaagcctagcttgctggcttggctgatcagcttgtacttggcggcgtagacatcgacgtaggtgaacgcagcgtcggggtaggttttccggagacgagccaccgtttccttgagcctctggttgaagagctgcgcaaccttgttgtaggtgacggagcagccaaccttgtccttgaccgcggcaatgtcggggcggtgaatgagagcgtaaggcaggcagccaataggccccgtgctgtggatccagaagttccttcctccgaacccgtgcacattctggattattgaggtgagcctctccatgagctcaggaatgaacgctacgacttgttcagtcgtcatgttcgcgaagtagcccgccgtgatgtcgttttggccgatgtcgaaggtgtacagcgcctgggagaagtactcggcctttggcaggagctccctgtagatgccacctttgttgttgtaaacgaactggcttctgttgatgaactgttcgaattcccaggactgcacgtccaaggagatggggctgaaccccgagaggaacagggatgtgttctgtcggctgattgtcgagccggctgttgcgaaattggccccctgcgagaagttgcttcctactgagttgaggtacgcacttaggtaaggtattcccaggttttcggcgatgaagtcgatgacgaggcggccgtcgcagtagcggccggcgggcatgccgaagaaggtcctgccgttgggcggcggcgcggcgccgaaggcggccgacagcccgcccgtgtccgagttggagtcccccgaagttgaacacggccgggaagtggcagtcggcgcccgcgcccgcgcccgcggaggcctgcagcagccacaagaacaccagcgacagcagcgccgcggctccggccgtggcggtgcggccagagccacccgacgccattccgtgggtcacctgagtgtggccgcactgaggcggcgggatgtgggggcgcgcgggcggggaggcctcgtgccga

SEQ ID NO: 29831 - DNA, 1230 bp, Triticum aestivum
  Clone ID: PAT_TA_29831
gttttttttttttttttttgagtgaattggttttctgtgttattgaagcagcacgacatatatacagaagctctaacaattgttcttaccaatcaagtcccaatcagaagttcagaaccgctacatcaatcgacacttaaaaaccaaagaagcatggccctagcaacctccaagcatcctaactgagcaagtcaagagtgtgaggtttctcacataacttggatggaattgcaaccaagagatgccaccaaggaacccatgctcacatctgcataggtgtgcccaactgtgctgtggagccaccagcagaacgccgcctggcccgccgctgctcatagtcagggtcatcagtgggcagctcgtaacggcacaccgggcatgagttgcgtatggcgagccatggcccaatgcacgccccatggtagaagtgtgcacacggcagccacgtggcgagctccccctgcacgatcccgtccttgcacacagcgcatccctgtgcggcctcctccccactgatcgccaccacctggagccgctccaccgctgcccgagccgcaggtggcgcgccccccaccgtcacgtccgccatatgccccggcagcacctcgaactcgtcttcatccagcggcaccggcagcacctcccagccgacgctccggaatatgtcgtcgagctccgggccctcgtcgccgaaatcaaagggcggctcgtcggagaacatggactcgtcctccccgctgtcgatcccctccatgacgcccaggatctcccgctcgctgaggaagccgaacacgtcggcatcggcgtcgccccctccgcctcctcctcccgccccgcacccaccgccgcccccagggacggaggcgtctccggcgtcggcgtcggcggcgtcggcgatctcctcccactcgaggccgtccgcgaggtcgtcggcgaggtcctcctcgaggcagtcccagaagggcggggagcgggccggggaggggctgcgcatccggaggaaggacggcgagaggcggccgaggccgaggctgaggtccaggtcgaggtcgtggtcggagtcgaaggagaagggggagcccggggcgggggttagggtttgagattcgatgtcgaagttgggggagatgtcggagtgggtgaagtggtgctcctcctcctcgaaggcgtcggagaaggagaggtaggagggctccccgagcgaccccggcccgtcctcgtcgatgccga

SEQ ID NO: 29832 - DNA, 1303 bp, Triticum aestivum
  Clone ID: PAT_TA_29832
gaaagaaaaccgaatggttcgctgaatactagcaaagctggtgaaacttacaaatatatcaagcaatgcatgcaattacttactttgtcccaaaaattatactggccaccaacagccacaaatgaaggacgctggtgctatactattagatagatagaaaaacctctctgtacacatgacaacatatgctcaagtctggaaccactctattcgcgacgcatcatcaaggatgtgacataagcacttcggtgacatctccgattaattgtttgttcatccgtccgttcaatccgtcatcaaccactggacagtcttgatatttggcgctgcaaggcggtacaacaactcaagagctcttgtcggcggttttcgttgaaggcagcgttccaaatacgtggtcccacagggtcgatgtgattccaaagcccttgttttggattctgaagtgatggttcagatggtatttcttgagatattttgcaggatcgaatgagggctgtgcgtgatgcaggtagtagtgtgtgcaatcatagatcacgtaacccaacaggccacctccaaacacgccaggagtggtagttgtagtagtgaagagcttgacaaaattccagaacggatagcacaagatggctgcagcagttggtggaaacacaagtcgaagtccatccattggatgcttgtgatggcatccatgcagaaggtagtgagctgtgtttgtccagtaacttttagtatctatgtggaaaaggtaccgatgcagcacgtattcaaccagtgtccagatgaatattcctgccacaaccatcagcgctacttctggaactgtgtggcccatttggattgatgtattcaagcaccagcaaacaacaggcaaccaaatgagaggaactgcccaccatttcgtacgtgttaagaactccaatacatcattggcaaaaaaccgtggcccctctttgctaacaattggctggtgaacccagtcctgatactgttcctccagatgaccaacctgaaatacaagaggcttgtccaaatcgacggtaaaggcttgagcaaccattgtcttggactgtgattactgttactgctcggcgcaatgccttccgccgacgccgctggagggggaggggcggcggggggccgggccggcgcgagcggctggggcgcgcgcgggggagggaggccggccgccgctgctgctcgcgagctcgccctcgcgccgtttgtcctgtacccacgcagagtcaaacaaggcaccaaactaacaataaatcaaatgagacggtcacgtggctgccgcact

SEQ ID NO: 29833 - DNA, 701 bp, Triticum aestivum
  Clone ID: PAT_TA_29833
ccgtgctttttctgctgtgtgtgtctagcattaatttgcggtgaagctaaatcatttcttattcagcagagagagacaaagagtaggagttgaccagctagatcagcccccagtgttctccaatccttcctacctacacacataagatacttattgcggatcaagcaagcaagcaaccgtggagattgatctacacataacagtaacagccagcgttcctacaaagacttgaaacatcaccacgagattaatggatctacaggcaggctaagcttcaagccagcttccattttcacttcttccccgtggcagcagcagactgaaggccgctccagtcgatcccgcccgcgatccgcagcgccctctcccgccaatcttctgccgtgttcttcgattctctctctttggtcaatttctccatatctcgccgcgttagtctcgggccttcatccaagccctcgcacaccaattcaccattctcatcagtgtaacagaggatgcccatgtttttgtcttcataaaccttgttcaccttgcaggcgaagctgaccgaactagaagcttgttgcctggattcggaactggagcagccatccatggaagctcttgcgcaaatcttcctccttgggactatgattgcagcagtagacgagtagcacctcaaggcagccatggccgagctttgaggcgtggaaccacac

SEQ ID NO: 29834 - DNA, 934 bp, Triticum aestivum
  Clone ID: PAT_TA_29834
tttttttttttttatatttttatatttgcaaaaataataaaccttacaatttaggtacgacaaaacgaaccagccgctaaagcatcatgtacagcttttatacttgcaccgcaaagagcacactgagagccatgatcaggccagcccccaaactggctagatttagagtagaatccgaagtactggtactcgtctcgtcatcggaagcaccggtttccgaacggcgtggagacgttctttggggtggttgaagtcgaaggccggcgccctgtcggcgctgtcgggcccggctgctggccctgggcgcgtcggccgaccgtcggcctgaggccgggcggggaggcgttggccgtgtgcgacggctatggccgatgcgctggacgttctgcgcactgctcgccgttcgccgtcccggtgcagaagtacgttgtgccctccttgagcagtgggacgggggcggtgacggcatccttgctgaactccggcgcggcggcggaccaatcgacggtgtcgtcgaggccggagtcgtcgtagtcgcagctcttgtacagggtctcgttccgtgtctgcaccaccgagtgattcttgtccgtgttgaatatgagaaaatctccgagggtgaagggtgaagttgtggcccaaggcccacgcctgatagtcgaccgcgaggacgtcgtactgtcgtcgccggtcgccgacgtcttgtttcttgtaagcgtccccggcggggcgcgggcgcccagggcggccaccgccaaggcgacgacgaggacgcgccggctgcaaagctgcagcatcgcgcgcgatccgcgcgcgcgcaagagaaccgtaagaaagaagctagggccaagctacggccgccgttgcccgcctagctgttgcggccggagagatgcccttgtgacggccgacagtgcgccgtggcctcgtgccg

SEQ ID NO: 29835 - DNA, 1638 bp, Triticum aestivum
  unsure (1)..(1638): unsure at all n locations
  Clone ID: PAT_TA_29835
taggggcccttttttttttttttnttcnnnnnnnnnnnnnnnnnnnnnnnnnnnnnnnnnnnnnnnnnnnnnnnnnnnnnnnnaacaacctgatcccactttccattgtgccgaaacctcatcaaaaagaaaaaaaaaactttccaatgtcccgaacaataccaaaagcacccctgccttggacaaatttatcatattatcaagtagtatttttttttgcaaggaatttattctcaggctaaacaaaggggccaacggagttatccatacaagtacacacaaaaaaataaaacctcacaacaaacacaaaggagcaacttcttcagacccggctctttcttcgtcctccgcctgtcaacggaattgacaggtttcctcctcctctcctaagtttttatataaaagtaatccgtggagtaattggtcgccaccagattctcaccccagcaaaaatggtgctgggatttgtccagcaaagacagctctcatgcggctgacgctgacccctcccacttgttcaccacctccttcagttgctcaaatcccattcggtttgtgaagctcccaaaagattcgccttcctggcgcgtgctattccagtaggaaaacagtggttccaaaaccttctcgatatcttgaagcttcactttgttcataaacgtttctgccaaggtggtctggtttggtgttcctccaagccaaatctggtaactgtttgggccatcaccaacaaagccaacctctgccatatatggtctggcgcatccattggggcagccagttatcctcaccactacagactcctcatccttgatgccaaccttgtcgaaaactgctctaattcgtttaagtatcggtaggatccctcgctcagcttctgtttgtgctagagggcacagaggtaaggcagggcatgccatggaggttatgttcaggagatcaacatcctttggttccaacaggccagcttgagcaagagctgcagttatgggttctctccatgcctgatcaaccccacataagataaggttctggtttggagtaatactaacatccaagctatacttctcaattatctctcgcagagttttctttgcttgccccccaagacgaccattatcaacatgcactccatagaataatttaccatcgccctgttcctgccagccaaggtagctgttgaattgccattctggcaatggatgaaaatcttcaaacttctttccatagtatttttcaacctcagcccggaacttgtcaataccccagctgtcaagcagatacttcattctgctatacctgcggtcatctcttcttccattctccctctgagtgacaacgattgcctttatagcatataatatatcctccttaggaacataaccaagtggatcagccagacgagggaatgtggtttctattctgtgtgtccttcccatgccacctccaacatagaggttaaagccaacaggctcccctgcactatctgaaacgacaacaacaccgatgtcattggtcaggatatcaacagagttatcaccagcaactgtgaccgcaatcttgaacttcctgggtagatactgggtcccgtagattggttcaggggaatcagggaagtttgttcggacgcgtgatcaa

SEQ ID NO: 29836 - DNA, 679 bp, Triticum aestivum
  unsure (1)..(679): unsure at all n locations
  Clone ID: PAT_TA_29836
atctcaaacccaaagttaaattgcacgctggctgggagctataatacacttcactcatattactcctcacatactacaggtactattcaccatgtacatagtgtatatatcataggtaaaaatatggcaagggatccctaatagtacagcaatatctacagagcagaatttgttttgctgagagacctacacgctggccttctcggaaccaatctgccacatgctgatcgaatcctttacgcgatccgtacgcaaatcgtggtaactctgctctcagaatgagaatcggcagaggatcgggtagcaaaatgttgaaaaacacacacacattgttcgcggaaggggaggatggatggatcgccgttcatttcttccagctccggcagcgtaggaccgagtcgtcgccgccgacgatccatgtctccttggcgatgtccatggacacctggaagaagtcgggcgggtacctcatcaccaccaggttctccttctccggctcttcctcccttgccttgttgctgtcgcccttggcctcctcgtcctcccctggttcggtaacccatactccttgcaatagggcctattccgaatcagattgccacacgttaactaaaggggcgcccggcgccaattcccccaaaagggtctattgccggccaaaggccttntttnaactcng

SEQ ID NO: 29837 - DNA, 747 bp, Triticum aestivum
  Clone ID: PAT_TA_29837
ggaagagcaacttttgcaagatggatggaacggcgtgacaaatgccgccgctggctaccgccatgatcaacaacattaattcttagcatccagtagcagctagctagtgcttagttcagtagagtagaggaggtacatatttatttatttattatccaaagaagaggcagcaaaaggcctagtagccgggggtcttggtgaaattgaagtggccgcactgcgtgaagaagggcagcctgacgaacccgaggcgcttcctggccacgtcgaactccagcacggtgttctccatctggaaccctccgacgagcaccgccggcgcgctgcggtccccggccttcaccccctccatccgcgcgaacgccaggcacgccgtccccggcctcaggtccaccatcgagctcagcccgttcatggtccagttcgtgccgccgccgagcgtcagcgtcacgcccggcaccaggtacccgatccgggtgttggccagcgactgcgtgtcgtagcacagctcgaatggcggcacgggcttcaccggccgcgccacgggcccgccctgcgcgccctgcgccttcagggccctggcgaacgcgtccacgaacgggcggtacacgtcggggcggagcagggtgaagggcaccttcgtgcacaccaccgcggcgccggcgccgggcacgcgggtgctctccacggcgatggactggagcgagacgtagtgcgcgggcgcggacgcgtgggcggacgcgtggg

SEQ ID NO: 29838 - DNA, 974 bp, Triticum aestivum
  Clone ID: PAT_TA_29838
gcatgtgtagattgactcattattgatcatggatacacaaagctagtcgaacacacatgtttaggaatagtaaacactcatattcaagcacactcagatcgcctacgtacataggtacgcatgcaacacacgaacgcgtacataagcagtaccgttttacaactcacaggactaacaaccacactggtgcttattccatggatggataccttagttataagcctgtcggtatacgtgacaaattgcttgatcatccaatccatgttccacgagccagcccgctagctcagttgaggggcttgccggaggcagcgcgacgtgcgtacaccggtggcttaggcttggacggtcctggctgggggttggggtttggctgcggcttggatggtcctggccgtggtttaggctccggctttgcaggagtgggttttgggtttggctggggttttggctgaggttgtggcttgacttctgggtccggctttgctgggtttgtcctagggttgggctgcgggtcgggctttgggttcgtcctgtcggaaccaatgtcgtctagtgaatacaccggcaatgaccctggctgaggtttaggatttggcttttcaggagttggctttgggtccggttgaggcattggctttggttgtggcttggcatctgggtccggaattgggttgggttccggctttgcacgagtcatgggctttgggtttgggttcgggttcgggtgcggcattttagggttgggttggggcatcggttttggagtgggtttcggggaaggcttggggtcgatgagcctccctccatcggcgaggctaggatcatccgccgtgaccatggcaaggaggagaagcaaggccaggtgaaagcacagcgaagtgcagccgagagacctcatcgtggcgaggtcttcttggtgctcaaatttatctatcacttgctgggtcactctacgtgaggtctgtttctgc

SEQ ID NO: 29839 - DNA, 1330 bp, Triticum aestivum
  Clone ID: PAT_TA_29839
ttttttttttttttttatctgcatgtcgggattgatcgcccttttgcaaatcgattcccacacacccgcgtacacacacgtccacgcctcatatccactccgctttccccacgctccgagcgctaacgcacgcgggcgcatcccagacacgccgaggatataccgtcagtcccctgacacctctcgacccactccatgccgcactgcacagtcccccaacggtgggcccctgacttccacgggctccggtacgtgacatattgcttgatcatccaatccatgctgcacgagccaccttgctcgcttagttgaggggcttgtcggagccaacgcgacgtgcgtacaccggcggcttaggcttggacggtcccgggtgggggttggggtttggctgcggctttggtgttggcttgggggtcgggtgtggatcaggctttgggttcaccttgtcgaaacgaactgacagtgagtccaatggcgtcgacttggatggtcctggccgtggttcaggctccgtctttgcaggagtgggttttgcgtttggctgtggttgtggcttgatttctgggtccggctttgctggagttggttttgggtttggctggggctttggctgtggttgtggcttgacttctgggtccggctttgctgggtttgtcctagggttaggttgcgggttgggctttgggttcgtcctgtcggaaacaccgtctagtgaatacaccggcaatgaccctgactgaggtttaggctttggcttttccggatttggctttgggttcggctggggcattggctttggttgtggcttggcgtctgggtccggctttcttgggtttgccttagggttagggtgtgggtcaggctttgggttcgtcctgtcggaaccaatgtcgtctagtgaatacaccggcaatgagcctggctgaggttcagcctttggcttttcaggagttggcttcgggtcaggctgaggcattggttttggttgtggcttggcatctgggtccggtattgggttgggttccggcattgcaggagtcgtgggctttgggtttgggtttgggtttgggttcgggtgcggcattttagggttgggttgaggcatcagttttggaatgggttttggggaaggcttggggtcgatgagcctccctccatcggcgaggctaggatcatctgccctgaccacggcaaggaggagaagcagggccaggtgaaagcacaacgaagtgcggccgagagacctcatcgttgcgaggtcttcttggtgctcagtctatgtatcacttgttgggtcactctacgtgaggtctgtttctgcgaagaa

SEQ ID NO: 29840 - DNA, 622 bp, Triticum aestivum
  unsure (1)..(622): unsure at all n locations
  Clone ID: PAT_TA_29840
nnnnnnnnnnnnccaaaaactgcaaacgaagtgctctgcagaaaaatactccagttgagacgagagctaaatcgctaaatggtttattgcttctacaggagaataaaaaaatatatccaataggtacagaaaagacacaccccgcagtccaattatccacaggcattaaaatccttatgtcatctatgaattacactacatcctagtgccccaccctgattctagctcaccggcatgacaagcatttcagagttcctcgcctctccatgcttgccttcctagagaaggcctaggcccgctgaaaatatcacaagaaagcagaataaatcaagccccggttggctgcaacgcctttattgttctcctcttccatgtgtcagtctccggttcaaaagtgagctcccaggttggccagtagtggaggtcctgtttcagagtgagcacgcgtggttttccgttcaaatggacggtcttcaccctgacgaactcacgatcttccaatcccttcaccacttcaataaaggactccagatctggagttggttgcccgttaacttcaactatccactggagagcataaagaccatatctatgtacggggcttccatggccggacgcgggg

SEQ ID NO: 29841 - DNA, 1540 bp, Triticum aestivum
  unsure (1)..(1540): unsure at all n locations
  Clone ID: PAT_TA_29841
tcgagcggccgcccgggcaggtttttttttttctaaaggaagcttctctttctgttttgtttggtccgaagcctcactgaccgagtagctgcgccccccggctgggtgccccagtctctgcgcccccccggaaaggagctgcgaccggcgccctctgccttaatcttttttttttttttttttagtcgcaaaacgcttaattgcttcttgtacaggcgactagaaaataagcggaataccgagcaggtacagaaaggacacacctcgcagtccaattatccacaggcaatccatatgtcatctatgaactacactatatcctcctagtgcccaccctgattctagctcaccggcatcgacaagaatttcagagttcctcacctctccttgcttggccttcctagacaaggccgaggcccgctgaaaatatcacaacaaagaaaaataattcaagccccggttgcttgcaacgcctttattgttctcctcttccttgtgccggtctccgtttcaaaagtaagctccaaggtcgacgcctagggagggtccagctcctgtatgagcctccttggttttccgtcaaagtgcgcagctttacccctaacgaactcaggcccttcaaatccctccacccttaaaataaggacccgcggttttggatttggacgtcggccccgcccactatccaattcacagtcttccaatcccttcaccacttgaataaaggactccagatctggggttggttgcccgttaacttcaactatccactggagagcataaaggccatatctatgtacgggacttccatggcaccatctagcaacataaactccatgaccttcctcgggcaaaaagccaagtgcacgcactgctgaatgaggatcctgaattatggatccacaccaattcaccatccttgttgaaccattaccatctcttacatcggttccaacaataaggtcaatttcttttccctgacgaaatattgtcatgttaagcacgccatctgaatcgatagattggtccaacttttggcaagcattctcgatgtcaagaaagcatgttattggttccttgttgatagccagaatcatatctccctgttccagaagcttttccgcttttgatccagccaaacaacctttgacccgcaagacttgtctgcgcacagggtccttcttagcgagagcctgcacccagttatcgctcaatccatagcttcttgctttcgagagcaaagttggataaagttccacctccagaagtctgacaagtggcattggccttcgaattccattgataagccgaaatggtccaggagtacccgagattatcttctcaaggacttgacttattgcatatattggtatacctctaacaaactgatggtcctctgaactgctacaaccatatttgagctgggtggaaaagcttgcccataacgcttgaactcttccttgctcatccgtcaatatacccgaaaatgagctgccgaaatcagtatcaagctcaanacctccatatttatgcacgatat

SEQ ID NO: 29842 - DNA, 1853 bp, Triticum aestivum
  Clone ID: PAT_TA_29842
aaactgatgaagcttaccaaatttatttgaaagcatatgctgcaaaaatccaacagctcttccatgcgttcagtgcttagatcatgtaaacagatctcacaacaagcatcaaaagtccgaaaatgacattcgtgacaatacaaagtagtcggtccagtaaacgttcgcagtgctagcatacagcagtctcactaactgcatgtgaatagtagagcaatcccacagcaaacactctcattgccttagaacagaagctgagctcaagacgaatcttccgaaaagttgacagccaggtcccagtagtgtggaactttagcatctgcaaacaccttcttggcagcagcctcgctccgacactgatgcacaccgaacctcggaaaggtgggcttcaccacgctaccctgccagactaacacgcagctattcaccggcttgtctggttcctcgtcggcatcatcctcgccaccaactgcagcagcccagtcaatccggttcagcatcagcttattgtacctcttgatcgacttcttccctccttccacaaccacaacacttataccatctgtgataaccgccgcaccagtcagccggttctcttgggcattcacgtccactttgaagcgggtctgggggtgcgacaggtctctgattctgtacacacaaacaatacaacctagtgtgttgggatcatcaaacagcttcctctccttcttctcacggcgttctgatggtgtgagtttgcgggcaatgttgcggtccacgtgagcctgctcacgctctgcagcagcagttcggatttccatctccatacgtgtcggatcctgtgtagcttctgcaccaagtactttcataaggttgctcatcttgaccttgggctttggtggctccaagaggccttgcctaatcatttcttgcctatctttttccttagcgaggcgcctctgtgttctgagcttcttctgctccttcttagtcagcttaagtggctgaggcggtggtggcgcaggctcagccggtggttccaatggttctggatgttccacatagatggtgatcttatccatattaagcttttccaaggagatgtcctcgtaagtaggagatagcagaattttcgagtcccatggctcaatgtcaggaatctcttccttctgcttttgctttggaggccttccaccaggagcaatttcaattagatttgggttcatgtctacctcgacctttgccttagcaagttgagcttgctttactttaagctctttggcttgtgcttcgccaaattgattcttaatcctctgcagttcagcctgcctcgaaagtttgccttcctcaataaactggaatcctggccttttaggacgaaggagcttagttgggttgatgcccatcctttcatcaaaatgaacagtagcttttgcaagcgactccaagtctggtttgataatctggaatgcatccttcttctgcttgttaatgttgaccttcagagtactcaggttgcttggcttggtcatgctgataacatttccatgctcatcgatttccctaccttgagcatcaagaccgagaacaggggccttggcaggtctttgaggaacattcagtccagtggatgtaccagggagcatgctggtacaaggtgcaaactgtggatcctggcgaaatcccatcttagtagcaatctcttgtgaaggaatctgtgtatcaggaattgcagtaccaagttaattaagcacaggtaatctcttgagtttttctgataattccctcttcagttgcaaagcctttttagctttcgctaaatcatcaagacttaagttgctacttctgccagcagatgaatttgcagttcc

SEQ ID NO: 29843 - DNA, 943 bp, Triticum aestivum
  Clone ID: PAT_TA_29843
gtggcgcgaaaaaacttattgtactggtatagatcaagaaactggtgtctatttggatcaacaaatcatcaatatcctgaatccagtcgtcaatgaagtacaccaatctgtgctggctagcaaaaaaataccaatctactatctctacagcaagctacacccccatctcatatacagttatacgtacaacctacttcatttaccacaccaattgtatacttgtatgatatacgtatatacttgcttcagatttaccgtgtactaccatgcatgttctgcttgcttctccatgcatactggcggcggcgccggccggccggcccaggcttctggcacgccgccccctgcgttattcagtgccatgctgtgcgtccaggtgatcgacagctcaagtgacgaagtcgtgtagcagctgcgacgacgacgaggcgaaccgctgccggtcatcggcgccgttgaggaagtcgaagtcgccggggttgccgtacagcaggccctgctgctcgggcggcacgtggccggcgttgttgttgttgttgcagtgctgcaggcccagcgtcagcgacacgctgccgctgaggtcgcccatgttgccgccgtacggcacgaacctggcgtcgtcgccgtggtgcgcgaacgcgtcctgcaaggaggcttgccgccgcccggccccgtggtggttcaggcttgaggcctgctggcgcgtacgtgcccatgtcgccgccgccgaggctggacagcgggccggcgtccatgctgcccaccggctccgacttgtaggcattgagcagctggctcgcgccggcgtgcgtcgacgtgctctggaactcgtcccggtcctggtcctccgagcatgccgcctcgtccaccttgaccgtgctggttcccggcgttctccgacgacgagttggtggagtccatctccgcgccgaactcctccttg

SEQ ID NO: 29844 - DNA, 822 bp, Triticum aestivum
  Clone ID: PAT_TA_29844
gccgcctgggtagtgcgccactgggtcttcaaggtccttgacaacatccacgaccaccccatgctcctcaacctcccagataacgggcatcgccgtgctggccgcatacttcggccgagctgtcgccgccgccgtgcgctgtcaccgccgcgtggtggccaccaccgcgccgcctctgcgtcggtgcgtccgagccgccgtgcaggcccgagacctcggctcacgccctggccatcgtgctgctccgggccgctgcacgcatctgagcgcggggctcgccgttcgccatgcgcacgcagcgccatccgaactcgctggtgcacgggtgctcccggaggtggtcagtgactcaggtcgttcaatccatccgccagtacatagctggctagcctccgtatgaatcaatcaagcagcttgttgtacacctgtacgtgcgtatgtattcgcgcgcgaacgacgacgggttccggcgttgatgtggctcacctcgacggcttcgctccacggctcggtgctcgtcgtctccaagctctggatcttgcccagctcggtgcggcacccgaggaacctcctggagacgcgaggaagcaaagaacgtggtccggggctaaccggagctggagatcgtgcggcataagatccaccggctttgacctccgaccgagccatggccgtagctatgtggcttgcggacgcgcacagaaagaggagaggaagaggaaaagagggtggcgagcggcgggcgcaaggagcagcggcggcggtgcgagctgcccagacgtggcggcggggccgggcggcgcgcacgagggcggcgctgcc

SEQ ID NO: 29845 - DNA, 392 bp, Triticum aestivum
  Clone ID: PAT_TA_29845
gtcgaccccgcgttttcttctcaccgcctgagcagcttgctccagctgcatggatcccatcgatgattccatccaaagtttttggtccagtccagtccagtggtgaaattcgttcattcgtttggttaaatttgttctgctcctgtacagattgagtgagtgagtgatactacatacatacatactccagtagccgtatacgtagaagatataggtcctagatcttgttggttccttgtaacgacggaggagtacttgcttcctctttcggttgttgtgtaggcgtcagtatattgtagtccacagttcatacatactcatacagagattggtcatgaactggcagtgccgtgtaacagaaacatgaatggaattggaaattattcgaattg

SEQ ID NO: 29846 - DNA, 1299 bp, Triticum aestivum
  Clone ID: PAT_TA_29846
ccgagggtccgccttccttccgcctgcttaaacgccaccacgtccaccaaacccagctagagcgaggcggacacccaagcaaccacactctcccaccctcagccaccgcacaaggaagaagcagaagaggtcttctctctccctgctttgcttagcttcgtttgtgactgccatgtcgtcgtcggccatggaagcgctccacgccctgatcccggagcagcaccagctggacgttgaggcggctgcggctgtcagcagcgccaccagcggcgaggagagcggccacgtgctgcaggggtgggccaagaggaagcgatcgcgccgccagcgctccgaggaggagaacctcgcgctctgcctcctcatgctctcgcgcggcggcaagcagcgtgttcaggcgccgcagccggagtcgttcgctgcgccggtgcctgccgagttcaagtgctccgtctgcggcaagtccttcagctcctaccaggcgctcggaggccacaagacgagccaccgggtgaagcagccgtctcctccctctgatgccgctgctgccccactcgtggccctcccggccgtcgccgccatcctgccgtccgccgagccggccacgtcgtccaccgccgcgtcctccgacggcgcgaccaacagagtccacaggtgctccatctgccaaaaggagttcccgactgggcaggcgctcggcgggcacaagaggaagcactacgacggaggcgtgggcgccgccgcctcgtcgaccgagcttctggccgccgcggccgccgagtctgaggtggggagcaccggcaacgggagctccgccgcccgggccttcgacctgaacatcccggccgtgccggagttcgtgtggaggccgtgcgccaagggcaagatgttgggaggacgaggaggaggtgcagagccccctcgccttcaagaagccccggcttctcaccgcctgagcatctagctcctgcatggatcccatcgatccatccaagtttttggtccagtccatccagtggtgaaattcgttgattcgtttggttaaatttgttctgctcctgtacagattgagtgagtgagtaatactacatacatactccagtagccatatacgtagatataggcagtaagttgtaacgacggaagagtacttgcttcctctttcagatgttgtgtaggcgtcagtatattgtactagtcgacagttcatacatactcatacagagattgggcatgaactagcagtaccgtgtaacataaagcatggatgaaattggagattattggaattgatggaaa

SEQ ID NO: 29847 - DNA, 833 bp, Triticum aestivum
  Clone ID: PAT_TA_29847
gcccctaacaatcaagttctgctaattacttttttttttttgaattatgagaccaatcaaacctaatgcgttcctcagcaacaaggttcaaaaaagaagggagcatgcacggggggagagaaaaaaagcaaaataatgatgtctactctacgggtgggacaccctattcacattatccctaggagcattattacagcatttaccatgtcattagcctggctattggctggccggcggattccccttgctagccccattcaccgctgggttatgttgacaaatggctggtggtgttcccgtgccggtaagcaagttcctggctggtgttgctccggtgacaggagccgcattcctagctggtggtgttcctgtgccggtgagcaagttcctggcctgtggcgttccggtgccagtaagcgagttcctggctgctgttccagtgccaggagccgtgttcctgactgcaggtgttccagggccgggagccatgttcctgactggtggtgttccagtgccgggagccgtgttcctgactggtggtgctccagtgccgggagccgtgttcctgactggtggtgttccagtgccggtagccgtgttcctgactgatggtgttccagtaccgggagccatgttcctgattggtggtgttccagtgccaggagccgtgttcctgactggtggtgttccagtgccaggagctgtgttcctggctggtgttccactggcaggagccgcatttttagccggtgttccggtggcaggagccgcattttagctggtgttccggtggcgggagcgcattcctggtggtgtccagcgccggcggccac

SEQ ID NO: 29848 - DNA, 1049 bp, Triticum aestivum
  Clone ID: PAT_TA_29848
gggggaaataatatttatttccaagttggctatagaatagtaacgcaatgagacaagagatggtatatgaaattcgtacgcgttaatacatgggggttgtctctgtgattctaggatatatgtatgcgcttgcattcccaatttcccagacaacatttagagctaaaaaagactagaacacttgatagaggagaacgaagctgcttggttcaacagaccgcaagcaggatggagatggcggtaggggcggcttcgagggtggtggtgcaactggtgcgtggagtcgtggtcgtcttgaaggatgcactccagctgcaaggtgctcgagggctggaccttgaacggccaacgagcggagacacgcccttgcaccaggtaccggagctgccgcttaacatctgcatggtatccgagatgttcctgcagatccttgccacggggctcggcgccctcgccttggtctgggcgaccgtcgtcctgctcggcggtttctccacttatctacacaaggctgatttctgggtcatcaccgctatcgtcttcatccaaacagccaggtacctcctcagtcctcgccctcttcttatgactgtagatgactagtcctgtactacaaacaggtccagtaattagtttgcctctgttgagcaacagggtcgtgggcataaatgtaagccccgaggcagaatttttcaaccaagttccacaagcattcctcgaattgggcgccgagcactacacgaaatgggggcgacgaagacccctgactggccgagcaactggccaaaacttcgtttactatctcatgctggcacttggaagtgcaagggatttcataaccattgtggccttcctagcaatattggtccttgcagttccgatgatcgcagggttaggctgcatatcactttccatctatcgtctcgttgccctcctgtcgagacatcatggcaatgacaatgtgtttcgtgcactcatcttgtggttgtttctgaggctgtatcgttcttatcttgcaaaccacgtgagcttcaagtatgacttaggac

SEQ ID NO: 29849 - DNA, 1194 bp, Triticum aestivum
  unsure (1)..(1194): unsure at all n locations
  Clone ID: PAT_TA_29849
ggggcatataaatacaagtttcaaaattcaaaatttttagtttgcccagttcaaagctcgtcgaatcgtcgcctgggatgggcctcatcaagccctctctcgggtgaaccggccatcttttagctcctatatatagataaatagatgtacaagccacattgagttgacaaacaacaacagcatgatcctgctacccgatgttggccacgaacggcaccaggcgcttgtggtcccgcttgcggccgagggcgcaggtgtcgaggacgcgcccgagcagcagccgggtgttctgcagcgccacgtcgcgcgtgaccagcccggtgtccacgggggcggcgacgccctgggccgccatcatggacccgaaccccgacccggcggcgtactggagcggcccgctccgggccttgaacgacgactggggaagcagcatcctctccagcacctttctcacccgtcatcatccccccatggccgccaccgttctcgcccgacagccccaggctgtcgtcgctgccggccgtgccgccgccgccgcagctccgcagcagcgcctccagcacgttgagcgcctccgcgcacagcgcgctctccaccagctgcgacaccacgttgtacacatgggggatctgggacgggtccaccgggggcctccgcctgctgcggcggcggcatcaggagcaccacccgctggtagtccagagggcccctctccaggagccggcagaggtgcccaaaggccagggacgagtgcttcggcacccgctcggcgcagatcggcggcgaggcgcgcgcgaggaggtcttccagcgagatgatttccccgtaagagtatgctctgaagacctcggctaggacatgaagagatttcacacggcaccatcctgagatattggatgccacatagtaggccttctggttctgttcttgtagaggcgaagctgacccgagggaagatacgtccttggtgagctgcaacccgagccatgggagcagacctgtgatgtgcatcagcagccttgtctcgggattcccaaatatagaatcgcatgtgggcatcgtgatcctggatagcacctcgattgcagacccatggctggcgctagccatgagccctttccttttgttccgtanagncagggttngttccnncaagggngttanattcgagaagagtatnannnntaacncatc

SEQ ID NO: 29850 - DNA, 754 bp, Triticum aestivum
  Clone ID: PAT_TA_29850
gctactactaaatcagcggcaattaatatggaactaagggagtataaaacctagtacaaaattacaaataaatcttaacaaaaatttcatgtggtttgcaatcctatgaatccaagaactcaggtagaaaacatgcctaggattagaaccctctaaaaattctttgaatcaaagaggctcaatgttatttttgccgattacaaatttacaactaagcagcaggctgccgatcgcacatgcattacacatgcaaacccgcaccgtacgcccgatctcaccggccacagcccacggcagctattcgtcgtcgccgccgaacggcgaccacgacctgtagtacaccgcgagcaggaagaacatcagggcgagcacgacccccaccggcgatccccgcccggagcggtaggcggcgtcgagcgactctcccagggcgaagccgaagacgtccacgagccggaggccggacgagaggacgcggatgacgaggacgaggccgagggggagcaacgggagccccacgggcccgaggagctccgacagggcctcgcgcaccgcctcgccgccgtccaggacgaacagcggccccgccaccaccgcccccatcaccaccgccatcagcagcccgtgcggcgtccggtagtcctcccactcccctctctgatccgacatcatcgcttgctccggcgaccggcctccggcctccggtacgtccagagctagccggctgcaaatggcgctacgctcgttggctcgt

SEQ ID NO: 29851 - DNA, 900 bp, Triticum aestivum
  Clone ID: PAT_TA_29851
tttttttttttttttttttttttatctgaaatcagcttggatagttccattcacgaattttagttatataaacttagaatacagcatcaagtaaaacttcatggttcgcaggatcgatgaaaccaacatgtcgatattgcacatttacatttcaaaacctcctatttgtccagttctccctcctctacacattttccatcgcactggaaatcctcagtttctacagatgggtattcacagtggagattcatacacaacgaaaaagtgaacacaaacataaggcatcgcgacctgtgcttgcacatatctcagtacgttccttggaacgatagtcgatcccgtagtgtgtcgataagagtattctgcgccagagtactctttaggcgaccaaatagctcgtcgccattgttagcctctgatgctgcctttttagcttcctcagtcatattgagacgcgcatatgcctcagatctttcaccaggatctgttaattttggaatatatttgagagcttcagttttttgaccggcatcaatgcatgcttccacaaatggtttatagcctcctggtggtctcttctctctcgagaatgtttccaaagcatcccaattaccaactgttgctaaagcacacgacttcaaccagtaccaccttttatcaggaaccttgaactctgatttcactttgactgcagctcgctcatttcccattacaatacaagtttttattgtatcactgacactagaaccaacaaatattgcttgcttcgtggaaacttctagttgatgcttagcaatttggcatgctcttcagcagatttggattcaaaaagatgttctttggtctcagcaaaaagcctgtgggcctgctcaacgagcctcacttgtggaccatggagag

SEQ ID NO: 29852 - DNA, 1264 bp, Triticum aestivum
  Clone ID: PAT_TA_29852
gacagatctaggagcaatgctgcgagtcgcagcatcagcgcctagcgaatgcagcatcgattggtttgtacttccatggcgattgtatagatgtgtacaagggtaaagcaaagatctataccctgaaacatacctcctattgaggaggtgggcagaggtttataggagatgacagaactcgcagatactgtatgtacacaacaacaaaaagagtgacccagttggggtgtcactctgatgcgactaggtgcctaataaaaaaactagcaaagcttcatcatctgatacagcctccaagaagccacaaaactcctgaatcatcaacaatccatggcagtgagacatagacctcgctacttgggtgtagagctgttgccactcccctcccattacaccagatgatgtagtctagctcatttattttccgacagctaatgaacacaacaactgattgctaaattgctaaaaaagaacatggtcatccactttcaaggaacattgtctcccatccacagtaaaatttgcatacatgcgatgaaaacattatcttaccaaaaatgtccattcatcccagcccgagtatctcccaacagttctttgaagaaacgacagtagcaaagtagagcaatgctatggggacgacaaagtttggacgactcatgaacgacgattaaatcgagccgacgaatctcaagcacagctgagcagtggccgctggatcctttggtcgtgcacttatcgtccacacactgtcgtgtgtggagcagtttcggtagcaaagtattcctttgagccagcaacttgattgactatcccaacaaaacaactcatcgaactcatcgaatccaaaacttccagaaatgtggcatctccttgtatgctccctgatcccaccttcagcatattgtagcaccaaatgtagagctcatgcattaacagggtctctagaagctaggccatctttcatgctactattgcatactccatcctctcaatgaagttgaccatccccacaagttagagtaggctttgcggtaacttcaccattgatgtcatctgatttttcaagcgccgaaactggaatgcctgccccattagagctctcgactatagcacccacttcaactgttgcaaccttaacttcactcttatcactctcaacagaatttgttggtggtgtaactagttatgctgctgctgttgatctttcatctactagaacttccaaatatttaacttctagtgagctttgcatatccctcgt

SEQ ID NO: 29853 - DNA, 1062 bp, Triticum aestivum
  unsure (1)..(1062): unsure at all n locations
  Clone ID: PAT_TA_29853
ttttttttttttggaaaatttcngagcatgtaaaattgattgggatgttatctgaatcccaccacaaatgctcttcagctttaattccaacacacacagctctgttctcttctccccaatgtacatcacttgaacaacagtttgagctaaatttctaccggaaagccttttattgcggtatagtgagcgacaacacgcctgtgggcacatcttcccttgtttgtacattcatctacactctacaacaggatgctctcaaagaataataattgtatctagaactaacgaatcagacaatgttattgatgctatagcttgcgatctctggatgactcgaattctagataggcttgcgccaacatttcaccgagccggagttgagcttctgtggagaggtgcagctggtcgtcgctgagcggcaggcccatggcgtcgacgagaatcacgttgggaagattgatacttttctgagcatctcttacgatgtcggtgtaattcccctcccctgatgcaagaccaacctggatgacgagcagattgggcgagccgagatcctccctgagatcggcgacgaggcgctccatgttgccgccgtaggcgcgggcgtcgtcgacctcgacggtgtcgctctcgccctggaaccacagcacggccccgagcgccccgccccggcccgccacggcggcgcgcgccctggcgacggcggcctcgtacagcggctggcccctagcccacatccagatcctggtgccgccgaccgcgcaggggacgaggccgagcaccagcgggtcggagtcctcgccggcggggtcggagacgccggagggcgcggggagggaggagggcgagggggaggaggagaggaggaggcggtgcgcgaagggcatggcggggccgaggccgcaggtcttgtgggtgtcgatgtcggcgtggagcggcggggcggcggcgacccagcggcggtcggcggcgaggcggaggaggcgggggtgggggaggtagggggcggggaggggcgaggtgggcgcgccccggccggccatgtggactggccggccagga

SEQ ID NO: 29854 - DNA, 1283 bp, Triticum aestivum
  Clone ID: PAT_TA_29854
ctccgggcttcggccaggcaatgatcaaatataaactcaaacgagcactagcattcattgttgtcccaaaaaagctggactcctggtatgaacaactaaacaaatcttgttcatttgaatggggttaacagatcatgcacacccgaaaaaagcttctccatgcggaaacgctataacttttacatggaaacaggcaatggcatgaactatatcacccccctagtacgaaaaaaagcttcactcattagtgcaaaaaatgcagtggcattaactgtaaaaccccccctagtataatactgatagtagttcatcagtccaacaggcacaacttattaatttgcctttgatgttgcctccaatctcccgactagtagcttcactacatacttcccaagaatgtcagcctcaaggttcaccttatccccaaccttcttctttggcagcacaacattgccttgcgtgtagcgcacaagcatgaagtcgaaccacccggcctcctcgttcacattgacgacggtgaggctggttccgtccacggcgacgaaccccttaggcacgagcaagctgaggatctctggcggcgcacgcacggtgacccagatagaatcgccctcgggccggaacgcggcgatctcgccggtgccgtcgacgtggccctggacgaagtgcccgcccatgcgagacgccggcgtgagcgcgcgctcgaggttaacgtcgtcgcccgcgacgcgctcgccgagtgacgtgcaccggagggtctccggcgcgacgccgaaggtgagcgtggaggcagcggtgtcgatggccgccacggtgaggcacgtcccgtcgacggcgatgctgtcgcccagctgcgtcccggcgaggaggttcttggtctcgacctcgaggtcgacaccgggagccgcgtctcccccgcccccaggaggcgtgggcggcgggccgatgcggcgcacgcggccgacctcctcgacgatcccggtgaagagggagcgcacggggatgtgggaggtcgaggaggaggagatgctcttggggacgggggagagcgagaagcgcagcggctgggcgcggagcggcgtggaggaggccacccgggaggcgaaggggagcagcggcgacgaagcgggcaggaggcccctgcggaggatgtgcgggtggcaacggacggccgcggcggcggtgggcggcggcgccatggcgagatccttgtcgcctggattggggtgggggtaggttggggttggtgctcgcgccgcgtcagccgtcagccggacgcgtgg

SEQ ID NO: 29855 - DNA, 151 bp, Triticum aestivum
  Clone ID: PAT_TA_29855
ccactaacttgcaatctcaacattcatcatacaccaaaacaaatgaaaaaggcatgtgacccagaaaagaaacgaaagggagtgcgcaccagcacgcctttgccgacccgggagaaactgtcggtagaactgagcaactccttcgtgtcca

SEQ ID NO: 29856 - DNA, 561 bp, Triticum aestivum
  Clone ID: PAT_TA_29856
ggttcgggtggggatcgccggttcgtggtgtacagcgggagcctcgacgggtccgtcaaggtctggcgcctgtcggacgcacaagctgcaccacagggtgcgccggcgccgttaacggagcgcacagcagcaccgtcgcaggcctggagtggccggccggtcccggcgacgtacgcggaggcgtgggcgccataccagccgatttcggagccgaagcgcgtggcagcagcgtgagggcgaagcaaccatgctcatacgtgcgcgcatggaaggaaacaatgtggtggccacacgtgtactcgagcagatcgtactagagagtgtacatatacgtaggaccagtacgagttgtgcgtgtattttgaggtgggaaatcagattgtcaattgtgtggtggtggccgaaatctggtccgtgcagttgacgggggaaaatgggcggtgggttgacagtgagaggtcacgggccacgtcaaattcggttgaccggagaggtgattttgtttgtaaccattgcgatggatttcgtgcgaaaaggtgtgaaatatgaaaaataataaaa

SEQ ID NO: 29857 - DNA, 543 bp, Triticum aestivum
  Clone ID: PAT_TA_29857
ttttttttttttttttttttgaatgcaagcattgctcatggaattataactgaaatcccttagtgctgaccagagcctgccctggcgcacatctgacaggatcaataggttggaaaaataagatacagcagcagcacacattcataaaataaatcaaagctacaagcacgcaaatatagggggatcatactccctccgtttcaaatgtctaaaggccatgaaaaagctctgctggtcttgggagtgagtaagacgtgctgctctccttgaggcacttggccaccaggatcctgtcgatgcggtcgtcgcctatatacaccggcgggacgtcatcgcttcagttgtgtatatcctaacgattcattcagaaaatccagagccttgcccttgtcccatgtaatgtttgttctttggttatcagcaagaaacccaacaactccattccaattggatattaccgttcatagtattaatatatcgtcctcttctccttgaaaacatcaatagacttgacgtgcacatgaaagccatcacatgtgttgt

SEQ ID NO: 29858 - DNA, 1232 bp, Triticum aestivum
  Clone ID: PAT_TA_29858
aagagctctagcattaatttcatcaaattgacatccattttacaagatcaacccaacccagccaagccatactaacgaaaggagggaaagaaacctgtcccaacacacccatggagtacatacatgttgtaaaaaccccaaaccggattgatcctcctttgattttggcagtcctttataatttaccaacagctgaaactcttgccctaaacattcctcccctcaccccatttgatccctacacctaattaagaatcctagtaattagcctccggcatgcacaagcacgcatcatgtccccggcaggcgcgtggagccgctgcagccccccatgtcccctcctctgtccgtctgtctcctacgccacgccggcatgcatggttgcggcccggccgtgtccccgctagctcacagccccagcaggatgtagtagacgagtgtggcgcgcgctcacaggcccatgcaggatgtagtagacgtgcgtgatgggcagggcgacacgcatgccgaatatgaccagacgaaggggacaatgccctggggcagcgctgcctgcacgatggcgatgtggaggagggtgccgcggaggccgacggcgatggagggcgcggccatgacggccgggcccgtcaggaaccgcacggccatggcgaacctcgaccgcttgttcccgcacgcgccgggccgcggctgcagcgctggcaacagcgccccccccgctgatgatctccggctgcaccctcatctcccccccgaggctgaacgggaccattcccagccccgccgctgcctggacgatggcgacgtgcaggagggtgccgcggaggccgacggcgaaggaggcggcggccatgacggccgggcccggcgaggaaccgcaccgccatggcgtacgtcgcccccttgttcccgcacgcgatgatccgcggctgcagcgccatgaacagcccgaggctgaacatggccatgccgagccccgcgtccgacaggatggcgatggaccccaggacgatcgccggcatcgcgaagttccaccggaagcagacgagcgaccagatgaggccgatgaggctggagtaggtgttggggttgcggatgagcttgcgccacaccatgatgaggatgaggcgggtcatcacgctggtcggcggcatcaccgtgggcgccgccaccaggcccgcggtgccctgctccgccgcggccttctcgtcgccggcctccgcgtccctctc

SEQ ID NO: 29859 - DNA, 625 bp, Triticum aestivum
  Clone ID: PAT_TA_29859
aagcaggacaagggcgacaccgaggaggcgcagagcgaatgcaatggcgatggcgcggcgcctgggcagctgtcctcgcccgccacagtcgatcccaagtgggtcaagaggatccttgcaaatcggcagtcggcacagcggtcacgcgtgcgcaagctgcagtacatctcggagcttgagcgcagcgtcacgtcgctccagacggaggtgtcggcattgtccccgcgtgtggcattcctcgaccaccaacgctcactgctgacgctggggaacagccacctcaagcagcgcattgcggcgctcgcgcgggacaagatcttcaaagatgctcatcaggatgcactgaagaaggagatagagaggctgaggcaagtctaccagcagcagagcctcaggaacgcggaacccccggcacacgacgacggccccctggtccgcggcgacaacagcaacggcttgatcgccagcgaggggaccgccgcgccctcgtgatcgagatccggcacatcggcctcaggacaaccaagtgttgtcgctgttcttcttgctgctgctactgctgctgttaagatttggtgcactgcattggcttggtttgcatatatcctgcggggtttatggtgtc

SEQ ID NO: 29860 - DNA, 1389 bp, Triticum aestivum
  Clone ID: PAT_TA_29860
ttcacccatcaaataaagtcgcttgcctccctcagtccactttgtgggcagctcggagaaatgctgcccctcgaactgaattcccacgctttattaggcaaaatcagtttctcatgatatgttacagtagaaggctagagctacgaaggtactacacaagatacacgtaccaatgagttttacagatcaacagactgaacaagatcacaaagattctcttacttcgattgcgcaagcacaactcagggtggctctatatgcgccttgccaatataggcacggcagtccttgcacttcgagaaccggagctatacgtcggccatgatcacggaattgccctgcccgtgatcaaggataactctgggttagcttttactttccccttgttaagatcggcatcgcagttgttgcacatccctaagccgtactgctccgggaccacgaaggcggccttgaccggcccgctcttaaccctgccgctgctctggcatttagattcggaccttacagcacgaggtcgggcttgtctttcggagccgtgccccatggctccggccaggaggcgccggccctgctccctcctctcttctcctgccgcttcttcccgaaggtcctggcggacctcacgcggggttctgttcagggaataatcatcagaatgacggctatcagagaggcgttgaagccgaactaaaacaggttcctcttctttcttcttccgaatatcctctccctggtgttcaagcttatacatgggatccgcaagcttgtctctttcttcatcagcagggagcaggagcgtctctgcatcttcaacatcgaaatcttcagtcttccgctgagccccactgattataacatactcagtattcttcgggtctgtatgtatgactatctcatgctggcaacatggtgatttcatactgaagctccatatcttggtagagtagtaatttccaacttgtttcttttcagcattaaaccttactcccttccctatcatggaactgcatccaccacaccagacattgaaaggcatctcgaatcttataatcaggatgccctgatccagcttcctggcccgctccctgagggcatgttggccgtggaacttgttcagcccacccttcttcgggctccattcgggcgggtagtagaagttgtcggccctcgccgcggcaagcgtcgacatgttgtctccggcgaggaggaggaggaggaggatatcagcggggagacgagcggaggtgcggtggctccgggagatcggcggcgacggggaggtctcgggcgagcggcggcggcggcggcgacggggaggttccgggtgagcggcgggcagaggaaaaggagatttgtgttttcttcccgtgccgaattcggcacgag

SEQ ID NO: 29861 - DNA, 681 bp, Triticum aestivum
  Clone ID: PAT_TA_29861
caattgttatttgattgtataaagaccatccatggacagttcaattctgtcggtgagaatgaggcgctgtaggaactgcttgagctgcacgagcgtgacctcaaagtcgggcaggaacatgcccaggcggctgtgtatggtctccagcggcagtgcgccgttgctgcgcagcatgttctgcacgaacgcctgcgccagcagctcgtcttcggtgaagctcaccgccgccgccgatgatgatgatgatgatgatgatgatgatgatgatggcttgtcggactcatcacttgccgtcgacgacgaagcggcagcactgcttgacgccgacgatgaagaacgctgggcgacgcggcgccgatgctcgtcctcgtcttcgatgacttgatagacgtcggtggcgctttcgaacaggacgcccttcttgatccaaaaggcgagcgccttgcgcgtgcggctctcggagatgccgacctgctcggccacgcgcgacagggccaggccgctgcctgctgcatggtcgtcgtcgtcgctgttggcgaacggggcaatgacggcggcgtgcagcggctccacggccaggctgaggtggcggccgtcgtcaaagtccagtgccagctcgacggtgccgacctgatggacccactcgagcttgcgcaggtgcttgtgcgcctcgtaggcggc

SEQ ID NO: 29862 - DNA, 1102 bp, Triticum aestivum
  Clone ID: PAT_TA_29862
ctctgatgattggttaggaacaaaactggagacaggcaaatccaaacttccaaaactttcccaccgggaaaccacccaaatcagtgtccctctccaagcttgcgaaaggatgcaagtatgaaccatctccaactctactcttcttgggcatcttcatcttcctcttcagcttccttgagccactgaataaaaacatcagactgtttaacgaaaactttatccggctcatcagcattttctttttcttccgcccatctcaaaattgcgtcttcactaactatctccttatcatagaggtaaggcaagatctttgaaaacagtggagaaaattcttttgtcatctcttgacacatttcctcgaatttcaatagtatttccatctcctcatcaactgtcttggtgtaattgcgtaaaagatccttccacttggtaagtgcgtccgcagttgactttagaagactatcattggtagattgtgcagcgactaatgcagccctcattatcgaatagaaaactgctccagcacaatctgcatgttgaaggctataagacaacctgagcgcgttgatttctagtatcaaattatcttgatgaaccccatcaactgcccgttggaaagtctcttcgacctctttctcaaacttagtataatcatcatcctcaatcacaccaatctcagaatcattgtcacggtctgcttcagatggacggttgttcaagtcttcttctgatccaacatcaccgtcaacagaaacagcatgctgcaactcttgaagtttttctttaggaattggagcaattgattgtctccactcctccagaattccagtatcaccacttgcccatatgaaccaaggacaccagagcctcgtcccgaatccccccctaagtcatcatcttccgataagatggtagggtggtcggcattactcctagtgctggaaaagggtgcactatctgtaactccagaattggtgtcagcatactcaagttcctcatcactatcttcatttgaaggcttgtcaagtagtgacacttttgaataggcaggaacaacaacattctttcgaactttaatcttaaacgacaagagcagccaggc

SEQ ID NO: 29863 - DNA, 1199 bp, Triticum aestivum
  Clone ID: PAT_TA_29863
gaagagcgcactgtggggcggatctgggtgacggctcccgtgccacctccccggaacgtggggtctcgccgtcgttatctccccgcacggtgcggtgttggtgaacggcgacggggccctagccagaaagcgcgaggtcggtgttgacaactgcagcggacaatcgtcgagtccgtcgtcgtcaccattccgcttagcatagtcgtcgtccacgtgctcctcttaaggttcctcctcgccaccacgggtggacgccggtgaggccagccttccctccacgcgtagcaactgaaaggaacaaggcgactgggaaatcctgggctacatatccttcctttccttgattttccttccaaaagctgaggaagatgccctggttctcgtcaaatgcaagctgcactactgtcaaaaagtgtactctattttgcagtgccataacttggtaatccacctgcatgataggtagatgggagccgggtgcggaggtgacgcgatctactcgggaatatgagaatgctataattatgatgtcaaattgataggcgcagactgctgcttctggaatctgaatgtacaccgccatgcatgttgcaagcaaagatctcttcagccatggcatctcacggcacggaaccacaaatggtcgtggggccccttacgttgatccaaatgagcccgtggtctctgctagaggaatgtattgtcttgcaaactgaattggttttctggttcatgtctttgcattttagttgctggagagattgttggatatactttgttgcttccagcccatagataaggcttgcgcggtcgctggcgggctcgttccccatgtgacctggatgcaaatctctggccacctacaagtgaaactgcttgaagaccaagttcgaatatgtatgagggtagtgaagttgggcatgcgagtctacttgcagtatcgcatcctgatgttatcagtccagtagtgaggggaaggtgccgccgacgaggatgtggaggaggacgaggtcgagccgggtcgatgaagggtgttgtggttggcttgctggccaagcagccacctctctcctcctcgtcttcgacatcgtgaagaacgatgatgaaatggacgcatgctgcaggagcagcagagacgttgtgtgagccttgggttcttcatcgattccttcgtgcatgcccttggtcacatgaacacc

SEQ ID NO: 29864 - DNA, 834 bp, Triticum aestivum
  Clone ID: PAT_TA_29864
catacacatgacacgcaacctctcattcctcttcttcccctgatctggtcgttccaattcttggcaatcgggaggaggcagccagtggacgggaaggccgggcggaagagaaggatgaggggacgcggctgcgagtacgccaccagccgtgcggattggatgggaagagaagtcggcggcggtggcggtttcgatctctgatctgccaccagcgccgccgcagggacgggtgaaagcatctgaggggcggcgcgggcccgggctcgggcagccaccatggcgtcgaatgcaccggtgggggcctcttcctcgtagcaaggcgtggccctgctcttccccatagcgctgatgacaaggcgggcggcgccgcgagctctcgtcccgaggaagccgcgggaggacgaggtcaagacggaccaggtcgacgtgcccccctgccacaccccttcttctcctacggtctgcctgctgtgcgcaatgatcgatgctcgcccgtagctgtctctgctggcaccaatggaggccattgcccgccattgccggcctcatgagcgcatctctggactcctacgttttacggacattgcttgtttatttgctgaatttggttcacttttggataagccatacatcagggaatcattcagcatgaataccattgataagggcgggagtttacctggcaccgcacagttgccgtgtcaggcggcgctccatgggcgcgcctcaaccgctagtattacaccacatgtggttgcatgttctctttcacacacattatgtggtaccagagcacaaaaactcaaaggtaacactatggaacaaacaactcaa

SEQ ID NO: 29865 - DNA, 783 bp, Triticum aestivum
  Clone ID: PAT_TA_29865
cctccaaaacaacctaaaaatcaggaccaaatttaggcccaaaaaatttctccaatgtgtgttcccctcctagcttgatctgtttgcacacaacaactctaatcaaaccccctctgtaatcctgccccaattacctatagtgtcactcacatatcctactcatgaggtggaagtgattcaaccaccccccacttgttgctactctccccctccttgctcctggtggcctgcccatccttccctatgacgttgctgatcgcggtggcgatggccgcagagaactgatttgggtccgacgccatagtgccggcattgtcaggcaatgccgttggcctgacgtcgtcaacgcctccggtgccccagaacggcctcttgccccctcctagcccagccgcgccgccgtgcgaagggttcggaggccacgggtacttgaggtgcgtcgccggctgagcggacagcccagaggaatgcccgaacatgctgaggtgctgagcaccaccgccgcccatgttgccggacattagtggcgaggcggatgagtggtattgggagctagagttgagctgtaggtaggggctgaggtaggaggaggacgccggcggcgggccacccgagacagccgcgtcggaggtggtgctagagagcagcatgaaggtggcagcaccggcgcccgcggtggcggttgacgccatggctgtagcgccgacgggcagcgggtggttgtgcgtgccctcgtacgtggtgatcaggatcgacatgtcctcctgacatctctgcacctgc

SEQ ID NO: 29866 - DNA, 506 bp, Triticum aestivum
  Clone ID: PAT_TA_29866
ttttttttttttaatgagtttctttgggaaagagaaagaaacagagaataacacaagttcattacatgaccgtatataatcagttcaaactttagcaatcagatgaatgggggaaaacaaattaggtagcagtacaacgagaagttattaaagctctaaattgaagcgatatactgaataacgcaagcgcttgcgttgttgtagcagagcaacaggaaccttagttcagatcctgttcttcgacaccagccaagatttttatccatttcatctctcctctcttcttcatcacctggtacgtgggacctataaaatccgtatgtgtacttccccatcatgcccaccagccatcaccgccgttgattctagtccagatccattctttctccttcatcgccgctgtcatcatcgtcatactcatcatcatcctcatcatcggtatcttccgatatctctggatccaaatgaagattaacgattggatggttaggatgggtgtccattgc

SEQ ID NO: 29867 - DNA, 1721 bp, Triticum aestivum
  Clone ID: PAT_TA_29867
gggtgcatgcatcaggatttattcttatttttctacacaaataagcttgtttagtttctgatacatataaaaacccatatgaacttcaaaatgaagtaagcattagaagcattacttattctaatctcgaagtctggtgtggggctacaacatagatcaacataaagcagtaaatgaatgaatacaggataaacgagctgatggtggatatcccaatatatatattgccagaatcttgaattgcagcttctggtaatcaaatgtacaaagatttgttcaggatgagcatttgatcttgtaatggaggtgttgtttcgctgatttcatcatgtcccgattcgcaacagctgacctcaaatttgcagcacctgacaatggattatgtgactcttcaggttacgtcctgcaatggtcgaccacaggtttgccacaaatgacttgtgctgacccttacgagcaacagtttcccacatgcatgcactgtcggtctcgatactcattgttggatgcaagatatcaacaagagtgatgctcatgttgttgcgaataatgcaaagcttaccatttaaagacaccaagcctgcggcttccgaggctcgcgccctgcctgggtggtgcctgcttgcagccatcccggcaatcagatgaatagagacgtccattgaaggaaatgcttgggtttcgccaacctgtaaccatttcatcatcaatggttgaccacaaattggatgacggtaggtacacttcacatgtcacttggcgatgggagtcaagcccttttaggaaccacttgtcatcatatacaactccgatgaaaggcaccatcccgttgttcatctcagggatgcagacccatctgttcctattagggtcataaacttcagcagactgaagagtcctttgtatgccttcacattctccaccagcaacatatagacaattgtttattacacaggaaccaaaaaagtgtcgctttcgtaacatatctggagctcgatgccatttgttggtccgggcattgtaaaatacaacacgtctcatagagcccctcaaaggatccttaccgccaaataagtacagatagcaaccactcagaacagcacagccaaaaccccaacgcttctgaatactctggtggaacaggtggaagggacttccagagctggttcagtggatcgaaggcatgccaggatattttcccctcacgatcccttttaaagacataaacccattcttctgccatgctgagtttcttgcgcaaggaataatagtaatttcctgacaaaaggcggttccatcttttacaaactgtccggagattggggtgttccactcgtggaacccgtataagacaggcaattgcaagatcatcaggaaggccaggcaaaagtggtgcttgagctcggcacctctccttccgcgagccccttgacttgcgcttggttagtttggcatcaggttgcatgcacatctttgctccagaagcaaattttctagcatccacgacagttttaaggcccgtatctaatctgcagtaacaggagacggactctaccagcggcgcgcggacgcggacaccagcgctgaccggcggcggggcaactctggaggctgaatccatcgctggatcgggcggcgaatccacgcggctttcggctcggtgtcgggggtggacgagaggctcgcggtcgccgggagtggggcgcacactccggaccggt

SEQ ID NO: 29868 - DNA, 415 bp, Triticum aestivum
  Clone ID: PAT_TA_29868
cctcagccgttgccggcggcgccccatccgcggcgaagtcgccggtgagctgggctgtccggcagcagggcattgctgccgccattcctcgcgcccagtaccccatctttccactacgccccatcagcagccgcgccgcccctaatcgtcggcctcggcagaggaggggaaccgcgttgccgacttcggcttgatcccctcaatcctcgtcggtggagtagggacaagcatggcagggcaaggataaggtttgggatgaaccacaccaacgtcaggcaggtcaatgtaacctctgtattgcaatttacgcgatgatttggtgcagcggaatggcattatatggtgagccgaaaaccaaatgggattaaacatggcatagctgatgtacatgcaccgatgtgtatatgtcttgctg

SEQ ID NO: 29869 - DNA, 688 bp, Triticum aestivum
  Clone ID: PAT_TA_29869
tgaagataggaccccacgcgtccggcaagacaggggcggcgggtagggaggggagctcgagctagagacggtcgatggccgtgtcacgctccggcgcggcgggcgtggccggcggcggcgacacgaccgacgacgcggaccgagcgcggctgcaccagctcggctacaagcaggagctcaagcgcggcctctccctcatgtccaacttcgccttctctttctccatcatctccgtcatggccggcgtcaccacgacctacaacggcgggctgcgctacggcgggccggcgtccatgacgctcgggtggctggtggtggcgttcttcaacggctgcgtcgcgctgtccatggcggagatctgctccgcctaccctacctccggcgggctctactactggagcgccaagctcgccggcgaggagtgggcgcccctcgcctcctgggtcaccggctggttcaacatcgtcggacagtgggctgctaccaagagcacggacttctccctggcgcagctggtccaggtgatcgtcctgctcggcaccggcggggcaaacggcaacgggtacacgcacacggtgtacgtcgtgccggctataaagctcttcttcctcgtcttgccgaagtcgattttgaaagcggccatcagcgggcctgtcgggggcaggggaaaccacgaattcgattattg

SEQ ID NO: 29870 - DNA, 978 bp, Triticum aestivum
  Clone ID: PAT_TA_29870
gccccgggggctcgccagccaccccgccccgcccgctcaagctggtctgcgctctgcgctcctctgcccccgcctctctcttcctgcggccgctgcatatagtactcttgcgttggctttagtttgccagcccacgcgtccgcccagcacaaacaagactgtactctgggctcctctgactccgtgtcttgctaaaatatctttggtcgactcgttgcgaggttgatcagatggcggaggaagcgaagcaggatgtggcgccacccgcgccggagccgaccgaggacgtcgcggacgagaaggcggcggttccgtcgccggaggagtctaaggccctggttgtcgccgagaatgacgccgagaagcctgcagctacagggggctcacacgaacgagatgctctgctcacgagggtcgcgaccgagaagaggatttcgctgatcaaggcatgggaggagaacgagaaggccaaagccgagaacaaggccgtgaagttgctggcggacatcacctcgtgggagaactccaaggccgcggaactggaagccgagctcaagaagatgcaagagcagctggagaagaagaaggcgcgctgcgtggagaagctcaagaacagcgccgcgacggtgcacaaagaggcggaggagaagcgtgccgcggcggaagtgcggcgcggcgaggagatcgtcgcggcggaggaggccgccgccaagtaccgcgccaagggtgaggcgccgaagaagctgctcttcggcaggggatagatagccgcggcttggagacggtcctcttcgcttcatcttcagcttctctctgtttgaccgttgcaatgtgtgctgcccattgcatcacttgtgtatttatctttgggagtgatcttagtttgtatggtatcatcaattgcgtcgtgatgtaatttgtattattttgtggatacttgggtgtatactgtataaagatggagtagtcttttcgtgc

SEQ ID NO: 29871 - DNA, 550 bp, Triticum aestivum
  Clone ID: PAT_TA_29871
cccacgcgtccggtcggacttctacttcggggacccgtacagccccgtgaacgccccgaacacggggttcctgtacgtgaggtcgagcgcgctcatggtgggcgtcttcgaggcgtggcgggcggcgaggctgtccttcccggggaagcacgagcagcaggtgttcaacgagatcaagttcgagctggtcgacaagcgcgggctccgggtgcagttcctcgacacggtgcacaacgccgggttctgcaacaacacccgggacttcaacacgctctacaccatgcacgccaactgctgcgtcggcctcgccgccaagctccatgacctcgggaacctgatgaaggagtggcgcgtgtatagggggatggacgacgcacagcgccggcgcggccccgtgcggtggaaggtccctgggatatgcatccactgatgattggttgatagcgatgcacatgtagtcgaccatttccttttgagatgtacaaatgtgtctgcagttgtgcgtaagacaagatcgaggtttatgtcgtcagctcgtagtttgctcaga

SEQ ID NO: 29872 - DNA, 1164 bp, Triticum aestivum
  Clone ID: PAT_TA_29872
cccacgcgtccgcccacgcgtccgctcccctggaagccagccacaacactagccaggcggcggaggacgagctggagcggctgctgcggacggtggcggacgagcacaagacggtgatcatgacgtcggtgaacgaggcgtgggcggcggagggctcgctgctggacctcttcctcgagagcttccgcgccggggagcggatcgcgcacttcgtggaccacctcctcgtcgtggccctcgacgccggggcgctggagcggtgccgggccgtgcacccgcactgctacctcctgccacccgtggccggcggcaacaagaacctctcggacgagaaggtgttcatgagcaaggactacctggacctggtctggagcaaggtccggctgcagcaaaggatcctcgagctcggatacaacttcctcttcacggacgtggacatcatgtggttccgggacccattcgagcggatgtcggtggcggcgcacatggtggcctcgtcggacttctacttcggcgacccgtacagccccgtgaacgccccgaacacggggttcctgtacgtgaggtcgagcgcgcgcatggtgggcgtcttcaaggcgtggcggacggcgaggctgtcgttcccggggaagcacgagcagcaggtgttcaacgagatcaagttcgagctggtcgacaagcgtggcctccgggtgcagttcctcgacacggtgcacaacgccgggttctgcaacaacacccgggatttcaacacgctttacaccatgcacgccaactgctgcgttggcctcgccgccaagctccacgacctcgggaacctgatgaaggagtggcgcgcgtaccgggggatggacgacgcgcagcgccgccgcggccccgtgcggtggaaggtccccgggatatgcatccactgagtctgagtggttggttcatggcatatgcgcatgtggtcggccatgtctgtttgagatgtagtacaaatgtgtctgcagttgtgcgcaagacaagatcgaggtttatgtcgtcaactcgtagtttgcttagaaggtttgagtgttcatatcgcgtcatgagaatgcgaatccacgaatagtgtatgacgtatgatcttgaaacccaagagagtgatagtatgagatgccctcaaggggatgatgagaagct

SEQ ID NO: 29873 - DNA, 1314 bp, Triticum aestivum
  Clone ID: PAT_TA_29873
ccacgcgtccggaagaggcggctgaccaggctggccctttcccttgcatcccccccgccccctcccctcgaacccccggcggctggctgcgcaacccgatcccgatcccgatcccggcagtgactgatagagtgatagattgctcctctacttgtatcgatcgacggcgcaagtgctcaagaccaagagcgtggaggcatccatctcaaggtgagcgatggatgcgcccctgcctccgcctgcttacgccgatggcgagcagacggacttcgtcctcatcaagaaattcggctacctggtcgaccgccaagacgccaccaccgccacctgcgtcctgcagggccccgacatcaagggcagcatcaaggtcacattttgcgccgcctgccctccgcgcgtctcctacttttgcgtccacgccaccgagtacgagcacgccgacttcgacctccacccgaccatcctggctacggagggccctctcgtcctcctcagcgtcatgctccccagtcgatccgacatcttccatcccgagaaagagtgggatttcgtctaccaggctgccaccaaggaccccgagggaaaggggaagaaggtaagccacccgtcactcaagcacctccctaatcctggccgccatcacgaatttgaggaagcctcggctgccctcttgcgaacctgcagcaagcatcgccaagccgccaccaaccatgaccacttgccccatctcccccatggagtcactctgcgccctcggagctccagccgcttgaccccgcgccctcatagctccagtggatacattctgcaacaccatggagccaacaaggaggagcacaactgcgaggcatgccaattcgtcatcgccgcaaaacgttctgcgcgtgtcagaaggacacaacatgagctctgcctctatcactcagagaaggaggcctggagcatcaagacggccatagtattggggaatggtccatacaatcaccattggacagacaaagcaatcaccattggaggagataatggtgtggtcgcatgggtcaatcttgctcgggatattctcttctgtgacgtgcttgctgaaacccccatactttgccccatcgaactgcccctgctgatcccggagagcgagggagttgggaccggtgatccaagatgcagtcgggatgttgccattgtcgatggtttcatccactacacccagctgcagattcgaattggtcccgggctcgttcacagaaagatggaaccgtcacattcgatgggctggaagctaccaaatgtagcatggcaattgacacccgttcgttg

SEQ ID NO: 29874 - DNA, 755 bp, Triticum aestivum
  Clone ID: PAT_TA_29874
gccggccgggcctgcaaattgacaagttgttccaaagtgattaatcatggcttatgagattattgacaacatcgcggctgaaggggctccctactacacgcctgctcaagaccctccagcaggcacacagaccagcggctcaaccaaggttttcacacccatcaccatccgaggcgtcacattcccaaaccgtctctttcttgcccctctctgtcaatactccgccaaagatggatatgctactgattggcacttgactcatctcggaggcattatccaacgaggcccgggactgtccatggtagaggccaccgctgttcaaaaccacggtcgcatcacgcctcaggacgttggtctctgggaagatggacaaatcgagcctttgaagcgcatcactacttttgcccacagccaaagccagaagattggtattcagctctcgcacgctggtcgtaaggctagttgtgtatctccgtggttgagcatcaacgctgttgccgctaaggaagtcggtggctggccagacaacattgttgctccttctgccatcgcacaagaagctggcgtgaaccctgttcccaaggccttcaccaaggaggatatcgaggaactcaagaatgactttctggctgcagccaaacgagccatccgcgctggttttgatgtcatcgagatccatgcagctcatggatacctgcttcaccagttcttgagtccagtcagtaacaaagaaccgatgagtatggtggcagctt

SEQ ID NO: 29875 - DNA, 783 bp, Triticum aestivum
  Clone ID: PAT_TA_29875
aaaccaatctccgctcaaggatcaacacagcacctggcttacaatctcctctgctagctcttctttcagtttctaccgcaatggctgccatgagaaccattctcctcgccgtgtccgcgatggccatcctgagcaccgcatcggcggcaatctacaacgtcggcgagccaggtggtgcatgggacctcagcaccaactacggcacctgggcgtcttccaggaactttcaccccagcgaccaaatcatcttcaaatactctcctcaggcacacgacgtcctcgaggtcagcaaggccgactacgactcctgcagcaccgctagccccatcgccaccctgaactccgggaatgatgttgtctccctcactgccaccggcacccgctacttcctctgcggcttcccgggccactgcgccgggggaatgaaggtcaagatcgatgtcgtgccaagctcgtcctcttcctcgccggccccggccagcggccccagtgcaagcaacgctcccccgccagctcctgtctcagccgccacctctattgaggccacagggtttggcctcgccgtcttgcttgccgttgccagtctgatggcttgagtgcatctctaaaaaaacatagaagtcactgtttactatcaagcatacgtggtgtacatgtatagtcaagtaattatatcgtatgttgtatgtattcaggcttcacgttttgcatattctttgcatattcatttttggaggatgagtaataaagattcttttagtattaaaaaaaaaaaaaaaaaaa

SEQ ID NO: 29876 - DNA, 977 bp, Triticum aestivum
  Clone ID: PAT_TA_29876
accggtccggaatttccgggtcgacccacgcgtccgcccctgtctctcctcggtattctattcctctcccgatttcgcctcgccattcctcccctccaatccgcccggcgacgccgcgcgcgcgcacgcggggtccgactcctacggcgccggcgacaacccggtgctagggctccggtgacctaggccctgccccgggcgatcgcggggggagatccatgtccgcggacacgccgccgctcccgccgcccgcgccgccgctcggcgcgctggatcccgagccggagcccgcgcagccgctcgagccccccgaggtgatgcacaagacgagggccgttgacttcctcggccgccgcacccccatcgtctaccagaacgacaacgggccctgcccgctcctcgccatctgtaacgtgctgctgctgaagaacgtgatcagcctgaacccggatgcgggcgaggtgtcgcagcagaagctgctgtccctcgtcgccgaccgcctcattgactccaacagcagtgcgcagggcagggacgaggagtacgcccgcaactgggagcacaacatctcagacgcgatagaccttctaccgcgcctcacgactggcatcgatgtgaatgtcatgttcagaaaggttgatgactttgagttcaccccagagcgcgccatatttgatcttctggatattccattataccatgggtggatagtcgatcctcaggatactgacactgctagtgccattggatcaaagtcatacaatgctcttgcttctgggcttgctgaatttaagtcagagaaaccagcagaagatgataaacatgtgcagaggaagaaactgttgattttgctgctgcaacagcagcagcattaggggttccgtcacctactgtttctctagggatatcatttgatgaaagtacactctcagattcagctgaactgcaaatgagacgaggcgaccgtgaggaagacg

SEQ ID NO: 29877 - DNA, 845 bp, Triticum aestivum
  Clone ID: PAT_TA_29877
cccacgcgtccgcacggccaaggtgagcctaccggagcaccgtgactacaacatgaccacgacgatcgtgcagcacgaggtggagggcctggaggtgcagctcaaggacggcagctggttcgccgtgccccccgagccggacacggtcgtcatcgtcgccggctagctgctcaacgtaaagcctgacatgcacccctcttccccgctaccgtgtatgtgtgctgaactgttaataaacgtctggctgcaggtggtgaccaacggacgggtgcgggcctgcctccaccgcgtcaggacgccgagcaaccgcgagcgcttctccgcgctgctgggctgcatgcccacccaaggctccacggtgcgggccatggagcagctcgtcgacgaggaccacccactggtataccgtccctgcgatccctacgagtactgcgccttcaagtactcggaggaaggccgcaaatccggcgacgcgcacgcgctcatggcgttctgcggagtagccaaagatggacccagctgtgtgatggattaactgacgaatatagaccaaggaccacggaagaaactctgcatgcaacattttccctttactttcgcctgtgcttacacagttgagcacgtacgctctccaatggcttaggtttatcggtcgaatgatgaataatgtttccttacgctttcagttttgttcagatgttatcttgttaaagatcttcataatattcaggactccgctgcaaatccgacgtgagacatttgaccatgacaaatcaaacatttttatgttaatttatatttgccgatgatgacaagtttagtttgcgggcaaaaaaaaaaaaaaa

SEQ ID NO: 29878 - DNA, 665 bp, Triticum aestivum
  unsure (1)..(665): unsure at all n locations
  Clone ID: PAT_TA_29878
gttcaacatccctgtgattgttctttcatctttgataaatgaagtgtcaaatatgttcttacatagtaatatacactgatcaacttcatattctaagggtttggtttaacagggtgcatgcatctaaatcagatgatgtaaacaaagcctctgggcgtcatgagtcagaaccaaagcaaccaggcattgacaaaaataactacatacagacactagaagctacaaccggatagatacaagctgtacataccaacactagaagctgcaaaggtacagccctacaacacaggcacaaaacattcacaaatccgctgcctcttcgcagatcaccactctaaaaccctattataccatacatacattacacctcaacgcatctctctcagtagattatgctatgtgatcccactcggccggtcaaaccggtctcgacgaggcgggcctgttgttgttccccttggtcgacgatggtctcgagccggtcaggctccggttgctgctcggctttctctgcagctgcgggcgagggctgttccctccctccttggcgtcgtggagctgctccagcgccacgacgacctgctccatgctcggcctgttcctcgagtctactgagaggcactgtagcgccagnaccgccgccttctgggccttggccagggagt

SEQ ID NO: 29879 - DNA, 520 bp, Triticum aestivum
  unsure (1)..(520): unsure at all n locations
  Clone ID: PAT_TA_29879
nttgancaanttatttggagtagataccacagggcacaaaagatgaatagtttttgcaatacatagtaccgagacacgttaactggcgaagaagttcttgatcatctgatcatgcagtagcgcttgcacggaggtgatatatttattaatggaaaactaaataacttcaaaacatggacgtatgcagaaggttgccattcctttttttgcttttgaaatatgctgatcaaagctcttttatcataagtgcatcttctttgcggaagttgatttgtttgcttcagttccggtccaggacaaaattacattggagtatgcagcgagaagtggcttgatcgactcttcaaaagagcaacaaaattgctggcggcggcggtggcagatggagacggaggtgtcgctggtggcagaggggcggcgtcactggaccacgtcgagatcgcagccgcactcgagaagaaggcggcgctggaccggggcatctgggaaagggcagcgtggccaggagcttcgtcccgtc

SEQ ID NO: 29880 - DNA, 1292 bp, Triticum aestivum
  unsure (1)..(1292): unsure at all n locations
  Clone ID: PAT_TA_29880
cgccggcgaacgcgacgcccagcccaccctcgtcgccgacggggaccacgcggccctcgccggcgccgaccaccccccccccgccccgccgccgcccggcgagacccacctgggccacccccacgacggccgccacctcctccccgaccagagcccctcgccggtccacggcggccgcggccccgtccacatcgacggcccccccccgcaccgcttcacggtctacaaggacggcctccccgaccacgaccacctctcctccccaggcatccaggggcggatagtcatcaaggagacctacggaaggccccgcccgacgtcgcagtgcaaccagtcgctcatccccctaaccgacgaggagctgtgcggtctcccccaccatgtgctgacccctggcgatgcggggcctggcaccttccgaatgcgtcgtgcaaaccagcactggatcccgaggaccagactggccctggagcaactcccgaacgccgaccgacggatccgcacagaccggaggcgaatcgagggagggcgaagctgagctcgttccaccaggagattcgtgcacctttggttcgcggtggtgatgaagaagctgttcaatgtgccacaggatttcctgacaaaaagggacgcgtgggctgggaccttcgaaggtgtcgtgcaaaccagaactgaaccgaggacagactgcccagagcaactcccgacgccgacgaggatccggcagacggaggcgaacgaggaggcgaagctgagctcgttccagcaggagatcgtgcagctggcggcggtgctgaacggcgaccaccagctaagcagcctgcaggagaggatcagggagaggatgaacgtgagggaaggcacctcctacatgaggagcgccgtgcggcgcttcttcgaggccggcatgtcggccaagaggatgggcctcgccgacgacgagcagatcgtcaagatgaggccctcccttaccaccagaatgacctcctcccctgcagatcaagatgatagtccgtagagagcaacgatgcatacatacataggatgaagattgatgttggggaaacaattaccaaatcttagtactacacatacatacatagaagatcagccagcgtacgtagcctagccagtaccatacggtgtgctcgtgctatatgggatggaactgctgtaggccggatggattcggcaatacatgggctgtagaaaaaccaaacattggtactgtggtatacaaatacaagcaatgcagcattcccccagtcnnnnnnnnnnnnnnnnnnnnnnnn

SEQ ID NO: 29881 - DNA, 703 bp, Triticum aestivum
  Clone ID: PAT_TA_29881
acaacacaagaataaactgatagaataagtgatgagacaacatagatgctaagagttactacatcagcgtgtatgtctggagtacgattgaatcgagggcgtcacaggttcatcctaagataaataaacccctggcaaaaacaaaggatgaaacatgctagttcactaccctttataatcccccaacttattctaaagccatataatccacttctgagccacagacaagttacggtggagactcctccaggatgcttcttcttgctagaggatcccaggggcgtcttccctcttcgtttcttcttttgctttgtacctggagcaattttgagatatttggagaggctacttgcaacatacgcctggcctaaaccaattgtgtttttggctccaaactcagcaatgctctttatcatcttctttctcaagtcaacagcaagcacatatgctgtgcgttccatgtcccggtagtcgatcttggcgaggaaataaacaatgtcgtcttcttgcgggctcaggctcagggtgggtaggccaatgtgtagtctctcgaatgctatggtaccctcatcgaccagcagatttggcagtgactttgaaatctgcgaggaatcgagctcgaggccccgtgtgctgccaaggttttctcagccacaggcaacgaaccggggtgtcaattgccatgctacattttggtagcttt

SEQ ID NO: 29882 - DNA, 551 bp, Triticum aestivum
  unsure (1)..(551): unsure at all n locations
  Clone ID: PAT_TA_29882
ggttgattacaaatctgaaaacattacctgacctgaacctctcgcgtcctccggccctgcgcttaatacagtcatgcaaataaattaggtagtaggctctcggtggcaatcagggcgacccaaaatcagagcaattcaaagggtaatcgaaattattcagggagaaatacaaaaattgatcaattcaatacgagcacaaccgtgcggatcgggccgggggacggggctaaacgggggagaggagctgggcgaggctgggcttgggttcggagctcatgccgacgaggatgacgagggggatgaagccgtagtgcgcgaccaccttcgtgttcttcatcgcccaagtgctccactcacgcgccagccgcgccgcatacgccgcggccgactccgctgcctccgctggggccttccccttctccatggccgcctctgccaatcgtgtcgccgagagaagaatgattaggaattttggatattgccctcgtgccgccgccgccgactccgctgcctnccgctggggccttccccttctccatggccgcctctgc

SEQ ID NO: 29883 - DNA, 823 bp, Triticum aestivum
  Clone ID: PAT_TA_29883
gaaacaataggatgaatatcaacttattttctgggcttatacagtacatgtatgatacgaggatctcagggaaactataccaaagtagtaggactacacacagaacagggttattatagctctaccaatactagtcgtgacacctgatcaacatctgcacagcacaactctcgagtccttgaaattgaaaactatgtcatctccctccggagagtccactgattgtgcccatggtcatcatcgtattcgtggcggacgacggatccgacgtcgccgacaagacgaaagagtcgaacccttggctctgcatcagggccagcatactgaagctcatctgcgtgggcgtcagctcggggatcggcatgtcaccctcgaggtactgcatcacctgccgcatgctaggcctcgcgccgggcatggggtgcgagcacatcaaccccagcttcagcgccaggaccacctcgccggcgtcgtagttgccgtcgagcctcgcgtcgaccacctcgaggagcgactccttctgccagtgctcgagcacccagtccaccagcatgagccggctgtcgttcatggcctgctccacgggcctccggccgcaggccacctcgaggatgaaggcgccgaaggcgaacacgtcggtgagaggggacgccttccccgtccgcgccagctcgggggccaggtaccccatggtgcccaccacgtgcgtcgtctgcgggtcggcgcctggtcgtacagccgcgccaggccgaagtcgcccgttcatgtcggcgtcgaggagcacgttgctggccttgatgtcccggtggatgatgacctgctc

SEQ ID NO: 29884 - DNA, 1684 bp, Triticum aestivum
  Clone ID: PAT_TA_29884
ttttttttgttgtccgtccaggtacaggtctgctactagtatctcaggggaacaaattcgtactactcggtcgatgcggagaccaggcacacaatagctcttccactactagtcatgacacctcttgtccttgtttactcattcaccctccacccgagaggccggagacggccgagacgtcgccggaggtggggctggcgtccgtggtgaccgtggacgggaatgacatggcgaacgagtcgaacccgtcgttctgcatcagcgccagtgtggtgtagctgaggaacgtcggcaccacctccggcagggccacctcgccgtccaggtactgcgtcacctgccgcatcccgggccgcgcgtccggcagcgggtgcgcgcacatcagccccagcttgatcgccaggccgcgcctcgtcggcgtcgtacttgccgcacagccgcgggtccacggtgtcgagccccgcgcgccggcgctcctgcgcccgcgcccactccagcagcacgtgctgctcgtcgggcgcgatgcgccccggcgggcgccgcccgcaggtcacctccagcacgaacacgccgaacgcgaacacgtccgtcaccggcgtcgccttgcccgtgcgcaccagctccggcgccaggtaccccatggtgcccaccacgtgcgtcgtctgcgggtccacgccgtggtcgtacagccgcgccagcccgaagtcccccagccggccgttcatgtcggcgtccaggagcacgttgctggccttgatgtcgcggtggatcacgatcttgtcccagtcctcgtggaggtacagcaggcccgacgcgacgcccttgatgatccggaacctctgcgcccagtccagcgccggcttctccttgctgccggagtacaggtacttgtcgaggctgccgttggacatgtagtcgtacaccaggaggagctcccccttccggcggcagtagccgagcagctgcacgaggttgcggtgccggaggcggccgatggtgaccacctccgccacgaactccttgatgccctgcctcgactcgtgcgacaccttcttcaccgccacctccagcttcgacttggggagcgcccccttgtacaccctcccgaagccgccgaaccccagcagcgtcttgttcttgaacccttccgtggcgcggaacaggtccttgtacgtgaacctgtgcggcccgaactccacctcccactcctcccgcacctccgcgtacctggaccgccgccggacgagcaggatcaccacggccaccacgccgaggacgaacgccgcggtggcgatcggcaggacgatgtccggcaccttagaccgcggcttggcgcccacgaacggcagcttcggcaggctgccgatgtcgatgggaggtgcagggccgtccatggcgaagctccagccgagaaggtagtggcgggacctgaccgtgcccgtcgacgacgagaagccggcgtacgccggctccacgagcaccttcgacaggttgctcttggctgacaccaggggcgtcgaaggcttggctccattcttcagaggcgccaggaacacgctgatctgcgtggagtcgctctcgtagtccacccagacctgcatcgccttgccgctgatcaggagcagctcattgaacgcgccggtctcgtcgtcgtagtagccggccgagtgcgccctcgtgccga

SEQ ID NO: 29885 - DNA, 2755 bp, Triticum aestivum
  unsure (1)..(2755): unsure at all n locations
  Clone ID: PAT_TA_29885
ggcgagggcagcgcaccatcttatcatatcattagattagtgctactagttccgattacccgcacacaaagcactctctatcactcttatcatataccatcgtccggcatctatcaagctccgtatcgaagcaagaaggggtggtcctttgaatctggtcgtcggagatgacggtgacaccccagatcacggtgagcgacgggaggccggcggtgcgcggccggacggtgctgtccggcgtgccggacggcgttaccgcggcgcaggcttccggggcggggctcgtcgacgagacctcggggggccccgcggcgggcctgggcaagcgcaacggcgtcttccccgccgggcactctccgcgactgcctactcctgtgcctgctccggtccaagccgtggacgcaggaggcggcggatcgccgccccgggcagcgagtgccggatggcgacgccaccacgcctcagcggccgcccagcagccccggggaacgacctggtccacatcgggcccgtcggcctcgtggcgcctggcgctgtccgtcgcgcccatcggaccgctccacagggtcaacgacggcggccgccgccggagatgcatcgagagcgggggcacaggggcacagacgaagtagggcacgaaaagtgtgtagatccaggcgggcacgcgccccttgctcacccaggccgtcaaggccgttagagcacatgcagacgttccaccacagggagaagaaaaaggtgccgtcgtttgtggactggttcgggtggtgcacgtgggacgctttctacacggacgtgacggccgacggcgtcaagcaagggctccgcagcctggcggagggcggcgtgccgcctcggttcctcatcattgacgacggctggcagcagatcggcagcgagaacaaggaggaccccagcgtcgctgtccaggaaggggcgcagttcgcgagcaggctcaccggcatcaaggagaacaccaagttccagagcaagcatgaccaggacgacaccccggggctgaagcggctggtggaggagaccaagaaggagcacggcgtcaagagcgtctacgtctggcacgccatggccggctactggggcggcgtcaagccgtcggcggccgggatggagcactacgagtcggcgctggcgtaccccgtgcagtcgccgggcgtcacgggcaaccagccggacatcgtcatggactcgctctccgtgctcggcctcggcctcgtgcacccccgcaaggtctacaacttctacgacgagctccacgcctacctggccgcctgcggcgtcgacggcgtcaaggtggacgtgcagaacatcgtggagaccctcggcgcgggccacgccagcgtcggacgcgcagcacacccgcgtgccacgcgcgctcgaggcctccgtcgcccgcaacttccccgacaacggatgcatctcctgcatgtgccacaacaccgacatgctctacagcgccaagcagaccgctgtcgtgggcgcctccgacgacttctacccgcgcgacccggcgtcgcacaccgtccacatctcctccgtcgcttacaacacgctcttcctcggcgagttcatgcagcccgactgggacatgttccatagcctgcacccggcggcggagtaccacggcgcggcgagggccatcggcggctgccccatttatgtcagcgacaagccagggaaccacaacttcgaccttctcaagaagctggtgctccccgacggctccgtgctccgcgcacagctccccggcaggcccacgcgcgactgcctcttctccgacccggcgcgcgacggtgccagcttgctcaagatatggaacatgaacaagtgcgccggcgtggtgggggtgttcaactgccagggcgcggggtggtgtcgcgtcgtcaaaaagacaaggatccacgacgaggcgcccgggacgctcaccggctcggtgcgcgccgaggacgtggagggcatcacccaggccaccggcaccgacgactgcaccggcgacgccgtggtgtacacgcaccgggcgggggagctcgtgcggctgccccggggcgccaccctgccggtgacgctcaagaggctcgaatacgagctgttccacgtgtgccccgtccgcgccgtggcgccggacatctcgttcgcgcccatcgggttgctccacatgttcaatgccggcggtgccgtcgaggagtgcgtcgtcaggacgaacgaggacgacaaggccgttgtggcgctcagggtgcgcggctgcggccggttcggcgcctactgctcgcggaggccggcgaaatgctccctcgactcggctgacgtggagttcggctacgacgccgacacggggctcgtcacggtcgacgtgccggtcccggaggaggagatgtaccggtggacgctggagattcgggtctaggctggcatgctcgtgttcacgatcacggggctggctgaggcgatctcagccgttggattatttctttccattgttggtgcctatagtgcttaagagagattgatcgagagataaatattgccatgtagagagattatgctttgctctatcattgtggcaaatgcaataatgtatcccttctgtactatcattaagatttgaatgaatgcaataaaggatggtgctccttgtaaatcgattaaaccaaactaaaagaaataaaggatatggtgcnccttgtaaaaaaaaagaagaaaaaagaagatgacccatcgggaaggtagcgaagaatag

SEQ ID NO: 29886 - DNA, 989 bp, Triticum aestivum
  Clone ID: PAT_TA_29886
gaaacggaagatcatgagttttccttttatttagagtgagcctcagctgttacaaacacaaaactagtccagaatgcactgaaatgcaggattcagggacgttttatttcggtcatacatctgtggtagccaaacagcacaggagatcggtacaggatggccacctgcaacattttatccaccaaaagaatgcggcgacagctcggatacccttcttcgccttcaccttcggcgccaccggcggacagacgctccataaaattgtggtccgcttcgtcggtgccagccagtcccacagtcaaaaccacagctatacctacagatgaattacatacacggcaccgtggggcgatctagtatacaacaactaacaaacaggagaggagaggagagcttcttctgcttcagccagggttccgaccgcgctagaaagtggaattccacagcgccttgtcgccctcggcgcacttattgtgcacctcccagatcctgccttccgagttgcatatgccgctgcacttccagtcgaatgacgccgcgcaggtgttccccgcctgagctttccattcgcagtcaggtggagtaccacaacagagtctccggtcatcaatgtgctcgacatccaacccgaggaaccaagatcctagtgaaacatcctcgtttatatacttgtgcaggacgtgcttgtttatagatatgtaggttgctagatcttttgaaatggcgtataattgaccagtagcatgtcggaagtacttatttcctggctcgccaaattcccaatgctcaggctcatagtatctcacacccttttcagataggacagggccagatttcatgcaccccatatatactcttggcttccatgcctgtttggacaatatctgtccaagcgttgctatgttcacatgcacgtcgtcatcaactttcacataaaaatctgcatcccataatgaaacagctgtagcaaagtatgtcttagttttgcc

SEQ ID NO: 29887 - DNA, 740 bp, Triticum aestivum
  Clone ID: PAT_TA_29887
ccacgcgtccgcctgaagcacgcccacccctccgccggtccgacacgatgaagcacgcccacacctaagccggtgcaagctcgatcgcacacttcagtagttccctacacgcagtacgtgctgcttctctagcagcgtatacctaacacatcgtcgtcaccgccgtactctctcactcacgcgcggtccgccggcgatggcgggtaggacgttcgtggacgctgcggtgcgcgccatgcaggagtacgtgcgggtgtccgacctggccctagccgccgcggtgctcttcgcgtgcaacgccgccacgacccgcctgaagtcgcggggcagacccatgctgtggccggtgttcggcatcatccccaccctcttcgcacaccttgacaacatctacgactggggcgccgccgcgctagctcgctccgggggcacgttcccgtaccgcggcatgtggggcgggggctcctcgggcgtcatcacgtccgtgccggccaacgtcgagcacgtgcttaagaccaacttctccaactaccccaaggggccctactaccgcgagcgattcgtggagctgctcggcgacggcatcttcaacgccgacggcgaggcgtggcgcgcgcagcgccgcgccgccacggctgaaatgcactcggcgcagttccacgagttctcggccaggaccgtcgagcagctggtacacgggccggctgatgccgctgctgcagcagcagcagagccagggt

SEQ ID NO: 29888 - DNA, 1127 bp, Triticum aestivum
  Clone ID: PAT_TA_29888
gacctctgaagcaatgagtggccagctgaagaagacgaccaggggcgaggaagccgcgcagcagagagcgtcgtcttcggaagaacagcagcaggaaaagataaatgaggtgcggggtctcctcgacagtctgacggaggagatgccgagttttctgtcggacgccaccatccggcgtttcctccgggcgaggagctggagcacggagcaggcaaccaagtctctcaaggagactgtcaagtggaggcgtcagtacaggccggatgcaatttcctgggacgacattccagaaacggagaacgaggcccggaggacacatgtggccgactaccttgacaagaacggaagaagtgtcctcgtagcaaacgtgccaatgaagtctaaagtttcagcaaaggagcagataaagcacctggtatatctcctggagtatctcgccaccaactcagcggatgaacaagacgacttcgtcgtttggctgaccgacttccgaggctggtccatatcgagcacgtcactgtcgatagcccgcgaacccatgcacataatccagaactactatccagaggctgataagccgtggcgattcctttggaagcttagccaatatttgaatctttttggacatgagccagaaacttcgtgcagtatatgctgaaaagccggagagcctcaagacattcgctgacgtctttgagttggatacgctgggctgacatctttgacttggatacactggagtcttcgtttggaggaagaagcaccggtacggccttccacatcaacaagtatgcagagagaatgagaagagccgacaagatgagaggagcatcaaaagattcaaatggccacaaccacaactgatctccctgaccaatagttctagaaaaatatctccctggccaatggccctgactaaatacaagttgcttgtgagccgtacatgagcttagctaaagcacacgaacagggtaaagatctacttatacactaaaacatgaaggcgcacgtttgaatatttgcggaagtctagaaatatttgcggaagtctagaaagtaaaagcacctgagagttttgaaatggatgaagctaaaaagccctaaaaaaaaaaaaaaaaaaaaaaaaa

SEQ ID NO: 29889 - DNA, 620 bp, Triticum aestivum
  unsure (1)..(620): unsure at all n locations
  Clone ID: PAT_TA_29889
gccagtcacagcgccaanaacaancgagctactacaccagtcgancnattttccacaggcagcaaggcaatacagcgtagcgcctatgtcgggcgagttccagttccacgacgagctcgcgtcgctcttcacgcagcggccggggccggggatgcagcagcaggagcagcaggcctcctggctccgccgactacctgcagacgcccatggactacgatctgctgtgcagggcgctggagctgccggccgcggaggacgcctccaagagggagctggtggttggacaccacgccaagcggcgggcctcccccccaacgccgcgccgggggggggacgcgcaactctcatgtctcctcgtccaaccaagccgcgcgagggcggnngngggggnngnnncgnagagggggaccccnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29890 - DNA, 405 bp, Triticum aestivum
  unsure (1)..(405): unsure at all n locations
  Clone ID: PAT_TA_29890
ggggagccgagtgggaggtggagtcagcgatggcggcgctgcgacgggcgacgcgggaaagcgcgccgaggaggcgggcgctctgcgtgccgcagctgctcgctgcgctccgtcgcgtgctgctgtccgcgcgtcactccgccgcggcgcgcgccgacgccaccgctgctctggccaacctctccctcgccgccgttaaccagtctaagctcgcgcgcgccccgggcgccgccaagaacctgctctccatctcgtccgattccaacgagccgttgcccatccgcaggctggccctcatggtgatctgcaacgtcggcgactgcactgagggcaggacagcgctcatggacgccggcgccgactcgacgngnggcggggtgcttggcggcgacgcttacagggggg

SEQ ID NO: 29891 - DNA, 748 bp, Triticum aestivum
  Clone ID: PAT_TA_29891
taggggccttttttttttttttttttgatgacatagaaaccaaccaagactatgtatttatttcttgatgaacataattgtgggtacggaactactagcactcaaagccaagtccgccactaaatgtggcatccaaacacgattgcattgatattacacagaagtaagcgtacatatacacatataggttgcagtagatcaactaattaagtgactacaaaatgccattcctcttatattttacgagtagttttccttgtggctctggcaagaacttgccccagtctgtcttggggaaaggggagatcaattcgagctcaaagttcctcagcaaatggctccatatcactttaagttgcatgtaagcataggcctccccggtgcaaatgtgtcttccaccactaaatgacgtgtaagagaacttgccaccaactttgtcctctcttctttcggggccaaaccggcatggatcatatacctgagggtccttatagatataagagatgttattagtcactatagtaggagttgctacgatgtggtcttgcgggatgtcatattctttgccctctttcgtcttcaccatgaattgcttatgtgccctgcggaccagcattggtgttggagggtgcttccttagcgcctccttgatgcaactatgtagtgtatccatctctataaatgcattgtagtctagccccatgtccttggatttgctactgatttgctgttgctcctcaatggcagc

SEQ ID NO: 29892 - DNA, 688 bp, Triticum aestivum
  Clone ID: PAT_TA_29892
tgcgacaaaatgtccagttaacttagagctatttacatatcgtttacttaagtaaaaaaaactcaagttatcttgctgcaggcaatctactcaatgctgatcacacaaataataatgtccgaaagcacttaggaacaaccagaccacacaagcataagtaaccaaatagacatcagaggggagggagcatttttcagaagttcctcattaagtttcacagttattatgtgaggagtaaaggaccaggtgaacctgtgataacggggaggcggcagtacgggacgggaagactcgccgccggcgggcaggatgaagagctggcggctccaaccctagtttgcgcgtgagaactgcatccgtcgcacacaaccaggcatccatcgtctgccgtcgtgctccagcgagccggcgaccgagggttgcctggagcggaggtggaggcgaccagagccggcggcggcgcgacggcgagctcgggcggtgaggcggcggggcagaagctgcaggagacggcggcggggacctcgaggccgagctcaggccatggcttccctggctccagaggccgtggcggcgccggacgcagcggcggggcgaggaggaggccggccgtcggggtctcggggaggcaggagctcctcgtcccctcgatccagatcgggatcgaggagggagcaacaggggcgcg

SEQ ID NO: 29893 - DNA, 537 bp, Triticum aestivum
  Clone ID: PAT_TA_29893
taggggctaggttttttttttttttttttttttgatcccaaattcgtattgtattgcctgtagtaaaaagattgctttcggtctcacgtgtctgtcaaaatgccgaatgtgcacatgtgattctggtagagtccagctatccgcgtgaacaaaagccgaaaccgcttaggtccagcactgtccagagccagggccaggctgacactgcatgcgtccaccgccacaagaccagcagccgtagtctccagcacactggcactttcctggggaacagtcggcgtgaggagagtagcaggggaagcagtcgcaacgggcctcaaggccacggagagcgagaagaggcttgtcgataccagtgtaggtgaagccaccgtcttcaatggtggtagtgtcgacagctggagtagctgagactccgagggagagaagaagagagacgacgaaagaggccttcatattgattgattggtatcgggtaggtagttgaggttggaatgtgattgtgagtgaggttcccgccggccccggccggccggc

SEQ ID NO: 29894 - DNA, 1035 bp, Triticum aestivum
  unsure (1)..(1035): unsure at all n locations
  Clone ID: PAT_TA_29894
gacagtttccngaagancatgggtcctttggtantgcagncaaactccgggtgtttacngaccatgtttgaaagtgaanctggtccgcctctgggcaaactgcgcctgcttattataactgtgaggaggttgattggtgtgtacacctttgccaacaactataagctagctgccccccgtcggggggcaccagaagggaagaatgagaaacatgttgcttatagcaggatggttgctcaatcaaaaggcaactcctgtttacatcaacaattacaacaaatggcgcgccggccggatctctgctcgtcggacctcaccgcaaactttaaatagatcacaggaaaattggttaaattgactgggtgtgagtggaggacattttacataatatacggtgtctgtaaggttaatcacaagctaacaattcttgacagcatgtacgcgtcttcgagctcccccgccaaagcctcgttagtttccggtgaatttggaatgttatttcttattatgtactgcgccaatgcgccgtccccccgaagaattttagccccgcacccaggcctgtcgacggaaccaatggcctcctcgtccaccacaacagcatctactcgctcatttccagctttctcgtcagggatctcgtacatggcctccagtagaatggtctctaagagggctcttagaccacgtgcaccagtgtttttgactatggccttctttgctactattctcagtgcaccatcagtaaagtgcagcttaacattgttcaggctaaacattttcctgtattgtcttgaaagtgaattctttggttctgtaagaacctgaacaagctgatcttcatcgagagctgccaaactaactagaatgggcaggcgtccaatgaactctggtattaggccaaacttgcaaagatctccactctcaacagattctaacaaagatgacgtgatcgttggactggtcactcctgaacttctcatgtttgtacgaatgggtgccccaaatcctatagatgaatcttgtcgtctttca

SEQ ID NO: 29895 - DNA, 1052 bp, Triticum aestivum
  Clone ID: PAT_TA_29895
aaagcatgccaaatcccttgagtagtaatccagatcattagagttgaaagcaggtttcatttggagaagtagcaatcagctgcatagttggttaaactatgcattacatatatgctagctggttcaaaaggaagggtaagcagttttggtaatggtatacatatcgcacattgtccaaaagtggaggcacaattccttgtatggtaaggcagagttcatggctcccacacgcggcagtggcggtcgccgacgatcctgtctagaggcggtgaatgatgcttctcaaaataaagaagacattggcgatgaccccacgacgcactccacgacaagcttggtgacgaaggggttgccagcgaggaggtgctccctgagctattgaaactgcaacaatgaggcctccatcgcaagtgtctttacaacaggtttgtccggtactggtcagagacgggttgtagcaggtggttgttttctgtccgctgaccagcggctccgcagggcgccccggcggggcggcgcgctcacgccggacctgcgcgctctgatgcatccgcaactaaagcttgcccaaatggaagaacaatattttgggtaaatgacgagctcttatgtgagcatccaacctaaaatccacaacaatatatggctgtacaccagcgaggagggcgacgcggagattgagtcgggatatggataagccccagtttccagcgaggccgttggccgacttaaagtagcaggtggcggcgacagagccgcgtaccagaggctctgcatattgctcagttggaagagagcactaacatcagacctagggattctgaagttcaaggccagaaccttgtatattttttgtatacttggccttgttttatttgtaaatccctttctgccctttcgcaacaaaaaagaccatttctgccaccaattggtgggcatacaggcattatgtaattatttctcaaaaatttaaaacatagcagcgggagcctctcctgctgttttgagtgctaaaaaattcattaaagcaatgaactaatctcgtgccgaat

SEQ ID NO: 29896 - DNA, 1335 bp, Triticum aestivum
  Clone ID: PAT_TA_29896
gttctgacgcatatataatttgaaaaagctgaatcttatcacaatccatagaaccaaaatacaacaggcctaatcacctagagccagcagcaagggagaacagaatagtcacagtagcagcacaagaaggagcgaggatcaaccgcagcagcggtgtcatcagacggcggcacccttccgctgctcggtctcgccgtgggcgaagtggcagcgctcgccgaaagtgcaggtgcccttgaggaagttctcacatgtcttggccctgtagtcgatcctgccgccaggcccgaccccgccgccgaccaccccacggaggaggggggctgcaccgctgcatcggttcttcgacggggtgctggcgctgatgctggcaatgagatcacgcgccatgtcgttggcttgctttatctggtcgaagctgccttccagctcaatgttcttcaggtctgggtttgtgttcgtggtcacgtatcgagagcttgcgccctgtgatgcggcagatctgcttcgtgttgaccccgcccttcccgattatgcctccggcgagagcggcgtcaacactgaccttgcaggtagacgaggcgccaaagtttccagcaggaggacccatcgaagctggcagaggtggttcgtgtcgacctccatatcgaccacccataggaggagcataggaactttcttgggacatgtaggaggatggtggcctgccaagctccctctcgccgtgggcgaaatggcacttgtcaccaaacttgcagccttctgcagtgttgtacttggtgcacatgtcgaagctggcggaggtggttcgtgccgacccccatatcgaccacccataggaggagcataggaactttcctgggacatgtaggaggatggtgccctgccaagctccctctcgccatgggcgaaatggcacttgtcaccaaacttgcagccttctgcagtgttgtacttggtgcacatgcgtgttttgacaccagaagcagcatgatccgcaggagctcttgacggtgcagacacagcagcatggcctaggctgtgtgattttgatactgcctggtatccaccagggacaaagtgcgcaaagtgacatccctcaccaaaggggcacccaacagtgctgaaaaacttggtgcaaggcttcgatttgcttgatagaccagtttgttgtgactccgattctctcgagcgcttcccgcctgcggcgcctccgttggcggactccggccgggatctcttgcgggcggcggcatccatggcgagccctccgcgtcgaggcggaaaccctagcttgcggtttggcggaggcggagtggggcgcagcctcgtgcc

SEQ ID NO: 29897 - DNA, 1702 bp, Triticum aestivum
  unsure (1)..(1702): unsure at all n locations
  Clone ID: PAT_TA_29897
tttttggcttttttttttcttgctaaccatattccttcttacttcgttcttgtagtgtacgtacataactactatgtacacaaaatctcacaaccacccccgctcgagctcacacaaacaccataagaagtgcaacgccaagcatcgatcatcgtggcgttgcaacgcctactctttgcctataaacaaccacccagatcccccgataacatattcatttttgaccctggaccttgtcaacgttcgaaatcggaacctctgaccctggcacgggcttatgcttctttgtaatggtatgcctctttcatatccttcctgtcattatcccagccaggggatatgtgtgttagtaacactgcacagtttgtgtgcagcagcacaggccctcagggagttcctggagcaataggtacagctaatcatgaggttaggacggcaggcttcctctgccagtactgcttgaatctctgccttgcatactcctggtaatcgaagtcgatgtcactgacacgatctgatattattccccagaggccccaaaccagatgactcgcgagcgtgtacttctccacgctctggagcagattctccagctcctccgtttcaggttcctcgcgagaagtgctcaggtaagtcttcacgaaacgcctctgctcgtcgatatctggatatttactgtagtccagtatatgaggcttttccgaatggtagtctgccgccatctcacagaaatggttagcgatgtcatatgcaactgggttgaagcttgcatactcgtagtcaatgatggtcagcatgttggtctcttcatccatcatgatgttgccatactgtagatcattgtggcagaaaccaatccagtggtggtaatcccctgagaattccttctccagcgaggcgatctcatcctccaggcaatccaagcgtagttcgttggcctgatcggttgggcacaggttattggcagttttgagccagttcttcagtctgtcccagaggagcacatgcttgggaccaggcatgtcaaggttgtggaattccctcagttttgtagccaccagagctgaaatttcaggatcgcgcatatcgggagccgacagcgtccgtgcgtggatgaactcctcgacgcggccgttggggaagcggccgaggaggcgggggccctggccgtggcgggacatgcaccccgcggtgcgcagctcgtcgtcgcggtcgaagaagaggtcgacgccgtcgccgtaaatccgcacgagccccttcctcacctccctctccttgagcgcccccgccnccgcgcccgcctcgccgccggccggggcggtgagccagcgcacctggtacacctcgttggtcatggcgcccttgagcggcaccacctccagcgcgcggcagtccgccacgttcggccacgccgccgccaggtcgtgcaggagccgccgcgcctccttggggatcctcgcgggctccgccggcctctgggcctggctctggttctcgatcgccaccattctcgctaatcacgccttctgctctcttctggagcggaaatggacaatccggcgcttacggttgatctttctgtttctttttctgatttgggtattctttcttgttcttggtgaagcgagattggatataaagaactaggcaaagcgttgcagctgcaagtaacagggagggagctcgtgcccgtgccgaattc

SEQ ID NO: 29898 - DNA, 442 bp, Triticum aestivum
  unsure (1)..(442): unsure at all n locations
  Clone ID: PAT_TA_29898
acggacatccgctccttagtcctggtatatctcagaaccttcttcctgcttcccccacatcccggcggcggccacggctgatcggagaagggggaagaatgccgtgctgccactgggtgctctccgtggccgagagcagcagcaacaacaaaacgccgtcatggctccaccgcctccacaccaagggcggcctctccttcccctcccacctccaaatcgatgacctcctctacggccgaatccagccgccccctccctctcctcctccgcctgtcccccctccgccgccgccgtccgaccgcgacgccgccgccaccaacccccaagacccgccccctaaccccaagtctatccccaaagcaccccgcaaccccgcccccccaaaccctancgattaccaaacaanaaccattctccgccgncgccntcgccggccgccgtt

SEQ ID NO: 29899 - DNA, 214 bp, Triticum aestivum
  Clone ID: PAT_TA_29899
agattgtgctcatcatccgtctcatggtacttaccgtcgggtgtgggatgagtgcgggcgttggttgtcgtcattgttgttgttgggatggtgtattttgttggtttgtacagtttgtcgttcgtcggcatctatttgaccgaagatgactttgttgtttttgtacatgctgttagctgattgttgcaagttgactcaggattgctgatctatt

SEQ ID NO: 29900 - DNA, 1021 bp, Triticum aestivum
  unsure (1)..(1021): unsure at all n locations
  Clone ID: PAT_TA_29900
ggcgacgggcccccacatcgcgtcgaggatgctctacacggccgagaacagcttcgacgacatagctggtaaagtggtggcggattttgggtgcggctgtggtaccctggccgtcgcgagtgctctgctggatgctgagcatgtcactggtattgatattgacctccagtcccttgaacttgctcaagaaaatgctactgatctagagctggatatcgacttaattcagtgtgacataaagaacttaaatttaaaaggccttcttgttgatactgttgtcatgaatcctccctttgggacaaaaagaaaaggagccgacatggaattcctttctatgggcttgaaggttgcatctcaagctgtctattctctacacaagacttccacacgagaatacatcaagaaggcagccctgcgtaattgcaacgcagtcagtgctgaagttctgtgtgagctgcgctatgatctacctcggacctacaggttccacaagcaaaaggagctcgatattgcagtcgatctgtggcgcttcgtcccacaagctcgagacgaaagggcaagctagcagcctagcatgacgcggcaatgtgacgaggccgtgacatcacgcttgttgaaccaccacagcgtgatggctggacttgctagaagaagaaaaccccagtagatcagcagccatacccaccctgggcagtgatagggctttccggcacattggcaggcaggattggtgctctctctgtaccagcacttgttcagtttttttcttgttctatactcctactatcagagaaaaacagcgtctgggaacaaaattcagcgttaaatcggcgagcatcgtctctgcgcccagttactctctacaaagtggaaatttttgctgcgagtaattcacagcgtacactcatctgttttttttccttttgtagaacacacgacattgttttgctaaacattttagtctttgtgggtctgtnctaggacacatnctagatgggcatagttatgtcactctctgagc

SEQ ID NO: 29901 - DNA, 1030 bp, Triticum aestivum
  Clone ID: PAT_TA_29901
gcacctcgcttcgtcgacctcgggtctcccctgctcttcatatctcctctctccacccccaccctcctccccgagcaccaacaccgccaagaacgcgaacgccgacgtgagcatctatcgagacacagcaacgcgagggcgcaccccgatcgaccgagctgattaagaagatcgagtgatgcggaggtcggactgggaggaccggtgccggcggcacccggagcaccggctgtccaagggcgtgtgcccgagctgcctccgcgaccgcctcgcccacctctccgccaactcctccgccaccaccacccttacgcgcgcctccaactcggccagcacctccccctactcctccaccgactccccgccgctccaccgcgcggccctctccgccgacgccacctccgtccacgtcgtcggctccggggccggctcctccttcgtcaacgtctccgccttctcgcagccgctcatgccgacggcctcaaagaaaccagcagaagccaagggaaaggagggcgaggcgaagaagaagaagaagagcagcagcaagaagaagatcgggcggttcctgtcgaggctggtcgggacggagaagcggcggaaaacaggggaagcaggcgacggcggcgagctcttccattccagcaccatgaaggagaagtcgtcgaccaagtgggtcttcttttgatcagaccggccggcgccgcccaccaaccattataccaacaaacatgcttggcctttctcggttctcgatcgatcgggtattgatgatttttctttatttcctctattatttttcacaagtattcttcttgagcttgatttgatattttcctcaagcgccgtgtatatacacgagatcaagtagctgaccgtaaggagaagcacacatatatggtgaaaatcgcatatggttattgattttttttaaattaggacagagtgtatagatgtaaattaacttgtatttgtatctagcatagtatgcactactactacgtgaatgctcctgggattcacgaattat

SEQ ID NO: 29902 - DNA, 906 bp, Triticum aestivum
  Clone ID: PAT_TA_29902
ccggctcgaggggccggccgggcgcgggaccaggacagaacgaagcaacaaagcacacttggtttgagaaaaaaaaaactcaaatggccgtctcttcctatttccttgtcttcgcccttctcgcgttggcctcatggcaggcgatcgcttctgatccgagccccctgcaagacttctgcgtcgcggacaacagctcacatgttctagttaatggatttgtctgtaaagacccaaaggatgtgaaggccgaagacttcttcttggcggccaaactcgacatgccgagagacacgaagacgaacaaagttgggtccaatgtcactttgatcaatgtaatgcggattcctggcctgaacacattgggcatctccctggcgcgcatcgactatgcacctttaggcgagaacccacctcacactcacccgcgtgccactgagatcctcaccgtgcttgaagggaccctttatgtcggctttgtcacatccaacccagacaacaagttcttgtcgaaggtgctcaacaagggtgatgtgtttgtattcccggaaggtctcatccacttccaattcaaccccaacccctacaaactggcggtggcaattgctgcacttagcagccagaaccctggggcaatcaccattgcaaacgctgtgtttgggtctaaaccagcaatctcagatgatgttctcgccaaggccttccaggtggagaagaatactgtggactggcttcaagctcagttttgggctgacaaccataactaatgatgtattgcatcgactacatggaaagtggcgttgtgttttttgtaataattctttatatttgtttgttgtattttattagcatgcaaaacatttatcatgtacggtggaaatgctagacataataaaacattggtctcag

SEQ ID NO: 29903 - DNA, 314 bp, Triticum aestivum
  Clone ID: PAT_TA_29903
cttgcagcaaaaaagcgagaaattcctgtacgagggtatgtttcttgtgtggttggatgcccagtagaaggatcagtaccaccttcaaatgtagcttatgttgccaaagagctttatgacatgggctgctacgaggtttcgcttggtgatacgattggagttggtaccccaggcacagttgtaccaatgcttgaggcagttatgtccgtcgttcccgtggaaaagcttgctgtccatttccacgacacctacgggcagtctctttcaaacatcctcgtctctctcaagcattggtacaactagttctagatcgc

SEQ ID NO: 29904 - DNA, 827 bp, Triticum aestivum
  unsure (1)..(827): unsure at all n locations
  Clone ID: PAT_TA_29904
agtaccccaggtgatcttgcattatttgctacccacaatttttaagtatgccatagctagattttgcttgctactattgggcttcagtttgttacatccattaggcaaaggatattatctggcacgtgccagtttgacaccaaggtcctcactgtcatcctggagccttggcatatttggcatgatttgtttctcatgttgccttcaaacaaatgttgaattttcttgtcttcaaataatggaagaaaactgttcctagttgtataccagtgtcgtttgggaaaacattgattgcccatcaccaggttcagtaaattttaactcctcttaatgtcagattgtgtttaattatctagataaacccaccttcgcttcatgaaaatttcaattaacatgtagcttctttgatatattcaggcacagttgtaccaatgcttgaggcagttatgtccgtcgttcccgtggaaaagcttgctgtccatttccacgacacctacgggcagtctctttcaaacatcctcgtctctctccagatgggtattagtgtcgtggactcctccgttgcgggccttggtggctgcccatatgcccaaggcgcatcaaggaatgttgctactgaaagacgtagtgtacatgctgaatgggttggggatcaagacaagcgtccatctaagcaaggtaatcccaagccggcgaattcatctgcaaacatctggggcgccaatccgggtccaangnaactactgccttnaacaaaggttaccgcgaacgcctcaaagctatgaggttgccctaangccgttacccngtacatcaaaaagccgggc

SEQ ID NO: 29905 - DNA, 1130 bp, Triticum aestivum
  Clone ID: PAT_TA_29905
cttcttccttcatgcatagcaatcgcagtctcagcctctcgttgcttcagggccatggacacggcgccggtctgcctcggcctcatggtcgggcgtcccatggagcacgagccgtctcgggcgagatgcaccgggaccagaaccgaggccgacgttgctagctcggcctgtggcaggagcaccttccatgaccaacgacgaggctaagatcctggcaggcgaagctggcgcaggtgagcgaggagaaccggaagctgactgaaatgattgcctacctgtacggcaaccaggtctcgcgccagagccccgacggcgagggccagaacgcgcgccggaagggcagcgtcgccgacgcccccggccagcaagaacaggagccgggacagcatggacacctcccattcttgcgatgtggaaattagcaacaggaacgtaggaacgggcgaggccgaacatgtcgatgtggacagccctctgagcaatggcacttgccggagaatcaaggtcaagaaggtcggcaccaggatcgacccatcggacacgagcctcgttgtgaaagatggatatcaatggcggaagtacgggcagaaggtgacacgggacaacccgtccccaagggcctacttccgatgcgccttcgcaccgtcctgccgtgtcaagaagaaggtccagagaagcgcggaggacagctcggtggtggaggcgacgtacgagggcgagcacaaccacccgcaccccacgcgggccggcgagctgccgagctgcgccacgcagggcggcggctcggtgccgtgctccatctccatcaactcctccggtccgaccatcacgctggacctcaccaagaacgggggaggcgtgcaggtcgtcgatgccggggaggcgcaaccggacatgaagaaggtgtgtcgggaggtcgcgtcgccagaattccagagggcgttggtggagcagatggcccgcgagctcaccggcgaccaaaagttcaccgacgcgctcgccgcggcgatcctgcggaagctgccggattattagcataactaattatagagactacgcgaacttcagaaactttctaattttgtagcatttggaacactaaggctgacgtagtacaaaatttcatctac

SEQ ID NO: 29906 - DNA, 1156 bp, Triticum aestivum
  unsure (1)..(1156): unsure at all n locations
  Clone ID: PAT_TA_29906
cccacgcgtccgcccacgcgtccggacaagaccctggccccgcgcctcgccgagctccgggacctcgggctctccccgtcccagatcgcccgcctcgtcctggtcgaccccgcccgcttccgccgccccaccatcatctccaagctgcagtactacgtccccctcttcggctccttcgagaacctcctccaggcgctcaagtacaactcctacctcctcagctccgacctggagaacgttgtcaagcccaacgtcgcgctcctccgggagtgcgggttaggtgactgtgatattgccaagctatgcatccccgtgccgaggctgctcaccagcaagccagagcgcatccaggccatggtggcgcgtgccgaagatgtcggtgtgccccgtggctctgcgatgttcaggcacgcgctgctggctgttgcattcctcagcgaggagaagattgctgctaaggtggagttcctgaagaagacattcaggtggtcggaagctgaggtggccattgctgttgccaagcttccggtggtgctgaggaactcccaggagaggctgctgcgcatgtcggaattcttgatgtcggaggttgggttagagccggagtacattgctcacaggccggcaatgctcgcttgtagcttagaggctcggctcaaacctcggtactatgttgtgaagcttcttaaagaacatggattgctaaagcctaaccgaagcttctacaccgcagcccaggtgagcgagaaggtattcgtggagaagttcatacgtcctcacaaggaagctgcgcctcgcctcgctgaagactatgctgccactctcaaaggggaagtgcccactagattcagattgcaataaccaagaacaagcttaaatagtatttaaccgctttttgcacaatgaagttttctctctggagtctgcaaagcaagttggcaagtcttgttcctgtgttgtttttctaacactctaactggatgtttggtgtccactatagtatgccacttgcntttggganttgctaananttctgaattcnaataaagtttggncgcatcanttagaanaaacatgnanatcataattggtctcaaagtatcnacaanaatttcnaccggttgtnatcgatttgcaaatagaataaantctttgg

SEQ ID NO: 29907 - DNA, 983 bp, Triticum aestivum
  Clone ID: PAT_TA_29907
gtaaaagatggaggtgtccgccgacgcggcggcggcggcggcggcgcggacgctgcggtgggccggccgtgcggggcacctgcgcggcgtcccgcgcgccgcggtgatcggcgccgttggcaccatcgccaaggcgtacgtgtcgctgctcaacacgaccaccgtgcacaacgccgacgccctccaccgcctcgtctcctcgcggccccccggcacgccgctcctcaccgtcagcaaccatatgtccacgatagatgacccgtttatgtggggattcaaaggtttccctattacagattcaaagcttgcaagatgggtgctgacagcagaggacatctgcttcaggaatgtattcatgtcttacatgtttcgacttgggaaatgtgtgccgatcactagaggggctggaatttatcaagaccatatgaatgaggcccttgaagtgcttagcactgggggctggttgcattcattccctgaaggaaaagtagcccaagatcaccaaccaatcagacggttgaaatggggaactgccagtcttattgtccgagcacctgtaactccaatagttttacctattgttcacactggttttgaaaaggtcatgccagagaaatcattttttggacgccgtccaccattgcctctctgcggcaaggagatacagattatcgtgggagaaccagtagattttgatctgccaggcttaaagcaggtggcagcaatgataccccaagacacatccttcggaaggaagggctggccaaccatcacgccggaggggctagacgaggcagcgcagagatggctttaccagaagatgtcggataagatccagtccgcgatggagagcttgaggaagacgcttctgaacttgaagcagcattgacattgattctttttgttcgttcttcgaccatggggcaaggatgcgccgccttttttctccgataccttgttgaattggttagggcatggtagct

SEQ ID NO: 29908 - DNA, 236 bp, Triticum aestivum
  Clone ID: PAT_TA_29908
cccacgcgtccggtcggcgtggtgctgccgccggacatcatggaagccttcgcctcctgcttcgccgagctcctcaacgacaagaagagcgtctgaccggcatcgcatcgcccgtgtgtccgtatgtgtgtgtgtgtgtgtgtgtgttgaccacgagctggcttttgctcttgtgacaatactgtactgtcgctgtgtcaaatttaaaacgggattatatggagtatgttgttttc

SEQ ID NO: 29909 - DNA, 593 bp, Triticum aestivum
  Clone ID: PAT_TA_29909
acgagagcagcgacacggtggagtccggcagggtcagcaaggcggcccgcggggcttggggcagggcggtgaggctggaggagacggacaagttctaccaggttgtcaagaagctcttcctcagcgggattgccccccgggtgggcggcggcgtggcgatcacggcggtgcacaaggtcgcccagggtccccggtgcagggctttccagcagcagggacagctcctggccgctgcgcgcggcgccgacgggggcaatgccaagttcgcgtggtacggcgcgccgtcggcggacgtggccgcggcggtggagcacgggttcgggaggaccaacagccgggtcctcggccatcgcgcgcacggcgacggcgtccacctctcgccgcctcagtctccttacgccagcgcaatgctagcaaatgcagatgagaacggcgaggcgcacatcgtgctgtgccgtgttctgatgggccggccagaggccatcccagccgggtcctcccagctccaccccagcagtgacgattacgacagcgccgtcgacacatgcagaatccccagtggtacgttgttttggagcaaggatatgaacacg

SEQ ID NO: 29910 - DNA, 1759 bp, Triticum aestivum
  Clone ID: PAT_TA_29910
tctgacccgaccgcctccacgcatcatcgacgcatcatcgacggtgaagcgtaggtagcgagcgcctccacagatcgggatcaggcggcgatggacttctccggcgatgtcaagcaggcgatcccccgcccggccgtcgctttcggcggcgtcggcagcgctggcccgtccccgctgctccggggctggcgggagttcaggcggagcggcgcgcccgtcaggttcctctgcttcgagggcggcgcctgggctgatgtcgtgggcgaggcggctgtgcctctgcgccgggcgttcctggacgggagggtggtcgccgaggccgcgtatggcggcagggagttcctgttcgacttcttgcggatggtgcgcatcgacgctggcaccgcccaggaggtcgccatgggctggattgacgaccgcggggcctgcttcttccctgtgccggacagcgggcggaagaggaagaggggcgagcctgagctggaggacggggcgttgtccggggtggaggaggggtccgacgagagcagcgacacggtggagtccggcagggtcagcaaggcggcccgcggggcttggggcagggcggtgaggctggaggagacggacaagttctaccaggttgtcaagaagctcccgggctgcaggcggcgtggcgatcacggcggtgcacaaggtcgcccaggtccccggtgcagggctttccagcagcagggacagctcctggccgctgcgcgcggcgccgacgggggcaatgccaagttcgcgtggtacggcgcgccgtcggcggacgtggccgcggcggtggagcacgggttcgggaggaccaacagccgggtcctcggccatcgcgcgcacggcgacggcgtccacctctcgccgcctcagtctccttacgccagcgcaatgctagcaaatgcagatgagaacggcgaggcgcacatcgtgctgtgccgtgttctgatgggccggccagaggccatcccagccgggtcctcccagctccaccccagcagtgacgattacgacagcgccgtcgacaacatgcagaatccccagtggtacgttgtttggagcaaggatatgaacacgaggatcctcccagagtacgtcgtcagcttcaagtgccccagcctccatcagatgcaaggatcatcgggagcgacctccgccctaaagaagccttcgccggtggctcgtgacatgtttccgacgcttctagcagagatccagcggttcgtgccatcctccaagctggagacattgcaggggacctacaatcgcttcaagaaagggcagatgaagaaggatcagttcatccggttcttgcgcgccttcatcggcgacagggtgttgacagcagttgccaagaaactccgaggatactgatggacagtgcaagggtgttcttctgctagttctgttgtcgtcaaagtggtgtgctggtggtgaggtggtagctcattcggctgactccatagaaccggaagggtgtgcgtgtcgggtatcaaccagatagttcttcatttcttatgtcgccgtagtttagccgagaatcgttgttgatctcaagaacatagaggggttacgggcaatcttccattaaccaacacaaagttagattttattcttggtttctgctatattttacttggtattttgttcctgcaaccgttcagactgaaatctacaatttatcctgaaacaacattgtcgacgcagcaacattctggcactgtaccaaatacaatgcatccaa

SEQ ID NO: 29911 - DNA, 1049 bp, Triticum aestivum
  Clone ID: PAT_TA_29911
ttttggcttttaaccactttattgtctgcataagcatacagggaaaagcacaggaattaggccccaagacttggaggcgatgtcgtggtggaggtccaagccgcacttcagcgccgacagccaggactcgagctccaacgacgcgtaccgcggaggcaaggaccgctcgccgtcgcgtcgcgagaagtccgacgacgacgaggaggagtaccgcccatacgcaggctacggcgccaacaccaaccgcggcggggccaacgaaggcggtggcggcggcggcggccacaacggtggttacggcggcgggggcggcggctacaacaacggctacggcggcggtggctcgtacagcaacggcaacggcggtatcacgccctacaacggcggcggcggtggctacaacagcaactcttcctacggaaacggcggcggtgggtacaacaactcttcttacggcaacggcaacggcggcgacgggtacaacaacgctcccagctgggcatcccaggacaccggcggccggacgccgatggtacataaacaccagggaggtccacgtctatggggcgccgcggaacgccgacgactacaacggcgaccagaagcggcgtggtggcggcggcggcgggggcagcgggttcttcggtccggccttccatgccgtcggccatttcgtcgatcgtaggttcggcctcgacgaccggaactgatcgatcacgcccatttttatggctgattgcgctggccatgcagataggcatggatgctgacgacgatcgagtactacactactactacgtgctgttatgtgtcttggatagtttccaagtgtaccagtgatgatgtccttcagttctgcgcagtgatgtgtgtgtatggtttgtgttgcatcgtgtacaacatgcctttatcacgcagatgttgtatatgtatatatgtacgcaacttaattacttcttgttctctctctcaaaaaaaaaaaagatgttacttatggttatatgtacgcaacttaattacttcttgttctctctaaaaaaaaaaaaaaa

SEQ ID NO: 29912 - DNA, 942 bp, Triticum aestivum
  unsure (1)..(942): unsure at all n locations
  Clone ID: PAT_TA_29912
cgggctgagcaggtcggtcggcgccgcgtctcgctgctccgcacccaaactaaccctcgccggctcgccgccacccactcgccggcgcggatgggagcacccaacggcggcgctctcgccgctcctctcttcgctgttcgcgcgccacgcaactgattggccgctcgttgcctccccggagatggccacggggtccatggagacggccctcatgagcgatccgacggccaagctcccagacgacctcctggtcgagatcatctcgcgcgtgccgttcaagtccacccgctgctgcaagtgcgtctccacgcgctggcgggacctcatcgcccaccccgaccaccgcgagaagcttccccggtcgaccctcgccggcttcttctacaaaacctacgacatagccagccgtccatatgattctcatggttacctaagcgtctcagggaactggtgccccattgacgcctccctctcgttcctgccaaaatgggagaagattgacttgttggactgctgcaacggcctcctcctctgtcgatgttcaaagccttatcctgaggaaccggattacctggtgtgcaatcctgccactgagaaatgggtaaccttccctgccaatgaatggtcctcggaatcgtatgctcgcttgggatttgatccggccgtctcctcccatttctatgtgttcgagttggtacctgctgtgggcgccgtagtggggctggaagtctgcatggcacatcgaagaagtggggatttactcgtccaaagctgggaggctgggacacatcaaattgaatggggacgatccaattgatatacgcactttcaaggtggacattctcaatgggtgttgtattaagttccnataataattgggtgcaancatcgacgtggagggaaacgtcgtttaatnctgttctacttaaatgatcnnctgtg

SEQ ID NO: 29913 - DNA, 1652 bp, Triticum aestivum
  Clone ID: PAT_TA_29913
accaaaattgatcttttattatagcaaaatgatacattggtgcccgaagttcctggcactaattggacgatattcgcactggatacacataattttttgctcccattttgctgatcttgattggcgggaacaaaactttttggcatcatcttttttttttggtcttcctcctttgctacctgggccacattttcctgtttgccagcgccattttttttttttttgaggaactggataaaacctttaagggcgacgtccgttttttcattcctcatgagcacctttgcgacctttggtggagtcaccatgacctccttgatcaatttttcgatctccggggtatgtggcatggtgatctatagagtggtagttggaggccaagattcgaaacgactttgggcagcagtaccccatgtgaatgtgcatgtccatcctgccagggcgcaaaagcgcaggatcgagcctttctttgtaatttgttgtgaagataattatcctctcctccccacttgttgaccaaagcccatcaacgaagttgagtagcccggatagtgtcaccttgtcctctgaagggttggatttggtgccctcctgaccttcctcccgctgttgcagctcgacagtgcagtcgatgtcctcaatgacaagaattgaccggttggtcatcccgatgagcaacctccgaagtgttgagttccagttgacctcagtgagctcaagatcatatacatcaaatttgaggtaattggccattgctgcaatcatgcttgacttgccagtcccaggtgggccatacagcaggtaccctcgtttccacgccttgccgatcttcttgtagtattcctttctcttgacaaacctctcgagatcatccatgactgactgcttgagcttgtgatccatggcaagcgtgctgaaggttgatgggtggtggagatcaatggcaaaccatgactcaccttcgttcatgtagatcttgagcgtcctgttctgctctttgattttcttggccacggcgaggatgtgagggaggtaggaggtaagtgctttgtccttgtgcttcctgtggaagctcatctcgaaggaccggacctcaagcttgaaattgccgctgccgccacggccgttggcgttgctgctgctggcgctggagttgtcccggcagacaaggcgccacttgaactcggtgccctcatggacatcggccatctcttcgccctcctccatgctgaacatcatgctcttggtctcgtcgacgcggctgacccggaggcgctgcatgtcggtgttgatccgcgtcgccaggtacgcccgcgcggcgtcgtagagctggttgttggcccacccctcggtctcctctatgatgatggtgtgctgggacgacatgtgcgagcgaaggtagcccatgccggagaagagcaggtcacgcacctcgtacggcaccagctcgttgacgacgccccgcaccagcatcgcggacgccgcgagggaggccgccgtggtgacggccttcttgtacgactccatggccttgtcgtaggaggccatggccggcggcgggctacgggcaaagtcactcctctgctttcgcctctcactttccttcaagaccaagtagtgctgggagatttgaacttgccaagcagtgatgc

SEQ ID NO: 29914 - DNA, 1223 bp, Triticum aestivum
  Clone ID: PAT_TA_29914
gacaattgtctgtttgaaagaacagctgagtgaaaaatgtaagtgtgatgatctcataaccgtggagctcttaacattagctccatcggctattcttttatttttatcagagcatacttcagcacaactcctttttcactataaagaatgaatcaatgatgttgagcgatacaaaaatgaagatacacggacacggtacaaacaaattggggctgaaattctacaaggattgcatcgttcgtctcctggcaccaatttataagtcgtcgaatgggccactggccatggaatgctcagtgacaaaattcttaatcttttgtagggcctcgacagcaatatcagttggggttagctgagagacatcatcatgaccctttttagctgcaagctcttcaagagaaaccctcacatcggcgtttgcataagcatcccctctttgctcagcgagcaggctgagtttcgtgaaagccgctgtgtatggatcagcagatggctgatctagaaggggccgagaagcagtcccaacttgtgcaattcgcttcgcaagcgcatccaaaggcacatccaacatgatagacagacctttcttcatatatctccagttaactggccgaataacagcaccgcctccagtagcaacaactagccgatgcattgaggataaatctctcaagacactactctcactgtctctgaaaaatgcttcactgtgaaccttgaatatttgagcaacggaaggcattccgactgcctgttctaccaaactatcactgtcaaagtatgaataacccaagacttcggctaatatcttgcccaccgtgctctttccggagcccatttcattccaactaggtaaatacaccgcccattcaattcaaactgcactcctcccgctctcccctgtggctagtggccttcggcccctcccccacccccgcccggatcacctctggatgtctggacgcagcagagcggggcgacgggcctggccccgcgaacccgcagcgccggcgcggcggccgggcctccgacgcgcagggtcgccgcccgcgccggcctgtccccgccgagagccccgctccggcgcccggccccgaccgcccgcgactgcatcgcgagtcccgcggccgcctccatcgctgctgctacccccggcccggtcgtcgcgggtagtaggtggccgtggcgtgcgacgttggaggcggaaggaaccctcgtgccga

SEQ ID NO: 29915 - DNA, 1205 bp, Triticum aestivum
  Clone ID: PAT_TA_29915
ccacgcgtccgcccacgcgtccgcacactgcagacacaccccttctcgaagctcccatcccgcggccggaatccagaaatggacgacctcctcggcctcggcttcccggggcccggcggctacgacggcgaggacgaggaggccatgaggagcctctacgccggcgcccccgcggaggaggaggaggaggtcgacgaggggtacgccgtcgcggcgatgaaggccggggacgagagggggatcgggaaggaggggctccggaagaggctcctcatagagggcgagggctcccagctccccggcgccggcgacgaggtcgaagtgcactacacggggacgctggcggacggcaccaagttcgactccagccgggaccgcgacgccccgttccagttcaccctcggccgaggccaagttataaagggatgggatttgggcatcaaaacgatgaagaggggcgagaatgctattttcaccatcccaccggagcttgcatatggtgaggatggctcccctccagtcatccctccaaatgcgacgctgcagtttgatgttgagcttctctcatgggcaagtgtcaaggacatttgcaaagatggcagcatctttaagaagatactagctgaaggcgagaagtgggagaatcccaaagaccgtgatgaagtttttgttaaatatgaggcgaggcttgaggacgggactcttgttacaaaatctgatggtgttgagttcactgtgaaagaagggcatttctgccctgctatagcgaaggctgtcaagacaatgaagaagaatgagaaggccctccttactgtcaaaccacaatatggctttggtgagcaaggcaggccggcctctagagacgaagctgcagttccccctaatgctatgttgcacattgatcttcagttggtgtcctggaagacagtcactgaaataggcaatgacaagacgatcttgaagaagatcctccaggagggtgaaggctatgatcgtcccaaagactgttcaactgtcaaagtgaaacttattgggaagttggatgatggcaccatgtttgtaaagaaaggtcatgatggtgaagagccattcgagttcaagactgatgaggatcaggtgattgaagggcttgacaaagcagtgcttagcatgaagaaaggagaagttgcctttgtgactattcccccagagcatgcatttggatc

SEQ ID NO: 29916 - DNA, 1202 bp, Triticum aestivum
  Clone ID: PAT_TA_29916
gcccacgcgtctcgtgccgaattcgcccacatacaaatacacgcacgcacgcgcacacttactagctaggtagccactagacatccctgccgaagatggcggcggcggtgaccgtggacgaagtgatgaagatgcagagggcgcagggcccggcgacggtgctggccatcggtacggcgacgccgcataactgcgtgtaccaggcggactacgcggactactactttcgcatcaccaacagcgaacacctaactgatctcaaggacaagttccagaggatgtgtgacaggtcgatgatccgaaagaggtacatgcacgtgacggaggagatccttaaggagaaccccaacgtctgcgcgtacatggcgccgtctctggatgcgcgccaagacatggtgctcggcgaggtcccgaagctcgggaaggaggcggcacataaggccataaaggaatggggccagccactgtccaagatcacgcacctcgtcttctgcaccacctccggcgtagacatgccgggtgccgactatcagctaaccaagatgctcggcctccacccgtccgtgaggcgcgtcatgctgtaccagcaaggctgctttgctggcggcacggtgctccgcgtggccaaggaccttgcagagaacaaccgtggcgcgcgtgtgctcgtcgtctgctcagagatcacagccgtgacttttcgtggcccatgtgacacccagctagattccatggttggccaggcactctttggcgatggggcagctgccgtggtcgtgggcgctgaccccgacgtgcttgttgaaaggccactgttccaacttgtctcggcgagccagacaatactgccggacacggatggcttcatcaagggccacctccgggagggtgggctcaccttccacctccacaaggatgtgcctgtagccatctcaaaaaacatccaacaagcgctagaggacgccttcgctccactcggcatcgatgactggaactccatcttttgggtggctcaccctggtggtccggccatccttgacatggtggaggcagaggccaagctggacaaaaggcggatgcgtgccaccaggcacatcctatccgagtacggcaacatgtccagcgcttgtgtgctcttcatcctcgacgagatgcgtaagcgctctgctgaggacggacacgccaccaccggcgagggcctagac

SEQ ID NO: 29917 - DNA, 990 bp, Triticum aestivum
  Clone ID: PAT_TA_29917
gcgatggcatcctggtgaacacgttcgagtcgctggatgctggggtggtggcggcactcggcgacccccggtgtctgccgggacggatcatgcctccggtgtactgcgtcgggccattcgttggtggcgtcggaaacgaggcgaaagaccggcatgagtgcctcacgtggctagacgggcagccggacagcagcgtcgttttcctctgcttcggcagcgcgggaaaccactcggcggagcagatcaaggagatcgccgtcggccttgagaactccggccaccggttcctgtgggtcgtgggaaaccctttcagcgacgaccaggacttcgacgctctcttgccgaacgggttcctagaccgcaccagaggctgcggcctggtcgtcaagcagtgggtgccgcaggcagacgtgctccaccacagggccaccggcgcgttcgtgacgcactgcgggtggaactccgtgctggagggcgtgacggccggcgtgccgatgctgtgctggccgctgtacgcggagcagaagatgaacacgctgcgcatggtgggggagatgggagtcgccgcggagatggtcgggtgggagcgggggctggtcgaggcagccgaggtggagggcaaggtgaggctggtcatggactccgaggatggcatggagctccgggcgagggccgcggcacacaaggaaggcgcggccacggcctggagcgacggcggctcgtcgcgcgcggcgattgccaggttcttggccgacgtcgacagccggcagcctcagactcgcggtgatcggtgagagtgagcgtggacttggcatgcatacagtacatgcttcttgatgcatctcgtaccagagcgcgcatacagatgataatcgcattcgctgaggccaatgcatatgaaaatgaagttcaatgggcgatttctctaccgtccgattttatgtggagattcctggtttcttttttgcgtggttggagatccctgttgtg

SEQ ID NO: 29918 - DNA, 791 bp, Triticum aestivum
  unsure (1)..(791): unsure at all n locations
  Clone ID: PAT_TA_29918
cgtcttttgggttcgnttgcngggatgaattagtttcacctaatgggcacatcaggcagtctgtctttctaatcgcatcaaatgctgcagcaattttacctgccttctgggccctccggcaaaaggcgtttgccgaatggattctttacacgtctagtggaatttctagtgctttgtaccattcgtgggatgtgggcacctggtgcatactatcttttcgtgtattacagtttttggacttctggctttcattcatggctgttgttggtacattcatatatatggctacaattaaagaagcttcaaagcgagcaatgcatactgctgtgtttattctgacagctattttagctgcaactggtgccaccagatctgccaatattggtatcgtcgttgctattggttcatttggcctgcttattggatggatattggaattctctaccgcacgaagatttgtatgctgctcgtggcgaattaacctcaatgtgccccatagatggccaaacctcgcggctttgttcctggaataccctggagatgctgaacaagcggttcccgtttggctgtatttactttttggttcatcacattaccttttgcagctttaagctggnagctngaatcaanatngtagctattgggtttggnacagtatgtggcacataactatctacacatctcatcctctcctaagtcaatgcgttcaacactacgaacatntcggagacaactatnatttcgagcaaatacttccaacgncaaatcattcnnctagggatnccggagaa

SEQ ID NO: 29919 - DNA, 931 bp, Triticum aestivum
  Clone ID: PAT_TA_29919
cccacgcgtccgcattttaattgcagaggttggttgtttagtatcctatactaataacttttagtaagatcagaaagcagattgtacagacacatggttacagttaatagtatctcgcataaagggtgcaatagactgacaaagtcatacataataccactaggaagctggagatggaaaggaaacaagtcaacaattgtttgtttggcacaccatcattatgaattacataggcacacaacgtaggcacacaacgctgtacttcaaggccatggaagtcatgcggatgggagatgcaagtgctacatgaccacatgcatgcaggtctggaagttgtgctactgagtggagtaccattggtagagaagagagatggtttggcgtttgaggacagattggtagaaacagaggatgcaaaactacatggcaacaacgactttgcaattgttgaagatggcacggaggagtgcgtgccatagtgttgggcattctgctagtgtcaatgccctgctggggctcgcagccccagacaagcatagagctgctggaaggctgacaaacagcagagacaaagccctgtatgaagggcttagtaaacgaactagattctgcagcattttgtcgccaccaaggtcacaagaggacggaccacatgtccagaaagaggggatgccccaaaaaagccacggaagccagggaaatgaaagaactgcggaatagaagacagggccacttggtattgctaagatctcaactataattctttagtttgtagtactggtttttaaaacatgagatcttgcaatgtgttttcgcatgagcactggtccatgcttatccatcagaccgcactgtcgtgagtccccgctgtatctaaagagaatgaactatgtgtatggatgtctgaactatgatggcccatgtttagtgt

SEQ ID NO: 29920 - DNA, 896 bp, Triticum aestivum
  Clone ID: PAT_TA_29920
ttagatagtaggggcttttttttttttttttttttgtttgtctcggttgtgtttattttcctgccatcctagtctaagctgtacggtccgcatttcggcgaactcagttgccgaaccatctcaggcaaaggccaaagaaacacgcttagtacaggcgcttggggggagacatggaagccttgatggtaaggcttccaacgttctgccagcccttcttgagaagggagacaaggtagttgatggccaacatgatgttaccaacaagctgctcctggctcatctcgacgttgccgacggcgacacccatgcagagaaccttcttgagctggaacttgatggtgctcttgacctcgttgatacgtccggtaagatcatcggcgtgagaaacgggggtagggaactttccggccttggacagaccaggacccaagagacgggggatctgcttgatcagagcctcggaagcgacgaaagcatcgtacttgcgagcgagcttcttgatgagcttcttgttcttgttgagcttcttcaagtcatcagcggacatggcgtcaacaccaccgtgcttggctcggtcgatatcgtgctggtcaccgagaatgcagatggacatgttggggcggggaatggaggggagacggatggagccggagaaacgcttgtctctctgggggtcgtagttcttcaggccgatctgaagctcgacggtctcgaggaagtttcgcttcttggtctcattggagtactcaaggagctctccgacctgggttcggacattagcgactgtgattttagacattttggcagtctcccaatagataggcgtataatctaatggtgatcagaacgtgggttcccagccggcgcgcctccgcgcgagcggcttttcgattttt

SEQ ID NO: 29921 - DNA, 863 bp, Triticum aestivum
  Clone ID: PAT_TA_29921
gagttttttttttttttttttgaaaaaatcagaaaaaacattgcatgcacggatatactataaatcactctccgcaagactttttcgttcaaacagcagacaggtactcaaatgccacaatttcaaaattacggaaagcagccagattgcaacaaatctaacagcatagaaaattacaacagcaaaaaacctgatctcccattgccataattaatactacaacaattgcatggtgtgattgcactctgatagtatctatctagttttatccatactggcgtcagaattaccttggttatcatcttcttgcttgaacttggggccactcaagacatcatcagctgtgcagccgtggatgtaatcaatatcatgctcctgccgcccatagctgttttcagccccctggtagccactagcttcattatcaattgatttcctgcaagatggtctttccggccctcccaaatcttccagatgttcatgaccatgttcatcatcatgctcatggacatgttcttgctcctgccggctgccgaatgacgggtcgtatgcatggggaccatgcaccctcatttgcaccgacctcagtagcgctgttcgcctcaggtccgcgccgtggcacatgtcattgggtgaagacgggaaccggccttcattctcagagccacgtcgagggtgagagcaagccacggatgagagggagcagctggggagaggatatgggcttgatggtaggaaaccagcttgcggtttctggaaccggtgaggagaagacatcggactagttgatgggctgaccattgcatcgccttgactcccgttggggtttagttgcgtgtcgaagtacccggacgctgggtcga

SEQ ID NO: 29922 - DNA, 620 bp, Triticum aestivum
  Clone ID: PAT_TA_29922
gaatgaaaccgacccggtccactagaatggaaccatttcattacattgcatttggttcgccaatcaaagacaccccaagatcatccctgtactttgtacaccccatctatcaatacaatcaagcatgaagtagagttttacatccaccgagagtgcatgaacctgggtaaccttccctacttgttttccacctatatcatccgactagctgtgacacccaatcgagtgatctgcctagttcctaatcaatgttttccctgcaccatgctatctacaattattatgtgatgcaggtgacaaccaatttacatgttagtcccaatatccctcaaataactgtgcgttacatcccaaattgcaaggaagccatatatatatatacgtgcaaatttacggtataatgaggcttgcacatgcatatcctgccagaaagaatctggtatcaagctcttcgctgtagtaagataagacctttgtccatggatctctagtttaccaccagaaggtatggagcacagttctcccgatactccttaggtctgacttgactctgtcgttggcaaggtatcttgcctcgtcaactcataggttgtctccggactatgattccggacgcgtgg

SEQ ID NO: 29923 - DNA, 892 bp, Triticum aestivum
  unsure (1)..(892): unsure at all n locations
  Clone ID: PAT_TA_29923
ctttgacccgcgccactcagtcttgataattcttaagttaagaacacgcccagcccccacccgacaaacagattattctgcagatcgtatacctgctgcagctactcacacacaggctctgcgagcgcgccacaccccctacttcccaaagagtgatttgatccaccacacgccgccgtccatgggggtgtccttgctctccggcgccggctcggggtccgccctcattcggagtttgctcacgtcgtgcccctcctccttggctccctccagcggttccatgcaccacagcccgtcgtccttgggcggcccgcggatgacccgcagctacttcctggggggctgcccgacgagcgcgtactggtagtcgccgtcgatgtggagcacccactcgtcgcccatgacggggaccacggggagctggggcggcacgtagaagctcaagttgtggttggcgtcgtgccggccggggtgggcggcgtcgggcggggccccggaggtggccgccgcgtccgtccggccacggcgcgttcagcaccttcacggggccgccggggtccagcccgtgagcttggcgtggtcgcgggcgccgcggggccgggaaccgggaccgcaaggacgccgccgcggccgacgggcccgggttcggctcgcggcttggcggcgccgtcggcgccgagcccgtcgggggtgcccggggcggcgggcggctcgcgccggtgccgggacgggtagcgggcgggcacgggccgcaggcccgtgggccgcgctggcgcctgcccgggcgcgaacgccctcgccgccatcgcgcgttgcgcgtggggagggagcgagggcggcgtgggttgaggcgccgacggcgatagggatgcctcgtgccgaattncctgca

SEQ ID NO: 29924 - DNA, 783 bp, Triticum aestivum
  unsure (1)..(783): unsure at all n locations
  Clone ID: PAT_TA_29924
ttttttttttttattacttaaagtcttataacccgccaacatacagtattgattctttacttaattgataacggaatacaagaaaaccaaaactaagaaaagaaagcccaaaccaatctccttgtcttctcaaaataaattccaaaaaaattacatgtattctttgttcgttgttcctggccatcttatcacccaccatcaaacggaattccccatcaaacaggccaaggacgcgccaaaactccaattcggtgagcgcgagagcctcagagcagcaccggcacaaagcaggccttgacgtcgtcgctcgcccactgcagcccgttccaccagtgcttgtcgccctccaccctcaccctgccctgcccgccggccaccggccgcatcggtatgcgcctcagccgcgagcaccccctggtctgcagcctccgcagctccgggaacgcgcactccccgccgccgccgcggatgtcctccagcctcggcagccccagcagcgccagcagcctcagcctcgggaacgtcaccacctcctccgcctcgctgcccccctccgcggcgccgccgaccagcctcgtcatcccgttgcagccgctgaggttgagcgactcgaggcacgggaggtgctgcacccaggtcatgtgcgtcagcgcgtggcacgcgccgatggccacctcccgnaggttggacgccgcgccgtgggaccactccatgacacggagcctcgcgaggaacccgaacttgaccacctccagcctcggcgcgtgcgcgtcggccacgatc

SEQ ID NO: 29925 - DNA, 220 bp, Triticum aestivum
  Clone ID: PAT_TA_29925
caatctcaacgttcagcagtcgggcagactgagcttgcaagggcaaggtccatacaaaaatcaatgcaggggatggcgacggttttgctggttggtccgttggtcaggcaacgaagacgtaggaggcggtggcacatggggactcgtcatcatcgtcgtcgccgttatgggggaggccgtcacggtagacgtagacgaggacccagaccggacgcgtggg

SEQ ID NO: 29926 - DNA, 758 bp, Triticum aestivum
  Clone ID: PAT_TA_29926
tgctgggcgtctcgtcgcaggcttcgctgagctgccgggagatcgagcgcgagcgcccgccgctacggcacgaaggacgccatctcgcggaactggccctccgccttgccggcctggtcggcgtggtcgggccgcgggacgccgcgctgggagcggtggcccgccggcaggtggacgccgaggatccggcggcaggaggggcaggcggagtggccgcccagccacttgtcgacgcaggcggcgtggaaggcgtggccacactgggggagcacgcgcatggcctcgccgtcctcgaactcggcgaggcagatggcgcactcgggcgccgcggcgtcctcctcctccttgcccttgcccttgcccttgccggcgtcagcggagacgtaggcgacggtggggatggcgcggagcaccgacttcttgacgcccctgttggcggcggcgcgcaccctggcttccgcgccgccgcacgcgcaccagcgggcgacgaggccgatgccgaggacggtgatgagcgcgcagagcagcgaggcgaggatgatgacgatgtccctgtcgtcggcgatggtccgggcgcccggcgtggacacgccctccgccgccgcctgcaagaacctcctggccgccatgggcgtctgctgcagctgcgtcgtcatgtctgtgtctctgtctgtcctggtgctggtgggatgggtcgggagtgagacggagacgggggtagctggatgcgttgcgggggaggaaggtcggacgcgggg

SEQ ID NO: 29927 - DNA, 950 bp, Triticum aestivum
  unsure (1)..(950): unsure at all n locations
  Clone ID: PAT_TA_29927
cttttttcatactctcatactcaacagaacatcttttcgtacacatataacagattcaaaggagtcagaaccggaaaacacaggcaaacagctgaggataaacaagcggcaatcgtctcaaggacaaaactgctgcttctaggcaaaattcatctctgttcctacggtgcacaattggttcagtttctagtggtaccaaaatctcttgtttggattgagaacacggcaaaatttcagaggactgtcattgtcaggtctgaattaatgccgcttcctcttgcctcctttctggtgttttctccgccccgcgctctgtctacgcggctcactggaaccaccgtcgtcttccttctcgccatcgagcagcgtgttcatcccgaggtcgaatccgtcggtcaggccttgtaatccatgaagctgctttttcatctgcttctccatgtacttctcacgtttggttacgggagctcgggtgaacagctcctcttccgccttctcttgcttctctctctgccgcatgtaggccataaattctttgctttcgtcacccgctgtttccttccactcttcaggtctatcagcagcatcatcaatcatctccttgaagtaaggattctctgttgccatacgcaataatcttttctctttccttacagcgtctttactatgactatcatccatggcagctggcccaattctcggaggaacgtagataccatctttgccctgtccttcagaaacaattttgggatccatcatatccgggtttggccggtaccccaacaggtcgtcctcgccttgttgcctgcccttgacattgacctcagcatctggcaccttatcctgggcagccgcaccatctgcagcattggtgagcttctggatctggtactccatcttcttgtctattgggcgaatcttctcaagaaacagcctgatnctcgacaagc

SEQ ID NO: 29928 - DNA, 740 bp, Triticum aestivum
  Clone ID: PAT_TA_29928
cccacgcgtccggtgctctgcctcgtgtacaaggtggtggactacgccgtggaggccgagtggaagccctgctactgctcggccgcggcgcgcgaggacggcggaggcggcggcgtagcaacgggcgcgaagggggcgctgtcgttcgtggccccgcgggcggcggctgggacggcggggccgaaggtggtgcggctgtcgtcgtcgtcggccaacaagatgcagctggaggacgtgtcggacacgctctacgtgcgcgcgtctctcctctcggacgccacgcggaagccgggccccatcgcgccggcgctgaccgtgagcccggccatcgcggagctcatccgcggcaagatcgaccgggcgccgcgcccgccgcggcaggcgccctgctggtccgactgcgactgcaagatgtgccactcgtggagcaccggctcgcgcgcctcccacctctacgtgcacgtgcaggccccgccgcctccgggggccggggccggcgagcaggaggcggtcatcttcatccacggcttcatctcctcctcggtgttctggacggagacggtgttcccggcgttcagcccggcggcgcgcgggcggtaccggatgttcgccgtggacctgctggggttcgggcggagccccaagccggccgactcgctgtacacgctgcgggagcacctggagatgatcgagcgctccgtgctccagcgctaccgcctcaatttcttccacgtcgtggc

SEQ ID NO: 29929 - DNA, 1054 bp, Triticum aestivum
  Clone ID: PAT_TA_29929
aaaaccacgagtaaaacggacgcgtgggttttttttttttttttttttttttttttttttttttttttttttttttttgtctgtcaaagtaggaagtaactcaatataattcggtctatggcaacgccggcaggacttgtcttgggcgacaatacatccatccatcgtgctctgcctctccggcgaaaaaagaaaccgtatttacagatctgcccctgccgctgttgtgcaaggcggacggcctctcctaaaaacatcatggaggtacatgcaaatttccttcgctctactaggggcaaaaaaagaaggcgaccaaagaaactagcagtcatatcagctacatgaactccggcggccccgatcagagctccgccggcggcgggcagttcaggtcgaggtcgaaagggacgggcttccttgcgggcggcgacggcgccagatccaccaccgacgacgagtcggagtcgctcggggacacggacgccacggtcaccttcggggcctggctgtacatgtggcagccggcggcggcggcggccgcggcctgtccgaagaagtagtacgggtgcgacacggggtagccgctgaaggggaagcgcatgccggcgccggcggtgctggtggccgcgcggtggaacaggtcgaggtcgagggacggagggagcggcatggcctgcatgggcgcctgcacgtcgccgccgaaggactccacggtgctgctgttgctgctccggctgccgtcgacggtgagggccgccgcggcggcgggcggcgcggaggcgggggcgaaggggaagttggtcttggccttgttgccgcggtactcgcgcgcggcggcgtcgtaggcgcgggcggcctcctcggccgtgtcgtacgtgccgagccacacccggctcttcttggccgggtcgcggatctccgccgcgtaccggccccacggccgctttctgacgccgtggtagtgcgtgccgacgcccccgtcgttgccgtcgtcgtctctctgcgctagcccgtgtcttgtgtgccctgttgcttttcgttttttccttttttt

SEQ ID NO: 29930 - DNA, 1884 bp, Triticum aestivum
  Clone ID: PAT_TA_29930
gcacgaggttttttgcgaaggagcgcagcggcatctcacatcactcctcccccaccccaccaccatcgccgcccccacgcgtccggctcaacctcgtcgcttccggaacaaccaaggcaagcaatccaatagaaaaacagcggcggctcggctggcggagggaggcaaccaccacatagaccagcccgcgccgcgcagccaccccgccaagcagagccagcagcccgagcgcgccttcctccgaggcgaagcgccggcgcgccgcggggaggcggccagccatgtcggtgtcgtgcgggctggagtgcgtgctgtgcgtggggtgcgtgcgctgggcgtggaagcgcctcacctacatcggcgcctacgacagcgagacctggccgcccgcctcgcccgacgacttcgagcccgtcccgcgcatctgccagatcatcatggccatctccgacgacctcgacaaccccaagctcatgccggccacccgcggctacacccagatcgacggcgccggcgtccacaagcgcaccacctacgacgaggtcggcaccgcatgccacaactacatcgtctacgtcgcccgccccttggatgtggtcgacgtcgccgacctctctcaagaggaaacccatgagggcgcttgccctgcgtcatcttccgacactcacagcgagacgacttcatcagaaccgaaatctgcaggaaggaccagttgggatgagctggttgtactggagagggagacggagacgctgcgggagctgctgcgccagcaggggcccgattgcaagctcatcttcgcgggccactcgctcggctccggcatcgccgcgctcatgagcggtgctggtggtcaacaaccgcaaggcgttcggcaatatacccaggagccacatacggtgctacgcgctcgccccagcccggtgcatgtcgctcaagctcgccgtcatgtacgccgacgtgatctactctatcgtgctgcaggatgattttttgccaagaacaccatcaccgctgcaagttttgttcggctctatattctgcttgccctgcttgttattcctgttttgcttgagagatacatttaaacaagacaagaagaagtttaaagatccaagaagattgtatgctcctggtcggatgtatcatatcgtcgagaggaaattttgcagctgcgcaagatacccacctgaggtgagaactgctattccagtggaaggaaggtttgagcatattgtgttatcatgcagtaccactgctgatcatggcattatttggattgagcgagaatccgccttggctttagagctaatgaaggaaaatgagaaggcaacaactcctcctgctgaacaaaagatggagagattgcaaagtttcaaggaagaacacaagaatgcgctccatagagcgaaaaccttggatgttcctcacgcgatagacatctctgaagaggaaacccatgagggcgcttgccctgcgccatcctctgacactcacagcgagacgacttcatcagaaccgaaatctgcaggaaggaccagttgggatgagctggttgacaagcttttcaccagggatgaagatgggaagcttattgtgaacagggacatggtggcgagggacgttgttatcgagtagtgacgggtaccatggcaactcattcttttcgccagccttatacaagagtgtatagtggtaaatcatgtttttaccttcgcggaattttctttttttggcgacttagagagaaaagcagtcccaaatgccctagcgcttgtgcatatgtagatttcatctgcgtattcttgagtctgaaatgtcatgtacgttggttaatgctgcaagtattgtatatcgtctctgagttaagagttggattttgtt

SEQ ID NO: 29931 - DNA, 1017 bp, Triticum aestivum
  Clone ID: PAT_TA_29931
ctccccctctcccccaaaacgccaaaaacccaaaccccactcggcgaagaagaaaaagaagcggcgcaatgcaggaggcggggatgtctgcgctgtggaacaccgtgcacgggtggttcaccccatgggtgctgttcctcgtgctacacctcatcgtcgccactatattcgtcacctccagggccacgtcctcggcggggagcggagaaggcgctccggccggggctgtcggcgagaggaggagcctatccctcgtggattcaatggcaatcgaccggccccacttcaccgctcccgcccctgaggccccggtgaccggattactggatctgggacagcccgacgagcaaccgccgccgctccagatggagccggaggatcagggtgagcacgacgcgtttacaaaagagggtgagctcgacgagcacacgcacatggagaggagcatgtcggaggcggcggtcgaggccgagttgcctcggctgccgacgcggctgcgcaagtctgcgagcgacaagccggcgttcgcgcacttcgtggccgagtcggacaccaaggaggtggaggggcgcaggcgggcgacgaggagggacgcggagcgccgccgccccctggtggcggaaccggaggagccggcgtcggaggtggagatcgaggaggccggcggcgaggtggacgcgcgcgctgacgagttcatcaacaggttccaccaccagctgaagatgcagcacatggactcattcatgcgctcccagaagaggctccaccgccgccgggcgaccgtggtgccagaggcgcgctaggctggcctcttccgccgcaggtgctccgtgatgctgcacagagcttcccgcgctagcctagtggatggatggatagctcagtagtcctaataataaatcaaacaaaacctggcttcggaatctttgtcaagaaatagcaatggcggcgagccagctctgaagggttaaaataaaggggaataacggatgtggtgtgcattctgtaaaaaaaaaa

SEQ ID NO: 29932 - DNA, 1117 bp, Triticum aestivum
  Clone ID: PAT_TA_29932
cgtttcttgttaagcttgatacgaatgtcgtttgtccccactgtcttccctatcaaatatcgaagattcacaaatatgcgtctatatccttgccatttcaatgaacatccacgctcactccgctccttcgatttcgcagctattttgtttccaaatagctgcctttgttattaagactctgttactaactcctcacggtctccttcggggacagggtatgtactcgtttacactaaaaaattccgatgtcatatctgctaaccatgttggctgcatcccaattgatcccttcatgtcccagtagttctagtccacaacgtcattttactctacgtacacgtcgagttgcaagaagaccctatgagtgcggttaataaatttgacatgtattagaaaagaatagcatgtaggttaatgatattggctatttatattgagacttagattaattgtgtaccattaaaattatagcttggtcttactatatgcatgtcacctggtctaaattcagtgtgtacatcacttttttgttctcagtaagtttctagcatttttacatgcatctctctgtagcctagacatagtaaactattgatgctattccaaacacaagctcaagcaagttcaataaattatatatttttattagtataatcagcatgagatacaccttgatttcatcacttggtttactgtctgcatatttgtttcaatgcaggtaccatcaatgtcctagaagttgtagcttccagcctttagtaactacacaaaaactgccaaagcttcagagccatcatgtgagtatgagtaaacacaggtcgagttgcaagaggaccctctcatggcctatttcagttgggaacttgtattaagatgtacttgagctacataaagtttgagggctaattttcgatggatttgtatgccttgatcaggtattaggatcatggttatttgtgctatatgtatagaggcacctctttattggaaaaaaagtatagatgcacctatgatatagtggagattgatgagcagcaccacatccaagtgaacctgagtgggaacctgtttccaccgagagactaccgggactttgatgctagctagcttctattcc

SEQ ID NO: 29933 - DNA, 301 bp, Triticum aestivum
  unsure (1)..(301): unsure at all n locations
  Clone ID: PAT_TA_29933
catttccaaaacccatcntaggtgggatgatggattataatctatgtggacgtcaaatatccgagccccttaggggtatacatcagaaatacagtagatagtttttctttcatacttaggccctgctaggaacacgggaattttcccgattcctgcaggaactaactctttccagtgaattatctgagatccaaacagaacctttacagaaaaaaagaacatagcagcccagtttgttttcaggttatcttgtaaatttttctgactggtaagattgaaatagtcatattttcgagcaaaa

SEQ ID NO: 29934 - DNA, 1665 bp, Triticum aestivum
  Clone ID: PAT_TA_29934
gcggcggccgccgccgccgcgccgccgcccgcggctacggccccggccccgacgacgacaaggacgaggaggaggagcaggacgcggccgcgccggcggaggaggaccaccacgcagaggagcctgttcccctttgcgacgagcagttctttgacgaaatggatgaagatggaaacttgagacacaacaatgatgctcgccttggaaacaagagggaaaacaatggcaggaggcctgcaaaccctactctgttcgactcacttaggaggctgcagctgatttggttgtccttgaccacgcttaaggctacagagcattgggtggacagttaatggccttcggaagcacagctcgcaaccaagcaaacacctcaaggttcaaattttcaagcaaagcccaaagtcagttgcagcaagcatcccaactcccaacgttgcccttgcagatactatcccaccaaacttcacacccttccattatggacgcatctgatgagatgaagtacaaacagacccaggaacacttcggtgtcgaaagaaaacctacaatgggtcatgtggataaatcaaggcttcgtgcacagccttcatcaggagtcaggttagagtcggcaaggccaaagacccaggatggcttggaaagcaacgtaaggttggaagcagccaagcgtaggctccaggaacgttaccaagaagctgaaaatgctaagaagcagcgcacgatacaagtaatggagctgggggacataccaaagcctaagagtaacaccaggcaacctatggtgaagtcaaggaataacattagaagtagggtactcggccggcgctgattcttctgtgatgtttttcctcacttgatgaatttgtcgccatgtcaagctggtccaaaaggaagcagctgaacttggttgccaggaccaaaaccatatttttgaacataaacaccttcttcacctctgatggagagttatccttgaagttgcgagagtcgcgctggatgcaataagttaagcctttgctttgcatgcattctccgctcttgcgttgggagctcgggagagtttagtcatgtcttgataatctgagagtggacatgtagttcatcctgtatcggctggttaatttttcttccaccttacttgggaaggaagctgtagatactcaggatagaaaaatcctaagagtaataccaggcaacctatggtgaagtcaaggaataacattagaagtagggtactcggccggcgctgattcttctgtgatgttttccttcacctgatgaatttgtcgccatgtcgagctggtccaaaaggaagcagctgaactttgttgccaggaccaaaaaccatatttttgaacataagcaccttcacctctgatggagagttatccttgaagttgcgagagtcgcgctggatgcaataagttaagcctttgctttgcatgcattctccgctcttgcattgggagctcgggagagtttagtcatgtcttgataatctgagagtggacatgtagttcatcctgtatcggctggttaatttttcttccactttacttgggaaggaagctgtagatactcagatagaataattatcaatattcgcggtacctcccatctacccccgcccgtttacatgagtttattccgtgggacattcttggt

SEQ ID NO: 29935 - DNA, 1594 bp, Triticum aestivum
  Clone ID: PAT_TA_29935
cgtccgcccacgcgtccgcttttctctccctcctccggcctccagacgagcaccagagagacgagcgcagagcagattcccacgcgacgcgagcgatctcgatcgattgacagagaagaggcaaggggacggccatggggctggactactacaagatcctgggggtggacaaggcggcgagcgacgacgacctcaagaaggcctaccgcaagctcgccatgaagtggcaccccgacaagaaccccaccagcaagaaggaggccgagagcaagttcaagcagatctccgaggcgtacgaggtgctgagcgactcgcagaagcgggcggtctaggaccagtacggcgaggaggggctcaaggggccaggtgccgccgccgggggccggcgccggcgcgggcgggccggggggcgccacctcgctccccacgggcgccgacgggggccacggcgttgcggcgacgccgagggcaccgctggcggacgtcttggcggaggacctggtgcccctgccgacgccggtcgggcgcagcctggcggcgccggtcaccgcggcgatccacccggggtatgagcggaggtgctgcgcggcggccgcatcccgatcccctcgggttcgtccccgtccagtgttcggcgggtcgggcgccgccgccggccccccccccgccccgccgcccgccggcggccccgccgccggccgcgcctgccccgggatgttcggcagcggcggcggcggcggcgcgccgctcagggcggcgcccatcgagaggaagctgccctgctccctcgaggagctctacaaggggaccaccaaggaagatgtggatcccccggggggtccccgatgtccgcgggaagacgattccggtggaggagattctgacgatcgacgtgaagccggggtggaagaagggcacgaagatcaccttcccggagaagggcaacgagcagccccacacgattgcggcggacctggtcttcatcatcgacgagaagccgcacgcggtgtacacccgggacggcaacgacctggtggcgacgcagaagatccccctcgccgaagccctgacggggtacacggtgcacctgacgacgctggacgggcgcagcctgacggtgcccatcagctcggtgatccacccggggtacgaggaggtggtgcgcggcgagggcatgccgatccccaaggacccgtccaggaagggcaacctgcgggtcaagttcgacatcaagttccccgccaggctcaccgccgaccagaagtccggcgtcaagaggctcctggggcagtagggcgtgcccagggagccttgtctgtctgtgtgttgttgaactgaacaggggatgtgagatgagatattgcctgcttttggagcatcggcgatcaccgagttggccctgtggactagatgatgagaaaatgtatacaatgtgaacttgaggtgcatagataggtaaatcttggatcaagtgcatttcttgtaagcttttggagatcgaagttcgtccgctggatgacttaattttttgttgttcgtctgctgtatggattagtgatgtgatagaggtaataaagtgatttcatcatagccc

SEQ ID NO: 29936 - DNA, 766 bp, Triticum aestivum
  Clone ID: PAT_TA_29936
atctccacaaagtattgagctgaaggtacgtacggtggtgtaggaaatcgtcaatggacaagcttcccaagcgcccggctaactacgtgccacttagcccggtcgggttccttccgcgcgccagtgcagtatacggcgaccgcacgtcggtcgtctacgggcgtctcaagttcacatggagccagacgcacgagcgctgccgccgcctcgccgccgccctcgtctccctcggcgtccgcaagaacgacgtcgtctccgtcctcgcgcccaacgtgccggcaatgtacgagatgcacttcgccgtgcccatggctgctgccgtgctcaacaccatcaacacgcgcctggacgccaaggcggtggcggtcatcctgaggcacgcccaggccaaggtcctcttcgtcgactatgagtacgtgcgcctcgctcacgacgcgctccaaatcgttgccgatgccggcgcgcccgtgccgcttgtcgccgtcatcgacgatatcgacaggcccaccggcgtccggctcggcctcttcaagctcgagtatgaggcgctgctcagcaaaggagacccggcggcggagctgccttcgctcgcagatgagtgggatgcggtggtgctcaactacacctcgggcaccacgtcggcgccaaaaggcgtggtgtccagccaccgtggtgcatacctgaacaccatgggccagctgctgtcgtggggggtggggaacgagcccgtgtacctctggacgctccccatgttccactgcaacga

SEQ ID NO: 29937 - DNA, 1282 bp, Triticum aestivum
  Clone ID: PAT_TA_29937
gccggccgggccgagattttcgactcttgtcaccaacaaacttgagctgatcctcccgtgtacagttcgggcttactgtgactgattttgtcaactgaccatacaaagacaatgtccgaccagcctgcgactgtcgctgctcccgcggctcggtccgacctagcgtcggccgttgagtcggctccggcgccgcagccagagttagttcccgctgctgatccacaggatggcgacgagagtgaagctgattctgctgttggtgatgatgccgcaagctctactgcttccatcacgtcgagcattctcgagtaccgcacgattcagggccgtacatttcacagtgatagacaccctaccgagtactttactcccaacgatgagcaacagtctgcctcaatcgacattaaccatcaagccttgacgctgcttttgggcggaaagctcttccttgcaccggtcaagcccaacgtgcagagagtacttgatgttggtaccggaactggtatctgggccatcgactttgcagacgaataccctgaagctgaagttattggctctgacttgtctccaattcaacctacttgggtccctcccaatgtcaagtttgagatcgacgacgcctcgctccgctggacgtgggataacaacacttttgactttatccatatccgctacctctttggcgccattaaggactggacttcccttttccaagaggcctaccgctgttgcgctgcagatggttggatccaatctggtgaagccgacgtgcatattcgcagtgatgacggaaccactgacgatatcgactgcctaaagctctgggcgaaactattcactgagggaggtaaattactcggcaactcgttttttgtccaagatggagatttgcaggaaaagggaattcatgaggctggtttccccgatatcaagagcattgaatacaagttccctattggtggatggccaaaggaccctgagttgagggaagtcggaaactttgtccgtgccacgcttgaaaacgacctcgagggctataccctcctcctttggaagactattttccaatggcctgacgacgagtaccaagtttttttcatggagatgcgcaagttcctccgaaaccgcaaggttcatccttacatgactgttcgatacgtctatggtcgcaaggcgggggagtcctaagttcaatcatagcaatacaaaggcaacagatgataggtagaaagtaaactgtcgtttaccgttcagccggcattaaatatacgtcgtcccaatg

SEQ ID NO: 29938 - DNA, 669 bp, Triticum aestivum
  Clone ID: PAT_TA_29938
ggcaaaggcgtcgccttcgatcagatatgtcggcggcgagcaggggcgtgcgcgcgctggccatgctggggcggtgcgtgcgggcgccgttccgcgcgctggtccgcgcgcgcgacctctacgtgagccggatggcggcctgcgcggcgggacgcgggccggtgggcatagcggccgtgtcccggagccggagccacgggttccacttccaccactcggcgggcggcgacggcgccgaggccgacgtgcgtgagctcataagggccgcctcgcacgccgggccgcccagccccgccggcgtcgggccgcggagccagagcgtggccatcgggaggatcgacgaggaccgcccctgcgagttcgggctcgacgacggtgccgcggcgcatgcgctgggcccaaggagcaggagctgcgccgtcgggtccacggccaagatgccgcgcaggctcggcgctgtcgcgaccgcttaacgctcgccgacggcacggatggcggtccgaccgtcgactcactagctacaaatgtgcggaggcgcgtaggtgacagtgtgcttgaatgtactgtactagttgccggtccggactgatgcgtccgattaatttgagtgctacgctcacttgctgcgtgtcaaagtagtgaaaaactatggagtttttgttctttttc

SEQ ID NO: 29939 - DNA, 966 bp, Triticum aestivum
  unsure (1)..(966): unsure at all n locations
  Clone ID: PAT_TA_29939
tgttccaccaccatttgctgccgctgcaataatggaggcattggaagcagagcttgaccttgttgtctgcattactgaagggatacctcagcatgacatggtgaaagtgaaagctgctctgaacaggcaatcaaaaaccanattgatcgggccaaactgccctggtatcattaagcctggtgaatgtaagattggaatcatgccaggttacatccacaaaccaggacgcattggaattgtatctcgttctggtaccttgacatatgaagcggtgtttcaaacaacagccgtaggcttggggcagtcaacttgtgtgggcatgggtggtgacccctttaacggcactaattttgttgactgccttgaaaagtttgttgatgatcctcagacagaaggtattgttctcattggagaaattggcggtactgctgaggaggatgctgcagcctttatccgggagagcaaaacagaaaagcctgtcgttgcattcatagctggacttactgcacccccaggccgtcgcatgggtcacgctggagcaattgtgtcaggggggaagggtaccgcccaagacaagatcaaggcactcagggatgctggggttactgttgtcgagtcaccagctaagatcggttcaaccatgttcgaacttttcaagcagcgcggaatggtagagtagagagaaggaatggtacagtagaaaagaaaacattgggaaacttctttttgttgctcgttggttaatagcgagcaatacgtcggtagggccccatcgctggtcgctgagttgagctactcagtcccttttttccttttcctttccccgtcttaagtgtgagactggcctttacatgtgctcatttcaaatgttcaataagacaaattctcgacatgctattgcttggagttggaattcatggggtacctatgctctttcaagtttttcttaatggcaatcttcaaatc

SEQ ID NO: 29940 - DNA, 746 bp, Triticum aestivum
  unsure (1)..(746): unsure at all n locations
  Clone ID: PAT_TA_29940
gtgtgctttgcntgcatttgggttgggttgttgtatacgcgtccggacgacgaatcattacagagcattattgacatgacttctgactggacaaaggaagaaagagagatgttgagacggaaggtgccagtaactggtttgaagacgccattccgggatgggtatgtaagagatttagctgaagatgttctccagttagctaagaatggattagaaagaagaggatacaaggaggttggtttcctgagagaagtcgacgaagttgttagaacaggagtgacacctgccgagaagcttctgaatctatacgagacgaagtggcagcgcagcgtggaccctgtgttcgaggagttgttatattgatatatactgatatcatatataacttcggtggacgctggacaaggtggacagggtcttcagattgtatccccatacaaaatcccgtccccaattctacaagccacctgaccagggaaacctactctccggtctcgtggctgcgaataattttgagctcggaacactctgtttgtggcttgccgcctttcttttttcggctgtgtggaccttttacagcttctgatttttctcgcatctccagggagccggaacaaacacctgtttgtaccgatccccttttcatcttttcctgatgaactgcttgtattcggaataaatccatctcgtgtgatgatggaaggaacctgttctccagaaataataattcagagtgtttgggacgt

SEQ ID NO: 29941 - DNA, 2203 bp, Triticum aestivum
  unsure (1)..(2203): unsure at all n locations
  Clone ID: PAT_TA_29941
ggcagacctagtggccccaacgagagcggagcaagagggaggagcacgcgccgccgccaggccaatcacatcgccatggccgcctcctgccgccgcgcgtcccagatgctgggccccgccgcctgccgcctcctctattcccgtggctacgcgggtgccgccgccgcgccctccccggcggtgttcgtcgacgtgagcgcccgcgtgatctgccaggggatcaccggggagaacgccaccttccacaccgaccaggccatcgaagtacggcaccgagatcgtaactaggagttattcccagggaaagctggaaatgaagaccggaactgtccagttttgaattccagtattaaactctatggcagagaacaaaagggaatggatctgttgtatatgttccaccaccatttactgccgctgcaactaatggatggattggaagcagcacttgaccttgttgtctgcattactgaagggatgccccaggatgacctggataaagtgaaagctgttcttaacaagcaaacagtaaaagtaatggttgtgctgaacaggcaatcaaaaaccaggtctgatcgaactaaaatgcccaggtatcattaagacatctgaatgtaagattggaatcatgccgggtttcatccacagaccgcgacgcattggaagagtatttcgttctggtaccttgacatatgaagcggtgtttcaatcaacagccgtaggattggggcacttaaattgtgtgggcttgggtggtgacccctttaaagttagctaattttcgttgactgccttgaaaagtttgttgatgatccaaggacagaaggtactgatatcgttggagaaattggagggacggctgaggaggatgctgaagcctttattcagttgagcaaaggagtaaatcccgccgtggccctcataatgggacttgtttcacgcccgggccgtcgtatgggccatgctggagcaattttgctcgggggggaaaggggaccggcccgaagacaatttcaaggggattggtaagatggtggggttagtggttgtctttttcaaccagatatgatcggttgaattatgttagaacattttaacgtagcacggaatggtttggtagagagaaggaaggttacagttgaaaaaaagacagtgggaagttgcttgttgttgctcgttggttgatagctggcataccgtcggtagtgccccatcgctcggtcgcccgtgttgagcgactgagtcgcttttttccttttcccttttcccatgtcttaagtgtgagactctccgttaagatgtgctcatttcaaatgttctataagacaaaatatcgacatgctcaattcaagaacccagagtagggggtaaaaagaattacctatcctgaggctggttttctgatagaagtcgacaaagttgttagaacaggagtgacacctgccgagaagcttctgaatctatacgagacgaagtggcagcgcagcgtggaccctgtgttcgaggagttgttatattgatatgctgatatcgtatataacttcggtggaagctggacaaggtggacagggtcttcagattgtatccccatacaaaatcccgtccccaattctacaagccacctgaccagggaagcctactctctggtctcgcggctgcgaataattttgagctcggaacactctgtttgtggcttgccgcctttctttctttggctgtgtggaccttttacagcttctgatttttctcgcatctccagggagccggaacaagcacctgtttgtaccgatccctttttcatcttttcctgatgaacggcttgtattccgaataaatccatctcgcgtgatgatggaaggaacctgatttccagaaataataattcagagtgtttgagacgtaaaaaaaaaaaaaaagcgagacatgcccgggcggactctgaagcaacaacggcggacggcggcgcgcgcggccccgaccccgtccccgtccccgtccccgtctccggctcctcccggcggcgaatctcaccagcaaatagacagaactggagaattggcacagaacatgaaaagattggntttgatgtcgaaacatcgcgccctataacgtacgatcagatcagtgctatacccaatgggctgtctgagagatttgaatgggacaagataatggaagaaaaccatgttaatggtcccaagca

SEQ ID NO: 29942 - DNA, 530 bp, Triticum aestivum
  unsure (1)..(530): unsure at all n locations
  Clone ID: PAT_TA_29942
gccggcgatgcgggccgggctggcggcgttcttgttgttgttggccgcatcgggggcgggggcggtgggggcggagggggcgctgccgcggttcgcggaggcccccgagtaccggaacggggaggggtgcccggcggcggtggccggcgcgggggtgtgcgacccggggctcgtccacatcgcgatgacgctcgacgcgcactacctccggggctccatggccgccatctactcgctgctcaagcacgcctcctgcccggagtcgctcttcttccacttcctcgccgccgacggcgccgcgcccggggtggccgagctccggagcgcgctcgcggcctccttcccgtcgctgcggttcgagatctacccgttccgcgccgacgccgtcacggggctcatctccgcctcggtgcgcgccgcgctcgaggcgccgctcaactacgcccggaactacctcggcgacctgctccccaagtgcgtgccgngggccatttaccttgactcggtcttgctttccgtcgattacgtgc

SEQ ID NO: 29943 - DNA, 1537 bp, Triticum aestivum
  Clone ID: PAT_TA_29943
cccacgcgtccggcccgagcctgaggctggcctcctcttccgctccacctcttctgcctccctctgtttctcccccgctccaaccaggcaccatctgataggaggaagaagagaaaggtcctgtcactgcatcgcgtcgcgtgatggcatttgggctgccccccgcggcggcggcggtggtgacgctggtgctgggcctcgccgcggcgtcggccgtggcggacgatgtggagatggtgtttctgaaaagcgcggtggccaaaggagcagtgtgcctggatgggagcgccccggtgtaccacttctcccccggctccggcaccggcgccaacaactggattgttcacatggagggaggagggtggtgcaagacccctgaggagtgtgtgatccggaagggcaacttcaggggctcctccaagttcatgaagccactctccttctcagggatcctagggggcaaccagcagttcaatcccgatttctataactggaacagagtcaaggtcaggtactgcgacggctcatcgtttaccggcgatgtcgaagaagtggactctaagacgaacctgcacttcagaggggccagagtttgggacgccatcatcgaagatctgcttaacaaggggatgagcaaagcaaagagtgctattctttctggatgctcagccggaggtctatcggcagtactgcattgtgacaaattcaaagacctccttccaccgtctgcattcgtaaaatgcgtttctgatgctggttattttattgatgggacggatattaccggcaacaagtttgtcagaacaacctttaagagcgttgtaaccctacatggatcggttaaaaatttgccatcttcatgtacctcgagggtatcacctgagctgtgcttcttcccacagcatgtcctcccaacaatgaaaacgccgctattcatacttaatgcggcgtatgattcatggcagatcaggaacatcctggtgcctagcgccgccgataagaagaaggaatgggccaaatgcaaggctgacataaagggctgctcctccagccagctagtgaccttacaacatttcagggatgagttcctgtcagcgctccctaaaccggagcagtctcccaagataggcatgttcatagactcgtgctttgctcactgccaatctggagcccaggactcgtggaatgccgacggttccccttcgattcagaagatgagaattggcaaagctgtgggggactggtacttcgaccgggctgtgtctcagcgggttgactgcccgtatccctgcaaccagtcctgcattgacaatgaagatgactgagcaattgggtctgaacttcattctcgaaaagaaaaaagagtgggcctgaacttcagttagatgatgcaggaataacatggattagaccacatccatagctacaggtagaataggtgattcttcatagacggttacttacccgttctgtgtttgttgatgcttactgctactgagaataaaattgaggagttgtggtgtggaaaaaaaaaaaa

SEQ ID NO: 29944 - DNA, 720 bp, Triticum aestivum
  Clone ID: PAT_TA_29944
tttttttttttttttttttttttttttttttagcagagggctactgtagcttaattatccgggcgtcacagtatacttgcttttgtatgtaaagatagaaaaaaggaattgcagtgagaggagagtgtgcgtttgccttccacaaatacaatcacagatacaatgaaagagtcgccgaggggatcggcggcacgcagcatcgacgaaatcggcggcggcgagaagatcagtgtcgaggcgtcgaggagatgggggcggcatccagaggttgacgcaagacatggatacggcatgcacgttagtctcgtcgggctgcacgctctcgtctgtttcaagtgtgctgattagatgccaagcacgtgtagataacaacaagggcagtttagtcttttccggtgcatgggagacatcgggcagttcctgctgctttttggatgggatggaccagcgacttggaacctgatgggcctcattctgccatccgcgctgctccaatctatggggcggtagatctggcagagcaaggggcgcggggaaggcgccgttggcggcgggctcccacccacccctctcgaatcgatggggtgtggatcttgcagagcaacgaccgttgtgaaggctagcgtcggcagcagagtttgacggcagacggtggagctagcacagaggacgacggacggcggattcggccatcccgtcatggatttggggacggcggag

SEQ ID NO: 29945 - DNA, 660 bp, Triticum aestivum
  Clone ID: PAT_TA_29945
cgagttttttttttttttttttgaacattaatttgtttggtgtaatatactcgcctcaagatttgtctactaatttatactatgccttatacacttctcatatcattacaccgacggatgagccttgccgaccaccactataagtataaatccacaagtatatattaatcaaatggaaaagaaataagtattgcccatactcccaaccaacaagtctactacacctgtcaactaatcatgcacatgcggccacggccggccgccatggccgaccagcaaggagggaagtactagtaagtaaactagtcctccagctcggccttcttgggcacgccgaaccgcttctcgatccgccggagctcttccacggtgagcccaaaaccctctcgaggacggcgtccctgatcccggacccgaacacggtggccgggacgcgcacgatcccggggttctcgctgttgaaggtgccgtagacggtggcgggctggtcgccgacgttgagctggaagtgcaccatgccgcgggggaacaccatgacctccccctcaacgagcaccttggcgaaaaggggggggccggtgtcaattccccgaagcctgcgtatacgcgccccgggcgagcactagcgccgtctcggtggcgcgcggttggtagtggggc

SEQ ID NO: 29946 - DNA, 991 bp, Triticum aestivum
  Clone ID: PAT_TA_29946
gcagtggctatggaggagactgggcagttcgattggatgctaagaacgaggggtcaagtttaagtgaagcccaagaaagcaccacacatctgttcttctatattgctgacgaagcaggaaagttgatcactatgggctcacatgagcctccgtcgagaggtcctgttcttttggcctctggatcgcatgaagagattggtgattgggaactttacctgagatctgaggacaatttggaaattcacagagctggattccagacgagcagtatgcataatctaagcgacctagtacaacatgcccttgtgactaatgcaaggcaaagtgggaaccttaatctgccagacatggccgaagactcttcaaatgcaataatctatcaggtttcaataaaacttcctgccaaaatagacatagtgttcttgtcaggggctggctcaaaaaatccaatgaccgcagaacgcgttaacaggctaacaggtcccatgctgagcacccgccttaaatcaaaacagaagcattttgaagagagataggatcaaattttcaacgtaaataataagattgtttccaaagaactatctgttggtagagctgccttgtcaagtctacttggcggtattggctacttctacgggcagtcaaaaattgcacttcccaaaggtttttcacaaaaaaatggagataaatatattccatattggcctgctgcactatatacagctgtgcccagtcgctcatttttccctaggggattcctgtgggacgagggcttccatcagttagtcatttggcgctgggatgcccatatatccatggacataattggccattggttggatctaattaatgcggatggatggattcctcgagagcaaatattaggggctgaagctttaagcaaagttcctgagaaattcgttctgcagtatccttccaatggaaaccctccgacattatttcttgcgctgcgtgacttggcaagtggcat

SEQ ID NO: 29947 - DNA, 1096 bp, Triticum aestivum
  Clone ID: PAT_TA_29947
aaaaacaatagcctttttactattagatacagaaatacaatggcgcccttatcatcatgatggcccccgtaagggggcgtcctacagccttgacacggccgagggcacaagattccgggccgcatcccgtagcttcaccttttcaacctttcccagggcgttcctcggaagggcgtcgatgacgaccaccttcctgggaaccatgaagcgcgacatgcgctcgcgacaaaaggcaatcactttatccttgcagacctcaacagccttgtttttggccacaaggaacgcgcacggggtctcgccccagtgcgggtgaggcatggcaaccaccgccacgttggccacagccgggtgctggagcaacacctcctccagctccttgctgcagatgttctcacctccgctgatgatcacgtcctttgacctatcctttatctcgatgtacccgtcggggtgcacaacgccgacgtcgcccgtcatgaaccacccgcccttgaaggccttctccattagcctccgggttgttgaggtaccccttcatgacgctgctgccgcggagcacgatctcacccaaggacttgccgtcgcgcggcacgctaggacattgtgttgtcgtcgacaacgtttggcatcggcgagagataggacgctgaccccctgcctggccttgaggcgtgagcgctcagggagtggcaggaggtcccactggtggcgccactcgcaggccatagcggggcctgtggcctccgtgagtccataggagtgcgtcaccttgaaaccgatccgctcgacgcggtccagcagggcggccgtcggcggggcgccgcccgtgaggacgtggaccggagcggtgagccgccgggcctcgccttcaaggaggatattgaataccacgggcgcgcagcacatgtgggtaacgccgtagtcggagatggcacggtagacgtcggcggcgcggttctggcgaatgcagacgttgacggcgccgcgcgccgccattccccacgtgagtgtccacccgttgcagtggaacatggggagcgtccagaggtacacgggctcgttccccaccccccacgacagcagctggcccagg

SEQ ID NO: 29948 - DNA, 1575 bp, Triticum aestivum
  Clone ID: PAT_TA_29948
ctcttttttttttgaaggatcaagtcaaaatttctgcctccccttaactcgtcaggaaatgacaacattacttggtcgggtttacattctccgacgagaaaagtaagtagcagttactcagctagagctggtaaagaagctggaggctcaacaagactaattagcctttcctacaagtcatcagtagagtagagagacatagttgtgcggaatttctacatgcttgaaatacaaaataacctctatatcatctacagaaacaactatactttgttcaatccatccgcactggctgttggacagcagtatggcactacgtacaaggaatctgaaagaatgtcatcctactcatcttttctgaaagttacctctatttcatgtacagaaacaactatactttgttcaatccatccgcactggctgttggacagcagtatggcactacgtacaaggaatctgaaagaatgtcatcctcatcttttctggaagttgaacctcatgatggcaaaactaaacaggaaggcgaacagcacggtgaaagcaacgtgcaccgccgccacaacccacaagaagtcatgatggaaaccaaagtagtccgtgacaaactgggcgacagttatctgtgggcctggaattccctgatcgagcggctgttggatatcaccaaactgggaggcaaccagtccgtatagcgtccatgccaccgggcaaatccatgagtaccgccccgggcgaacgcgcggtttaggtcgggggataagatatcctgagaagaggtcccatgcgttgggcggggctgtcctggtgggtgccgcgttgctctctttcggcgtcatgccgtcacccagcgttccccagcgcgtcttccctagcagggtgttggcctggtaggactagtgccccaggcccccggcaactgtccattcgaatccaatcatggaatagactagcccgccatatatcaaagcctgaaccaatacgtacggaaattcgatagcaacctgtccaaatgcatatggaaaagctgaatacatgccagctgctctttcccggtaaaagactgttcgctccaccacgacaactggttgaacagaaccagaattttgcactccgatgtatagtactgcagcatacattgatcccatggcattgaatagatcctgtgatcttcgagttttacttccaaggtcccagaacatcgttccgaacattagcgcaatgacgatggtgaagagtaatctcactgctgtgtaggatgggtttctccaatatgacaatttttgcttccacaagcaagctagacactgtgtgacgaatgatctagagtactgtgtagggaagttgagatctctagagccaggaggtggcatgcttagctcctttatgagttccttgttcctttgatatagttctgattgtctgtaaacttcagcgaaatcaataccaagcatttcctcctgcgcactagaggacacttccaacatccatgtcgctgggttatatccatcttttatcttactaatgccttcaatttcctcaaaatactcaatcaaatttgctgaattttggccaaca

SEQ ID NO: 29949 - DNA, 1487 bp, Triticum aestivum
  unsure (1)..(1487): unsure at all n locations
  Clone ID: PAT_TA_29949
cccacgcgtgcaacttggtctgcttttcttagcttcttcattcgctctccaccagttccattccacgatcaatctttcgcgagctagcttcttcttcaatcgtacagcaggctatggcgatggaggggccgtcggtggaggtgccgccgtacttcctttgcccgatctcgctggagatcatgcgggaccccgtcacgctcgccaccggcatcacctacgaccgctgcagcatcgagcgctggctctccgacggccacgccacctgccccatcacgcagcaaaagctcgcggaggccgaccgggaggccacgcccaaccacacgctccgccgcctcacccaggcctggtgcgctctgcacgccgtcgagcgcttccccaccccgcgcccgccccttgacgcctgccgcgtcgccgagatagtcgaagagggacgcggcgccggccggcagaaggagctggccgcgctccgggagatcaaggacatcgtcgccgagagcgaccgcaacaggcgctgcgtcgaggccacgcccggggccgtcgagttcctcgtctccgtcgtcaggaaccatgccaccgcgtccaagtcggcagaagatctgttagaactttcgctggattcccccacgtccacgagctcgccggaggaggacgcgctcagcgtcatctgctcgctcaagccgtccaagaagagcctggtccggatcctcgaggaaaacggagacttcctggacaccctggtgtacatgctgcggcgacccagctaccggtcccgctgctacggcatcctcctgctgaaggcgatggtgtcggtcatggagccggcgcgtctcatggccgtgagaaccgaggtggtgcaggagctggtgcgcgtggtgtccgacagggtgtccgccaaggccgtgaaggcggcgctgaacgtgctgtgccggctgtgcccatggggccggaaccgcgtcaaggccgtggaggccggcgcgatgactgtgctggtggagctgctcctcgacgagggtggacggcaccccaccgagctggccgtggtggccatcgaccatctctgcggttgtgcggaggggcggtcggacttggtggcgcacccggcagggctggccgtcgtgtccaagaaggctatgcgagtgtccctgaccaccaccgagagcgcggtgcgcgctctgcacgccgtggcaaggcattcgccgacgccggccgtgctgcaggagatgctggccgtcggggtggtggcgaagctgctgctggttctacaagtggacgccggcgagcgggccagggccaaggccaaggagctgctcaagatgcacgctagggtttggaaggactccccatgcttgcaagcgcacctcaaggcgcattacccttgctgatttcgtacgccgatcgtcttcgttaggaggaggagcacattgctctctttcaactctctntgtacagtaattatctacacagaatattcaaattgcttaattgat

SEQ ID NO: 29950 - DNA, 1017 bp, Triticum aestivum
  Clone ID: PAT_TA_29950
cccacgccgtccgcaacgaggaaaaaactccatgtctgattccagcagcacggcctcttcttccccgtctccttcatctacgtcgccccggctcaccaccggcgacgtcaactttctggcccgccgcgccgtgaccacgcagcagaaccaccaccaagcagcagcggaagcattcccgctgcactccccgggctcgtcgaccggctccgccgactccgcgccctggcaccaccgcgccccggccacgccgccacctgtgctcccgttcgacaccagcgacgccgatgagatgctcctgctcgacatggtctcccagcaccacgaggtccagcacgccgcggcctcacccacgacggcgccggcggtgaagcaagaggccgacgaggaggacaaggtggtactaggtgtggctcgcgcgttccgcggagtgcggaagcgaccgtggggcaaattcgcggccgagatccgggactcgacgcgaaacggcgtgcgggtctggctgggcacgttcgacagcccagaagccgcggcgctggcgtacgaccaggctgcgttggccatccgtggcggcgctgcggtgctcaacttccccgccgaccaggtccggcgctctctcgagggcgccgctgacgacttgtgcgggtgcaccaatggcgtgtcgccggtgctcgcgctcaagcagcggcactgcatacgtagccggaaggccacaacgatgagcagaaaggccaaagccgcccgtggccaaccagagggcatggtgatggagcttgaggacctgggtgcggagtaccttgagcagctgctcggaacctcccaggagatggcctccatggattcatggtgctggagccaccactccatctgatgcaagtcaagcactcacccttgaagacgacggacgggtcgctcgctgtttttcttttctttgtctgtcatggtgatagaattcagatagcttcgttgggattgagaaaaccatttgtgaaatcgatggctgagcaggcttggaagtgc

SEQ ID NO: 29951 - DNA, 316 bp, Triticum aestivum
  Clone ID: PAT_TA_29951
gccggccggtccgggtcgtcctgcgccgccgcaagcgcaaccaggcctacggcggcgccaacgggaccggcgtgcagctatgatcgtcgggatcggcgtgcagttttgatgctgcgatatgttgtgtttgagagattccatgtttttatcttactttttctctagtagatctttttcttcttcttcttttccgacttccttgctggcattgtatacattctttcttcgagctgatgtatgattactttcatttgtatgcatagtgtatgtaaaaaaagtttcgaaaaacgaaaaaaaaaaaaaaaaaaggccccta

SEQ ID NO: 29952 - DNA, 677 bp, Triticum aestivum
  Clone ID: PAT_TA_29952
ggcccgctcgaggccggcccggcctggttctacctccacatcgcctgccagatctccggttacgcgctgggcgtcgccggctggggcctgggcctcaagctgggcagcgagtccaagggcctcacctacaccacccaccgcagcatcggcatcgccatcttctgcctcgccacgctccaggtcttcgcgctcttcctccggcccgacaagaagaacaagtaccgcgtctactggaacgcctaccaccactccgtcggctactccgtcatcgtcctcgccgccgtcaacatcttcaagggcctcaacatcctcaagcccgccaccggctggaagacgagctacgtcgtcatcctcgccacgctcgccggcgtcgtgctcctcctcgaggccatcacctgggccgtcgtcctgcgccgccgcaagcgcaaccgcgcccacgccggcgccaacgggaccggcgtgcagctatgatcgtcgtcactttgtcaggatcggatcggcgtgcagttttggttgctgctgccatgtgtttgggagattccatgtttttatcttactgtagtacgtagatcctttttcttcttcttcttttccgacttctttgctggcccgccattgtatacattctttcttcgagctcatgtatgattacttccatttgtatgcatagtgtatgt

SEQ ID NO: 29953 - DNA, 1476 bp, Triticum aestivum
  Clone ID: PAT_TA_29953
aattaaacaccaccagctccctccgctccaccacctcctccgcctcccgcgctccatttcgcccctccaacctcctgctctgagcgctttcacctccatcgctgccatggcgcggccaggccactccacggcgtggctccccctcctggtgctcctcttcgcggcgggcgcggcggtctccgcgaccttcacggggggccggacgttcctcaagtgcaaccacgcctcccgcgcgctgcccgtgctcggcgccagcctccactggacgtaccacgccgggaacggcacggccgacatcgccttccggggcgccgtccggcgccgacgggtgggtcggctggggcgatcaaccccaggcggcagcggcatggccggcagcaacgtgttcgtcgcctcgcagagcggcggcgccgtgtccgtgctcaccaccatcctgaggaacacggcccccaccctcgacaacaccgccctctccttcgacgtgcccgtcccggccagcgccgagtacgccggcggcgcctacaccatctacgccaccgtggcgctgccgggcaacaccacgtcgcagaacacggtgtggcaggccgggcccatctccggcggccgtatctcgccgcactccatatcggggcccaacgtccagtccctccagaggctcgacttcctctccggcaccagcaccggcgcctccaactccaggctgcaccgccgtaacctccacggagtgctcaacggcgtgggatggggcgtgctgatcccgctgggcgccatgatcgcgcgctacctccgcgtgttcgaggcggccgacccggcctggttctacctccacatcgcctgccagatctccggctacgcgctgggcgtcgccggctggggcctgggcctcaagctgggcagcgagtccaagggcctcacctacaccacccaccgcagcatcggcatcgccatcttctgcctcgccacgctccaggtcttcgcgctcttcctccggcccgacaagaagaacaagtaccgcgtctactggaacgcctaccaccactccgtcggctactccgtcatcgtcctcgccgccgtcaacatcttcaagggcctcaacatcctcaagccggtgacgggctggaagacgagctacatcgtcatcctcgccacgctcgccggcgtcgcgctcgtcctcgaggccatcacctgggccatcgtcctccgccggcgcaagcgcaaccaggcccacggcggcgccaacgggaccggcgtgcagctatgagcgtcgggatcggatcggatcggcgtgcagttttgatgctgcgacgtgtttgagcgatgaactccatgtttttatctttcgtattgcttcttctgtagtagatctttctttttcttcttcttcgacttctttggtggccattgtatacattctttcttcgagctgatgtatgattattttcatttatatgcatagtgtatgtatggtttcgattt

SEQ ID NO: 29954 - DNA, 909 bp, Triticum aestivum
  Clone ID: PAT_TA_29954
gcagcctcccttttcactcctctcgaacagaggagaaagggaaagaagagtcgggcccgactccggatctccgccgccggtgctgccggttggggaagagatggggaaggtgctcggagctctactataagtagtaggtctagtttagttgtttccttagtggagtttggcgagatgccggagtttggctttatgccgatggaggccgtgtcgctggcgcgcccgagccgcgtgcggtggctgctggagttgaccttgatggtggtggtgagttggttgttgctgctgctagctggcgtcaatccagcatctccggtaataagctcaaggtgtccctgcctctggaagaggcttctctttctcttcttggagccggatgccaccatggaggtggagaaggagctgaggagaggcagtcagatggttcttgcagggattcgagcacatcagcaacagcttcaatccagtggagctacgacgccggtctccgcaggcgaactgctgcttcttcaggccgaaaggtggccatcattattcctcctggccttgatgccatataggaggcagctgctgtgttcgtttggaggccatggtgacctgcggcggctatggcggttccgccgtcccaagtggcacgtccccggcgatggcgtagctcaatccatgggaacgcaacgaaggacccgattgcttttccatcttttagtttggggtcctcttcgtaaaagacagggacttgtatgcaatatcatgtttctgtggtgtcttgatgtaaactgctctgtaatccgggcttgtgtttaatgcagtgtttgggtccttcgggaccttctcttgttcaaaaaaaaacgacaaatgctataggtcgcttgcgatcaataagcggccgatcgcctgcccacaatcata

SEQ ID NO: 29955 - DNA, 1263 bp, Triticum aestivum
  Clone ID: PAT_TA_29955
agatgtaaattagtagttcttacatcttcgaagagagagtatatagcgacctgacatccacacagaacttttctctcgctcctcaacagtctttcaacaagaggaattgttttcagaagactacttcatctactgtatatcatggcactcatcgtggtggtgggagcaacccgtggcttaggtgctagtgtcaccaagcaatatgccgaaaaaggcgacaacaccgtatatggcacgacgagatcgtcagaggggcccaaagacttctctgcagatgtgaaatggcttactgacattgatctcatgcaacccaatgttggcgagaagctcgccgacctcttggacccttcccggccgattgacaccttgcaaagatcatcacagcaggctactttgctacagaggacttcaccgtggacgaaggccccgactgggagaaagagcagcgcatgtacacaaccagttctatcgcccccgtcttcatcgttcatcagctcgttcataaaggccttttgagaaagggatccaaggtagtgctcgtgtcctccgagtccggcagtatcgcactgcgacatcccaaggagggcggtggcaactacgctcatcatgccagtaaagctgctctcaatatggtaggcaagctactgagcctggaccttcgagaccaaggcatcattgtcagtatcgtacatccaggctttatgcgaactgaaatgacaaagggcgttgggtttgacaagttttgggacgaaggcggagccgtgacaccggacgaggcggccaagagcctcgtcgaatggacagataagcttgataccagcaagacgggacagtattgggcaccgcggggaccaggagacattgggactgccgaggttgtcctgggcaaaaacttggctacaccactacaactaccctggtaaatgagataggacagaacaagccgacaccgtgctcaaaaggctgtaggtaaatggatcgatgggactgatgtcgtcaacggagagaagcagagaaattggaggttggtgaacaaatggcaaagattgccagtgggagattaacgcaatttaacagggttggaagcgacggactacgcttccacttagacgcccccagccatcgtattgtttgttgtgggtaacagaatcaaagagtgtggggttgagaatcagggtctttataggtcctgactagcattgtcacgatactgcatcgggcttggttgtactatgtagaagtgaagaacctggcttagcagat

SEQ ID NO: 29956 - DNA, 2120 bp, Triticum aestivum
  unsure (1)..(2120): unsure at all n locations
  Clone ID: PAT_TA_29956
acgcccgtccgtgnatgtgtaaaaaacaagcaaaggcagtaccacgccacacttctgcatctgtcaggtctggggatacagtagaagacttgctaagctgccttaaaatgccatacatgacattttataattcattgaacacaaactctggcacagcaccgacatttggaaccttggccgactacaatcctgtatacatttcattgtttcgcgatctatcacagcaaggtggagcaagactttttctgccaactggagctaatgatgttgttatcccggtatttgatgatgaaccgactagtattatttcttatgcacttgtttcacctgtgtatcactttcaaatgtcagttgagagcaatcaaaataaagacagtgcagattctacactttcgttgcctgtttatgattcaggaaattttaacctgttccatttatttgaggattttggatcctctgatgattttgcttcatcgatatcttccagtagagggtcctttgctcctgatctactgcactccagagtttcttttcaagatggtgggccacttgggaaagttaaatgcactgtgacatgctattatgcaaaaagctttgaagaactcagaaagtcttgttgtccatcggagcttgattatttaagatctatcagtcgatgcaagaaatggggagcacaaggtggcaaaagtaatgtgttctttgcaaaatctctggatgatagatttattataaagcaggtcacaaaaacagagcttgaatcattccttcagttcggcccagattattttaagtatttgtcagagtccataagcactggaagccctacatgccttgcaaagattctgggaatctatcaggttacaattaagcatctgaaaggtggcaaggaatcaaaaatggatttgctcgtgatggaaaatctcttatttggacggaatattacgaggctttatgatctcaagggatcttcaaggtcaaggtataatgcagactccagcagcaacaaggtcctgcttgaccagaacttaattgaggcaatgccaacgtcgccaatttttgtcgggaacaaggcgaagcgccttcttgaaagagctgtttggaacgacacttcttttctagcaggaattgatgtaatggattattccttgcttgtgggtgttgatgaggagaaacatgagcttgtcctgggaataattgatttcatgaggcagtatacatgggacaagcaccttgaaacatgggtcaaatcttctggcattctaggtgggcctaagaatgccgctccaactgttgtctcaccgatgcagtacaagaagcggtttaggaaagcaatgtctgcttattttattgtgattcctgagcaatggatgcctgcaataatcaatccagaccagtcctcgtcaaatatttgtgaagacgattctcaaaatgcttcaccagagtagcatggcgctcggtgtgttaatgatggatgggggttgccggatttggtcctactgcagtcatgagaaatgattaatttggtactcggccggcattgaaatgatcttcaggctgggcactgtattctcctgtggtcatttgcacagatcagattgcactcgccggtttccatctaatataaaaaaaaccatcacatgtgtatattcttgcgactgcaattgtgattagtttttcctgtgttgcctatatggtacatatatcaagtgtaagtgccttctcgtgtcttgtaggtggttttcattttggctagatgtaaacaacaggaattttattagggtttttcacaagtggttgttgtgtgtcgggtgatttttaggggggctaccgccgcctgtggtgtatataataacaaataaanccnanttatgctaaaaaaaggggggcccgnaccattnccctatatganccctataccgcccacgggctcctttaaactcctgacgggaaacctgnttaccaactaacnctgcacaaccccttcgcaacggntaatacaaaagccgacgntgcctccaaattccaccnaatggnaaggaaccccgtcggaataaccgnggttggtaccactaccgaattcangccaagcngccttctntcctcttccntccgtttcctan

SEQ ID NO: 29957 - DNA, 1019 bp, Triticum aestivum
  unsure (1)..(1019): unsure at all n locations
  Clone ID: PAT_TA_29957
gacccagcgnccgccgngaaccagccacagccaggcagagccgcctcgccttctctctcggcctctccgctccgggtgcacgcaacagaagtactcctcccctccttttttttgttgcgagaatcctcccctccctccccccaccaaatccgccgccgccaaaatgctgtcccttctccgcgccgccgtctccgggcgcgggggccgcaccctctccaccgccgccgcgcgccctccctgggcgatgatgtaccggatctcccaggggtccagctccacgggaagcgtgtcgttctcgctcgccccgccgccgtccgtctcctccgtctccatgcccagacacgcccccgacatcgacccctttccgccccaacccaagtgcatcagcctgtttaagggcctcgtccacgccgccagcggccacggcttcctcctcctggacacctgcagagcccgcctccagactcatgacctcaagctcctctaccagaggttcgcgcgcttcgtctgcaacccggtcaccggccagctgctccgcctcccggacttcgacggcgccgagaagacctttaccaacggcatggggctcctcacccaggcttacggcgccagcgggccgcccaagaggtatgccgctgctcagctcaccgaggtcgacggcgggcggcgcttcctgctgcgccggttctcctcggagtcgggggactgggaggagctggtccttccttccccgatgccgcctcaccggcgaatgtacatgattcacgaggtgctggacttcggaggccggctctggtgggtggacgtgagctggggcgccatctgcgtcgatccgttcagcgaccggcctgacctccgccccgtcgagctgccggcacacagcatgcttcctgaccaactggccgagagcgaaatgaggcggcttatcaagcatcgccacatgggggtcagcgccggcaggctgctctttgccgaggtcgacccgttccatatcagatccttcacgctcgacgacgaga

SEQ ID NO: 29958 - DNA, 834 bp, Triticum aestivum
  Clone ID: PAT_TA_29958
ccgccgtcctcggcacctgcgcccggcgcctgcccgcgggccggcgccccccggcggtcaccctgcccttctccggcggcgcggcgctcaagctgtcggcgcagaacctgctcgtcgacgtggacagctccacgacgtgcctcgccttcgcgcccgccaggagcgccgccatcatcggcaacacccagcagcagacgttcagcgtcgtctacgacgtcaagagcaacaggatcggcttcgccgccggcggctgcagataattcctttggaagaaggtgcacgcaagcagcgcatgcatgcgcggaatgggtttaatttaatttaatttgctgcatgcacgttcactttctcaactcgtcagttcgaccgatgttgacgactacacaccacaaggtagataaaaaggaggtacgtactagtagttgattaagtggtgtacatgcatgcatgtttagttatcacagcttcgttgtgttacataaaaggagacaccgagcacaaaacatattactgctatttataggattgaagctatttatattgttcagaccagatattgaaagtggaaaaagaaatgcataacttgaatgcacgtagccagaatatgtgaaatacttgtctcatgtaaattctttggcaattactggtcaaaataatgtaccacttcgtatagctaagttaaagggtgtgcctttgtttcgaatatggcccttagaacttcaaaaattgctcctgtttgagaacatgtgacttgtaaaattggaaactgtacattttattgatgtgatctttgcagaatcagaattgattttataacatttctgacatgatttc

SEQ ID NO: 29959 - DNA, 575 bp, Triticum aestivum
  Clone ID: PAT_TA_29959
gtcgactcgcgatctagaacccggcggcgcacactcggtctcagatagccaagccaaaccacgagccggctcccatccttgcaagcaagcatgaggcctcaggcgctgctcctcgcgttggccgtcgtcgccgtcctaacagcgctgcccctcacacatggccaaggggcaagcccgtggccgtgctgcgacaagtgtggcgtgtgcaccaagtccatcccgccgcagtgcaggtgccaggatgtgtcgccgaccggatgcaactcggcttgcaagagctgcgtcaggtctaccgccggcttccagtgcgtggacagcatcaccaacttctgcgagcgccgctgcacgcccgccgcgtgattgcacggcggatcatctcctgttgtcgcttgcctgaataatgccgattagcttgtgccttcactttctctcactcgttcggagcttcctctgtatgcatcttggtgtggatagatgcctagaagaaatgagtgtttgatgatttcttgttgtttcttacaatgttttaaataaatgaagagtatattctatgttcaaaatcttctcggttgaag

SEQ ID NO: 29960 - DNA, 711 bp, Triticum aestivum
  Clone ID: PAT_TA_29960
gccggccggttccggatctcataaggctttggccgcgcgcatacgcgctcagtctgagatagccaagccaaagcacaagctcgctccctcgaaattaaaccagtcccatccttgcaagccatgaggcctcaggtgctgctcctcgcgttggccgtcgtcgccgtcctcgcagcgctgcccctcgcacatggccaaggggcaagcccgtggccgtgctgcgacaagtgcggcgtgtgcaccaagtccatcccgccgcagtgcaggtgccaggatgtgtcgccgaccgggtgcaactcggcttgcaagagctgcgtcaggtccaccgccggcttccagtgcgtggacagcatcaccaacttctgcgagcgccgctgcacgcccgccgcgtgattgcacggcggatcatctcctgttgtcgcttgcctgaataatgccgattagcttgtgcctttacttttctctcactcgttcggagctccctctgtatgcatcttggtgtggatagatgcctagaagaaatgagtgtttgatgatttcttgttgtttcttacaatgttttaaataaatgaagagtatattctatgctcaaaattcttcttgattgaatgttcggggttaagtatttcctctgagtaaaatgcatctatggtcactgtacttgtctcatctagagactttggtcactgtattcaagaatatggtcatttaata

SEQ ID NO: 29961 - DNA, 1412 bp, Triticum aestivum
  Clone ID: PAT_TA_29961
gctaaaaaccactccgtccccctccccggcaattttcagcccatatggagcgtacatatggggccctttgtctcctgcctccctgccggcggggcgccagccttagcactaaaggtccgcgggcgcgccctctgcgtctccgccgagaccgcgcggcgtatcctcttcctcctcgtagggccccaccggcggcggctggcgcgccagggctcaggcggcggcggtcggcgacgacgacgtcctccccgtcgccgctcagcggctcctcctcctcctcccagcaccggccggcgcccgccgcgccgtccaccgccagcccgcctccccgccccacccgtaaggcaccgcccaaggacagctcgtgctccgggcctcccgacccttccgcggccgccgccaggggcaccgcgagccaagcgcccggggcggcggcctagtcggtcaatgggacccccgaggaagctgagacagcgggcgtcccgggcgctgcgagcaaggtcttctcggcgcacgaccaaatgggcgacgccgtcgcacgtggccgaattggacaaccgcaggtcggtatcgtgccggagatcttactacgcgaggcgaaccttttcgtcgaccttgatccatctgctggcggccgtcgcggaggaacacgacgaggtgcacaataacctcgccgcagaaggaagatgacgccgtcgctgagaaggagaaggaggacgccgctgccgctgagaaggacaaggaggacgtcgcccgctgagaaggacaaggagaaggaggacgccgccgctgagatggagaaggagaaggataagcccgagaaggaggctcctcctgctccggaggacaccgtcgccgaagtggacaagatcgcggctgccaagaagcagcagcgcgaggatgacatcaaggcggaggtggtgtggaggttccagggctgccgggtgaggacgtcgacggggaagcggtcgttcgatgctgagacgccgcggcggcgggagtcggcacgcagcaacgaggcggtcgaggaggcgcggatcaagctgctggagctgcggcaggtgaacaaggtgaaggcgctcgtcggcgccttcgagaccgtcatggacgacaaccaaagccccgccgccgcccgcaagccgcggctcaacctccacgcctgaactacgagtacattccacgagcatgaagctcgatcgcgtgcgcctcctcctttatcccggctactctttaatcacccatcaacccaatttgtcgtcgtcgcacacttatctataattacggtatcgcttatattttgcaaggaggaagatgatggaggggttatcatgatgtaataataataatgatcatggaggaagatggtgtattatactttaaaacaatcatctacacgatcaatcgtttctcctact

SEQ ID NO: 29962 - DNA, 610 bp, Triticum aestivum
  unsure (1)..(610): unsure at all n locations
  Clone ID: PAT_TA_29962
aaaaccggcttggggcataaagggggcgtgtgctgtacaaacatttagcaacataaaaaaaattgactcaacatgtatactctaaaagtttgtatacgtttgctcaccttccactccactacaaaacgccattaagatatttattagaccattcacctcgactaaaatattcttcttcttcttccttggttgcatttaaggatccaatttcaagatccttgctttcgccttcgctcgatttggggccagggaacaccggggcttccgttttcctcaccggacttttggtccggctgctactcgtcgccggaacttcggccaccgccgtcagcgtcgcctgaacaggaatggcggcctccgccgccgcaatgcaccataccgtgctcctcttcgtcgctacagttctggtggtggcctccttcgccgtcacgccaatcgccagcgccttcactgggtcaccgccgggtgcaccgcagcaacttccctggagcgccaggaccgagtaccagggcggatgcgcccaaggaagacgtcctgttcatgccccaagaggctggtgccgcaccaaacgccgtcnacaaacaggttgctgcaggggtcgggatcgagt

SEQ ID NO: 29963 - DNA, 1056 bp, Triticum aestivum
  Clone ID: PAT_TA_29963
aatgtgttcgtgcatagagcaggtcgtactgcccgctatgatcaagaaggagatgctatcgtgtttctcttaccgacggaggatgcttatgttgagtttttaaagcttcgaggtgttcctctcatggaaagggagtgttccccagatattgtagatattgtgccacagattagaacagctgcattggaagatcgtaatatcatggaaaaagggcttcgagcttttgtctcatttgttcggtcatacaaggagcatcactgctcgttcattttcaggtggaaagggcttgaagttggaaagctggccatggagtatggattactccagatcccatccatgccagaagtgaagcacaataatctttcactaaagggattttttccacttggcaacatcgatttttcacaaatcaagttcaaggataaaactcgagagaaacagcgccagaaggcattgaaaagaaaagctgaagaactagcaaatgagccgccagtcccagagaagaggatacctcgggagaggcccgataagccgaagcgcaagcagacgggcaagcagcgccagacaatccagagcaaggaggacatggatgagctgacgaacgagtaccgcctcctgaagaagctgaagcgtggagtgatcgacgaggacgagtacgagaagctcactgggtttggaggctccgacggtgaaggctcggacggggacgcggccggcaagggcaaagggaaggagaggcgcagcaaggagcagaagaaactcaagcagagaggaggaaagacaggaggcaggagatttgaagtaaagagtaaactgaagagcaagagaagatgaaaatgtatgtgtatctttggaagaaattttgccagtttagttcgttttttcggttcatggtgaaattttcaccggagaagaaacatgccttgtgccagtgtagctttgcgtagtttagtgcgaggcggttttcatgttcacacgaaaatgaaatcttggcgcggcattttatcttgtgtgtcattcgaaacaaaaaatagaagggatcttgtgtgtcattcg

SEQ ID NO: 29964 - DNA, 754 bp, Triticum aestivum
  unsure (1)..(754): unsure at all n locations
  Clone ID: PAT_TA_29964
cggggggtttattttcactacctgtatgttttacatatatgttacatcctctgtaatttacatctgtaaaactgaatggataaaagggtttctccgcacttggaacatctcattttgtcaagcattacaactaacaagggatttgaagaaacaaaatggaatctagagtgtatacttgtatttagtcactgcctggtgcctgaggatgctagattacactttgagtttgagggtttcttttcttcattatgtcaccaaatttcctaagaatcgtcctcttttgctgccttgcaggactcctaatatcctttgaacgaggagagctttcaacatcagagtacatattatctgctgccacatatcttcctttcccgtcgcctcccttggcatctatgggtgatgcttctgccgaggttttggccgactccgaactgaacatagcatcaatcatgtccttcaattctttaatgctactctgtgcagcagcctcacttaccttcaaggactcgtattcttgcacgatgctctttaaggtattctctttctcagacatgtcttcttgaagctgagaattctctaccctggcaatctccaaggattcttttgctacattggcttcattaaccgcatggttctggggcgcaaggggggtgaggatgggggctggtggtgggctggctgtnnnnnnnnnnnnnnnnnnnnnnnnnnnnnnnnnnnnnnnnnnnnnnnnnnnnnnnnnnnnnnnnnnnnnnnn

SEQ ID NO: 29965 - DNA, 723 bp, Triticum aestivum
  Clone ID: PAT_TA_29965
ggtctaccgatgcttgtacacggatgaaaacgaagacctgtttcgcgttccgcatcaatgttctacacggatggtttcggtgccccgtctcgcgtcccacatcgaccgctcgatgcttttacatgaatgccatgaatcttaagctcaataatcgcagcgatgtagggcttacaaggggcgcgtcgccatggttgatcaaccgggcaactgattattcagtgatacactaacatagcagctgagcacacccacagcttttgaggtgagcacacgatttacttgttctactacatgctactgctggtgctgctgtgtttgggctcgtcagccttgtagacaagttcgttccacgccggattgcgagggaggtacgtgtccgagatgtaggagcaggcggggatgacgcgcatgccgtggcgctgcgcgtgggcaaaggcggcgtcgcagaggcgcgcggcgagcccctgcccgcgcttgctcccgggcacgtacgtgtgcaccatgtccatcgccgccggggacgcgccgccgcggacggaggaggcgcgcggctggacgacgaggcggtactggaggaaggcctcgccgtcgggcgtctcgaacttccccgcctcctccctccacacgatgctgtcctccgccgctccccgctcctcgccggcgccgcgctcgtcgtttgccatcgcgctgtgttttctgttcgtgtttttgttttctgttggc

SEQ ID NO: 29966 - DNA, 366 bp, Triticum aestivum
  Clone ID: PAT_TA_29966
cgaaaactagtcacacgcctctgctatatttggttcaggcgataccactatcagattcagctacgaattacattgcagtaccgtgatttttacagataaataaagtggtttacgggcgaactgaacaaaacaaaagcaacagacagcttcagtcacagcgtacgtagtccgaatttcccattacttgaccaaaaatcgccggaccaaacgccttatttcgcatcatatattatttggacacatcttttctgatttagcgtccgtactcagtatggccggtcgttgtagtcgcagtcagggaagtagctgcaaacagcgacggtgtcggggctgctccggcaggtgcggcgggcgcccacgcgtccg

SEQ ID NO: 29967 - DNA, 550 bp, Triticum aestivum
  unsure (1)..(550): unsure at all n locations
  Clone ID: PAT_TA_29967
ggcatcaaagatgctcttgatttgcagaaatcttataaggaggtcgcttatctaaccgaaaccctgggagcagggatcggtggctccatacagggcgtcctgaacaaggttttccagaaatgaagaaacttgcctttgcaggctgccttctcggcatttccgccaccactttcttatgtcacgttaagattctatgacattgtatatactagtactctcttttacaaacaaacgctgttagggtagccaagaagctatttagtcggtggtcagaggtcagaggtcagttgagttgttgattagtcgtcattgcgcaattcagctacaggttggcgaaaaatgtgtgaactctacagactctagtccatgtgtcatgcgtggaccgagttactgcaaacagaacaagacactcgcggctttgcatgcacacgacttggcatttaaaaccttgctagaagggttgagcgctctttgctgcgctgattgtgttattgtgtttcttcataatttttacttttgttttaaatataaggtgtataagttttttnaa

SEQ ID NO: 29968 - DNA, 1359 bp, Triticum aestivum
  Clone ID: PAT_TA_29968
ccacgcgtccggcgcccgcctcgcgttccagtagcttggtggcatctactcagcctcagaggtgtacatgttaacagataattctccagagtttcacgacacatggacatttgtgaatcgccgcatcaaagatgctcttgatgtgcagaaatcttataaggaggtcgcttatctaactgaaaccctgggagcagggatcggtggctccatacagggcgtcctgaacaaggttgctcaagaaatgaagaaacttgcctttgcaggctgccttctcggtccgccccgccgcacttaatgtcacgttaagattatatgaccttgtatatagcacggcctagatccaaggccagcccggcggcgggcagcgcggtgcgctcggcgcgctcaaccccaccgaccaggtcctcctcgcccgccacctcctcgtggcgtccctcatgggatacatttttttcctcgctctcgtcattgaccggcttcacagctacatcagagagatgcgagcgctgaagcagaacctggaggctgtgtcgaagcagaacaagacattagaagaagcaaaatctggaaggtccgatgagagcaagccacaccacaacgacattgcttcgctgaacgaggagatcaagaagctgaagcggcaactgaaagaaaaggcggaggaggccaaggatgcagaggccaaagcactagctgcccagacacaatccgaaggtcttgcgcgcaaatacgaccgcctgctggaggacaacaagcatctccatgagcagctgcagtcaggagacatcccgctgtcgcgttcggatggcaagaagaatgcctaagatgtggttggtcctcatcaagtcaggaacttgtggaagcctgaagacagttgagagatgaacatgacgtgagttactgataatcagccatcagggtagtaccatctttaccaaataaatgctctggtattatgtaccagaacgcaaaatatcgctcaatctcttacagccaggttagccgtgactatgctaagatgccctcctgtaaacatctaatggtgttcgactgaatgttcgccaagaagttatttagtcggtgatcagaggtcagttgagttgttgattagtcatcattgcgcaattccgctgcaggttggcgaaaaatctgtttacgctacagactctagtccatgtgtggaccgagttgccgcaaacagaacaaagacactcgcggctttgcatggacacgacttgacatttgaaactttatataagggttgagcgctcgttggtgttattgtgtttaagatgtattttttttaagggtcaaacctttttgatttgacaaaatttagagaaatatatcaatttccac

SEQ ID NO: 29969 - DNA, 592 bp, Triticum aestivum
  Clone ID: PAT_TA_29969
gccggccgggcctggtcatggaggtgacgcagccgctgtggtgggagcgcgcgctcgtgctcgccactcagggcgtcttcttcaacgcctacttcgtcggctacctcatctccccaaagttcgcgcaccgcttcgtcggctacctcgaggaggaggccgtccactcctacaccgagtacctcaaggacctcgaggccggcttgatcgagaacacgcccgcgccggccatcgccatcgactactggcgcctccccgccgacgccaggctcaaagacgtcgtcatcgccgtgcgcgccgacgaggcgcatcaccgcgacgccaaccactacgcatcggacatccattaccagggaatgacgctgaatcagacgcctgcgccgctcgggtaccactgatcagttcaatggaccataggtcgatgcctgctcagtccaccgctgtcacttactaccactgtcgcctacgtttgtcccgttaaatttgagatggattttttgtgtcactttgtacccaaagatatgtttgcctaagccgttaattcctgtaaatatgatttttttaacatcagtacagacgcaagcgctcatatata

SEQ ID NO: 29970 - DNA, 880 bp, Triticum aestivum
  Clone ID: PAT_TA_29970
cgcgcgggcagcgacctcttcttccagcgccgccacgctagccacgcgctgctgcttgagacggtggcggcggtgccgcccatggtgggcggcgtgctgctgcacctgcgctcgctccgccgattcgagcacagcggcggctggatccgcgcgctcatggaggaggccgagaacgagcgcatgcacctcatgaccttcacggaggtgaggcagcccctgtggtgggagcgcgcgctcgtgctcggcacgcagggcgtcttcttcgacgcctacttcgtcggatgcccatccccgcccaagttcgcgcaccgcttcgtcggctacctcgaggaggaggccgtccactcctacaccgagtacctcaaggacctcgaggccggcttgatcgagaacacgcccgcgccggccattgccatcgactactggcgcctccccgccgacgccaggctcaaggacgtcgtcatcgccgtgcgcgccgacgaggcgcatcaccgcgacgccaaccactacgcatcggacatccattaccagggaatgacgctgaatcagacgcctgcgccgctcggctaccactgatcagttcaatggaccaccatagatcgatgcctgcccagtccttccgcccagtccaccgctgtcacctactaccactgccgccgacgtttgtcccgttaatttgagatggattgttgcgcgcgcagtatgtttatgtccatgagttttttgtgtcactttgtacccaaagatatgtttttgtaagccggtaattcttgtacatatgaattgattacttttcttgaaaaaaaaaaataaaaattggggctagataacacaaaacctaaacattaaacatggacgaaaatatacaacaaaaagactg

SEQ ID NO: 29971 - DNA, 846 bp, Triticum aestivum
  Clone ID: PAT_TA_29971
ctgtgcggcgctcaggcggcggccgggatcctccccaccactctccacttgacaacatcaccctaaacaccaaccttacacttcagccatgtacttctccgccattcttctgaccctcgcagccactgcatcggctgtcgatgttagggcttacagtaacagtggctgcaacgggggctgggtaggctgcgcgggaatcaatcccggcgtttgctgtgtgtttagcaactcagcaagcagcggcagactgagcgtttctgtgaacgctatcccaagcagctggcgcattcgcggcgaggctaacactggtggtggctgcacatacctcgccaaccagcaagattccaacggcaacacagacatctgcatgacatactcgtctcgcggtgaccgtaccggtggtagctactcgttcgtcggccgcaagcgcgctgccgacaactcttgccccgccgagcagcctgatggcggaaagtgcgaagctggtgtcaagcccgacctgcttggcctttctgatggcaccgtctacaacattgccgacttgtccgacgagaaggtcgaggagttggagaagattgccaacaccggcgctggtgccgatgctgtccctgccgagttcgagccccttcgccgctaaatcgagggttaaaactaaatggatggtccgtgatgagggtatatgtcgggacgggaggtttggatacaacaaggataggctggaagtatatatcggactgaaggtatcctaaataagagcaccttcggttgattacatatacctcagattaagaatatatacatttattcaactaaaaaaaaaaaaaaaaggcccttaccccgcgccct

SEQ ID NO: 29972 - DNA, 1699 bp, Triticum aestivum
  Clone ID: PAT_TA_29972
gcctcgtgccgcccgtccctcccaccaactgatgcgccgcctcccgtccttgttcttgcttcaaacccccacccgtccccaacccttgacctgagagagggagagagagagggagagagagagagaagagaaatccaaagaaattgccatccatccatggcgtccggctgctgcgtcctcgtcgattccggggcgtacatcgacgacaccaacgacagcaccaacgacagcacggcccgagagtatactaatacaggcagtcagatcatggtttccttatggcctgctcacccgccgatcccctcccgtctctccgtgcactgcaagtggatgcgtcccggccatgtcttcttccatgaacccaagatcctttgcgcggcggactgcttctttgtcctccgcatcgccatcggccgcagccccccacccataaacatcacacagaaggtgagcgactacttcatctaccagtcagctagctccacaggtccgtcgctcaagctcctcccgcaccctcaccctcacttgttctcagacaatgaggttggcgtcctcccccgcggcaacgaatttaccatcgccgtgctctctcaaacctcatattacaatttcgtgctctacctcttcaaatccgaggactggtattggacctccaagaaggtgctggtggactcgccgcggctacccttccccatgccgctcccccctgacgatgtccttggccactttcagcatcatggcaactcggtcatcaccatcgggagcaggggactcgttggctgggttgatctctggcacggaatactgctctacgacgtgctccgtgacgacaacgacaaagtacgccttgtgccgctgccggtaaggctgggaagccatggcggctatgcgcttatttgctgtccaaagccttaccgaagcgttgctgtcctgggggattgcctcaagtttgtcgagttggaagtctccggcgatcgtcttcctggtaaagaccctgaaaccaggggccccaatatcagaattgatgactgggcactcaccacatataccaactgcaacatcaccggcgatcccgacgattggataatcgacttcactgtcaatgcatctgccatccgaattgacacagcaatgcggtctggattgcttcactgcggaatgctgcgtaagactgaggctgcagagagaaacttgcaaaatctctggacatgtcagcctgttctcagcctgaatgatcaaggcactgttgtttacctcatcaccagggtcaaattctggcaccctaaggcatggcttcttgctgttgacgtggccaacaagcaagtacgagcaatggctaagattgaagctgaaaggagcaccgccttgtcgctcaactattttccttgtaggatctcatctccagctacctgcctgaatgggacaactatgccagttactcgtggcacactgatgcttggggaacaaactgcggaacaaactgcgggtgatggcgggaaatgaactgcgtctaccaaacctggtcaaggttaaggtttataatagttaatctgagtgttttaccgggacactttgtatgctcgctcgtatggggttgcaataatgttgaggacattcttctttgcatgtggttatatcttattttcctgtactcctaatttgaatttggcggtattgcatttccagtgttatttacatt

SEQ ID NO: 29973 - DNA, 416 bp, Triticum aestivum
  Clone ID: PAT_TA_29973
gagcggcggaggcgttgatgtccgttgagttcgatggcttcccgggaggcggcgaggggttcgagctcgtggcgcgcttctgctacggcgatggccgcctcccgccgctctgccccgccgaggtcccgctcatgcactgcgccgccgcgttcttggagatgacggaggaggtgcgcgccggcaacctgctagctcaggcggaggccttcgtggacgacgggctctgctactggacgtgggccgacgtgctagccgccgtcaagtcctgcgagtcctttgccgcccacgcctcgggggcggggctccaagagaagctgctctccgctctattctccaggatcgacgcgggggcggagacgcccaagtcgaactgctccacgtcgtcgacgtgctcgtcctcgtcgcaggacacggtc

SEQ ID NO: 29974 - DNA, 297 bp, Triticum aestivum
  Clone ID: PAT_TA_29974
cccacgcgtccggcgggcgtgccttcttgttgcatatatatctttcgttggctggatcaccttgcagtacagcaaaatggttgggctgaaggagcttgtgctggacttcaaactcttggagaggttcttgtaaattgtagatgggtttcggcgatgtatatcaaataagccgattccctcgtgtgatgtaacctagtgtaacttatcctgtgctgtgcttcgatatgcagccgcccatgagcaggtggatgaatcgtgggtagctacagtcggcatggagtaactcccatctgttgt

SEQ ID NO: 29975 - DNA, 660 bp, Triticum aestivum
  unsure (1)..(660): unsure at all n locations
  Clone ID: PAT_TA_29975
gcctgacaacagcatacattgcgctggggcttgctttgtcagttgtggcttatgattatcaggagattggaacactggtgatactgttctgcatcttccatgcatccgtgggctttgttttacctttgctcgcaagatttaggacaatgtacctgccaaatgaactacgtggaggcatgatgagcttttccctagcactgggaaatgcacctatgttcattttcctaatacagggcgcctaccatgggaacatcgcaaattcaaccattctaggccttgcagcctgtggccttttgtctgccgggggctgcattcatatgctgcggcgttggagaaagcacacccgtcaaaacgtgcgcagtctataggatgatgatagactacaataccggcttggaaagtgttgtgtttgtagcatgctcatttttcctcggcttatggccattggatcctcacggttaattagcattgtctatgccctgatcaatggtgcagcataccagaaagtaggtgtatgatatgttttctctgttaaaaagacgcgttgttcaaattgacgtcgaccgcatcctgtagacacggaaatgttatgatagaatcgtttttgtgctggaacatatccttgagccttgtaaagaccactgcnnnnnnnnnnnnnnn

SEQ ID NO: 29976 - DNA, 900 bp, Triticum aestivum
  Clone ID: PAT_TA_29976
gcgacgacgaggcgagtaagcccccggtgccggaagccaacagcagctccagcgaaatcaccgtggtacgccaccaccaagcagacagcggcgcgcgaccagcggccatggtcatcgacgtggtgacggaggaggaggccgagcagcgcatgaaggaggcgatggagctgcagcggatagggacccagcggcgcgcgatgcggtcggggtcgcggccggccgggacgaaggccgcgaagcttgtccggtcgtactccgccggccactccctcgccgtagtccggctcgaccgcgacctggagcggttcacgctgtggctgccggagcacgtgcgcagggagatggtcgccgctgccggggagcagagctcgcatcgtcgcgcgcagagagccggcagatggccatcgttcctaaggtacaccaggacgttgtcgggaaggttcttctcgacgccgaggagaacggaaagctccgagggaggggaggcgtcctcgtcgtcgtcgacgaggattagagggaagcgcgtggccgccgtcgatttcctcgaaggttctcctctgggcggcggcgtgtctaatgccaaggtcggctctgtggccggcgatgtcgacaaggcagctagccggcaggttcgaacgtagaaaagaaacgggacttttgaatctactagaagcggtgttcttccacgcatgcggggaatctgtctgtgctattaatccaagaaagagactgtaatcaccgcatgcagaatgctcaagaagccctgtggaggcacctgaattatttttttctgcgtcagtcttatttaatttccatatctagtcatcttttttgtttgaaaattccatagtcatctgatatatgacactgaagcttgtgttttaaaaaaaaaaaaaaaaa

SEQ ID NO: 29977 - DNA, 1477 bp, Triticum aestivum
  unsure (1)..(1477): unsure at all n locations
  Clone ID: PAT_TA_29977
accagttagtgcagaaatctgattcggacacaaagcatctgagtgtaacaaatgtgagaaccttgaaaatgaatgatgatgtccttgcagtgtccattggtccaactgggaagcatattgctgttgctcttttggattgcacagtgaaggtcttctttctggacacactaaagttttgtctttcactttacgggcacaagcttccagtcctctgcatggacatatcatccgatggagctctaatagttactggttccgcagacaaaaatctgaagatttggggtatggattttggtgactgccataaatctatatttgcccacacagacagtgtcatggatgttaagtttgttcctaaaactcattacatgttcagcgtggggaaagatcgtactgtgaagtattgggatgctgataaatttgagcttttgttaacacttgaaggtcaccatgctgaagtttggtgccttgcgattagcagtcgtggtgattttatcgtaacaggctcccacgatcgttctattcggcgttgggatcgtaccgaagaacaacttttcattgaggaagagagggagaaaagattggaggaaacttttgaggctgatttagacaacgcggttgaagatagatatgggcagaaagatgatgctcctgatgagggttctgtgggagttcctggtaagaaaacgaaagagacagtaactgctactgatgcaattattgacgcacttgacactgccgaggaagaagaaaaacgtcttaatgagcagaagaagttgcaaaacaatggggagggcactaaatctaagcctaatgttataatgcaagggcattcaccatcagaatatgttctgaatgcagtgtcaagtgtccgcccaaatgacttggaacaagcccttctgtcattgccattctcagatgcactaaagcttatggcttacttgaaggagtggtctctgatccctttgaaggttgagcttgtctgtagggtttgccttgtgctgcttcaaacgcatcacaaccagttaactactacaccagctgcaagatccatactgacagaactgaagtatattctttacggtagagttaaggactgcaaggataccataggtttcaatctcgccgcgatggatcatataaaggaactgttgacgatgagatcagatgcgccgttccgggacgccaaggcgaagctcatggagatcaggcaggagcagtcgaagcggtcggataggtcggatggcggcgagaaaaggaaaaagaagaaacccaagccgtctgtacatagctgatcatggatctgtctgtttttactcaactgttgtagcgtatacgcaccacactgggttatcgcgttcattccatgctgtcatgagcacagcgcaattttgagatatctgcgtgtgggccaatgttaattggcggtttcctgctagagaaacaaggtgtaccttccncttttagaagncaaggc

SEQ ID NO: 29978 - DNA, 201 bp, Triticum aestivum
  Clone ID: PAT_TA_29978
gtgatgtattgtgtctcttttttgtaatttgtagagtgcccctttgacatgtgcaggacatgtcattagcctgtaaaaacttggtagaatcttgcgcagctagctggagaaacttcgcgtctgatgaagagaactgaatttctgttttttctttgtggctaagagaatcatgatgcatgcctggttgtcatgccctcttgg

SEQ ID NO: 29979 - DNA, 1117 bp, Triticum aestivum
  Clone ID: PAT_TA_29979
gctctttgccgtgatggacgagactcctgccgaagcaaggcttagcgggatcaggcaggctgtgctcctgcttgagaggtcccatccttcggcaccgctaccgacgctggccgggtctgagtccaaagagagctgccgcagcggagtcgatgagcaaaaggaggttaacaagattgttgatcgtcagattcgggtattcttcaatgtccctggaagttctgttgcagaaattgatacaccggattctttctacaaacttagtggtgaggaggtaaggaatgaggcaaagatgaggagggaaaggctggaacaatctcggttgctaattccaaagtcatataaggagaagcaggcactggctgctcgacagaagtacaaacaagctgtcatccgagttcagtttcctgatggagtaattctccagggtgtattccttccagcggaggctactggttcactatatgagtttgtcgcggatgctttgaagcagccaggtttggaatttgatcttatctgtccagctgttcctaggtcacgtgtgctaccgcattctccaaatacaggagagcgggcacgcacgttgcaagatgaaggcctagtaccttctgctctcctcaaattcaagcccaatgagactgattctgttgtgttcaccggcttgcttgacaagcttctggaggctagtgaaccatttacagctgcatcctcttgattgttggagttcgggcccacattctcccctcaaatcttctgttacattggacttcatactgttgtaactcagtcacagggatatgtcatctgcatactcgttaggttgattgatagtctggtacatagattgcttggcgattgccatactttacatggtaaaacccaataattcatcagtcgcaccgtcaactgtacctgagcgatgagtgagctatacaatgtgtacaacacattaacttcccttgatgttgcatttgatactagaactatcgttaattcagtatcccctctattgttaggtttatacagtttgttggcttgaaatgcatgtgctgccttcgctgccgaagattttcttcaattgaatattggactgttatgggaaaaaaaaaaaaaaaaaaaa

SEQ ID NO: 29980 - DNA, 795 bp, Triticum aestivum
  Clone ID: PAT_TA_29980
ctttttcaacggtgatgcactgtgcatggattggctagagaagcaaagcaattcatccgttgtgctggtgtcctatgggactgtctctaattatgatgcaacccagctagaggagcttggcaatggactgtgcaattccggtaaaccttttctctgggttgtaaggtccaacgaggaacacaagttatccaaagaactcaaggaaaaatgtgagaagattggattaattgtctcatggtgcccccaacttgaggttcttgcacatagggctattgcttgctttgttacccactgtggatggaactcgacactagaggcacttgttaatggtgtacctcttgtgggtattccgcattgggctgaccaacccaccattgcaaagtatatggagagtgcatggagcatgggtgtgcgtgtaccgaaggacaataatggatatctaaagatggaggagcttgagaggtgcattagagaggtgatggatgtggagagaaaggatgagtacaaaagaaatgttgtgaagtggatgcaaaaggccaaggaggcaatgcgggaaggaggaagttcagacaagaatatcatagaattcgctaccaagtattcatcaatataaagtttgaacaatgttttacttcaatataagcaagtaggcagtgatttcagccttacaaaagtttagagtggccgacattttccatatgtaattgtagtgatatcttcttcatgaaggaaatatgccctagatgcaataataaagctattatttattttcttaaaaaaaaaaaaaaaaaaaaa

SEQ ID NO: 29981 - DNA, 1310 bp, Triticum aestivum
  Clone ID: PAT_TA_29981
gccggccgggccggaaacgacacggcctcgcacccaaatcagcaaagaaagcaagcaagccaaacaaacgacgtttcacccaataagacatggaggagcggcgcagtgacagccgacgccaggagcccatggtcgccagggcggatggccccccgattcccgccgacgagtccgacgacgagttcgagttctccttcgggagccgggagcctgccacgggcggcgccacggccgacgagctcttcgccgacggccgcatcaggccgttctacccggtgttcggccgcgtcttcgacgacgcgcacgtgccgtcggcgcccggccggaggccgctggggcggctgttcctcgaggaggcgcggaactcgtccgtcgggtccacgtcctcctcctcctcctccgccgccacggacgccggggacctcgacggcgcgtccccggacacctactgcgtctggacgcccggcgcgtcggccgcgtcctcgccggcgcggtcaccgcggaagagcggctccacgggatccttgtcgcggtggcgccgcgtcagcgagctcgtcgtcggccgcagccgcagcgacggcagggacaagttccgcttcctttccgcgccgccctcacctgccagggagcagcccaaggggaagccaagaggccgggacagcaaagccaccaccgagctcgacacagtggccgccggccaccggcagttctacggcgccaaggcctcccccggcgcggcgcggcggacgttcttgccgtaccggcaggatctcgtcggcctcttctccacgcccaaggggctcagccggagccaatacttctgacttcaaggaggcgcgtcccccgccccgccgtgaagaaccagtttcaaaatgtgagatttcacatttgggttgaaatttcgaacttttgacccgggagcaacttcgtgttcgtaattggccatggtataactggattgttgaacgggattgaggtagtccaaaaagacgaggcgtcaagtcagagcaagggaaatgtgaggcttaaattctggattcagtcagggataccgggctcaacaagtcaatgtgaagttgtgatcgacatgtgaacatagtaggaccaaaaaaaggactgtataggagattaaaatacacgtggaagctcagaaaagttttgtagtgatcatgtgttacctgtacatgcatgtatattgtactaccagaataatagatttttttcttgtagcaatctggtgtgtagatttttctgcgtgacaacagttttttttagcgtctatataccaggaacatgaattttttgtttac

SEQ ID NO: 29982 - DNA, 1096 bp, Triticum aestivum
  Clone ID: PAT_TA_29982
tccgccgttgcgggaacgacccagaaaaactgggcccacccgtgcgcgcccgcccggccgcgttagccggccttcttctcccacgccccaccgcccctcctcgattcctcccggcggcgagcgcaccgaggaagcgatgaatcccttcgcgaagaagccaacgccgcgagaggcgatcaggaacagcaagcgggagctgacgaacgcgacaagaggtattgagagggacatcgggacattacaacaagaggaaaagagactagttgctgaaatcaaaaggactgcaaaaactggcaatgaggccgcaactaaaattctggcccgtcaactgatcaggttaagacaaaaaatatctactttacaaggtagtcgagctcagattcgtggcatcgcgacacacacacaggcgatgcaggccaacacttcagtgtctgctggcatgcaaagtgcgagtaaagcgatgggagctatgaacaagcaaatggatcccgccaagcaaatgaaagtaatgcaagaattccaaaagcagtcagcacaaatggatatgacgaacgagatgatgtcagactcaatcgacaatgtcttagacgatgaccaggctgaggacgaaactgaagagcttgctaaccaggtgctcgacgagattggtgttgacgttgcctcacagttgtcctcggctcccaaaggaagaattgctggaaagaaggttcaggctgatgagagttcggaattggaagagctcgagcagaggctggctgctctgaaaaatccataaagtgactcccctttgcaaccctctctccacgcagagtgcctaggcttcaaattcttgttggggacctgaaagacattttgcatttgtgaatattggatgggggatggtttactagaaagtgaggggcagatgacgccgccagagtttgatcttaagggagtcctgtaaaaaggttgattgcttggctattactgtagccatgcaggctggaactgatgagtttatgcttcgatggagtgatttgtttgggtagttacagtgcttagtgtaaaaagtcgagagatatttcatatagtatctctttgctcgtaaggtttaatg

SEQ ID NO: 29983 - DNA, 2346 bp, Triticum aestivum
  Clone ID: PAT_TA_29983
ccacgcctccccccccatcgcggcatcacagttcacgcgcgcttggcatcctgcctctccgccctcgagtgctggccggaggctggagcaagtggaggatgggcaccaagggtgcggcaactttgcttgccatcctctgctccttgcttcttctctcgttgagctgcgggtgcctggcgccagagtcggagggggatcagacggcactgctggaggtcgatacatcatggtaggccgccagaaagatccctcgaaccctctgaggctcgctttttgtggaaaccaaccgggatctggcggttggacggcgggaggagctttccccgttcacacattcagcgattgatgggcctagaactcgttcgatgacccacttaaggttaagccggtaaaacgtggtctacccagcggtgcagaggagaagcacggccatgctggttccatcactctttcacttcatttgatctggctctggatgagtacggcgcagcttgcagcttgacatcgtgaagaagcaatggtgagaggtttaggcgaggtggaaaacaagatgatttacacgaggcattgatcgatcagcaggtctggtgcatggattccagaaagcaagcgaaatgtgaagttgtcttccctggttcattggaagtatatagataaataaatataggtttgtttttctggtatttggctattaggcctcatgtgatcgggcctggtatccatgacactacttgttgacctgccgcaagcatatatcaaaatgaatgaaaaggttgccccgatgccaccgccgtcgctttcccttcgctcgctgacccgcccctgtgcatttcaaacctcagtgccttcgatttcctggtggtacctttgttgaaggcattttgttaagaaatgctttcagatggagggaaactatcggtccatgggaagagaggcctgggcactatggagacgtttggaattactggacagatgatggtcttgggtattatgagcttctccagcttgcggaagacctgggcgccgagccaatctgggtttttaatgctgggatcagccggaatgatcaagttgataccactgccatcgcaccttttgtaaaggatgtattggacagccttgagttcgctaggggaagtgcaaaatcgacatggggatctgttagagctgcaatggggcatcctgaacgatttccgctgaagtatgtcgcggttgggaatgaagattgtgacaacaccaaaccattttaccagggacattacctcaagttctacaatgccatacgaggggcctatccagatattcaaattatttcaaactgcgatggctcatctgagccacttgaccatcctgcggatttatatgatttccatatatataacagtgctaatgatctttttctcaagaaagatacatttagcaggacatcacgtaccgggcctaaggtattcgttagtgagtatgctgttcatgttgatggggataccagcaagggaagccttcaagcttcattggcagaggctgcattcctcattggattagaagtgaatagtgatatcgtccacatggcgagctatgctccactcttcgtaaatgacaacgaccgcaaatggaccccagatgcgatagtcttcaactcctggcaacagtatggaactcctagttactggatgcagacatttttcggtgaatcaagtggtgctgtgatccatccagtgagactcaattccagctactctggttcattggcagcatctgcaattacctggcgagacaatgaggatatcttcctgaggataaagattgtgaactttgggccgaatactgtgaacctcacattatctgcaaccggactggaagctggtgtcgatacgtcaagatcagctgtcaccgttctcacatccaactattcgttggatgagaactcgttcgatgacccacttaaggttaagccggtaaaaagtggtctagccagtgctgcagaagagatgcaggccatgctggttccgtactctttcacttcatatgatctggctctggatgagtacggcgagctcgtagctgacatgtgaagaagcaatggtgaggtggaaaacaagatgatctacacgaggcattgatcgatcaggtctggtgcatggattccagaaagcaagcgaaatgtgaagttgtcttccctggttcattggatatatagataaataaatataggtttgtttttctggtatttgcctatcaggcctcatgtgatcggtcctggtatccatgacactacttgttgacgttccacaagcatatatcaaaatgaatgaaaaggttcccacgatgaaaaaaaaaaaaaaaaaa

SEQ ID NO: 29984 - DNA, 790 bp, Triticum aestivum
  Clone ID: PAT_TA_29984
gaatcgaatcggacaagaaatgaggcagcatgccacacaagcaacggcagagggcgcgggaggggacgtgggagaggtcgccgtgctgggcgtggagctgagagggagattgaacaccatgaattaggttgtgcccaatttagcaaaccaggccacctgaaggtagagattggagacgttgttctggacacaagtgaaaccaaagagcatacccctttgagcaatgccagggcctccttaaggaacattgacttgaacttagatcttgctgactacgaggaggatacgccgcaagtccagccttcggctccttcagctcctgtggtgaccgtggcaccgcaagtccagacttcaggaccgtcggtttcacagttgaaagaagaagtggagaccaaggatttcctgggctggcaaatgcctgagatgaacaagatggccatggacccggtgcagtttgcgctgtcgtcaaaccatagattagaggaggacgaagactatgacaatgaagaatgacgtgactctagcgtggatttagtttgagaagctgataggtagacatgacatgatgtacatcctagcaggcccagcttgacaatgtagtagcaattctcttgtagtatgtgtacccgcagatgctgcagaagtgatttaggatgtgacatatgttgattgctcaatagccagtagtagctagtattttgtgtagcaactatatagtgtagcaactatataactagacaggttcgccggttgtaaatcatggttgcttttagatcaaatgctatgtcat

SEQ ID NO: 29985 - DNA, 716 bp, Triticum aestivum
  Clone ID: PAT_TA_29985
aaattcaacacagtaacgtacctacaacgctcaatggcagcgactcgagcgtgtttggtcgcgctcgcggtggctctgtcatttctcttcttggagggcccagccgcggtgttggccgcgccggcgaagaccgcggagagtttggagcagcggcgacgggaggcgcaaagcctcctcaggcggctcaacaagcctcctgtcgcaagctttcagagcccggatggagatgtcatagactgtgtgcacatttccaaacagcctgcattcgaccatcctctcctcaaaaaccatactatccagatgcggccttcttacaacccaggaggtatgtatcatgaccccaccatcgcaccccatccaataacccagacatggcatcaaaatggtaagtgccccgagaacaccataccaatccagaggacaaaggagcaggatgttctaagggctagttccatcaagaggtatggcaaaaagaggcccaggagcatcccaaaccttagttcaatcaatgaccctgacacaaccaatatcacgaggggccaccagcatgctatcgcatctacaagtgttgataagtgccatggaaccaaagccacttttaatctgtggcaaccaatgattgcgagagccaatgacttcagcttggcccaattctggattagtggggggttcctatcagggaaacgacctcaataccattgaagtaggatggcagg

SEQ ID NO: 29986 - DNA, 1823 bp, Triticum aestivum
  unsure (1)..(1823): unsure at all n locations
  Clone ID: PAT_TA_29986
tagcgtattctctcccctcgtccatatgttttttttttattttactagcgtgaaataaataaatcgcttatgtggcaaataaacttacaaatacaacttacatcacacgtccagaaaaatcatactacatcaataattcatcttgcaaaggggccaatttctcatcacttcaatcatacattttttttcaagttgttaccagctcctccattcactattgtaattttatttgcctcaagcatttcctaaggagatataggggtccatcatccactgcatgctccagtggttgttaacattcttgtacgtccagtaagcccatccaaatgtggctttccgatacacagccatctgcgcatttgcaaaacgttggaagtcctcttttgttgcatcctttacctgccactcagccacccattcaccaacaaatgtgagagggccatctggcctatttatagcgttgatttcactggcgatgaagttgttgacataatcaatgttatcctgcacagtgaaactatcgaacttgctatcgaacaacgcatagtagtgcatgtcgaggacgaccctgttgaattgtgaggcaaagtcgatgagctccaacgaagatcctgaaagacggttggacatgatcacataggctgtaagtgagtgcctcctaacggcattgtagccttgttggtagtatgttttcaggctatctaaggacacgccgggagcaaccggctcattcatcaactccacggccaagaggcttgatctcttggcgtaccttgcggcgaggaaatcaatgacttgcacagtttgcgcgatttgggagtctccccatgtctgcgagccatccctaccaccgctatgctcgttggggttctgcgacccaggtgcggcatgcaagtctattatcacgtgaatgttgtgcctctctgcccatgtgaacgcgctgtccaatgcttggagagagcctcccacgaatggagctggagggttggggtcgctggcgatccaccatcccacagggatcctcacggcattcagaccgtttgccgccatgaacgcgaaatcggcttccacgatatatgtgctccagtggttattcatgacctgtgtagccatatctttgccgtagccattgcaaatctgatactccccatgtggcccgttgactatgttcactgcaaacacggacggatcattgtctccccaggtcgtgctctcgccgaagttggccgtcaccgaaccatctttatttgcctgcaggaaggacccatttggtgctctgatcctcattctattcttgtcggcgtagctgcgcactagctgaaacgtctcagtctgccctggcgcggaggccgtggccaccacgttaacgctggagacggtcacaaactggttgttggacaccttgaagttgaaggtgttctggtcgatccgccagagcttgaagctctcccagccggaagccgagggacggttggcgaccaacgctgcgccgccgccattnctcggcagccacgaacgcattctgcgtcacggacttgaactgcagttgtgtgccatccaggagatctttgtcggggatgccatcgaagatggagggcacccaatagactatggtcactacaaacacggacgggtcatcgtctccccaggtcgtgctctcgccaaaatttgccggtcaccgaaccatctttatttgcctgcaagaaggatccattcggtgctctgatcctcatcctatttttgtcaacgtcgttgcgcactagctggaacgtctctgtcttcccggccatggcggtgtgcctgcagcccggggatccactagt

SEQ ID NO: 29987 - DNA, 712 bp, Triticum aestivum
  Clone ID: PAT_TA_29987
aggacggcctcatccacaaggaggagttccggctggcgctgttcaggaccagcaaaggggcgaacctcttcgcggacagggtgttcgacctcttcgatctcaagcgcaacggggtcatcgagttcggcgagttcgtgcgctcgctcagcatcttccaccccaaagcgcctgaatctgaaaagaccgcatttgcattcaagctgtacgacctgagggggacaggctacatcgagaaagaagagctccgggagatggtggtggcactgctcgacgagtccgacctgtgcatctccgatagcgcagtcgaggagatcgttgacaatacgttcagtcaagcagactcgaatggcgatgacaggatagaccccaaggagtgggaggagttcgtcaagaagaacccagcatcgctgaggaacatgtcactgccctatctccaggacattacaacggcgtttccgagctttgtgatgcattcggaagccgacgattacagcggaatcagcaaataataaccgggccttagtgccacatgatccgctccggctatctatgaacatgctgctgggaggctggctgcgcgttcaattcagaggcgcgtgagctgcaaccggaaagcccggagctcgaatggggggagaacgcaagggagccgatccggtagccggtgagcgtgagatgatgtccaccggacgatgacttcatgtccatgcga

SEQ ID NO: 29988 - DNA, 104 bp, Triticum aestivum
  Clone ID: PAT_TA_29988
cggacgcgtgggcaatcccggcaccactagtatggcggcatcaccacgtgaattttgtgtacgttgtcacatgtgcttgataaattaagggcacctttgatttg

SEQ ID NO: 29989 - DNA, 936 bp, Triticum aestivum
  unsure (1)..(936): unsure at all n locations
  Clone ID: PAT_TA_29989
gggtgaccgggtggatctcaggatcctcctgaccatcggaatggtcggaaccgggctgttcaccgccgctttcggagccggctactggctcaacatccacagcttctactactttctgggcgtccagatgatcgccggcctgttccagtcgtccggctggccttccgtggtcgcagtcgtcggcaattggttcgggaagagcaagagggggctgatcatggggatctggaacgctcacacctccgtggggaacatttctggctcactgatcgccgctgccatgctgaagttcgggtggagctggtcgtttgcagtccctggtgccatgatcgcgctggtcgggctcgccgtgtttctgttcttgcccgttgaccccgaggtgataggcgtcgaggaggatcgccatgtgaaggactacgagaagaatggcacggatgtgcctctgctggaaggacattccagtggtagagacgaggcagtggggttcattcaggcatggagaatccccggcgttgccccatttgctctctgcctcttcttctgcaagcttgtcgcctacacgttcctctactggcttcccttctatctcagccacacagagatcgggggagaatatctgtcagactctgcggcggggatcctgtcgaccctgttcgacgtgggcggcgtcgtcggcggcatcctcgccggccacatctccgaccggctggacgcgcgggcgctgacggcggccaccttcaccttctccgcgatcccggcgctcttcttctaccgcatctacgggagcatctcgctgacgtggaacgtggcgctcatgttcgtgacgggggtgctggtgaacggcccctacgccctcatcaccaccgccgtgtgcggcgacctgnggacgcacaggtgggtggacggggactcccaagcgcttggccccggggcggg

SEQ ID NO: 29990 - DNA, 1246 bp, Triticum aestivum
  Clone ID: PAT_TA_29990
cgtttggaacttgcttggaagtcccatacatatcctacttctgttgcctatagcaccttctagttggcaaactctctgcagactgagacacgggttgtgaccgggccatcgcgcctgtctgcgccgccgccgcccgccgccgccccgccggcggggccgccgccgccggcggcttcgccgcgtcccggctggtgctcctcctcctggagggcggctccgccctccgcgccgcccgccgcccccctgacgtggcggcgagggcccacctccgggccgccgtgggggcggcggcgcggctcccccccctccgcctggtcctcctgctcgaggagagcctcatcgctgcattccgaggatgcgaaggcgtattccataccgcatgccccgtcaccgatgacccggaaaaaatgatcgagccggcggtaaacgggacgagaaacgtgatcaacgccgcggcggaggtgggcggcattcggcgtgtggtaatgacgtcgtcgaccggcgccgccgtcttcgtgcctcctcgtcgcaccgacgggggggccgccgaggcgtgctggtgggaccgcccgcgcggcctgcacgcacacaacgggttcggcctgctatgcgaagacggtggcggagcaggcggcatgggagctcgccaaggagaggaagcttgaccttgtggtgatcaacccgtctctagtgttgggccctctgctacagacggcggtgaacgccaagtacgtggcatattgccaagtacctggacggctcggtgcagacgtacgccaacgcggcgcaggcgtacgtgcacgtccgggacgtcgcggacgcgcacgcgcgtgcgtacgagacgcccgacgcgcatggccggtacctctgcgcggggcgcacgctgcaccgcgccgaggtgtgtcgtatcctcgccaagttcttcccggagtaccccgtgcccacgaggtgcaaggaaggggcgcgcgagatgaagaaggggtgccggttcagcagccggaggatcatggagctcggcgtcggcatcacgccggcgagccagtgtctctacgacaccgtcaccagccttcaggacaagggcatcttaccccgtcgccacgctgatatgtcctgacaactccgtggccaccggcgccttggtcacgtgcggcgcgcgcccccgtgaggtttgccagtcgcggcgctgtgttccccttttcctcctctcttgttctcctctttttttagaatctttattaaaaaatat

SEQ ID NO: 29991 - DNA, 695 bp, Triticum aestivum
  Clone ID: PAT_TA_29991
ttcaggacaagggctcactattcacccttggttggattcatacacatccaacgcagtcctgtttcctgtcctctattgacctccacaatcattattcgtaccaggtcatgctacctgaggcaattgcaatagttatggcacctactgacacaagaaaaaaacatggtatatttcatctaacggatccgggtggtattggtgtgatccatgattgcccggagagaggattccatccacataaagcccctctggatggctcaccaatctacgagcattgctctcacgtgtacatgaatgctgatacaaagtttgatatgattgacctccgagaacagtgagaggtatcagtttcattctgtcatagtttggcggctgtacatgcggcagttgagcaaattgtctgagttgagcaaattgtctgccttgatttctctagtgcgctgaagaaatgcggggatactgatttaagtgattgtacatagctattgtgtgtatagagatatcattggtacatccggggaaattgaggatttgcggtgtaattcaccccctttacctctggggatatacacttttgagatgagatgtaagtaatggtcaatctcattttatgcaaggttaattgtaaaagcatcatatgttttactccattccgaaataagttgatcgctatctaaaaaaagttagtttttatt

SEQ ID NO: 29992 - DNA, 2020 bp, Triticum aestivum
  Clone ID: PAT_TA_29992
acttctcgccgggggagcagaggagctcgccagagaaggccatggggccaccgcagccagccaagggcatcatcagcatcgaggcctgcgcgcggccgatcgccgtcgaccaccgcatcagcctcccctactacttccgcatcgcgggcaccctcctccgccaggccaagatatatcgagatgagaagaacatcctcgacctgtatgtcatcctcctgagatatacgagcttgctgtgtgagaccatccccaagcaccgtgactaccccgtattcaagttgagggaagcagagttcgtcagaaacgccaactcctctacactcattgatgttgtcaatgagcttgagtctctgaagccagttgtgaagcggcagctcgttgagcataacagaaggggtagcccggaagctaatggtctgaatggaacccctgctgcaagtttaaggacggagaagcatcctcgaaccacatattccacacagccatttgtaggttcattgcaaaaattctacccagatgggaggcatcacgtggcatcatggacaagtatccaaattgataggcagatccgcaaacaatttgtaaatctgccttttccaaaagaagagacactggctagacattcaatattagggcctaatgggcttcatggacaatggaatggacctgttgctgcagtcaaggtccaatatccatgcaatcttgaatttacacaaagtgatatgacaagtctagtgccggctatgttgaaccaagatggtctgcatggtcccagtaccacacatcccgatagcactacaaaagacaacgatgatatgcaatctgttctatctcttgatgatggtcgatggtctgcaccagcagaagaatgcacctctacgccttctgctagtctggagggagaattgtcccagttgaatatcagacagccttgacccccggcagtcctggccgaggtacatcctgatcgcgcacccccaatttctccatcaagagttgctgatccaacacaaggacttgctatatcagaaaccggtcgttatcataacttgcatgttccggtgaagttgatggagtgttttctaagggttgctgaggcgaacactaaaagaagtttagaaacttgtggggttcttgctggtaccctgaaaaagagaacttttcatattacaaccttaataattccaaagcagaaatctacatctgattcgtgtgaagctacaaatgaagaagaactatttgaagttcaggacaagggctcactattcacccttggttggattcatacacatccaacgcagtcctgtttcctgtcctctattgacctccataatcattattcgtaccaggtcatgctacctgaggcaattgcaatagttatggcacctactgacacaagaaaaaaacatggtatatttcatctaacggatccgggtggtattggtgtgatccatgattgcccggagagaggattccatccacataaagccactctggatggctcaccaatctacgagcattgctcccacgtgtacatgaatgctgatacaaagtttgatatgattgacctccgagaacagtgagaggtatcagtttcattctgtcatagtttggcggctgtacttgcggctgttgagcaaattgtctgccttgatttctctagtgcgctgaagaaatgcggttactgatttaagtgattgtacataactattgtgtgtatagagatatcattggtacatccggggaaattgaggatttgtggcgtaattcaccccctttacctctggggatatacgcttttgagatgagatgaaagtaatggtcaatctcattttatgcaaggttaattgtaaaagcatcatatgttttactccattccaaaataagttgatcgctatctaaaaaaagttagtttttattaacccggaaacctaagataaaaaccatccccggcagcctgccccgccgcaactgggccacccctgtagccgctcgactgccatccaaaattggcaaccga

SEQ ID NO: 29993 - DNA, 697 bp, Triticum aestivum
  Clone ID: PAT_TA_29993
gccggccgggtcggatctgctcgcggccgtgcaccggatcgggtacaccgccgccgtgccggaggtgccggggtggctctccgcggaggccaaggacttcttggacggatgcttcaggaggcagcccagcgacaggtccaccggagcgcagctcttggatcaccgttcgttgcttccgccgctgccgccggcgactacaaggccgcgccggcgaagcaacaatacacgtctcccaagagcacgctgcaggacgcactctgggactcggacaccgacgacgaggacgcggacgaaacgccggccgagaggatcggggcattggcctgcggcaactcggccttgccggactgggactcggaagatggctggatcgatgtgtgccaccaggtccacagaggcgctgactcgccgccggccgatgtgggttacgacctcgtttggcccgaagaatcagacgcagagcgcgagccgtctgcggttgctgctgacgacagcaacggcataccgcgcaatgcagtggtgaccgactcttccatttggcagtacagtctgtagaaaaaaatctcacccgtttcaatccgacggggatgaaaaattgagttttgaccgtcattgtaacaaagacagagtaatggaattcatttttttgctcaaaaaaaaaaaaaaaaagaaaaaaaaaaaaaaaaaaaggccccta

SEQ ID NO: 29994 - DNA, 729 bp, Triticum aestivum
  unsure (1)..(729): unsure at all n locations
  Clone ID: PAT_TA_29994
cccgcagcagcaccccaggtccggcctcaagctcagctgatcgattccgctggggcagatgcaccgccttatgttgttcctttgcaatgtgcaactcctccattatgcgcacatgagccggctttcatagttttgggctatgatcaggaagtgcagaagataggattcacttattcgttttgctgtcatgccagcatggttttgttggcgagatttctggccactaaactgccagtgaccccagttgagggttttgttgtctgtaaggttgtgctgcatatcagatgatacgacggccgacgggcacacttgagattctgtacatgaagcgattggattcagcggcaagtgttgctcctgctgtaccgccagacagtatggcgtttttctttcttttgcgaaaacacagttttggcgttgtattcgtaaaattttcacgaaagaaatgtttagaggccaaggaactcgaaacacgaaaaatgaagtgtctctgtgtggcctgtgtttgaacaagagctttctgagttttgtggcctgtgtttgctttgagtnaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaataaaaaaaaaataaaaaaaaaaaaaaaaaaaaaaaaggggcgccggttttaaaggaccaaactttacgtacccgggctg

SEQ ID NO: 29995 - DNA, 822 bp, Triticum aestivum
  unsure (1)..(822): unsure at all n locations
  Clone ID: PAT_TA_29995
gaggaattcggcacgaggcaaagaggctaacgctggcgggtcgtccctcgccgtcaccctcgtggtggtggtggtggccgcatcatccatgccggtggtgaagggggatgacaagtctgcttgcgtcggcgagtactccaagctctgcggcaagaaggaccccgcgtgcaccgccatggtcgagacgacctgccacgatgatgccgacagcgtcaaggccatcaagggcatgttcgacgagctcgccaaggtcggtggagacgactatggtttggcttctacggcaaggccatgggggcacgtggccctcggcgatgccgtcgacgagcatggggcctgccccggcaacaagacggtgagtgaatttgctggcgagcactgcatcccagacatcgacgcggcatgcaaggatcccagctgcagcgacggtgcttacatcgaatgcggcagtgcggcgtcgagattctgctacatcaaggccacccccgccaacaagaaagccatacagcaaaacttggattgcttcaagagctgttgcgcgcagaagaagagtgaagactgccgtaatgaatgcatcctcaacaagagtagtccggccgcttgaaaaatgaaaatgcatgcattccttccttccttccttgtacttgagggtgtttccttcatttcagagtgcctcattcatgcatgttttcacatgcgcatgtattcatctcatttttttttgttgaacatttattttgtctttttttttgttgcgaaaataaaattcattttgttgttgctgtttcnggcagaagcaataaanaaagnagaggtatataa

SEQ ID NO: 29996 - DNA, 945 bp, Triticum aestivum
  Clone ID: PAT_TA_29996
ggagagttggctcagatgagagaaactcgcgaaaagcagtagatagatactccccgccggagtcagaacgaaaaacacgaacagcactggaaaactgagtatggaccatatgtacaaaagccttatatatagagaacaactcagaacgatgcttcataaaatagacccaagtatgtcgagagtgatcatcaacaaatatgacataatgtttgtggccaccttttgaaacaaagggggaaggaccccatacatcagagtgcactaaatcaaaaggatgactagaatgagtagtgctggaagagtatggaagctgtatttgtttccctagcttacaacccttacaatgaaaaccagcatctatggaaacatgacccaaaacaccttgtcgaacaagggtagataaacgagaaccacacaagtgacctaagcgatggtgccactgggcaaaagaaaacgacgaagtggatcttgatgttgatgcaaccatctggaacgcggatgtggtggaagctgaaggaaggtgtaaggtgtcaaggatgtagagggatgtggatcctctacgacgatggccagttccaatgaccctcttgctctgacggtcctgcacataacaaaatgagtcatcaaaaccaacaaagtagttcatatcagcaagctggccaatagacataagattcatggacagctctagagcaaaggagatggcaggaacagaaaacttggatgtgcaaagagaaccctgatgagtaacagaacaaggtgtaccatcagcagtctgaacagaggcaccatcccgcactggctggcaagacacaagctgagagtgatcagaggtcacatggaaagaagctccagagtccagaacccaaggctgggttgcagcaacagcgggctgagggagaacagatgtagaagcacccccccttctgtcgtcgtctcgcagcc

SEQ ID NO: 29997 - DNA, 847 bp, Triticum aestivum
  Clone ID: PAT_TA_29997
gggttcttttttttttaattaatgcaagattctgccatttcggaactagtcttgttcatttctgtccttgtcatgcgaggagctacacatgaaatattcccgcttttgttctaaaccatttgaaacatcacattactttactttcaatcagtacacaaaacaaaacaccttcctcatgtgaggcggtccgttctcttcattatttaccggccggcaaggcaatacatacatacatacatacatacatacaagttaccgatgataattacgaacagtcaagatcagatgctactactatctccttccttccttacctacaggtgcagagacaagccacatctgggagaaggcgtccgtccgtctgtctctctctctaagaggaggatggcttgccctcctcatcatcctcatcatcagcccttgaaccacaggttccgcagcagccccggccttcaccccagcgccatcagcgtccccagggtgcacggcacgaggtagcgcagcgctggctgcccatgcccgtccctcacgttcagcgccacgtacgtgatcaggagcccggtgccgtaggccgacgctgaccacaggaagtaaccggatcgcaggctcttcttctgcgcggcccagtcataccttatagcaaacgcaacgacgaggccggggagaaggatgtccccaaagccaatgatgctgtacccgccccacgggtcgaacatccgcgggatcttgagcagcatcggcacgccgtctccgtccgggttgccgcctcccgcgccccctatcatcacgctctcgtggaacaaactttggagacgaacacccagaagatgtcgtacaggaacgcaca

SEQ ID NO: 29998 - DNA, 745 bp, Triticum aestivum
  Clone ID: PAT_TA_29998
aaggcattaatgagttcctgagtccgtgctacggaacatgattacattagtttcagcgcatcgagttagatgaggacacgatggtgtgaaaatcacttcaggcaggcattcccaaactgcaggtgatcttgtaaattcgtaaaaacattcgttgcgtgaggcactctacacttctgctcccagtctagttatacagcaaagagcgatgatagggataataggatcctgaatcacttgaaggcagggcaaaatgaagagttcgccatgtcaccggcaaggctgcacaggggtaggggatgaccttcagagcagacattggaaactaccgataccgaagaattaggcccaattaacgatcagaagataaattctttcaccatcacatctgcaaagccaccacaggcaatctactagactacttcgctgctgaattagatgctttctggatctccgttgttatcgcctcagcaaggtctgatgccttatactcagctccaaagcatcttactgtctccaggcatggatctagcaaatacatgttatgagaactttctacaatataatcctgaccaacttcaccaacttttttaaagaaaatgcggtattcttgtgccatctgtcttattgcatcgactgagcctgttaatcctgttattcttgggtcgaattcactaagatatgccttaagctgagcaggtgaatcacgttgaggatcaagtgtgacgaagagtggtttaatcttgat

SEQ ID NO: 29999 - DNA, 765 bp, Triticum aestivum
  Clone ID: PAT_TA_29999
gccacccggtattgcttgtaaaaatgatttgattacttttccagaaaaaaaaaaaaaaaaaaacacaaagcacataatttagaggcattttacaaggagacaagagagcacggcgagagaaaatagaagaggaagatatcctgaattcctgatcccatggagagagttgcctcgcgctgtgtcagcctcctagcacaaaggaggggctactctgcggccgtgaccatggtgaaaggagctgggaggagcgccgccgccaccgaggagaagaccgctgtcgcggcgaagagcgcaatggcggccaagaaggacgtgggcactggcgctgagaaggccgcgtgggtgccggacccggtgactggttactatcggccgtcgggcggcggcaaggaggtggccgcggctgacttgcgcgccaagctgtgctgctaagcaaagcaagcgaactaattgacggccgcccaccaagaacatttcctcccttaagcataatcgtaaaactgaagattgtgaggcgtttccacagctctgatcgagcatggctttgcctctcttttttttttgaggggagcatggcttggccttaagatacgtgctctcattgatcgctatagtccactttctcctaccgcggcgtgtccaggagaattcgccttcctgcttctcttcccgatgttcggctgtttgcttgatacaagaatataattttgtactgattgattaaataatgagtacagtgattaaacgacgtggagtttgttcatc

SEQ ID NO: 30000 - DNA, 1130 bp, Triticum aestivum
  Clone ID: PAT_TA_30000
cgtagtttggccttcatgtatgcatgcatgcagctgtgtgttccaattcccaaactagatgcaacttgcaagtgttcctccaactgtttacgtcaactcggccgatccaactctttgtagcccacgctgctggtagctgcaagtcgtgaacgacatcaattaatcgccctctaaatgcaccaccaccttgcgcaccataagtccataaccactccattgtgggccaaacagtgaacagcaaacgtaacatatcgcaggggctaaaaaaacatccccccgtgtcgcaccccaggcggcaccgggggcgacactcctccgccgccagcgacccccgcagcgggatccatctccgccgctgccgccggccgttgccgcggtggcggcgggccctgctaccaaaggcggcagggggcttcgattttgcgtctggaggcgtcgggggaggggcggagcggctggggcgtcgtccggccatctcgtcggcgcgaggaagccggggcggcggccccgggagacggtggtgcccttctttcttggcgggcggcaggaggtcgccggagggtgcgttctgcagcggttcctcggccgatctcacctcggtcagatctgcatctggcgtgggtcggaggggcggccggtggtggctgtagtttgctatggtctgctggtggtccggtcggccctgcggtggactgccgtggaggagctccggctgctccaagctttggtggtcggcggcatgcagcagttttggggacagcgtggcaatgcgaggtccagcaaggaggaggtctccggctgctctgttctttggggtggtggtgctctgctcgaggaggccggggcggcgacggtgcgggtcgtcgtgacggccgggttggacgtgtgaggtgcggcggcagctgcaccatgaggtggaaccggtggacgtcgaccatggagattgtgtgtgtgcagtgctttggatccgctcggattcggaggtgtggaggagcttcgggtgaaagccctgcacggactttgggtcggtgccggcaacggcggcgccatggtgtcgtttttcttgaaggcgttgtcgtgaagctctattacacgactctccgggagaaatccctagttttagttggttg

SEQ ID NO: 30001 - DNA, 962 bp, Triticum aestivum
  Clone ID: PAT_TA_30001
cgctcgctcactcactcgctcgcccaagattctgcaccgcgcgggcgggcatcagcctgtccaggtcaaagcccgtcgaaaccacgcacggcgagacgcagtgcggcaatggcgcggggtgggtcaccggggatcgacgtgaaaccggcagcctccgcgcgcctatccacacgcgcacgcgcgacgtgattgccccgttcccgatcgcaatctttttccgttctcatatgcaccgtcgcgctgagcttcacgctttaccggccaataattccggcctcgcatcgcatctttcgggcggagaagtatcacggcgggcggtggcggacaggtgaggtccacgccgacgtgtcaaggatgctgcggggtacgtagggccgccgcccccgcgctttctatcctgttcgccacggacggcgacggcacggccggtggcgacggcgccaggtgcggatgccgccggtggtttgtgctggcggacgggaccgggacacgtccctctcccgggccgcacaggggaaaagggcgggagatcagattagtataactctggaaaagcgcgaatcgcacggggaggggatcggcagagagcgagcgggagaattatttgcggaccgggaagcgacgtcgcgtccatgccatggtcgacacgacaagctgctgagctcggataggaagagataaggaaagaattcagcgccaagcttgctggagagattgcacgagacgtctgatcttgccccggacaggcggcgggtggaatgatctcgtggaaaggtgtcagtgcctctcggccgcattgatgctgcctgctcaaatcggggtaaacggaatgggttcttgggtattgttcgagcggccctcgtctcgtcggagtgggtcatatgatttttttttttttttaaattccgatcaattcatcaaacatcatgacgatataaggaacacgagaagtattaagaatt

SEQ ID NO: 30002 - DNA, 579 bp, Triticum aestivum
  unsure (1)..(579): unsure at all n locations
  Clone ID: PAT_TA_30002
ctcctacgaacccacgacacgtgaaccgaccccgagtgctgacccactaccttgcggcctattcgcgccgccgcctcgatccgccgcctccaactctcacccgcgtcgcccccatcgatcctcgccgccgttccctttgattttgaggggctttataaggatttaggatgcctcgagttggagacccatccgcatcttctatcttgagaatcacatatgagttgggataccttgcttccatcatcgcgggatgttgggtcgacggcaacctttttatacatggcgttcgttatatgtcaaccttcacagacttgagtggaaaagtgctagctatagggcggcctttgatgatagccaactctgtgatgttgcttcttgacggaatcaactcaccgtacgcacggactttaagcctcaccagatgaaacttttgtataaaatatggtgtgtctcctgaaagtttgttcgcgttattgaatgaggtgtggctgtgaaggtgaacggtgatgtgatactctgtttcttatcgttggctttcttatcgntggcaaaatgtttgaaatttgtctaaaaaaaaaa

SEQ ID NO: 30003 - DNA, 763 bp, Triticum aestivum
  Clone ID: PAT_TA_30003
gctcgcttcgcctccgccgctcccccttcgtcactccccctgcgctcctgctctgcatctcgtcctcctcctctaaccgccgttcgtccgcctcggcccccccggcgcgccgggctcagtggcgcggcggaggatctgtctttggagtcgccggagaggcctttgagatggcccaggttttgctggttgatccgtcctgattaggacctgtccgtggttctggttatctagctggtgggtcgtgccgctgctggtgtacggactgtctccctggtttccttgcagggatgtccgccgttcagttgcacttacgtggactacctcacgtgccgtcccatgcgtccgctggtttccttgcagatggcgatggctggtttgcagggtcttgttgtggggaacagaaacccgacagtccgtgtgtatgtctcgcgacactggcatcatcgtgggaccactgataatggtcctatcaaacacactgacatggtccttctggatacccggggcaaccacatctatgctgagatcggttcaataggttcaccacggccagtcctaataccaacccagaggctcagtttccattctgcacctactcactcactgaactgtcacgcctgcctgcccctctcgatgcacctgaattcttcacagatgtacttggagttatcactggtgtgtctgatgttgttcagtatcatagctcgaacaggagcgagccttccacaaagcatactatcaacatcaaggacctaagtggata

SEQ ID NO: 30004 - DNA, 467 bp, Triticum aestivum
  Clone ID: PAT_TA_30004
tcccggggcgccgggcaccatcgtaaagaacaccaagcgaaattagattcctccttagccatggcacacgctgactccccgaagcatccgctcaactccgtcaaacatcctgattttgatgtcacctactccagcgacacgataacccgtgtcatcgcccctgttcaagaattcatccaattaaccagttaacttgccgactaatccctactcatagggtcaccgagccgccgataaaccgaaaaatcgtctgattaattgattaaatggccgattaacttgccgattagccgattaatcccctactcgctagccaaccgagcagctaccagttaacgatttcctcaacaatggtcatcgcccacataggctaaaccaaactcaccagacttgtacgaagagaaccactccctgttgggcgtcgcatgaaaagagcaagctaaatccaacatccatgcttcagtttt

SEQ ID NO: 30005 - DNA, 707 bp, Triticum aestivum
  Clone ID: PAT_TA_30005
gctagccaaacacagaataaaagagagaaattctggagagcaccacgatcacataggatagacctttagactttccgtccagagagtgtaggagagtctactttgcacttggagcgtgtgcaatcgacgccggctgatcgacagagcggagatggggaggccgtcttcgacggcgaagctggtgtgcgtggccctggcggcgctggccgtgctgtcgccgctgtacatggaccgggacctcgaggcggaggaggaggaggaggaggagggctggggcctactgctgccgtcggcgctgtggctgccggcgctgctggtggtgctcatcctggccatcaacgtggcgtgcttcgtggaccggagggtcgtcaggttcgacccctactggatccaccgcgtcgggggctcctcctgcggcctcatggccacgctgctgctgctcggcttcgtcctcaagtgcaagggctaggctccccgagcgagccacccggcctgctgtggctgtgggtcgtctccgtctctccattttctttcatctcagatgaggaatcgatctcatagcagctcctctgattggccagttctctctctgctcctttatcttgactgaatcgtgttcttgagcgcaccgctatgcagtgtatagtgtttctggtgctagcaaaaggaattccgtaatgtccatggttaaaaaaaaaaaaaaaaaa

SEQ ID NO: 30006 - DNA, 230 bp, Triticum aestivum
  Clone ID: PAT_TA_30006
gaggacaaaagagaatagtatttcttcccttgttccttgtgcccaaataccccagaagcaagtggtttgttggagcgagaatgttccatgagttcgagtgtttttttttggtgattcgatgtcctctgatgttcctacctcagacaggtttgttgtagaagcgtgtgatttttacccacaccgtggaagtgtgatgacccgtatggggtgtggatcggtgcttgactttg

SEQ ID NO: 30007 - DNA, 1611 bp, Triticum aestivum
  Clone ID: PAT_TA_30007
acggcttgcgccctccccgtccttgctggcgcccggcctggccgcgaggcatcggcggctgctgcccgtggcggcgcccctcctcgccaccttgcggcatgctttcactatcaggtaagggtatgtcgccttagctgcttcgtaccttccgtttccttgtcactgccacagctggtcccgctctggttgcgctggcggtgttcctgtgggccggcctgctggcctgctgcagcctttcgtcctcgacttgcctggcaagtaccccttgggccttgtcgccaagggtccccgatgccgcgtccacttcttccccgccgacatccgcgcgccccgttgcttcctcccttgggccgggaggaccgtgtttcctggagaggccgattggttctacgctcctgtttacactacttgtgatctaactcgtgctggacttccgttaccgttcaagtctccaaggatgatgagaagcgcgatccagttcatttcaaagaggtggcctttctgggaataggactgatggaggagatcatttctttgtcgctccacatgattttgcggcatgctttcactaccaggaagagaatgctattgcgcgtggaattcttccgttgctacgccgtgctacattggttcaaacatttggacagaagaatcatgtttgcttgaaagaggggtctattacaataccaccatttgcgccaccacagaaaatgcaggcccacttgattcctcctgatactccccgttcaatcttcgtttacttcagaggtttgttctatgacaatgggaacgaccctgagggtgggtattacgcaagaggtgctcgagcttcattgtgggagaacttcaagaataatcctctgtttgatatctccaccgaacaccctgccacttactacgaagatatgcagcgctccgtcttctgcttatgtccgttggggtgggcgccatggagtcctaggttggtggaggctgtggtttttggctgcattccagtcatcatagctgacgacatcgtgctgcctttcgcggatgcaatcccttgggacgaaattggtgtttttgttgatgaggaggatgtgccaaagcttgattcaattctgacatcgattccgattgatgatatcctaaggaagcaaagattgctcgccaacccatcaatgaagaaggccatgctgttcccgcagccagcgcaacctagagatgcattccatcagattctaaatggccttgctcgcaaactcccgcacccagagaccatatacttacaaccaggtgagaagcatctcaactggacagctgggcctgttggagacttgaagccttggtaacataaaagcttccttgcaagacctggctttgttgatcttgtgaaaagttctgtttcttttatcacctttctctgagaagtccgaagatccatagaattatacgatattgaagtgtgttatatcctctgatgtcactctaactaaaaatagtggatcttacataaacggttgtaacgttgtaactgtattaattgtataaagaagtaaagaaatgaaatgagtgttcttgtcaccttgtgaaacctaagaatcaaattcattttccgctaaaaaaaataga

SEQ ID NO: 30008 - DNA, 1363 bp, Triticum aestivum
  Clone ID: PAT_TA_30008
cccgaactagtcccgaaacccaccaccagtctgtgtgcccatggcgaccttctccaacgaggagcttctgcaggcgcacaccgagctctgggacctcaccttcggctacctcaaatccatggcgctcgagtgcgccatcaagctcggtctcccaaacgccatccaccgatgcggcggcgccgccacgctgccggacctgctcgacgccatttctgtcccggagcgcaagaaggcgcacctgcctcgcctcatgaggtttctcgccgcgttcggtatctttactgtcaacgcacctgctgcagaggagtgcgcggatggggagaaggcgagcgccgtctacggcctcacgccggtgtctcgcctgctggtggacgacgccggcgccaacgggtcgtgcgggagcctctcgccgttcgtgctctcccagacaaccaggtaccacgtgaaagcggccatgcacctgccggagtggttcatgagcgatgacggcgcggcggcggtggcgatgccgttcaggatggcgcacggcacagacctgtggggcgtcatggggcgtgatcccaagatgaaccaggtcttcaacgcgggcatgggttccgacacccagctcgcgatggacttcgtcatcggcaactacggcgacgtgttcgagggggtgacctcgctggtcgacgtcggcggcgggaccggctccgcggcgagggccatcgcgagggccttcccgcacgtcaagtgctccgtgctcgacctccccaacgtggtcaattccatcccgcccgacggcgtggtcgagtacatctcaggcgacatgatgagctccattccaaacaccgatgcggtgttcctcaagtacatcatgcatgactggaacgacgaggactgcgtgaagatcttgacgcagtgcaagaaggcgatccccgaatcgggcgggaaagtgataatcatagacatagtggtcggatctcctttgaaagccatgctggaagcccaagtctcgtttgatctgctgatgatggtgatcacggcaggcaaggagcgtgacgagcacgagtggcgcaagattttcatggacgcggggttcagccactacaagacaaggcctattttggggtttatggccatcaccgagctgtatgcttagccatgccgtgcatgcgtgattacagcagatatctgctgtaacgtgtgtgtaagcgtaggtcctgtgatgttcatcgtggttgtcgaagtgtctttttgcagcaacaatttgttcctacgtctttaaaggctcccatatttgtatgatctgttgctcggctatatggacttaataaaattagcgttttgaggtgattcttggctctatattacttcggaaaaa

SEQ ID NO: 30009 - DNA, 1133 bp, Triticum aestivum
  Clone ID: PAT_TA_30009
catgaggttcgggagaagtgctgcaagcagctgagccagatagcaccacaatgtcgctgtgattctatccggcgagtgatccaaggcaggctcggtggcttcttgggcatttggcgaggtgaggtattcaaacaacttcagagggcccagagcctcctggcccacaaaatggtggaagagcggctgtgagcatgaggttcgggagaagtgctgcaagcagctgagccagatagcaccacaatgtcgctgtgattctatccggcgagtgatccaaggcaggctcggtggcttcttgggcatttggcgaggtgaggtattcaaacaacttcagagggcccagagcctcccctcaaagtgcaacatgggcgccgactgcaagttccctagtggctattactggtgatgatatagcctctattcgtgccaataaaatgtcacatatcatagcaagtggcaaataagagtgctgagtgatgatctatgaataaaatcacccttgtatattgatctgtgttcgagatacctgtgtattgagtttgttggtggtggtttgtgtgcatgtgtgtgcttctttaacaataataaaaaatacaacttgttcgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaataaaaaaaaaaaaaaaaaaataaagtgggcgccgttttaaaaaatcaaaattgtaaaaaccctgctgtgacccaattaatttttttttggggacatcaaaaatttattcagctgggggattataaaaaaggccgggagggaaaaaccttgcgaacacccaaataaactgattggaaaaaaaaaccccctttgcagcggggcattaaaaaaaaagggccccggaggttacccccttcaaaaaaagttacacttcccaaaaggcaaagggcccccccctttgatgggttcattatactgggggggagggggggcgcccccccccggaaacctttaatttgggggctccctaaaggccgcccatttagtttttttcccttcctttttccccaaaaaacttggtttttc

SEQ ID NO: 30010 - DNA, 1107 bp, Triticum aestivum
  unsure (1)..(1107): unsure at all n locations
  Clone ID: PAT_TA_30010
tgggtnccgggccccccctncgnggtcgacggtntcgataagncttgctatcccagtccgcggccaaaacaacattgaaaacatgaagaccttattcctcctagctctccttgctcttgtagcgagcacaaccttcgcgcaatactcagaagttggcggctggtacaatgaagttggcggaggaggtggttctcaacaatgtccgcaggagcggccgaagctaagctcttgcaaggattacgtgatggagcgatgtttcacaatgaaggattttccagtcacctggcccacaaaatggtggaagagcggctgtgagcatgaggttcgggagaagtgctgcaagcagctgagccagatagcaccacaatgtcgctgtgattctatccggcgagtgatccaaggcaggctcggtggcttcttgggcatttggcgaggtgaggtattcaaacaacttcagagggcccagagcctcccctcaaagtgcaacatgggcgccgactgcaagttccctagtggctattactggtgatgatatagcctctattcgtgccaataaaatgtcacatatcatagcaagtggcaaataagagtgctgagtgatgatctatgaataaaatcacccttgtatattgatctgtgttcgagatacctgtgtattgagtttgttggtggtggtttgtgtgcatgtgtgtgcttctttaacaataataaaaatatacaacttgttcgatacttcaaaaaaaggagaaggagttggaatgctttagcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttggtaaatcagctcattttttaaccaataggccgaaatcggcaaaatcccttataaatcaaaagaatagacccgagataggggttgagtggtgntccagtttggaacaaggagtcnctttttaaagaacgtggacttccaacgtcaaaagggcgaaaaaaccgnntattaagggcnatgg

SEQ ID NO: 30011 - DNA, 861 bp, Triticum aestivum
  Clone ID: PAT_TA_30011
ataggggagcctccaaaatgtcggcaagcatcttatgtcgaaaagagcacagtggcatcgaacaataacactccaccaagtgccctatgtcttattttacgacagattttcaccttaattcaaaccatacaaacctctagcttagtctatttgctcgctagataatttggtagcatggacttggccgcggcgacgcactttcctctgatggcggtgaagtgggtcacaagctggtcccgatccggcaggcacttcgtgacaacttcattggcgttgtagtcctccatccactggcgaatagcaggatactcatcatccctcatgacggttaccccagcgacctcttgcagcacgcctgcccagtgggacagcacgctggcgccggcgatgtcggctaggccgatggcagcgcctccgaagaatctcttccccttcagctgcatctccacaatcgtcaggtgttccttagcatcctccatgagaactttctgtgtctcgccttccgtccacagcgccagccacaccgacatcaggcacttatccgcaaagaacttggcccagaagcgggccttggccctctcgctggggtcggttggcaggagcggcgggccgtcgaaggcctcgtcgatgtactcgaggatgaccagcgactcgcagatggccttgtctccgtggaggagcaccggcaccctgtgttggacggggttgtggcggagcagcagctcgctcttgttggagaggtcttccgtgatgagctcgtaggcgactcccttgaggcgcagggccacctccgcacggtggacgaacgggctgccgaaggctccgatgagcttcaccggttcagtcatcttgcttccatgt

SEQ ID NO: 30012 - DNA, 878 bp, Triticum aestivum
  Clone ID: PAT_TA_30012
agcaattccgtacttttgactataatttgacataaatttcgttgcaacaaatactaatatgaattttattttagtatacgcaccatagggaacacacacataacagacaaatcacaaatcataatacagtacgtaatctgaatattttgccgacgcctgctgtgttgatcgatgccccaaactgacaactacgcccgccccaccatcgcgctgacggcgagcttgattcggtccttcttcccggcgaagtgtgcggcgagctgctccctccgcggtaggcacgcggcgacggtcgcgtcggaggtgtagtcctccgcccaccggcgcagtgcggggaactcgcccgcgccaacaatgctcgccccggccacctcctcgatcacgcccagcaggtgcgccagcccgcaggccgccaggtccaggtacccaacggcgtcgccggcgaagaaccgcttcccctgcagccgcgcatccagcagcgccagattctccttggtgtccctcacgaacccctcccgcgcctccccgtcgtccaaccacaccgccatccagaacggcctcgagcacttttgctcgatgaattgggcccagaagcgagccatggccctcccgtaggggtcgacggggaggagcggcgggccgtcgaaagcctcatccacatactcgacgatgaggagggactctaagacggccggccggtcaccatggaggagcaccggcaccgtcttgtggatggggttgtgcttcagcagcagctcactcttgttgttgaggtcttcaaggatgagctcgaatgggacgcccttgaggcgcagggccacctcggcgcggtggacgaacgggctgccgaaggcgccgatgagcttcaccggttccgc

SEQ ID NO: 30013 - DNA, 867 bp, Triticum aestivum
  Clone ID: PAT_TA_30013
ggcattgaacaataacattccatcaactgcccctatgtcttatttacgagagagcttcgtgtgatttaacccccagcaacacggagttaccaccaagcttagccgcttaggtctatttggtggctagataattgggtagcatggacttccccgcggcgacgcacttccctctgatagaggtgaagtgggacacaagctgctcccgatccggcaggcactccgtgacaacttcgtcggcgttgtagtcctccatccaccggcgaatagcaggatactcgtcatcgctcatgatggttatcccagcgacctcttgcagcacgccagcccagtgggacagcacgctggcgccggcgatgtcggcgaggccgatggcaacgcctccgaagaatctcttctccttgagctgtgtctccactatcgccagatgttccttagcatccttcatgagaaccttctgtgtctcgccctccgtccacagcgccagccacaccgacatcaggcacttttccgcaaagaacttggcccagaagcgggcctcggccctctcgccggggtcggttggcaggagcggctggccatcaaaggcctcgtcgatgtactcgaggatgaccagcgactcgcagatggccttgtcgccgtggaggagcacgggcaccctgtgatggacggggttgtggcggagcagcagctcgctcttgttgaacaggtcttccgtgatgagctcgtaggcgactcccttgaggcgcagggccacctccgcacggtggacgaacgggctgccgaaggcgccgatgagcttcaccggttcagtcatcttgcttccttcttcgtgatggttccgcctcccgcccgccgcctgagcggccg

SEQ ID NO: 30014 - DNA, 2072 bp, Triticum aestivum
  Clone ID: PAT_TA_30014
gtctagtgaagcccgccggcccttgcgctctttgtctggcgaccggcactgagactggaccaataactgaagacttctgctaacaactgtttaatataaactgctgcttataaatttacaatgccggtcgtcgtcacggcggctcatggtaccattactaacataaaaaacatcaattcaccagactgacggcgaagtggctacggatccagttcacacgctcacagggagcttctcatgcttcggaggcaaaactgtctgtcttggtggactcctccgcatcagacggcttcgattcgtgcatcgctgccgctttgagaactcggtcctgcaccgccgtcgtggagggggacgtcgccaggccaatcttgtttggctctagcttcttagctgcccacgagaacgcttccgcgcccactcttactggggacagcaacagctttaggtcttgcaggaaatcctccgaaccctcgtatgtagagaaccgcaggtagatcgtcaacccaatactaagaacaccgatgtactgcaaagtcgtctcccattctagcaaagcataagtcactgctgagaagcccagaagggatccaaggacaagtgtaggggtgggctttatgccttcgaggatttcctcagcatcctcatttattactgtcaatgcagtctctggtttcagttctttcacgcgaagattctttgcccaagattggaaacctcctttaaccaggtaaggttgctgaacaccaagcttcttcagcagcctagcaatggactttgatcgggttccattagcatccataataatgacctttgaatcacccttaaccaacttcaagttgcggattacaactgcaaccaaagcatcatcaacttcgcttccacctttaagtagcttctttgttggacctttgatctcaggcgaagcaacgcttgcatatttagatctagctgcacggcgtaggtcaggaattccatctttcaccctcaagtcctcaggccgaacatcaacaagtacggctttgccatcacttttcaataactccaatgtcgattcaggtgacaagtctccagaataaccaccatatgcgaagagccagtaagatatccctattgttgttgaacctccaagcaaaactgctaattgaacaattgggtcacttgggttcaaaccaacattctttccgatgccttcgatgataatgtatacctgttgaagggcacttccaattggtcgcaatactatgctagctttctcctcggatgagttcagcaaatctttgacatttggtggcaacgacgacttggccgagccatagtagtatacgagggacgtggttgcactgcccagtgaatcctctgcaacaacaattgccttcctaagaacatcagccgccacggcgccagctccggccaccttatcctgaaatgcgccgggaacgtccgggaccccaccggcggcctgcttcttggtggcagccaccgaggacgtgatgccaccagcgacgccccttatcgccttcctgtaggccccgagagcgtcgtacgccgacagcctgagcttgtcgtagccttcggtgagcgcgtcctccgcctggaatatctgcttgctgagcttgtcgatgaacctggccacggactcctcgacgccggtggcgtcggccgggaacgtggtgggcatctccgcgtccatcagggcctgctgcgcggcatcgtcggtgaccgcgccgaccacagcgtccgcggccaggtcgacgggcatcagcggcgggtcgaccccggcgcgccagagagggtcgggcagctcggcggcggaggcgaacccccgcacgatgtcatccggcgcggtggcgtagggggaaaggatggcggagtcggagaagagcgggcggtcgggcaccgcctgcgcgacgagcgggtcggcggcgaagggcctgagcgcgccggcctcgaccctccgcagcgcccgcgcgccggcggtcaccgggcagaggggggagcatggggtgggcgcggcggaggagcagaagggcagcatggcgggaggggtggtggcatcagctcgtgccgaattc

SEQ ID NO: 30015 - DNA, 1744 bp, Triticum aestivum
  Clone ID: PAT_TA_30015
aaaggtataatgggcagcaattcattgaacaaatcacagcaagtttattacaaagtatagctcggatgaaatccagagctacaaaccaagcaccatctaacagcatcctccgcagaccgctaccgaatgcctgcccgtcttcgtgcgcagaggaaaatccccacaagaacttttgcgaattctggcttctcagcttcaggatcaaggaagaagcacagaaagcgaaatgccccgcgccgcgtgggtgcgaccgatcgtcgtcatagggtttgtgcgcgatgccctgcagggtgagcgtcctagggcggattgtgcacacggaacacacaaacagctcctctttagaaacaacatggttcagactgtgatgctgaaaacgcacaggctttcataccaaaactctgcctgtttcatcggtcagtacacaggagagaaggaacccaacatacattttccccaggtttatattgtttttcttttctcgagcctatttcatttcacaacaagaggttgtaagccggcaggtcctggatccgcaggaggtcctccagagacagctccctctccagctgcgacttcgtcgcttccagcacatcgttgaactgcatgtaggaggcgcgcatcgccagccactgagcgtccatcatctcgaaggctatgcagtataggatgtcgaacacgtcctcgtgctcggacagcatcctgacgaagttaatccccggcaaagttttcggtcgagctgaattaagctccaacagttggatcaacatgtgtgagacgttaacgcctgctgtcgcaaaggggtattcccatgtggctcgcattccttgtgttttcagcaacaatttctggaaagaagccgggtatcttcttgcgaagaatagaaggttctcaagtgacacaaatccacagcccctggaaatcagttgcaggatttgggccctgccaccccatatctttccactgttcggaaactaagctcgtgagctctgtatcgggaaaggaagttttccaaagagccttcagggatgtcagatgatccggtcgggtctcgtcaaaaggtatgtttagtctgtcctttaatttttgcatcctttgttcctgaagaggggtcatttcaaagttcttctcggcatggacttgacgctttttacctgagccagtgaaaagccctccaaaccatgtcttatttccgaccatagcattaaccttggcagcagttgccatatttggcttcggagtggatgcattttttgcaggttgccccccaaaaggttcagatggagaagtttcctttttgatcattattttgttttctgctagtagggccttcgcttgctgtattccctgctgggattggagctggaacggaatgcccatcaaagaagagggagctatggcgctggctcctcccgacgccccctctcgcccgccgcccctccccgtagtcctcctcgcccgaccctccccgacgcgcgcgctaggagaaggcagtcagcggtgtctggacgcccgcgcatgagcggggggaatcgccgcctcttgcgcgcggcgccctcccgccgccggccaaagaatcactctttcccgactgcctgtccttgtccttgccgcgggacaagggagagggagagggattgaggttgggaggttgggagggagggaggaagaggaggacggaggaattggaaagagggtttccaatccggccccctcctccttccttcctttcggacgcgtggga

SEQ ID NO: 30016 - DNA, 2658 bp, Triticum aestivum
  Clone ID: PAT_TA_30016
ccatccccttcaattgtccgacatccataaaatattatgcacagcccgtttgacaacacgaatacaccgaagcgatgatggggattccattttatgcacatcttaaacaaaataaagatgttgagcagtgcaacatgaatcgattacaagcaaactaaccgacaggatctaacacttttgctggattgtacctggttgacagacaggcgaacataaacatcatagatacaacacgattacaagcaaaataaacgtcagcatctctagcatacactgtcccagtatagtcatgcatgcttatttacagctgttctagtagatttacaacggctctggcagaatagcacggcgttagcgtggcctggtccatgagcttaacccacgaattatgccatatatccatcagctgcaaagaaaggaagcgacttcagtggcatcacctgctcctcggcgttctccagatgttccgcagggaaatggagcccagtggaacagttctgcagcacctcaggggtcttcatccacgccttgtgggcttcgatggacttcagcttgtagcgaaacatctcttctgcccaatggcattgtttttgccgttcttctccctctgctcttacccatctttccaaattgatcagccaacacctcatattggcacaaaacagtccagtgctgtaagcatgaggtgtgaaatagatgaaaagccccgctggagtttctactgctgcaagctaggtttcctgtgctgcagttcagcaaggtgggcatgaactttccaggaaagcattgatcgccctggagtttctactgctgcaagctaggtttcctgtgctgcagttcagcaaggtggccacatcctttccaggaagcattgatcgcccacaaatatcacaaactttctcagcagcaagtcgcttctgcttcctcagctccctcctcatagacttgctggacaaggggctgagttgaagattgcatgaggaacctgttggggaaccagtaacaatagcttgacttctgctgtcatgggtctggccattagactcttctgaagatgcttcttgatcagaaaatgacttcttccttcgctttccacgatgtccagcctcatcaatgacaaagaaagatccagcagagatgggaaggtcctgatcttcagaaggccacttccttcccaactcatatgcataagagaagttgactatggcaaaaccagattgttcatagatgttacttgcctcagagcccagtgaggcttcttctcctacccaagcacaccagattttgctgatcttcttgcgaccttcgcctagcttcagcaattctggtaggcaatgtttccataacccagaagatgcacaggcaaattcaacacaacatcctttatcaacacaccaggaataacaagcggaccatcggtttcactgcggtttgacagagcactatcttcagtttgcgccctgcagcccccattcagacgtccatttgcaccaatgaatgagccttttgcgccattatgggagctcgaaccatctctcaaccttgatgtcacctcaaatgccattccctgcaaagtcaggatggggaaccagagcaagttcgctggtgttatgcgagcttgagtccagcaagagcggatcattctcgcgtgagttattgaagaagagcacaccatcattgaacggccatggcatgggcccaaacagggtgaccttggcctcggcataccgccgtgaatgcagattccccttgaggtggtcaaacagcacattgtcgctgaagcactcggtgaggcagatggtgcagaagaagatgacgcgcttcccgacgcgccggagctccacataggtgtgcccattctgccgcacctcccgcagcgtggccttggcagcaatctcacggatatccacaggagcattccgttgcagcaccaaatccttccccaccatggtgaaatcccctcgagtcaccaccaccagtcccttcaaatccgcctctctagcttacaaattccccccaaatcaacctccaagactacctcctccctggttgtccctccttgcaactctctcaagtttccacacacagaaaaaaaagtcgccgcacttgagatcttagtttcctcccgagccctaagattgcaagcttcttaacaaaaagagactgtaactggtagtacacgaatagaacctaacacggacggtcgtattcgtatctttccagccatgggaatggaagcaagcgtgaggaacctgcccagcagcgcgaactcctcgccggtggcgccaaccctagtcatcaaatcagacacgggaggcagcaaaccctagactcctgacgcccgccaaattggcgcgccggggggtggggtggggaagcgcggctggcgagagacctagcagaggacgacgacgagtcgaggctgctgtggcgggggaggaggaggaggctgatgcaggctgcggacggtgctcggcgaggcggcggaggagcggaggcggcagtcggacaagagcgccgagggcgacgaggccatgtagtgccaacacggcggcgagggaggtcgtcgccgcgcgccgttcgccctccctttttttcgattgtttgcttggacggggaagtttggtctggagggtggtggacaaggaagcctcgtgc

SEQ ID NO: 30017 - DNA, 1046 bp, Triticum aestivum
  unsure (1)..(1046): unsure at all n locations
  Clone ID: PAT_TA_30017
gctggcgaatggcgaacccaaggccgtgggcagtgcttggacctccagacaaaccagcgcccgccccagagccacgcccattacgcacgatattaagggctcacttattaatcatataaccaaagccgtgggaagtttttagacaaccgaacagatcagtgatggaaacaacgacacgaccagacaagggcacccattggagaacaacggcgacacaagacctgtgaaccctggagacagaagcaacgccatgaccagtcacttactggccaccacgcaggcggagaaccaggtggagggtagactccttctggatgttgtagtctgccagagtgcggccatcctcaagctgcttgccggcaaagatgaggcgctgctggtccggagggatgccctccttgtcctggatctttgccttcacgttgtcgatggtgtccgaggactccacctccagcgtgatggtcttgcccgtcagggtcttgacaaagatctgcataccaccacgaaggcggagcaccaggtggagggtggactccttctggatgttgtagtcagcaagggtacggccatcctcgagctgcttgccggcaaagatgaggcgctgctggtccggggggatgccctccttgtcctggatcttggccttgacgttgtcgatggtgtccgaggactccacctccagcgtgatggtcttgcccgtcagggtcttcacgaagatctgcataccaccgcgaaggcggagcaccaggtggagggtggactccttctggatgttgtagtcagcaagggtacggccatcctcgagctgcttgccggcaaaaatgaagcgctgctggtcccggggggatgcccttccttgtcctggatcttggccttgacgttgtcgatggtgtcccaagacttcacctcaccacggaatgggccttgcccgtcagggtcttcacaaaaatttgcataccaccgcgaaagcggaacaccaagtgggaggggggactccttttggatgttgnannntnncnnaatncggncatncttaaactnnttgc

SEQ ID NO: 30018 - DNA, 1310 bp, Triticum aestivum
  Clone ID: PAT_TA_30018
gaagcactctatttatctgtgctgttatatagcacgttccttcctcgcgccgtacaaaagtacagggtgtagttcagataacaaaaacaaaaatactacgacacctcagagtactccaaacaagtaaacctaggtaaacaaagcagttcagcaaagttaatagtaatgatacacttggagatgactcatatttcagtcgtcggcacagtagattgttctttccctctgctcttccccggagataataacctatccaggagtcgcttccaccactgcaccaaaagagtgattctaagattttccattttcacttctaacacaatgtcttttgttagcaacatcggcttcttcatccccatcaccatcatcgtcatcatcatcaacctcctcttctaaacacttgtcaagatctccgtttgcagccccttcaggtgaatcatcatcatttgctgctccagcttctcctcgtttcctcggtgggatcacatgaaagaatgccgtcttccagtcctttgtttccacaaacttttgcattatctcaaacacttggttgactgtaagaacctgagaacttgacatctttaaataatttccaatggggagtttggcagactgaatgccctgatcaactgcctttttctgtgttatgcctttccatctgttccgatccactagaccaccaatgatatatatttttgacatgtctagttcatcaaggacagtctcagcatccgctgtaagatacacaagattttctttacagtctgcaaatgcttcaaggtaagacttggcctctttttctatgatccacttatcaaagccaggtatcctttgaacctgggtccccatttctccgctgcaacctgtcaaccatagatgagccggagttgctgatcttccgttcactgcatagcagtacataatctgctgcgtgaggctgtgaatctcgttgggccgcatgaggtcggcgaactcgaggtcgagcaccaccttctgcccaccctcggcggcgcgccggagcctctcggcgcgcgctccccgctcctccacgcgctttcccacccgctcgagccgcgtctccctgcgcgccgccagcatcgcttcgcgcgcctcctgcgacggcgccgcggccagagactcctcccactcgcgcctccgccgctctatgtcggcgcgccggcgctccttctcccccgccttccgctcggccttgaacagttagggttagatgggagaagaattggtacggcgagatcgaaggattggatttggagaggggggattttgggtgggtgcatcttttttctttt

SEQ ID NO: 30019 - DNA, 339 bp, Triticum aestivum
  Clone ID: PAT_TA_30019
ggatgacaccattctaggcttctcatcgcagataggttacagggaaatcggcaaaatttatacagattaagggggaaagcggcaaaatttatgcgacaaaatcgatttacttcacatcgttcccaaaaaagaagtacaaaagaagtacaagtatgtaaaacagtaaatataacaaaaaaaaagaagctacgatcactgttaggagtatggcgttttattagggctgacaagtgatattaacatgcacagcgccttcatctccaccagactgaaactgagaccatttggacagctagatgcagtgcagcattccatcctagagattgcagcttgaactcc

SEQ ID NO: 30020 - DNA, 974 bp, Triticum aestivum
  unsure (1)..(974): unsure at all n locations
  Clone ID: PAT_TA_30020
gtatacatgacactttataaataaaggatagaataaaagacagtacggtgaatggtttcactggaatttggatgacaccattctaggcttctcatcgcagataggttacagggaaatcggcaaaatttatacagattaagggggaaagcccggcaatttatgcgacaaaatcgtttttgcgacaaaattgatttacttcacatcgttccaaaaagaagtacatgtaaaacagtagacaataaccaaaaagaagaagctacgatcactgatacgagtatggcgttttattagggctgacaagtgatattaacatgcacagcgccttcatctccaccagactgaaactgagaccgtttggacagctagatgtagtgcagcattccttcctagagattgcagcttgaactccagacataaagcaatggggcttcacaggtagcacatgctttgttgccaccgaatgcccacattgtgaacaaaagagcaccaggctacacatagtagatcataccaacttctatcagactaatatgagggatatgcagtgagactgatgggcctctgcagttcttccggaggaaagagtaggcaacatcgatcgcaaacttcttcacgaaattggagctcctcctagctttgatgtaagaatggcccatgatatacgcagcccctgcgtgtttcgcctccacgagtgccaataactcatctttcacctgctgatccatggcgtcctcatttggcagctcgaagcgaacacggcgcctccggcctgcactcggtgattcctgctcataagaggactgcaagcttcgaaggctctcggatttgctgctcctcgtggtagaaatggactcagctaggccacccagatctctcatgcccagtggggtgccagcatcgtcggtggttcttatcacagccattcttccctcgtntagcaatatcataacttgctgaagacgagacacccncag

SEQ ID NO: 30021 - DNA, 902 bp, Triticum aestivum
  Clone ID: PAT_TA_30021
gcaaaaaccgtcttaaatatttaaaaacagaggaagtagcatttggggacgacttggaaatacaacgaaagactgaatcttggcagctgcaaggccaactcacgtttctgcaatgtaaaaacagctgaatcacaaatagagtactactggactagtaatatggatgggttcagggccgcctgttcctaaaaaacattttgagatcttcgtctccatcaaaaaagtccatggcttcgagcgcagcctcccgtgctgggtcgctgcaagctcggacctgttccctgtgagccaggtagtcgtcgtcgacctccacatagccatacttggggtactcgctccgtacccaggcctggaagatggagaattcctctgcagcctcatagaagtcgcgcgatcgggatgggtccaaaacccggaaaggatggaggggcgcgatcgggatgggtccgactggaaaggatggaggccacctccgcccgcggcagccgcctcatctttctgcttggacctgacttggcgtagaaggccttcttcttggcggcgagcagctcgtcgtcgtcgtcgcctgtctccgccttccttttggcggcgcacggcttcagcgggcgcttctccgtcgaagcatctcggcatggctttaacgggcgctcctcgccggcggccaacgcatgcttggccgcgctctcgtcggacgccatgctcccggtgatgcgcgaaccctcctcgcgggccattggtcgctgatctgacctcccgaggaagcctcacacagcgcgccgcgagatttgttggagactcgaggaaccctgctctcgaattgaggagcaatttgataaaacggcacacttttcctcgtactttgatccaatggcacatcttttttttattggattaaacaacac

SEQ ID NO: 30022 - DNA, 1352 bp, Triticum aestivum
  Clone ID: PAT_TA_30022
gaactgcaaaaatgtcttatattagtgtacagagagtgtatttatattctatgacaatcatctttataaattacactagcttaattacagtagtttatagaaaaatgcttagaactatatgaaacaacttgtctcacatataccaaaccaaggttgcttatgagtaacaccccattgtttagcatatgctttaggccctgttaaatctgtggttataccttctgctaaattatgtttcatttgtctctcctatccttttttactatatgattaaaatccatacggatagacgaattctaaatggtcgtaaaactctagggtaaatctttgctgggtcatatgtgaatttggcctccagtcatttacttaggtttctggatttgcttggattatggaaagtttagctcacgagtgtagccacttcgccatttgtttatttgatcgaataacttgtatctatttcttttttaacaagatcgtgctgctcttgattatttgctttatgtttttgattgagccgagcgaggagaaccaacactatttagcttttggggtctctgtttcaaatgactcgacgtggccttggcgacactggcttgtataggaagaggatgctgatgactcctgctagagagctcatcgacgactgcaacaagcagtcccaagggacaaatccatttatcaaggatgactctgcttgatgtcgccgcataccagcagaagataaagcttagccatagactggaagactggggctatatagattgctttctaaaaccaatgcagatcaccctgctgaagaagaaggagaggaagttagaaatcagttttcagttttacaggtgcaaaatcaactcattccactgtaatactggacatccagatgtccaggatgtcggaagcatccgcgttgcattcatgaatctgacatacacatgtaagagatattctccctcttacagctttccaaacattggaaatcactagaccagaccatgaggttgagaattcagatgatggcctctcatgtagaactcaatgcacatgtagtcagatactacggataaagttcaggcgggcgttgaatcgtggacatgtcccccatggatctgggcggctgggcgaacagatggaccgagctccctcctccgcccaagaagcagccgagctccctcctctgcccaagaagcagccgacctccctcctccgcccaagaagcagctgagctccctcctccgcccaagaagcagccggggaagctgcatcgacggcaggaacaacatggcggatccaaatcgccagtctcctctgtccagagctgaactgagtggctgcccccatgagaggacacg

SEQ ID NO: 30023 - DNA, 1182 bp, Triticum aestivum
  Clone ID: PAT_TA_30023
ggaggaaacgaaagttcagtataaatagtaagtagttcatctaaatgagtggtaatacaacatgatcacacacattgcagagagcaaaggcttcatggaacagcagctaccttactgcttctaatctcatgatccgtagttgtacagagataaacagccagtttgtagcaactcatcgctcaagccgcgcactgcaacaccgcagagtgtcatcacctcactaattaattataacaaactcaaaggtccttggcagaacaggttaagctgaacacattttaggtgtcatcctcagttttctcattcatccgacgtcaggagaacactgccccggcagtaggggcagtcgccgtgggatcgaagccaccgctccaggcacgccgagtggaagacatgcttgcagcgcagctgcatgagcccgtctgcctcgccgcacctctccaggcatatcgagcactccggtgaaggcgcggtgttttcgccgtcttctgcgtcttggcaggccgtttcttgtagcacagggaccggttcggtgcacggggtgacaggcatgcagttatccacggtgctgaaaggctctaggaatgtttcttggacttcgctgtaggtggtgatggatacactggattggaagtaactggttaggctaccaagttcgctatcggccaagttggagacaccaatgtcagcaggatgagttactactccagcccaaatggtttcggagcacgaagtgttttcccttcttcctgacaagtccacactattaagcctctgaagaagcctttccctagcctgttgaacagcatcagggagccgtccatgatccgatacactgcggcttagccttgagctggagcacgtgaaccctatatgttctattttgtttccggcacatcccactagcttaccaccatctctttggtttgctggaacaagttcctgacccggcttgtgatgatggtggtggtggtgagagacggccgagctgcgctggcggcggggcccggaggcgctcgccccgcggcagggccggcggcgcgggtcggggggctccggcgggcccgggtccggcggcgccggcgaggggcggcgctggaagtagaggagcttggaggcgatcggcatgcaagggagggagatgtggcaaactgttgcagctccacctgccggacgcgtggg

SEQ ID NO: 30024 - DNA, 596 bp, Triticum aestivum
  Clone ID: PAT_TA_30024
ccctcccgggctcccccggtcgtgccactctgtcggccagcgctctctgcactcccgtcctgaccagagctgatgcccaccacctcgctctcgccccccgggagctggggctgcaggatggttaccggccccctcggcaccgggactcgtggcggtgggctattccggtccaggtcccccccgccgcggctgtgggcgtacagtgggtccggacgcgtgggcggacgcgtgggctgacccgtgctgcatcagtcgttctacagagacaaccatcattcgctgaacttccaaatagaccagaaaatattcgcaccagcaagcactgatgggctgaaaactcgggcagcaatattgatatgtaattgtagcaatttgtatacgagtgcgacgtttctactcccgagctcatctgcacccgccctgacgaaaaaaatcaaaacaaatactaaaaaaattcaaaaaattccatatttttttgtagtgtagataagtttatgcgtgaggtgcgctccaagtttcaactcatttgaacatcggagcaactctgagcaataaagacaaattcagggtcgataaaaaaaatatattaaataata

SEQ ID NO: 30025 - DNA, 389 bp, Triticum aestivum
  Clone ID: PAT_TA_30025
ggggtccacacacagttttgaatcgatttatcttttttgctgagagctgctcagatgtccaaataagttgaaattttaagcgaacctcatgcatcaaattgccaatcacacaaaaaattagatttttttaaatttttttagtatttattttgattttttttgaccgggtgcatgagtctgggcaccgaattgggttttcgtttgtaaaccccatttactggtacaagaggttatcagaagtctaaaactaaatgtaatgtatatctctagagatgtaatttgcattgcatttatagcacaggaagtagtatcctggaccattttgtgacatccgagttagtcaaaacaatgtctgtggaatgtgaagctccttgtgcgctgccgaaaaa

SEQ ID NO: 30026 - DNA, 1252 bp, Triticum aestivum
  Clone ID: PAT_TA_30026
gccttcattagtcattagttttgtagcaccatgcgtctaaacttcgcaaacaccaactgttatgtacaggagccattacattttacataccatcccagatgcggaggaagcgccaaacaccaactggtagtttcttgagctcatgcattttagataccaccccaaatgaggaggaagcacgatgcatttacagttgtttcttcgcatcacgttttaatgggcacaacgtatacgacataaacagttcagtctatcatcagatcaatcgtccctcccgtaactcacaagactaagtttgtacagacgcgcaggcacgttctgcatgctctactcgtagtggctatctacagatcggacggagcttcctattaccggacgactccggccgcaagtttaccaggtgggggagggcggccagctgaagcttcttaagtctcggagcccgtctccttgcacgagtcgagcgacagcgagcgcaggttctgcagcggcctcaaggtggtggagaccggcgttggacacccgggagctcgactaggttcagcgagaccaaagcggtcaggcccgagattatctccaaggtcttgtctgtgaggttgccgttttgggataggttaagcaacgtcaggtctttgaggtccttgatgttcttcactcccgcatcagtgattagcccaccgcagaactccagagaccgcagacccttgaaacatctgaggcagtttgtcccagcatcagttatacgcagctcccaaaaagatcaaggtgcgttaacccggtgagagttgtaagagctgccaagccattgtctgtgatttggcgattatcaggattcagtgacctcagtgaattcatgcccgccattttcttcaggaccaatgtccgtaatcacttgtaaaagagagattcatgctatgcaaattccgaagacccagagagatgacgaagtccattgcttccaactgcagtgtccgaaagttccaaacttctcaactgcaaaaggcctttcaggtgcaatagcccctcatcaccaatcttgcatgagtccaagttcaaacactccaaattgatcaattctcgtagatgaaccaagcaggcatctgtaatgtggttgaaccctaaattaagaaccttcaatttgacaagaccttccaatttctcacagccttcatcacatatgccacacctattgagatttaacaaaaccaatgaagccaatcctgatatagcttccaaacaagcagcagtcact

SEQ ID NO: 30027 - DNA, 788 bp, Triticum aestivum
  unsure (1)..(788): unsure at all n locations
  Clone ID: PAT_TA_30027
tattcttccgcgtaccaagacacgctcgcaccatcgacttaacggcagttcttccgcgactgcaccatcaccggcaccatcgacttcatcttcggcaactcccaggtggtcatccagaactgcctcatcctgccgcgcaagcccatggacaaccagctcaacatcatcaccgcgcaagggcgccgcgagaagcgctccgtcgggggcaccgtcatgcacaacaacaccatcgagccgcaccccgacttcaaggactcgacgggcaagatcaagacctacctggcgcgcccatggaaggagtactccaggaccatctacatccagaacgagatcggcgccttcatcgaccccaagggctggctcgagtggaacggcgacttcgccctcgagaccctcttctacgccgaggtggagaacaccgggcccggcgccgacatgagccagcgcgccaagtggggcggcatcaagactgtcacctacgccgacgcgcagaaggagtacaccgtcgaggccttcatccagggcgagcagttcatccccaagtacggcgtgcccttcatcccggggctcctcccgcagtcggaggcagggagggatcattaactccatccctcaccatgtttcattattccgctgctccattgctgcttgtatgcaattagtgagttgacatatacgtactattatacactatagtgcattgcgtaccatgatgattaactaaatacatgtataccttttaccgaaaaaggctcacgcccccgctttatatataaaagccaatgcnc

SEQ ID NO: 30028 - DNA, 875 bp, Triticum aestivum
  Clone ID: PAT_TA_30028
gccggccggtccgggttaggtgacctatagaaggccgccacgcctcaactctcctcgcctcccctcctctcccccactccactactcggccactcctccaggtctcgctcgcagctagccagatccaccagccatggccggcggcaaggcagcgctcctcctcctcctgtgcgcggcgggggctgctgaccccggccctccgcggcggacgacggcctgaccaagttcaagctgtactggcacgacgtgctggcggggacgagccccaccgcgatccggatcgcgcaggcggcgtccagcaacagctcctccaccttcttcggcgcggtggtggccatcgacgacccgcccaccaccggccccgccgtcacgggctccgccaagtccaaggacgagatcaggccgcgcgcaggggacctacacgttcgccgaccaggccacccttcggacctcctcatgaacatgaacttcgtgttcaccgccggggactacaagggcagcggcctcaccatctacggccgcaacgaggtgctgtcggcggtgagggagatgagcatcatcgggggcacgggcaagttccgcatggcgcgcggctacgtcgaggcgcgcaccatggactccggcgccaagtccggcgagaccgtcgtcgagtacaccgtctacgtcaaggcggcggcggcggcggcgttagcggcggctgcctgagcttaatttagctaatgatgtccagtccatgactaacggaaaagatggttttgcttgtaataaatggatttcgcagatttgctgcgtttgttgccgtgatggatgatgggtgtttgcagatttgagtgctggctgtgtgtgattggtcgggccccgtaccattcccctaa

SEQ ID NO: 30029 - DNA, 1727 bp, Triticum aestivum
  Clone ID: PAT_TA_30029
ccacgcggccgtccctaacctgtcccgacccaactcgccgccgccgccgccgccgccgccgtcgccaaggaaccctagcgtgttgatggcatcgacggaggagcaagtcttccttgaatcgaggaacctgtcatatgatggcgcccaccaccccgacgcctgcaccgactgggattacccggaagacccaggcgaccggcggaacggggtggaggttgccgagctccatgaccagccggcgcgcatgagcacctcagattcagatccatgtgaagtcgccaggcgtgccttggacctcatgttcccgcgggaggaggacagcgatgacggctggagcacctggagcgcacgggaggagggcagtgatgacgacgatgaacaaggaggggaagaaggcgatggtagcacacaggagagcagcgattatgaagacgacggccgcaattgccaagtgatactagccgagacaaactgtccaggaaagctctaccccgagagccaagcagaggccatagaactcagatgggcagactggttcttccagcggattgtagaacactcaaagctgtgcaaggagattatggccctgggagatgatgatgagactcctttccccccatctcccatgaaagtgttccctgaggcaacagctttatgcatccttggggccaaatcctgccaccaccgtgtttacaggacccatgacacttctaccaccccatcaactcttggatatcgtgaaccaagtcatatgctacaatttttctccatgcgtctatcaagctttgaagcctcgtattccattagtgtgtacggaatattcgccattcgggattacttggaccggcgacggaactatgtctttaaccgtcccagggatgatgctgtaacaattgagaagcaggattcttttgtcgtaccactttgtagcccttgtcgaggaatgtatgtatcggataaggctttagtagaagttgatctttgggtaaagaaggaaggggatgaatcagatgacaagcaactactttctgcctacgctgagattgatgtccatgctgaagctaatgtcatgttttattcacgaatttctggtgataattgcaatttggacttaaaatacatagtcctttcagaaagtgtcgaggctgtaatacaagtatatgcaaaggtcgaccatcctcaccatgtgaggttcactgcttttagcaccggatatgatgactatcctcatcgtggggttgtgctgtttgatgacaaattatttggtcacgaaaaactattccagcatattgttgcagtgaaagcaaatgaagaacttcatgtttttttagaagtgaacggttcagtgttccagtggacttttcaagacgaacatgtcggagctgttatttctcctgatgactcagtctttgagtatggccagttcttcgtgagggtgatatttgctccaaaggattgtcagtgaagctcagctccagcattctcacagtgtagccattggctgaaagcctgaagctcatggaaaagtgttgttgcttttcttggtattgtatataagtagcagctgaatttgtcttcttaagccctcttaggcagacatcagaagtactaatttttatagcctgaagctcatgaaaactagagaaaatttcttgacttttatgtggcctatccttgtaatatgactggtggaaacccaaacgtgttccaagtgcatttcctctgtt

SEQ ID NO: 30030 - DNA, 1000 bp, Triticum aestivum
  Clone ID: PAT_TA_30030
ggagccacgcatccatcctccccgaatctcacctcccccaccaaccaaaccaaaggaagcgaaccgaaggaagcatgtgcccgggccggcccaagggccgtggccgcgccacccccccccggcgcacacgacgacccctcctcctccgccacgacgacccctcctcctcctgcatggccgcccccgcccccgccgcgctggccgcgcggcggccgcacctggcgcacagggtcgccttgttagtgaccctccactcgcggttcggacgccagtagaagccgacaaacagcattatggcgccggttttacttatgtccacaagcctggtgcgccgcagcacaaataaaagcaacacttcgctcccacataactgcacgcgccccccccccggcggcacccgcatccgcgccagccacagcaccaccccggcgcgcctggcagcccagagccgcccactctgcgtggcgggcctcagcccccgcgccgccgccttctgccaccggagcctctcctccctcccacgctccccctcccagcgtcccccgctcggaccgccccgcaagcccaactcaccgccgccgtaacccatgccggcggactcggggtcgccggacgggaagctggactggggcgtgcagggcgcggagctgcgcaagtccacgtctttcggggtcagaagcagcagcaggacgcatgatgcgacgaggcaggaggacatgtactcgtcgtggatgaacgacggcggcagcgacatgctggcggcgcggtggtcggacctggagcagatggtcgcctagttaattaattcacattttcgttacagtttttgtagctgaagaagaaattaagaaatactactccactccactccactccagtatataaggagaaacaaaaagatggaagatatgtaatcgttctttgtttttttcaaacatgttctgctccgaacaattgataaaaagaaaattccccccccaaaaaaaaaaaaaaaaaaaaa

SEQ ID NO: 30031 - DNA, 961 bp, Triticum aestivum
  Clone ID: PAT_TA_30031
aacataaccgcaaggcatcgatcacctccttgctttgcatggcttggtagtagtacaccggggctgccgtcaaaaaaaaaagctgcagcgcacaggacaaaaaggcatgcacagccagcgagcacaagcacagcgccatgctcgtcttcgcatacacaaaagcaacccggtagagcggagccaccacggggggcacgaagtgcgccacgagcaccagcaggaggccctcctttctcctcaccagcgttacgagacgccacgcctgccggagcgcccccacgccgcggcaccgcctgtcgaccaccgacgcggcgacgcccaccaacgccacgacggtgacgtagagggaggcgaggagcgcgatgagggagacaagaccctggacggagagcacccccgaggggccgcgcatcagggcgggaggcagcgcggccaggaccgcccatgcgaagtcaagcgcgccgacgacggcgatggtgatgaacgggcccttcaggctgatcctccccttgaccagctcgcgcaggagctcggctagcgagtagcggtcgccggagtaggtcgtggaggccgcgaagaggaagaggatcttcttggcgaagccgaccgccagggcgaccatcaccttggagacggcgatgaggatgagcttcataccgtcttgcaataacggcctccccatctccatgacctccgcgtattcggcgctcgagaagtcggtgttgttgacctcggagacatggctggccacgacgtcggcgagaggctggacgaacacgaaaccgactatgtggtcaaggaaggcggcggcggcaaagaggaggagcaagggcgtgaagagcttggggtttaacgtggggaggatcagcgcttcctttaggaaagtaaagcatgaggtgggtttggcagccatggttccttttgtaaggtcttttgaagaactgaaggctgaggatggact

SEQ ID NO: 30032 - DNA, 1182 bp, Triticum aestivum
  Clone ID: PAT_TA_30032
atcagaatgtttctgaatgatacattaagcactggggcaatcaaaacatttctgaatgatacatcaagcctctggagcaaccatcagatttgaaatagtacatccgacaactacaactgcatgctgtatgtagaacaactatctgaggctctgcactaaactgatatttttcctaataatcagctcgttcctcagaggaatgtacagtagagattatattcctttcctaataataatcttgttcctcagaaggatatacagtactacaaccaactcataggatgatttttcttctttgagaaaattgtaagtcgctatcaataattctctagagcaggaattgcttgccggtgtatgttttgccaaactcccaatccttgggcacaacgttgaaattggtcattgtcgtgccgtcactcgaggtgagctcaaaggacaccggctgccctgtgagatctaagttgatgtgccatatctggccccagttgcggcccatgtcgagccagccagactctgttcctttgatcttcactgatctgacatcgccagcgccgccgacattgctgattaggactgtgaagaagaagctcttcccggagaccgagaaccgcacgccgccttcacgaaggcacttgacgcggcggtactggatgggcatgacgccggccttccagagcgcaatcttctcgaacgcctggatggggaggaggaaatggtggttgggcgggttgcagacgccgccggcgtcggcggggaagccgtagttgggcgggcagaagttggtggccgtgacgacgatggaggtgccggggaggcagtacttgaggtcctccacgcacttgacctcgtagcagccgccgcaggcggcgccgcgctcgaacagcgccgtgctcagccccaccgtcgccatcccgtacccgtgcttccccagatccccgaacccgcacgcgccaccgatggcgtctccggggtcggcggcgaagtaggaggacttggcgttgcgccattcggagagggcggaggagccgtaggaggaggggtgctggtggccggcggcgagggccgggaggaggaagacgacgaggaggaggagcgggggagccatggctcccagcaagcagcttttcgtccgtccgccctctcagtcaagtgaagcaggggagagtgtgaaatggaggtgga

SEQ ID NO: 30033 - DNA, 1004 bp, Triticum aestivum
  Clone ID: PAT_TA_30033
ggattaataaaatgtcccctttatcaaaaagttcatatgggaaaatgaggaaaaacttacaaacaagacggcgcctatactctctgtggttagaggatattccaaagtgttgtcctgctgcagcctgagcagcacgtccagcaggttctcgtcgtgagtgatgcaggcgccatcgcctgcagttcgtgccgccttacgctcgtcgatgatgctactaatgaagcgctggatgcggccctggcacctcctcatgcgtcgctctccattgctgagccaccggaccaacagcgacgatgggaagaggtcgacgaggcagaagccgccaaccagcactaacgcctcgtccagctcgcggaggtactcgtcctgcttcgtgaacctgccaccgaaaaccgccctcgtcacaacgttgttgctgagcgtcgccaccatcttgctaacgttgacgatggcaccattcgaagcggtgatggagcggaggaggttgcccacctcctcggccctgatgccctccgtctgcttcacctgcttggtgctgagaagctccaggttgcagagcttgcgcatctggcgacagtggtcgctgtagggggcgaagatgatgcccttgccgccacacccgaagatgtccagcgtcgtgctgcgtggtcggcccgcgaacgtgaggccgtttgttttcatcaccagggccgcagcctcggcgctggagacgatcacggtggggacctcgcctagcgtgaggtgcatcagcggcccgtgccggcgagacatatccatcatcctgcggtgcgggaggatgctgacgacatggtggaggctgccgatgacggggagagtccatggcccaggaggcagctgccttttgacggccggcttttccttgccaccggaaagccagacaaacaaaagtgctagtagtgtggatgctgcggtgaaacacaagcacaaagaccactcctccatggccggcagcttattggcaagtgatgacccgtctgcttatt

SEQ ID NO: 30034 - DNA, 1125 bp, Triticum aestivum
  Clone ID: PAT_TA_30034
gcaagcaacgtggtgatagttagaaaaaacataagagagtacattgtggttgggtaattaagaagaaaataaggcatgggggagtgaagagacaaacagagatcgctgtggaatgaagacaaatggaaaagggcggttatctgcgccggcgcgccggcccaactgttgggccggtcgaacgtcagccgccggatgcagcgagtcgggaccgtccgatctggcacttaaccccaactcgttcttctccctccggtctggtgatttgtagcctgtcgccgaagcgcctccttctcttgcgttggtcaacgcaaacaaaaatcccctccttcctgttccacgcgagcatctctgcccttgccccccgcgcgcgtgcgctctggcgaggggcggcagcacccgtccccttgcggcgctgctcgttgcaacactaccgtcgtagcccccgtgccacccttctgctataacctcgtcgtcgctgcacgtcatgtccgtagctgacaaaaccagaccattgcagctctagcgcggccggttccagcacacatacaccatggttggagcaccgccggtgtcgccgcggtcatcaacttggacagtcatgccgagcacaaaactccaaaagcaacaaatcctccatttgtcggttgaagcaaatatttacccggttccagcaaaattgaacaccggttccagcaaaacgactcatgaggaagaactcctagtgattgattgtagcaaaacagagagcccgtcccagcacccagcgatgccgtttccagcaaaacagagagcgattgaagcaccaggaggtcgtcatcttcgtcgctaggacctgctggttgcagcatgggtagctgctggccgccgttgatgcatgcagcacaacggggcaatccaagcaaaaaaccaacacccctggttgtagcatatgtgactgtctcctacctgaacagcgccgccgaccatgtccgcagcgccgcgccgtgatacggctcaccggtgaagaggaaccaagacaaaagagaggatgagcggcagtacatgcgggatagcgcgcggagttggtggcggccatcgccggcgcgagctaatcaggcgtgaatagaatggaggaaaaggggatga

SEQ ID NO: 30035 - DNA, 634 bp, Triticum aestivum
  Clone ID: PAT_TA_30035
gaagaaaatcatttcccatacaactttaagcatatattgtagttgcacttgcatacataccggtagtacgatttacatacatgtatatcaaattgatcaaacatggtttcatagttcgtcaaggcatgcacgcccagtacgaagctgcattaggccatactaataagctgcaggcccatgcacttattgaaattacatacaaccatgagtttttatgctcaaacatgcatattatgctaagaggaactaagtatatccccttgccttttattgttcatacaacaggccttttatcgatcgcccccgtgatttgcaggaagtccagttggaacaatccatctcctccaacactggctttgccggcgatggtgccatcagcggcactcctgatgaggcacgtgccgcggctgaaccccacggtgtagtctagctcggcgagctggctggcggagacgaggttagccctgagccctgggacgtagagcacgttggggagaaccaccgtgtcagtgatcacggagccgtggccgatgacctgcatgggcaacgccccgtcggctgactcaacaaagcggcccggttgatcgggcgtgaaaccggataggaggtcgcggttccccgtcgcgtggtatgc

SEQ ID NO: 30036 - DNA, 1158 bp, Triticum aestivum
  Clone ID: PAT_TA_30036
gtgcaagttggtggaaagacaacaaaacaagaaatccaatcgtcaaagaagaacgagaaaagaaaatacacaaaagatagaccacgattgccggcatcgagcccgacgaggcgtcggaggtgcgacaaagatgaggaagaagctgggcacccggttccccgcggcacggatcaaaaagataatgcaagcagatgaggatgttggcaaaattgcactggctgtgcctgttttagtttcgagagcccttgaattgtttctgcaagatttgatcgaccactcatacaaaattactcttcaaagtggtgcaaagacactgaattccttccacctaaagcaatgtgtgaagaggtacagctcttttgacttcctaactgagattgtcaacaaggtgccagatctcggtggcggtgaatcttgtggagatgaaagaggattacccagaagaaggaaattttcaaatggaagcgacccagagaatgaggagccccgatctagcaaaatgcccataagaagcttgaacaccagtcccagaggacgaggcagaggtcgaggaagagggcgagggcggcctccaaccaagagaaaggaaattggttatgtacagtttgaggatgagagcagcatgtttgctgaacaaagtgaacccttgccaggagatgagatagttccggagaccaaccgtggcaatgagagtattccccaaagctcacatcctctagtggaggctccatcagccatgacgccagctgtgatttcaaaggttgaagaagctagcaccaaccatcagccagattggcctatgccagatgccattggaggcattggtgttggaccatccagttttggacatctgacagtgcaggttgatgaggtagaggactacgacaatgaggattaggcatagtcatcctctcattcatcatatgctctaacaggacagttctcctggtgttgtacattgtaaatattgtttcaagtagttactgcagctatgatgtgtaacctatttctttttcccaataattggttctgagttgccgcattgttgacctaactgactaggatgtgctaaatttaaccctgtatttgacggttgaagcagtgatattctgtcgtcctgttatattgtacatgtaaccagcagtaattttgtgttaa

SEQ ID NO: 30037 - DNA, 1023 bp, Triticum aestivum
  Clone ID: PAT_TA_30037
cggcaggaattagatcttcgccacattaaaaaccatatagccttagttatgctatttacagagacataaatattgcaggcagcaaagacttctaatagaatcatcatcagctctcacaatctgggtaagtctcaattctgcacctactctaaacagaaggatcataataaattgatgctactgtgcttatggtaaacaaaaaggagcgaaacacaccatacataattcttaaatgacctatcctaggatgcatttgaccgcggtaccatcctaaaagtccttcccgatgcttctaagttgatcgccctgcgtttgagtttttgtgccaccttctcaacactgataagatttccatagataagttgatgtatgggctcaataccaatcaacgtcaagagaaaaagatcatgtgatgcatctcagttgattgattgtttcatctctgctaaggttgtgaagctctaaacttctctgaaatatctgctactatgcccttgctcaggttggagcttcatttgacgaagggcttcccatagaacaaaagctgggtcaccggccttgattctttttcaagtttccaggttgaaagtaccatcatggagaaacttctaaataaaaacaatagagaacaaattgtcctacataagttgcagttgcacatgcccatatatttgctgcaagttgaggcgcctttaagcaacatcatcaccactttcactatacagcttgcatatacaccaacggaaggtagtaaacaaaatgagggcactcaacaagcacaattcaaaattagaagtgcaccaggtacgtgaccaataacagttataatgggacaatggcgagaaattgccagcacaacagaacagtcgagataggcatgcatctcaatcacataggaaatcaagagaaaatattaagcaaaggcaatgtagaaacaaataagcatgctccaagcaaagttgagcgacgctggccctggaagtaagaaaaaatattttccctgaggaacaggcttgaactaac

SEQ ID NO: 30038 - DNA, 1024 bp, Triticum aestivum
  unsure (1)..(1024): unsure at all n locations
  Clone ID: PAT_TA_30038
naattcaaaaaccatatgctacgaagaactggaatagttagctatgtcttctccctctcgttggatggtaggctaacaaacttttgtagcatctgtaattctccgagctcagctgagcgaatgatgcaaaacaacggtttaatgaatcgttgccagaggttacagatgcaacgcttgcgcgctccttctgaagcagcatgaacttgagcttcgtaaaataggtacacgttggaggaaaggctttattgggcttccgtcctgcactcctgctatagcctcatcttctttgcctttatccgctttgcggccatgtaagtcacagcagcagaaagagtgtaccatgtaaaggtgtatttcagatggtcatctggcatcactgagtgatgaatcaaagcattggcatcttttggaagaggataaggattacttgcagagatgtcttcattcatatcttctatatagacagtgttctcagggaggccacatgcacgtgcaatcatgggaacatccacgtaaaaccactggccattactgggttcattaggtggaacaaatatgctgggcttctcacttcctcggattactccaataactcttacaggaggctttacaggtttttcaatctctggagaagattcaggcttcttagaccaaaatttccaccaagtacctctttcatctgtctttttatcagcttcgttcacatctaaagtttcaccaaggtcctggtgatcctgcatgtttttatcacgccaagcacgaggaatccaccctctattcacaaggatgggtgactgcaaactgccaggctcagtcgaccgaggtatcaacggagtgatcacataatacccattttcggtcacaccggagatgctccgggagcgaggcccgacgaagaccgacttctccgtgccgaaatcgccctcacacacgatcttccggaactccagcacagccggatcacgcgagacagcagaggagacggtctcgttccacgccacgggctccatctccagcctccgcg

SEQ ID NO: 30039 - DNA, 720 bp, Triticum aestivum
  unsure (1)..(720): unsure at all n locations
  Clone ID: PAT_TA_30039
tgctctgctttcgccattgccaggagtcggccggcgtgctgggcagcggcggcacggcggggcggcggcacagcccgaacggccacccctcgcagtcccggaagccctcccacgtcgccggcgggcccatgtccgtcaacgacgccacggtcgccgcccggctcgtgctgcgcgtgaagaagctcttcaccgagaagaaggcctcgctctcggcgtcgccgtcgtcgctgcccgcctccgcctctcccttctgccccccttccaccacgacgaacttctcagggctggacaccttctccagaacgcttctcgggtcgagcggggtgaaggaccacacgaaggcgctggacagagtcggcgagcccgcgccgcaccgcgactccttcctcagctgccggctcctcatctcgttgagtatcacctgtttcgtgtcgagcatgtcgtcgtcgtcgtcgctgtcgtcgtcggagctccacccggcgccgggggtcccgatgcaggggacatggcagtgcgcgtaggtctcccggatgaggcaggagagggacttgcagtggttagcggccgggggcctggggtggtgctcgtgcgccaagcaaggcattgctccagccaactgcaagggatcgatcgatctggtggagttgcttgtgcaacgctcatgcgatcggcgatggatgcttgcccacgcgtncgcccacgcgtncgcccacgcgtncg

SEQ ID NO: 30040 - DNA, 552 bp, Triticum aestivum
  Clone ID: PAT_TA_30040
gggaaaaagaaaaaaggggcccattcttggggttgccaacattttattcggaataagggggagcataaaacaggctttcaaacaccttatatacgggcccccatttgttcccgtaaagggttttggctatgtcgatctgagaacattgttcaaaaacccaaatcgatgacggattaaagctcctgggccttggcgcactgggcaaaaacccatccgagctggttggtttcgggggggaaaaaaaaaaaaaaaacctgcattgaaacaactccaaaaaaaaaaaaattcaattccttaaaaaaaagatcccacaaggcattggggatagccaaacacgttttcccgtcttcctccaaaaaaagggagttttgaggagggatgtccaagtaactggggccccgggcgtgggtaatttttaaagacagggccttaaattggttcttcacatcattgacagaactgaatgggtttttccctttccaacataaaggcaaaacacaacccttcacctttacaagggatgattcactgaaagggcctctaacctttgaa

SEQ ID NO: 30041 - DNA, 671 bp, Triticum aestivum
  Clone ID: PAT_TA_30041
gaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagcaccgacctactcgacccttcggccggcatcgcgctcctagccttaattggccgggtcgtgtttccggcatcgttactttgaagaaattagagtgcctcacttttgaccagcttgcactccgtgctccaactggggagaacacgatcctgttgaggggacccaagaatgcccgtgaggcggtgaggcacttcggcaaggcgcctggtgtgccgcacagccacaccaagccctatgtgcgctccaagggtaggaagtttgagaaggctcgtggtaggaggaacagccgtggcttcaaggtttaagtcgccctttctgtgtagtcgctgtttgcggggagcgactggtgttctgtttgagcaattgacagtaattagtaaagtactttgtactgagagtagcacaatctatcgcccccg

SEQ ID NO: 30042 - DNA, 667 bp, Triticum aestivum
  Clone ID: PAT_TA_30042
ggtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgcgctctgctcgctgatccgatgattcatgataactcgacggatcgcacggccttcgtgccggcgacgcatcattcaaatttctgccctatcaactttcgatggtaggataggggcctaccatggtggtggtgaggcggtgaggcacttcggcaaggcgcctggtgtgccgcacagccacaccaagccctatgtgcgctccaagggtaggaagtttgagaaggctcgtggtaggaggaacagccgtggcttcaaggtttaagtcgccctttctgtgtagtcgctgtttgcggggagcgactggtgttctgtttgagcaattgacagtaattagtaaagtactttgtactgagagtagcacaatctatcgcccccgtgttcggatgatattttggaagatccttatcgctgtcatctgttttgaatttttgagcttgaagaccatgttttgttgcttttcaaa

SEQ ID NO: 30043 - DNA, 839 bp, Triticum aestivum
  unsure (1)..(839): unsure at all n locations
  Clone ID: PAT_TA_30043
gcccgagttgctgctgcgactgctgtggggttgggaaacacattggcccaactgttggggttgctgctgctgagattggatggaaccctgaacctgttgttgttcttgcaggatgatggagtagatgatagcacggattgcctcatagcgggattgctgggggatttgcggcaactgctggcaacattgttgttgcatcacatggcaactgctctgctgcaacatttgcgacctagcaagacgttgtggcattgccacagggctgcactgctgctggaggaatagcttgcatgggtttagctgctgcaaaatggatggctgaacaacagggatttgttgttgcaccagctgttggtgttgttgttgttgtggaaaaggtgattgttgtggaggtaaaactggttgttgttgctgtgaaaatggtggttgttgcggtagaactagttgttgttgctgcgaaaatggtggttgctgtggtagaattggttgttgctgagaaaatggtggttgttgctgccaaaatggtggttgttgctgcgaaaatgatggttgttgaggaaatagttgttgttgttgtgaaaatagtggttgttgtggaaatgtctgttgtggtggtaatggttgctgctgccatggtctctccaaaccagggatacatctgcctcttaatttatgggttgcgcacaagctgaataaaatggtgtattcacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaannaaaaaaaaga

SEQ ID NO: 30044 - DNA, 579 bp, Triticum aestivum
  unsure (1)..(579): unsure at all n locations
  Clone ID: PAT_TA_30044
aacacactgacaacatgaaggccctcttcctcataggactgcttgctctggtagcgagcaccgcctttgcgcaatatagcgaagttgttggcagttacgatgttgctggcgggggtggtgctcaacaatgccctgtagagacaaagctaaattcatgcaggaattacctgctagattcgatgctcaacgatgaaggatttcccggtcacctggcgttggtggaaatggtggaagggaggttgtcaagagctccttggggagtgttgcagtcggctcggccaaatgccaccgcaatgccgctgcaacatcatccaagggtcaatccaaggcgatctcggtggcatcttcggatttcaacgtgatcgggcaagcaaagttgatacaagaagccaagaaccttgccgcccaagtgcaaacaagggcctcccctgcaaacatcccccggaactaattgggctattactgggtgatgttancttccaatttatgactaagctaataaaactgtcacataacaactngcgttttganaaatnaaaattgggcaatgggataantttatgaattaaaatttcagcc

SEQ ID NO: 30045 - DNA, 845 bp, Triticum aestivum
  Clone ID: PAT_TA_30045
ggcggacgaggtaagaagcagcagccgcagacgcagcgcgaccccgcaaggaaaccctaccgccgccgcagaagcagccatgggtatcgacctcgttgccggcgggaggaacaagaggaccaagcgcgtcgcgcccaagtccgacgatgtctacctcaagctcctcgtcaagctctaccgtttcctggtcaggaggaccaagagcaagttcaacgctgtcatcctcaagaggctcttcatgagcaagaccaaccgcccgccgctctccatgcgccgcctctctaacttcatgaagggaaaggaggagaagaacattgctgtggttgttggtacaatcacagatgacatgcgtatccaagaggtcccagcaatgaaggttaccgctctgaggttcacagagacagcgagggcaaggattgtcaatgctggtggggagtgcctcacttttgaccagcttgcactccgtgctccaactggggagaacacgatcctcttgaggggacccaagaatgcccgtgaggcagtgaggcactttggcaaggctcctggtgtgccgcacagccacaccaagccctacgtccgctccaagggtaggaagtttgagaaggctcgtggtaggaggaacagccgtggcttcaaggtttaaattaccctttctgtgtaatcgctgtttgtgtggagcgactgctgttctgtttgagcaattgacagtaattagtaaagtactttgtactgagagtagcacaatctatcgtcccaatgttcgaatgatattttggaagattcttatcgctgtcaactgttttgaatttttgagcttgaagaccatgttttgttgctaaaaa

SEQ ID NO: 30046 - DNA, 1058 bp, Triticum aestivum
  unsure (1)..(1058): unsure at all n locations
  Clone ID: PAT_TA_30046
gaactagtggatcccccgggctgcaggaattcggcacgagtacaaatcaacgcgatctcatcatagacgaggcactacaagtgctcatccttactctagaaaccttcgccacatcagtcgaccccacgttttgattgcggttggctgcgaaggtgagcgaggggaaggcggtgcagatgaatcggttgggcggcagtggcattggcggcaccgatgtgccaccgctgcagcatcagcggagggaggatgtgatgggccttggcgatcccatgctagtgacgctgcgcaacaattaccgccagaggataatggagcatgcacgatgggaggtaactgcgagattatatgaaggaaagagggtacctgctgactggcagcgggggctgccggaacttgctaggcgggtcgagaaagtcttgtttgagaaacacccaaacaagtgggagtactacaacatgacgaatggaccagttgagccacatttcgagtttgctgtgacctcgcttgctcagattcagaggcagagagcatcttccactgcgtatgctcatgggggcatgataccggcacctggtgtcacgcaaggggatacctccaacgagcttgtgaacacactactatctctggggataaactctagcgatgacctctcaaaagtgtcgaacagcaacttggcaatccgtgcacctgttaagaaggaggtctcagaggaaccaaagttcagctgtccattctgcttcgacgagctggtcgatgcgtcatcaactatctgcggccacatcttctgccacaagtgcatcaagttctccgtccaggctcagaacaggtgccctgcctgctggaggggactcaccatgaacagcttccaccgcgtctacctccctgctaccatggactaaactgatccagcccttctcgtcgctggcatttcatcatcctatctgaactattattcacagggttatcgttaccattcaactattggtactcggggggcgtgttaccgatcngcatccgccgcttgtaataaaccgtagtactcttncctgtgggaaatc

SEQ ID NO: 30047 - DNA, 1057 bp, Triticum aestivum
  unsure (1)..(1057): unsure at all n locations
  Clone ID: PAT_TA_30047
ctacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagaaggctcgtggcaggaggaacagccgtgggttcaaggtttaagaaagttgtgggccatcagcatagtaatcacttcctaccgagtagtagcacattttgttgccttggcttggattttgaaagatatttaaggattttcgtgccttgtctactggttactggttgagcaagaagacaatgttcttttgcacctctaaaaaaaaaaaaaaaaaaaaaaagggcgggttaatatagtactaaatcagagatagaaagtctgtgcgcagaggaacaatgtcgatgaagaccgtgttctcggtgctcctgctatgtatgctcgtggcgacacccatagcggccgagtacgacgcatggagcgttaacagtggtccctggatgtgctatccagggtatgcctttaaggtgccagcgctccctggctgtcgtccagtgctgaagctccagtgcaatggcagccaggtgcccgaggctgtcctaagggagtgctgccagcagctcgccgacatcagcgagtggtgcaggtgcgggtgccctctacagcatgttggacagcatgtataaggagcatggcgtgcaaggagggacaggcgggggacaggcgcgtttccaagctgccggagggaggtgggtgaaatcttacccgccggcggaagctttaccgggggggtttggaaaagcttcccccatcggtcattttgaatgcccttcttgagaagaatgggaaagccgttattggtccttgctcaaaagggggttggtgggacccccgcatttaaccccccgggacaccngccccttaagtttccaaaggcccgaaaaatgggaagttaaggcctttacccttaattgggtttgggggggggtgccaatggggccatatttttgtggcccct

SEQ ID NO: 30048 - DNA, 1172 bp, Triticum aestivum
  unsure (1)..(1172): unsure at all n locations
  Clone ID: PAT_TA_30048
cgtgtgtgtaagggatgctgaatgaaagcgtttgtgaacacctcgcctcttccccgcgttctcatcctgttcagcgtctcttctctccccgaattctccactccctgatccaaatcaacgcgatctcatcatagacgaggcactacaagtgctcatccttactcctctagaaaccttcgccacatcagtcgaccccacgttttgattgcggctggctgcgaaggtgagcgaggggcaggcggcacaaatgaatcggttgggcggcagtggcactggcggcgccgatgtgccaccgctgcagcatcagcagttggaggaggtgatgggccacggcgatcccatgctagtggcgatgcgcaacaattaccgccagaggatattggagcatgcagaaagggtggtcactgcgagattacataacggattgagggtacctgatgactggcagcgggggctgccggagcttgctaggcgggtcgagaaagtcttgtttgagaaacacccaaacaagagggagtactacaacatgacgaatgaaccaattcagccacatttcgagtttgctgtcacgacctcgcttgctcagactgagaggcagagagcatcttccactgcctatgctcgtgtcacccaaggggatacccccaacgagcttgtgaacacagtactatctctggcgataaactctagtgatgaccactcaaaagcgtccaatagcaacttggcaatccatgcacctgttaaggaggaggtctcagaggaaccaaagttcagctgtccattctgcttcgaagagctggtcgatgcgacgatgcgtcatccgactatctgcggccacatcttctgcgacaagtgcatcgagttctccatccaggctcagagcaggtgccctagctgctggaggggactcaccatgaacagcttccaccgcgtctacctccctgctaccatggactaaactgatccagcccttctcgtcgctgccatctgtcatcctatctgaactatacttcaccgggttatctttaccattgaacttctggtactcagaaggcgtgttactgagcccttcttgtctgcatccgtcgcttctaaataaaccgtagtctcttncctgtgggaaatcgaaacatgtgnctttgtaccgtggaaaacatatttnctgcatcgtt

SEQ ID NO: 30049 - DNA, 1124 bp, Triticum aestivum
  Clone ID: PAT_TA_30049
aaccctactaaagggaacaaaagctggagctccaccgcggtggcggccgctctagaactagtggatcccccgggctgcaggaattcggcacgagggatagtactaaattagaggcagaaagtctgtgcatagaggaagaatgtcgatgaagaccatgttctcggtgctcctactatgtatgctcgtggcgacacccatagcagccgagtacgacgcatggagcggtaacagtggtccttggatgtgctatccggggcaggccttccaggtgcccgcgctccccgcctgtcgtccattgctgaggctccagtgcaatggcagccaggtgcccgaggctgtcctaagggactgctgccagcagctcgcccacatcagcgagtggtgcaggtgcggggccctctacagcatgttggacagcatgtataaggagcatggcgcgcaggagggacaggcagggacaggagcgttcccacgctgccggagggaggtggtgaagctgacggcggcgagcatcacagcggtctgcaggctacccatcgtcgttgatgcgtccggagatggagcgtatgtctgcaaggatgtggccgcatacccagacgcctagtcaagcaaatgagtagctactatgttgtgtcatgcacctgcctcttaatttgtgggagtgcgcacaaactaaataaaatggtgtatgtgcctatgcgaaatgcattggtaatgaataaaagtgaagttgtcaagagctccttggggagtgttgcagtcggctcggccaaatgccaccgcaaaaacgctgcaacatcatccaggggtcaatccaaggcgatctcggtggcatcttcggatttcagcgtgatcgggcaagcaaagtgatacaagaagccaagaacctgccgcccaggtgcaaccagggccctccctgcaacatccccggcactattggctattactggtgatgtagcttccatttatgactagctaataaactgtcacataccactgcgtgtgacaaataaaagtggtcatggaataatttatgaataaaatttcagcatgtgcctgcgcgaggtgtctatagcaaacatttcagtatgcctatatatgttaatcaagatagcaatgttcac

SEQ ID NO: 30050 - DNA, 849 bp, Triticum aestivum
  Clone ID: PAT_TA_30050
cccctgctcgaaattaaccctcactaaagggaacaaaagctggagctccaccgcggtggcggccgctctagaactagtggatcccccgggctgcaggaattcggcacgagggttaatatagtactaaatcagagatagaaagtctgtgcgcagaggaacaatgtcgatgaagaccgtgttctcggtgctcctgctatgtatgctcgtggcgacacccatagcggccgagtacgacgcatggagcgttaacagtggtccctggatgtgctatccagggtatgcctttaaggtgccagcgctccctggctgtcgtccagtgctgaagctccagtgcaatggcagccaggtgcccgaggctgtcctaagggagtgctgccagcagctcgccgacatcagcgagtggtgcaggtgcggtgccctctacagcatgttggacagcatgtataaggagcatggcgtgcaggagggacaggcggggacaggcgcgttcccaagctgccggagggaggtggtgaagctgacggcggcgagcatcacggcggtctgcaagctacccatcgtcattgatgcgtctggagatggagcgtatgtctgcaagggtgtggccgcatacccggacgcctagtcaagcgaatgagtagctactatgttgtgtcatgcatctgcctcttaatttgtggggtgcgcacaagttgaataaaatggtgtatgcgcctatgcgaaatgcatcattaatgaataaaagcgaagttccctgttgaaaaaaaaaaaaaaaaaaaactcgaggggggggcccgggaccccaattcgccttaatagggagtcggattaccaattaattggccgccg

SEQ ID NO: 30051 - DNA, 779 bp, Triticum aestivum
  Clone ID: PAT_TA_30051
ttcttgaaccatttaagatagtactaaatcagagacagaaagtctgttcgcagaggaacaaagtcgatgaagatcgtgttctcggtgctcctgctatgtatgctcgtggcgacacccatagcgtccgagtacggcccatggagctataacagtggtccctggatgtgctatccggggcaggccttccaggtgcccgcgctccctggctgtcgtccattgctgaagctccagtgcaatggcagccaggtgcccgaggccgtcctaagggactgctgccagcagctcgccgatatcagtgagtggtgcaggtgcggtgccctctacagcatgttggatagcatgtataaggagcatggcgtgtcggagggacaggcggggacaggcgcattcccaagctgccggagggaggtggtgaagctgacggcggcgagcatcacggcggtctgcaggctacccatcgtcgttgatgcgtccggagatggagcgtatgtctgcaaggatgtggccgcatacccggatgcctagtcaagcgaatgagtagctaatatgttctgtgatacatctgcctcttaatttatgggttgcgcacaagctgaataaaatggtgtattcacctatgcgaaatgcatcgttaatgaataaaaacgaagttccctgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggaaaagatttaaagaaa

SEQ ID NO: 30052 - DNA, 1009 bp, Triticum aestivum
  Clone ID: PAT_TA_30052
cccacgcgtccgcccacgcgtccgcccacgcgtccgggaggcggacgaggtaagaagcagcagccgcagcgcgacaccgcgaggaaaccctaccgccgccgacgcagaagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagaggtcccagcaatgaaggttactgctctgaggttcacagagacagcgagggcaaggattatcaatgctggtggggagtgcctcacttttgaccagcttgctctccgtgctccaactggggagaacacgatcctgttgaggggacccaagaatgcgcgtgaggcggtgaggcacttcggcaaggcgcctggtgtgccgcacagccacaccaagccctatgtgcgctccaagggtaggaagtttgaaaaggctcgtggtaggaggaacagccgtggcttcaaggtttaagtcgccctttcttgttagtcgctgtttgtgtggagcggctgttgttctgtttgagcaattgatagtaattagtaaagtactttgtactgagagtagcaaaatctatcgccccagtgttcgaatgatattttgcaagattcttattgctgtcaactgttttgattttgtgagcttgaagaccatgtttcgttgcaaccagtcattgcttagcttcggtgcctctttgcttggcgatgtccaaaaaaaaaaaaaaaaaaaaaaaaaaaaaaaagctcgagactagttctctcacctcggccgcgaccacgctaatcacttagtgaattc

SEQ ID NO: 30053 - DNA, 824 bp, Triticum aestivum
  Clone ID: PAT_TA_30053
actaaagggaacaaaagctggagctccaccgcggtggcggccgctctagaactagtggatcccccgggctgcaggaattcggcaccagccaaaacacactgacaacatgaaggccctcttcctcataggactgcttgctctggtagcgagcaccgcctttgcgcaatatagcgaagttgttggcagttacgatgttgctggcgggggtggtgctcaacaatgccctgtagagacaaagctaaattcatgcaggaattacctgctagatcgatgctcaacgatgaaggatttcccggtcacctggcgttggtggaaatggtggaagggaggttgtcaagagctccttggggagtgttgcagtcggctcggccaaatgccaccgcaatgccgctgcaacatcatccaggggtcaatccaaggcgatctcggtggcatcttcggatttcagcgtgatcgggcaagcaaagtgatacaagaagccaagaacctgccgcccaggtgcaaccagggccctccctgcaacatccccggcactattggctattactggtgatgtagcttccatttatgactagctaataaactgtcacataccactgcgtgtgacaaataaaagtggtcatggaataatttatgaataaaatttcagcatgtgcctgcgcgaggtgtctatagcaaacatttcagtatgcctatatatgttaatcaagatagcaatgttcacatacacccagaataatagtttgtgtaattagttgtgtatgttcttggtggtggtttgtgtacagatttgccttccttctaacaaaatatgaatacatgga

SEQ ID NO: 30054 - DNA, 710 bp, Triticum aestivum
  unsure (1)..(710): unsure at all n locations
  Clone ID: PAT_TA_30054
ttcggcacgaggtaagatagtactaaattagaggcagaaagtctgtgcatagaggaagaatgtcgatgaagaccgtgttctcggtgctcctactatgtatgctcgtggcgacacccatagcagccgagtacgacgcatggagcgttaacagtggtccttggatgtgctatccggggcaggccttccaggttcccgcgctccctgcctgtcgtccattgctgaggctccagtgcaatggcagccaggtgcccgaggctgtcctaagggactgctgccagcagctcgcccacatcagcgagtggtgcaggtgcggggccctctacagcatgttggacagcatgtataaggagcatggcgcgcaggagggacaggcagggacaggagcgttcccacgctgccggagggaggtggtgaagctgacggcggcgagcatcacagcggtttgcaggctacccatcgtcgttgatgcgtccggagatggagcgtatgtctgcaaggatgtggccgcatacccagacgcctagtcaagcaaatgagtagctactatgttgtgtcatgcacctacctcttaatttgtgggagtgcgcacaaactaaataaaatggtgtatgtgcctatgcgaaatgcattggtaatgaataaaagtgaagttccctgtttgatcgagaaaaaaaaaaaaaaaaaaaaaaaaaaaaaagggggnnaaaata

SEQ ID NO: 30055 - DNA, 920 bp, Triticum aestivum
  Clone ID: PAT_TA_30055
gctccctatatagcgtctcctccacgcgccgccactctccttcccgagccggaggtggacgaggtaagaagaagcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacactatcctgttgaggggacccaagaatgcccgtgaggcggtgaggcacttcggcaaagcacctggtgtgccgcacagccataccaagccctatgtgcgctccaagggtaggaagtttgagaaggctcgtggtaggaggaacagccgtggcttcaaggtttaagtcgccctttcttgttagtcgctgtttgcgtggagcggctgttgttctgtttgagcaattgacagtaattagtaaagtactttgtactgagagtagcaaaatctatcgccccagtgtttgaatgatattttgcaagattcttatcgctgtcaactcttttgattttgtgagcttgaagaccatgtttcgttgcaaccagtcattgcttagcttcagcg

SEQ ID NO: 30056 - DNA, 1038 bp, Triticum aestivum
  Clone ID: PAT_TA_30056
ccacgcgccgccactctccttcccgagccggaggcggacgaggtaagaagcagcagccgcagcgcgaccccgcgagaaaccctaccgccgccgccgcagaagcagccatgggtatcgacctcgttgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagaccaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacacgatcctgttgaggggacccaagaatgcccgtgaggcggtgaggcacttcggcaaggcgcctggtgtgccgcacagccacaccaagccctatgtgcgctccaagggtaggaagtttgagaaggctcgtggtaggaggaacagccgtggcttcaaggtttaagtcgccctttctgtgtagtcgctgtttgcggggagcgactggtgttctgtttgagcaattgacagtaattagtaaagtactttgtactgagagtagcacaatctatcgcccccgtgttcggatgatattttggaagatccttatcgctgtcatctgttttgaatttttgagcttgaagaccatgttttgttgcttttctgttgacaatgtccactggtgaatgtgtctatgtgcgctccagtttgcagtatcattgtgttaactttgtacccatctgttgcttagcaacatataattctgtagggcatttaaacttgttaaatgcaacttgattctgagaaatgttaatgaactgcgatgaact

SEQ ID NO: 30057 - DNA, 1340 bp, Triticum aestivum
  Clone ID: PAT_TA_30057
ccccccccggcgaccgcggacggcgcggcgccgtccttgtcgagcgcgggcgtcgtccgacgaggggtcgtcgggcgagtccgccgcggagtcgtcggcgtcgtcgtcgtccgagggcgaggcgcccgcggagggcttcttcttggtggtcttcttcttcttgggggcctcgggcgccggcgcgggggcgatgtccttggcgatcttgtacagctccttgggctgcaggaacttggagatggcgtagacggcgagcgggtcgtcgtccttgatggtgtaggtgaccgacgccgagttcaccttggtgtcgagctccgcggtctcgccgtccttctccacgtcgaagctgtagtccttcttggcgacgttggaggtggcgagcgtgctgaccttgccgctgttggaggtgagcagctgcagcgagtagtagtccggcacggcgtggtagagcaggatggccgtccggcccttggccgtcaggttcttgtacttgggcatgaaggaggcgacggcggagtcgacggggcagaagagggtgagcccgttgtccttggtggcgttgatggtgctgtaggcgtcggcgtcggcggccagcaggcccgcgaagctcttgcagtacttcttggagagcagttcggtgatgttgacgggcgccggcgccgccacgggcgcctcggcctccggcgaggccagcaccttgctgatctggagcaccgccaggtcgtaggggatctccttgacggacttgacgaaggcggaggacggcgcgctgtcctccgcgtcctccgccgtgaacgtcaccttgccgccccggtgctgcgtgatgttcacgtacccggacatgccgggggccgcgccggactcctggaacatggtggagcatgcggtgacgccgtgggcgagctggtggagcttcttgccgccgtagtagtcgacgaggacgtgaatctggagcatgtggcggatggtctgcagcgtgcggcccccgccggcgaggctgcccatgtcgccgttggccacgacgagcacggtgatggtgcggcgcttgttgatgtcctgcgccagccgcgtctgcgtcagcagcttgttgaactgcgagtactccgggtacgccgccaggatcttggtgatgttgtacccctccgccgccgccgccagggccagcaccgccagcgccaccagcaacgtccgccgccgcgcctccatcaccctctcctcctcggtcgtcggcgtctggagcttggccgctggtgtcgtctcagctcagctcgggatggagtggggtggggcggactggtggagagcactgagccgagcagagcagagcaccacccagattc

SEQ ID NO: 30058 - DNA, 834 bp, Triticum aestivum
  unsure (1)..(834): unsure at all n locations
  Clone ID: PAT_TA_30058
cctccccaccccccctgtttcaaaaaatgggtaatgcgaaaccaatagttcagaaaaacgttcttatattatgggacggagggagtaaaaaaaagacgccaaaaatcctataaaaaatcttgtagatttccttccatttttatcactcggcgtcgcttggcgatgttcttatgagcatttcgtcactccgcatcctcttcgatggtgctgagcggcttgagcgccttcttcgccggcggaaatgccgccacggcagctttcttgccgattttcgccggactacccgaggctttcacagagtactccccgagggtcctctcgttcagcttcgcgttgacctgggcgtccacgtcgccacgcccgccctcggcgtgcaccggcgtgacgcgcaccttcctgatgccggcgccgcgcccacgcggccgcgctctcgtcgccagcgcctcgctcgcccgcaccgccatggccgccatgtcggcgctcgacaggggccgcccgagcatcgcgacggggagcacgaagtatatctggccgggacggagcagctcgccgccgccgagcgccggcacgtcctcgtcgaagtagagcgcgtcggagctgcacaggaagaacgagccgcccgcattgcctgcgccgaggacgtcggagacgctgacaggcgaggaggtggcgaactccgtcagcgagccgtcggcggcgatgacgcgggccgacgacggctgctgctggggcgcgacgctgctccggtggttgtgagagagacctgatcccatccacagtttctaaatacaggttgaatggttttggtgttgtccggcccgccnggcctcgagc

SEQ ID NO: 30059 - DNA, 791 bp, Triticum aestivum
  Clone ID: PAT_TA_30059
ggccgtcgggcagtgcgttctggcagtagctgaagccgcttacggtggtcattcctcaacagtatggtcggtctcttttaaccagaaaggagataggatggtcacatgcagtgatgactgtactttgaagatttgggatacgagtgctgatttgtcgcagccaacaactggagaagttcatgaatcttggcgacatctttctactttatctggacatcatggtcgaactattttttcagcccattggtcaagcgaggatgttattgccagtggggcaggtgatgatgctatctgcttatatgccgaggagaagagtactatggttgaggggcctttgtacagattaatattgaagaaagagaaagcgcatgacatggatgtaaattgtgtcagatggtgtcctcaggacccgagggtgttggcttccgcgagcgatgatggcacagtgaaattgtgggagctgcggggcaatgtactggagtgaattgtactctatgataatagttctagctgtgtaccttaagatcacagatcagtgtagggatcgccatttggtttctgttttccaaaacaatgctccgttaggttagctaatactttttggacctgcaagagcttggatggtggtgatcttgtaacagatttgccatccaagccacgagttctggcatcgatatggaattgttggcgtatacaatatgaaacaatagatgtgctatcttttttttaaacgagctttgaaacatcaaattaagttcctgtacagacaagtgctgcacacagttttttgc

SEQ ID NO: 30060 - DNA, 1480 bp, Triticum aestivum
  Clone ID: PAT_TA_30060
gaaatatcagtcaacccacattttttcgggaataacacactgcattgtgctcaattattttcataggaccgtacatttaaaaccaaattcgaaatatttaatctcataaatcatgcctagtcgtagatatccagtttgaaaactagaactaattccattcaccagcatgaattcagaggccactcttctcccaaacacagtagttgttgcctttagccgcaatcttgaaacccgaggggatcacgttgttgccaatattgtatcttgacccgatcttggttataaccttgcccccaatcttggcaacatagagatcgccctcggccttgaggatatccagtgtgctacccggatggatcccgttccttgacctgaccctagccagtgcggtgatctcctgcttcagcttccagtcgaacacgtggtcgtagaagaggcatggtatgcccgggtgtgtgaggatgtaggcgtagccctgcatgaccttgtctgaggggaatggccagagcctctgggtcgacccggtgtcgtggttgtcgatgaacgtgacggtcttctcgggcatccacccgatcagaccgggtgccttgccgccgttgccacgcatcctcccaagatcgccctgcacggcctcctggagcacacccttggtggggaagtcaaacgccgtggccggcccgccgacgccctgcacccagttcgcgagcagctgtcggtccctgtcgtagagctcaccaaccacgaacgacggcttgctgttgtcaacgtagatcttggccatggccgcggagtatcccttggcaaagtcgaggcgccatccgacgaagccgaggtcggttttgagccagttgagccaggcggagagctccctctgcacccgcgggttgagatggtcgatgtcgggcgcggcatcgaagccgccgccggtgtccctgtggccgcggccgttggagtacttggtgtcgtcgctgcagatctcgtcggggccccagtcgaggcggttgtcggacgttcctccctcgaagatgcagtagacgccgcggccgtccttcttgtcggcgcaacggtggttgatgacgatgtcggcgacgcacgagatgttcttgctgcggaatgcttggatcagcgacttgaggtcggccccgctgccgtacttggagttgaggttgtagagctgccccggcagataaccctccggcgacacggactgcgacggcggggggagccagacgtgggtggcgccggtgctggcgatgtcctccaccttcccttgcatgaacttgtaccacccgccttgtgtcttccatgattcccaattaaacccctggaaaagaatttgagcctgtgctaagctggaggcgagacaaagcacaacaacaagaaggccacagagagtggcagagtgcttggccatagctccagtctctgcagcgcagctcgcctctgcttcctatgaaatcgggactcctggaccgacggc

SEQ ID NO: 30061 - DNA, 1012 bp, Triticum aestivum
  Clone ID: PAT_TA_30061
acaaacgatgtgactggactccactaatttaaactagagccgatcaccatccacaattcagactggtgggctggttatgtactccctccgtccggaaaaagttgtccagagcttagttcatttcaaattttacaaaaaaaaccttccggttttaaatctagtgctaatccccccctcacctctgcttcttcctccttcgaccaagcggccgtcatagccaccgccggcagccaccgccagcagccgccgtagaaagagcgggcgaccacctccgccgacgcccacctgcgccgtagcccacctgcggttgctcagccgctacgaacgtgggccatccgcacggaggcgagctgccccgccgcccagctgaggctgctcctcgaccaccttgacgggcgcctcctcctcgtggccctgctcgcgtccctggccctgctcgccggttcctcaccctcgcggcaaccccagccgccgctgccgaccccggtcgccgctcccctcttgaagaattcggcaggcagggcaaggcggatcttccccggcggagagaggaccacgcaaacctgctgatgccacagccgattgcttctgctgattgcttctgctgattgcctctgctgattgcttctgccctcgactgctgattgcctctgccctcgagcacctcgactgctgattgcctctgctgctgctgttggctgcaggtacagtgccaattgcagtatcaatttcattttgtcaaagaagtactccatcagcgtcaattgcagtgtcaattggagtattaaaattctcaattgcaatgctgatctactgctgatgttatctgacatttacagtgttttgtgtctgtcaatcatactccattcagtgtcctgtgtcagaaatttggtgaagtgaaggtgaggtgaagtaactgaattcactagcataatctgaatcaaacaaagcatagtttgaattcactagcataacctgttgtagaaactagaatgagccttctttttttacc

SEQ ID NO: 30062 - DNA, 398 bp, Triticum aestivum
  Clone ID: PAT_TA_30062
atatcaacacggctcgaatagtatgtagaatcccagtataaaccaagaactagggtctcaagaactaagggagtaatatatggggggtgctagtactactgctaacaaagaaccaaaccaacgagtgatctctaccaccgaccgataatatgtgcatatagtagctactagctaacaatgcgactagtactactagtagatgcgaaaatctctagcaagatgtacatactaatggtcagaccacggcgggcgatgcagagcaacagcatcccgcaacaaaccaaccaatcgaatcgaagaatcgagagaaaggatcccgcaaccaaccgatcgaatcgagagaaggaatcagatcagattccccaatggtggagaaccgaatcagcccacgcgtccga

SEQ ID NO: 30063 - DNA, 1073 bp, Triticum aestivum
  unsure (1)..(1073): unsure at all n locations
  Clone ID: PAT_TA_30063
aaacaccacccaatggcgaaatagaagaatggatcccaaaaaaacccaatanacgcaagaactagtaatggtanacggtagaactcctgaaaacaaaagaaccaaaaacccagtaatcgacagatcgatagtatgtgcaaagctaatactaatgcagtactagatgcgaaaatctctactagcaagatctacatgctaatggacagaccatggcggcgacgcagagcagcagcatcccgcaaccaaccaaccaaccaaataatcgaatctagagaagagatcagatcagatcgatccccaacggcgcaatcgcaatcggaatcagaatcagaaccagactttgcactcggtgcgcttgaacgcgggggcgccggcggcggcgcctggggcggggagggagagcgggcagctgatcctggccctgggcccgggcaccttgaaggcccacaccttgacgcggagcttggcgttgagcttcacctccacctccaccgcgccgcccgccagctgcgacctgaggttagcctgggtgacgtccccctcgagcacctgctggccgccgaacgccggcttgacctcggtggacgcctggtggccctggaagaaggggtcgaggggcgcgaacccgaagcgctggccgtcgaagagggccagcgcctcgggcgccgtcgtagtagagccccacccgcttgttggggttgcgcaccgtcatggcgagcgtgaggttgtactggagcagggccgggctggcgggggtgccgagcgcgaactgggcgagggaggcggagtcgacggtggcggcgatcatctgcgggcggaagacgaagtagaggatgagggcgaggacccccgcggtgacgaggagcgagacgaggatgctgcagaggcagctgaagaggccgcacgccaggcacttgaacgggcagcacaggcacgacgccgcgcggctccccgaacccatcccgtcgagctggtggtgggcggcgaggaggagctgagggagatttgacggcgagagtggggaattggtggcctggtggatcggatttgggtgatttcccgacccggccggc

SEQ ID NO: 30064 - DNA, 1352 bp, Triticum aestivum
  Clone ID: PAT_TA_30064
tttttttttttttttttttttttttatggagaactgaacagcatatcgttgatgaatatttcaacaatggtcggattagtacgatggatcccaatatatccgaatatacgcaagaactagtaatcgtatacggtagtactcctgctaacaaaaaaaccaaaaatcatagtaatcgacagatcgatagtatgtgcaaagctgatactgaaaccagtacttcgatgagaaaatcgatactgagcaagatctaccggctactggacagaccataggaatcccgcaaggaagcagcaacccacacgcaaccaatcaaccaaataaacaaaaatcgagaagggatcagaacatccaaagcaacaacggcaataccgcgttgggaatcagaataagacctagatcttacaggccatgggagggaccgcggtggcggcggaggggaccagcagcgcgcgatgcaacccatcgcatcgagagcggggccgggaccaggggagctcgccgcacgcagcgcgcgcgcgcagctatcgactcgaatcgaccccggactcagaaccagacctctgcactcggtgggcttgaaggcgggcgcgccggcggcggcgggggcggggagggagagcgggcagctgatcctggcgcggggcccgggcaccttgaacgcccacaccttgacgcggagcttggcgttgagcttcacctccacgtccaccgcgcctcccgacagctgcgtcctgaggttgctctgggtcacgtccccctccagcacctgctggccgccgaacgccggcttcacctccgtggacgcctggtggccctggaagaaggggtcgaggggcgcgaacccgaagcgctggccgtcgtagagcgcgagggcctcgacgttgtcgtagtagagccccacccgcttgttggggttgcgcaccgtcatggcgagcgtgaggttgtactggagcagggccgggctggccggggtgccgagcgcgaactgggcgagggaggccgagtcgacggtggcggcgatcatctgcgggcggaagatgaagtagaggatgagggcgaggacccccgcggtgacgaggaggtgagacgaggatgctgcagaggcagctgaagaggccgcacgccaggcacttgaacgggcagcacaggcacgacgccgcgcggctccccgaacccatcccgtcgagagctggtggtggacgacggcggcggcggggaggagctgagggggattcggctggatgtggttcccggcggcggcgaggcagattggaggtgggccggcccgcccgctgagcggccgcgtcaaggtgtgggcgttcaaggtgcccgggcaccttgaaccctcgtgc

SEQ ID NO: 30065 - DNA, 441 bp, Triticum aestivum
  Clone ID: PAT_TA_30065
agaggtactatgtgttacacactatattgatgttgaaccatgagaacatatatgcccctttgttgtatatatgtccatccgctacaatgcacaggcaattaactagtattatgaaaatgtttcctaacaacacgatgatattctgtacacacaaaaaactagaatgagacatcgttccatgattgccagagaatttatatcgcaagtagtatcgaacatgggaaacggtttagcaatattctatgtaacattgtgttttagccttttatttctttattttttttaaactattgcgacaacgtaataattggttcatctttgaatccagagatcagatactggggaagttgttctcttccattttttcataataagatgatacgcctcaagtttggctaacaaaaataagatcctaaatgaaacataataaatcttgagttc

SEQ ID NO: 30066 - DNA, 867 bp, Triticum aestivum
  Clone ID: PAT_TA_30066
ccatgccgggaagttacagaatgaggacggttcatggttcggatcatggggtatttgcttcacatacggcacgtggtttgctatagagggcctatcggcagttggacagtgttacaataatagcacctacatccggaagggttgccagtttctattatcaaagcagctaaggaatggtggatggggtgagagtcatctttcatccacaaccaaggcatacacgaacctagacggggagaaatcacatgtagtcaacaccgcatgggcaatgttggcactaatgaaagctggacaggccgaacgagatccgtctcctttgcacgaagctgcaagacttatcatgagcatgcaacttggcaatggtgacttcccacaggaggaaatgattggaagtttcttgaaaaatggtcccttgtgttatatggcttatcgcaacatattccccatatgggcccttggagagtatcatagattagtactttgctctggctaaactagtaccttctggtatgaaggaattaaatgtcgctcctctgctggcaatgctgaaagagcgatgtcttgatttacatgtcttgaagaaagaaacaagaagatagtcgtgtaattataggtggtgtgcatatctgaagttcatacataatagtataagactatgttgtaatcgattcattaatttgttgtatggttcccgccaaaaagacaaaaatcctcgtttgtttgtcttcatgcctggtactagaggtgtgtcctgctactctaggtggtgtgcatatctgaagatcatacataatactgtgtgttgtaatcgatcttctggcaattgtacaagattccttaaagtttttgtacattcctgtaataaag

SEQ ID NO: 30067 - DNA, 756 bp, Triticum aestivum
  Clone ID: PAT_TA_30067
ttttttttttttagcaagacaatgtggcaaatggccaaatatattaaccgatataggttatgagtttgctcctctcacaatttatccgcaattcgaacaattgccaaaatgttacaggtatcgtcgtagccctcttagaaaaacctaaacagacggaggtaggataaagatattaacttcctaaactgggtacacaaaaaagtagaagaaacctgatgcagaacaaatctacatcttggcctccttggggtcctggtattcagcttctggagtctggtcgccaccaccactgctgccgctgtcaccaccggcagccccgccaccaccctgcatgtgctgtccaatctttgagactgccttgttcgccgcctccagcttctgcttgatggcgtccaaatcatcgccagccattgctgctctcagatcagagacagcagactggatctccgtgacaacttcagcagggaccttgtctttgtactcgctgacgctcttctcgatgctgtagatggtggtatctgcagagttcctgaggtcaatcaacgacttcctttcctgatcccgctgagaattcagctcggcctccttgaccatcttctcgatgtcactgtcagacaagccacctgacgatttgatggtgatatcttgctctttgccggtggacttgtcctttgctgacaccttgacaattccattggctgacctctatctgtggcatacccctcggggccggccccttgccgccgggcgaatgcc

SEQ ID NO: 30068 - DNA, 673 bp, Triticum aestivum
  Clone ID: PAT_TA_30068
gcttcttaaatcatcgatccaccattagatgagtcaggaaagaaatcttcctcttttacatcaaagatagcacactaaccacttccttgtttgtacgatggtgtagtaccaagcctatgccccttcactaatcactcatactatctcacccactttgtattatcatcatcctctcttctctataccattcccttgactgatatatagcagcactactcaatgaattttgtcgctggatcacacaatcaaactgaacctcgtgtaggatttgggggaggttgtcggcgagccagacatcgaagtcctcatgcgacgacggcgcgtcgacggagaggatgcagacgatctcggcgggcgcgtagccgctggtgtaagcatccacgggggaggctccaccgccgcggtccagtagcgcacggcgaccggcgcagagcatggcccggtgggcgccgatttggcagcagagagtggcgcgttcggcgtcacaggcgtcgcaaagcggggcacataggtggaggctcgcgagcgcgctaaccccgtgcacggcgccgtcacactcgaagaagagcctggcgccgtcggcggagtagaagaacacgacgcgccccgtgccgcgtcacaggcgtcgcaaagcggggcacataggtggaggctcgcgagcgcgctaaccccg

SEQ ID NO: 30069 - DNA, 711 bp, Triticum aestivum
  unsure (1)..(711): unsure at all n locations
  Clone ID: PAT_TA_30069
acccggccttgccgctgctgcggcagctgcgcggccacggcgctgtcgagcctggtctccccctggagcgtgatgagcgnccgcaccgtgctgcggtggccctggtagagcgccgtgaaggcgccgcggcacagctcggtgccgttgaaggaggcggcgacccagccgccgtcgtagtacaccccgatgcgcctgttggggttgtccgttatcacctgcacctcgaacgcgtcggacaccgtcatggaggtggtgttcacgtcgaaccgggtggccgtcagccgctccacgcggaacgtggggatcttggggcggaacacggcgtagaggatccccgccgtggcgccgagcgcgaccacgagcaggatcagcaccagcagtgtgcagcacacgcaccggcagcaccggctgtgccgcttccgccgcggcgcgcgcagcggggccgcagcgcccggcgcaggggcggtgatcggcagccggtcgccataggcgccgctgggtggcggtggcagcttgtccttgttttgctccggcaccgggggcggcgcgccgtcgacgatcaccgggtggacccggtggtagcttgccatgctctctccacctgctggctagttagctcctgcttgcttgcttcttacagcacgtagaagtagaatgaactggtttgcagaaagaaaatttcaaagctaccgatgcagttccggcccggcc

SEQ ID NO: 30070 - DNA, 1255 bp, Triticum aestivum
  Clone ID: PAT_TA_30070
cgagccaatatcttctccagaggaattcatagcaaaaggaatacacctcggatcttatttattacactaaaaataatgaatatgcgagccaaactgaataaataataaatttacagcactacccatctctaccatctgccgatccgatctcaatcaatatagatcgacaggaacggggacgagacctcggcaatcctacatacaagacacacgtatatatgcacaatccgtgcacggctcaaatggtttgggaatgatctaattaggcttgagcttgaaggtgcagctgttggatcggatgcggagccgcgtgccggcctcgaggctgtccaccaccaggctacaccgcgccttccccgtcatcgtccacagcttgagggcgccaaacttgatgcggatgggcacgcgcgcggtgaccgtgagcggcacgaacccggcctgccgctgctgcgccagctgcgcggccacggcgctgtcgagcctggtctccccctggagcgtgatgagcggccgcaccgtgctgcggtggccctggtagagcgccgggaacgcaccgcggcacagctccgtgccgttgaacgaggcggcgacccagccgccgtcgtagtacaccccgatgcgccggttcgggttctcggcgaccacctgcacctcgaacgcgtcggacaccgtcatggaggtggtgttcacgtcgaaccgggtggccgtgaggcgctccacgcggaacgtggggatcttgggccggaacacggcgtagaggatccccgccgtggcgccgagcgcgacgatgagcacgatcagcaccagcagcgtgcagcacacgcaccggcagcacctgttgtgccgcttccgccgcggcgcgcgcagcggggccgccgcgccaggtgccggggcggtgatcggcagccggtcgccatagtcggcgctgggtggccgtggcagcttatccttgttttgctctggcaccgggggcggcgcgccgtcgacgatcaccgggtggacccggtggtagcttgccatgctctcctcacctgactggctggttagctcctagttgcttgcttgcttgcttcttacagcaggtagaagtagtgctcgcaggatgaactggcttcaagaaagaaaatgttcaaagccaccgatgcagtgggagtccggcagcgatgcactccaagtttatacgtgatggctggtgtcaagttggtgtgtgtggttggtgctgcttgggtttctttctagatgtcgagctttcttc

SEQ ID NO: 30071 - DNA, 1273 bp, Triticum aestivum
  Clone ID: PAT_TA_30071
gcgctccccgcactccgccacccggggtcgccgacctcgacgtcggcgtctagggcgccgacaggggcgggctgctcgctgccccgcccacgaagactattacgggcaacagcagcttgacgtgcgcggcggtggggtccataccagaggcgcagctgaactacccggcgatactggtgccactctccgagaagccgttcaaggcgaagcggacggtgacaaacgtggggccggcgatgtcgacgtacaccgctcacctggacgtgcccgggtggctcaaggtgaaggtggagccagaggcgctggagttcacgtcggcgatggagaagaagacattcacggtgaccgtgagcagcaggggaggcgacgccgacgccgggcagctggcagaggggagcctacgctgggtgtctgaagatcacgtggtgcggagcccgatcatcgcggacgccagggttgtcccgacatgattctgtcaggcgttcgttgtactcagccagcctggttagcataagcacaagtatccatacagttcacaacatggagacattatcgttcttcccaactagcactactccttgaggtcccgattgcaaacatgcaatcacacaaatagggcacttatcaaaggaggtcactgagataaccttgtatctttactgtatcaaatatcactactcaaaatccaaaagggacggtgacaaacgtagggccggcgaagtcgatgtacaccgctcacctggacgtgcccaattggctcaaggtgaaggtggagccagaggcgctggagttcacgtcggcgatggagaagaagacattcacggtgaccgtgagcagcaggggaggtgacgccgacgccaacgccgggcagctggccgaggggagcctacgctgggtgtctgaagatcacgtggtgcggagcccgatcatcgccgacgccagggttgtcccgacatgattctgtcaggcgctccctggacatgcttctctcgcaagccgcatcaaaggcttgaatccgcataacggttccttcatcagctaataacaagcgttcgttgtactcagccagcctggttagcataagcacaagtattcatatatagttcacaaaatggagacattatcgttcttccgaactagcactgctccttgaggtcccgattgcaaacatgcaatcacaaaaatagggcacttatcaaatgaggtcactgagataaccttgtatctttactgtatcaaatatcactacccaaaatcctcaagtcgccagcac

SEQ ID NO: 30072 - DNA, 1398 bp, Triticum aestivum
  Clone ID: PAT_TA_30072
gatgacactacaaaattcgaactgtattatataatcagaccatatcatacaggaatcatacagtccattactttccagtatgtatccgtgcctaaaaatggaatttacatcaataaaccatctggcattgtaccaaaagtgccaaatagaattatgtactacgagagttcgaggtaaagcttttgctgctggcaaaatcatgcatccactccacccttcttcttacaagccaccgaccttaccagctgcaggtttgctctgcttcattttggctatgctaagaagatcgccaaagagcgagtcttctggcctgcttgctttattctgctgcttcagagaaaaggatgacgttgcaccattcattctctgagaaagttcatttgcactggtatacgcatatgcggcgttcgggatgtagtagcctccagattggtgcacatacccataaccggccatttgaactgcatatgactgttgatagttcatcccataaaactgtccgccgacaatcggttgggagttcatgcccattccttggttgatttgcatcgaattcgggtacatgcccccgtattgcatgttcggcacaaactgtggtgcttgctgcgcgccgagcaccggtggcaagcgcatacctcctggcatttgttgtgttgacatgaatccttgaccactttgtgcttgttggggttggttacccgtcaagtgctgaatttcccagggtggtggtggaaggcctctgttctgatcctctacaccataatttagtgcttgccgttgagaatccactccataagcaggctgcccattccatgaccttgtgacgttcggttgagattgttgaccgtaaggtacgatgtccccgtttgaataagtagtgggttgctgaggcagagtagggtgcactggagcagggtttgctcgagatgcaggggaaacaaaagagtttgtaagctggttatggtttctattgttggcagcaacactattttgttggaacatgtctgcaagggccaatacattctggtctgaagctgagtattcactgacaggaacaagcgccagcgagttttcaggttcaggtttgatgtagtcatctccactaaggaggtcgaaactaggagctggtgctgcaacaatagcttttgcactgctagatgatcgaggtgcaggaagtgctaattgttcaaagggtgactgcttgcttgcacttgtagtagttgctgaagacctctgcactgcttcttttgtagtatctggctttgctggcgtggaatggagcgatctctgcttctccaccggaacctctatgcctgcggcaatagcgtcgtgttttgctaaaacacgctgcagatcatcattcaaacaaagacccggctagcctcgtgccgaattcct

SEQ ID NO: 30073 - DNA, 1218 bp, Triticum aestivum
  unsure (1)..(1218): unsure at all n locations
  Clone ID: PAT_TA_30073
gcaacgaggctaatagatgatctactagaattgtcattatttcataaaaataacaaagaagatagtatgtgactgatccatgctcaatgcctaactgagctctgggataagagtagtcaaccacccacagatacagtgtcatttggagggaaaatctcttgcttgcactaaacacgtaacacgaacttcatatcacgtagtccgaccacctctgctccatggtcacccctggttgctcctctggccggagcgacggcgccgccttcttcccgatcggcttcgccgggtttccgacggccgtggctccacacgccacgtctctaagcacgaccgcgcccgcgccgaccttcgctccatcgccgatgcgcacattgccgagcacgctggccccggcgccgatgagaaccccgtcgccgaccttggggtgccggtcgccgcatgccttccccgtgccgcccagcgtcacgccgtgcaggatagacacgtcgtcgcctatgaccgccgtctcgccgatgacgacgcccgtggcgtggtcgagcaggatgcccccgccaatgcgcgccccggggtggatgtcgacgccgaacacctccgaagcggcgctctggaggagcagggccggcgggcggcggccctcggacccangagcgcgtgcgcggcgcggtgggcctgcagggcgaggaagcccttgtagtagaggaagcagtggaccatcttggcgcaggccggatcgcggtcccgcgccgcgaggaggtcggcacgcgtgtgctggctcgcctccgggtgtgccgccagcgcgccagcgaggatgtcccggagcgcgtcctgcggcagcgcgcccgggatgcagagcttcgcggacaggtgcgccgcgagggcggcctccagcgacgggtgcgacaggacgagctcggagtagaacatgcccagcagcggctcgtcctgcgcgtcggcctgcgcctcgccgtacagctcctcccagacttcatcgccgccgttcccgttcacgggcgcgcccgccggtgcggtgacggtgcagtccggcatgaagcggtagatggatcgggagatgcggtggcaggagtatgctgggttccacttgtccacacaggctgccatgtccgaccacgcgctgctagagagaaagagaggtggtgttgcggtgcgccgagagagagagagagagagagagagagattggagagatgtggcggagct

SEQ ID NO: 30074 - DNA, 2129 bp, Triticum aestivum
  Clone ID: PAT_TA_30074
ttttttttttttggttcatcctcaaatattcaggcgttcgtcgtatttacattatacacactttttttttgttgaattaattttttttttttttgaatattcaacaattataacaggttttaattaatatacaacgcaaatgtcttcctagttggttcatcctgaaatttctctactgttcattttatttacaagagaaagaaaagaaagcaatatgtacattattttccagggaacattcttcagtgccttgtatggacagtaagagcccttttggaacacagaaattttaccgaaacagttcaatccacattccccttacgggatggagaataaaccctgcattccaacagggccttaaatcaccagctaattgaagacactccaactgcagtaagaacactaaaatttatgcggattctgaacattttccaccgagcttcttcagtattggcaacgccataggcttcaaaagcatcaggagatcagcttttaatcagtacagcctgatcctggtggttatgtgctgctggcacatagggcagcgcaccaaatttttcccgcagtcatagcaagtctgatgcccacatccaaatgcaagatcctttgatttatccatacatatggcgcatgaaagtgtgctttctgaactttctgatgcataagtgtccggtatccttgaagccgcaggctgtgaactttctgatgaataactgtcaggcctccttgtagctccatgctgtcgctgtttgaaactgtctgattgctgaaacccacttgtttgttgaccaaagctactagaccgtgaataaacaccagactgttggtcaaagctagtagaccgtgaataaggagtccttggttggtggaggcagaggaactcttggaggtattccttggcgacggccaaggagttggagatcaagtgttgctttgtactgcgtagggatttccatcaatgctgacaacgcaaattcagcctcttttctatcagctgctatgctctttgacataatttccgtgaaattcacaaactggaaattgtcggaatgaccgagcaggtatgttgtcgtcaaacttatgcatcatatcccatggtccatcaccgaccccaacaagaacaatagacaagggaaagtggctagctttcactatagcatcaatggtatcccgctcctgcggacttaactgcccagactgtgtatccacacttcgagtaacctgtccatcagcaattatcagaagaacatgatattgaccaccggtgctgtctgcaatcccaattgctgtctcaattattggagcgaaagatgttggtccagctaatcgaagagttggaacaatttctctgtatctttccaatgcctcttcaaatccattgcatggttggttctctggataaaagctgaatacctcctggtcatgagttgatgcatcaccaaatccaaagcagggaatcaaattgtcttcatcaaaagctgaaagtgtccttccaataatagatatggcttgctcatatgggtttggagtgtttccaatatcatgtagacagcggcggttataggaaattttacctgtccattcattactttttgtaaaatcaatgcctacaataagatttgaagattcaaggcctgcctgagccaaagcttcagtcacttgactgacggaacggtagtcatcaccgatcctggaatacttcctctgcagcctggcttgtgcttctggctgctgcacgttgttacccgccgaagaggcataccttgggctgtaactggagggcgtgtttgcatacctcgagttatacccgttggatgaattcccatagtcagcagagttatacgacggcttggagtccttttgccccatttctcagcacttggctgaacttccctgctcccggcgtccaaggtcgcagcgcaggccgctgctccgggagtgggaagaggatcgctggagtagcggggacgaggggataggccgagtcagctgagaccaagatttgtacgcccggcacgacgagataaactataatcagcggagaagcggtggcgcgggtcaagtcaatcgccagcccgggaggcaatgcagttggcacttggcactggaagcgggggccagacggcaaa

SEQ ID NO: 30075 - DNA, 780 bp, Triticum aestivum
  Clone ID: PAT_TA_30075
cccaggatggatctgtacaggtcttcgtccaggttcgttgtacttctccgttccgcccggccgttcttgcgcccgaggcgcggaaggtgaggttcatgccgccggtcgatgcgcgcgccctgtgagttgtcgacgataggggccttttttttttttttttttgttgcctcaagttggcaagaattcttcttcccttccaccatattgtacagagcaggtccgccgaccaggtagcagtcaccaccacactggcagtgccgtggcatgccattgcaagttcaaacgcgacccaacgaaaagaaaaaccaaatgaattcgccactggaagtttgaaacaagaaatctccgaccacacgcgccctcggcggcggcggcatgccgtcaccggcaccgacacggcgaggcgacataacgttccagacccggctcgcactcggcagcttttttcacactgcctgaggcttcacggccggctcgagccagtcgttccagaacgccgcggcctccgggccgtggcccttcacgacctcgaccacggacacggtgtcggcgatccggaacacggtcaccttggcgacaatgtcgccggcctcagcctccaggtacaccggcccggcgccgctctttccttccctcctcacgcggtgcccctgctttttcccggcgtcctcgacccgggccagcacggccgcggcgggctcgccgacgaacacccgctccgtgcccggcccggcgccgaacagcccggagaggtccgagcccggcgagaaggccaggatg

SEQ ID NO: 30076 - DNA, 1918 bp, Triticum aestivum
  Clone ID: PAT_TA_30076
tttttgttgtcttttgaaataaaccgtccaagtatagtattatttcaaataggtttacaatatattcaggaacctcatagaaataaaacgtcccactatggtattatttcaaataggtttacaatatattcaggaaccacatattgatctagccacactacactagttatcgcataatactaatgatgttatgcaacagtagaactttgcaatttattttctatgtgggtaaaattatagtcttacagtatgcgcgcaactcttacagtttatatagtggtgcggctccgcgaataggtactctcaggacagggcgcaccgggagctggtccgtccgccgtgcggtgaggccgaacgtcatctgtcaaagtcgagctcgcgccgagggctgcccctggtggttccagggcacatccgggggccggcgccaaacggcaagaacgcaaagtcaccacccccaaagtctgcctttgctgcttcttcctcgaaccgttccggccggaactcctcaggcgcgtcgggccaatagcgctcgtcgcggcctagcgcccaagcattgaccaacacctgcgtgccccgctgcacgtcgtatccctgcacttggcacggttcctggcactcgcggaacaacaaacggcaggggcgggtgtagcgcgcagcgtctctcggacgtgcacttggcacgatgggtggcactcgcgggcgtgctaggacacggttccggtgcagtcgcaacgtctctcgaatgacgaagcgtaggtatgtgagctcgcttagggcgtgctcggccacggttccactggcttggaaggcttgtcgcacctcagttgtcgccttctgcatggccatcgggttgttcatcagctctgatatggcccactcaattgtcgtagttgttgtttcactgcccgcggagaatacgtccaagatgatggctttgacggcgtccatgtggatgggaaacttgagaccaccctccttctggatcttgagcagcacgtcgagcaggtcctcggcgtggtctccgccgccgtccatcctctgcaggtgctcctcaacgatgccgtcgagcatggtgtacagggtgtggcggcactcctcggctccactgagccacgcggcaagccgggacgacggccacatgtcggccaggttgaaccccgacgcgagctgcacgatgcgatcgagctcccggaggaacgcgtcgcgctccttgcaccggtcgcctatgacggcgcgcgccgtgctgtccgtcacgagcgtggatagcaccgcgcgcatctccacggggcgcgccgccgccgcagcctcgtctacggcgcggaccgctgtggcgacctcctcctcgcggatggcgcggaacgagaggacgcggcgcgctgtgaagagctcggacacggcgatcttgcggagctggcgccagtactccccgtagggcgcgaagacgatgtcctggccgccgtaggagagcacgcgcatggtggtgctgaggggccgcgtggcgaacatggtgtcgtggttcttcatcacctcgcgcgccccctcccgggaggacaccaccagcgtcttcacctggccgagctggagcagcacggccggcccgtagcgtcgcgacaggtcgcgcatcgcgcggtgagggagctgcccggctaggacgaggtggtgcaggctgccgatcaccggcagctgccacggcccaggcgccatacgcaggccgtcgccacgcgccccccagcgccggcggcccgcaatcatgatgagcagcgaaacgagagctacggcgaggcagaccgtgatgaaggtgtcctccatttgcgctctccctggcgactctgggtccgagctaaggaatgtagtgtcacctaaggaatttcgcttcgtgtgtttgcaagtggtgagtttcccggccccggccggc

SEQ ID NO: 30077 - DNA, 1555 bp, Triticum aestivum
  Clone ID: PAT_TA_30077
taggggccttttttttttttttttttcaagcgaatgtcaatctcaaattgcgcaatatgtacggttgtatatacggtctcccttgtaagaaggttgtgttgaatcgaaaaccgccgatcccattctcattctcatcatcatcacaagaggctaactcttgtcccaatcctcctcctctttctccacactccaagatattttcatatcttgtgcaaacctatcagccgcttactggaggctgttgccgttgttgccgatcaggttaggggagctgcggaggttgccagtgatcttgccggaggtggcagtagaggtcagccagttggtaacaccagagacaccagaaacacccttgacagaaataccgtagaggacaagtccggcaatgtggggagtagccatggaggtaccgctgatggtgttggtggcactgttgctggtgtaccaggcggagagaacgctggtgccaggggcaaagatatcgagaacggtaccgtagttggagtacgaggcaatggcccagttgctgtcaatggcaccgacagtgatggcgctgggagcagaggcaggagaagtgttggcagcgttggcaccatcgttaccggcagcaatggcagagataataccggagctggaagcagactcgacagcgttgttgaaggaagcagagtaaccaccgccgagagacatattgacgactgaggtcttggttcggcccttggagatgatgtcgtttgcagcccagttgaagccagcgaggatgatggaggtgctggatgaactaccctggaagaccttgacagcttggatggtggccttcttggcaacaccgtatgtctttccggcaatagtgccagcaacgtgagttccgtgaccgttggtgtcagcgttctggccgctgaaggcagtgtagacagcctgagcacgaccctcgaattcgttgtggctggtgatgataccagtgtcgacaatgtaggcataagtgcctgaaccagcattggtgtcgtagatgtagctggtagatcccttggaacggtgagagaccgttccgagtccccaggtagcgctactctgggttgtctcggcacgcttagagagagactctttctcaggctcgtcgacccagttgatggtccagacgcggtcctcttcgacaagggcgacatcagggttctccttgatctccttgatggtgtccttatcaaaagatccagcatagccgtggaagccatacttgccgttgtaggtgcgctcaacacccttctcggcacgctcgtttagtccacgcttgtggacatctccgacccagttgagatggctctcaatcttggaggcagcgatgtcagacttgagggtgacaatgtacttgccaggaatgacttcgtcagagttaaccttggcagtaggagcagcgttggcgaggccaaggaggctggtcgccgcagcagcgaggttcttgaagttaaccattgtgagaagatgtaaccgaataggagtgtaggtcttgaagtgtttatgaggatgagaatgatgagagtgacccgacccggccggc

SEQ ID NO: 30078 - DNA, 912 bp, Triticum aestivum
  Clone ID: PAT_TA_30078
tcgcgatctagaactaggctgaaggctgaagtgctgaaccatggagagcacgcgggcggccaccgccagctcgggcgtcggtcatggaggcagcgacgagggtgcggccgtcctcctgctgccgttcccggggcgcagggccacacgaacccgatgctggagctgggccgccgcccggcgcgcacggcctccgccccacgttcgtctccacccgccacgtgctctcctccaccccgccccccggcgcgcccttccgcgtggccgccatctccgacggattcgacgccggcggcttcgcctcgtgcccggaccccgccgagtacttctcccggctggaggccgtggggcccgagacgctgcgcgagctcctgctgtcggaggaggccacttcggtgcgcattctcatgtacgactcgcacctgccgtgggcggggcgggtggcgcgcccggccggcgtgcccgccgcggcgttcttctcgcagtcgtgcgcggtgaacgacgtctacggggaggtgtgggcggggcgctggcgctgccggtgacggacgggcgtgagctgctggtgcgcggagcgctgggcgtggaactgggaccggaggacgtgccgccgttcgcgtcggcgccggagtcgctgcctgttttccttaagacgtcgattgagcagttcgacgggctggaggacgccgacgacgtgctcgtcaactcattcagcgacatcgagccaacggaaaggaatatcaaacggagtccaattgacctgaaactttacgacgatgatttttggaccaaaagaagcccctgaagcaaaagagttgggccagaagagccacgaggccaccacaagggtggagggcgcgccctaccccccgggagcgccctctgaccttgtgggcccctcgtcggacgcgtggg

SEQ ID NO: 30079 - DNA, 593 bp, Triticum aestivum
  unsure (1)..(593): unsure at all n locations
  Clone ID: PAT_TA_30079
gtanagatagtatagcatgttaccgtacttttttctcaaagaaaaaaactaccgtacttttgtacactgtctgtactacactatacagtttcatcaccaaccgaatcccaccgcgtaaaatggaatggaaggagagaacaaggcgaaactacgtagaatatacagtactacagtagaaaacacagagcacgagccggcgctgcggtttagagattagaacgatgtcggctgcgcggcgccgcggcgcatcctgctcccccacgtttcgcctcgcgtgtccgccatccgccactgcagcccggccagctgtgcttcccagtcggcgaagcccgcgcgcggcgcggggctggagcgggacccggcggcgcccgcgcccgcgccacagcgcagctggatgtcgtagccccgcctgcgctcggggtcggagagcacctcgtaggcctcgcgcgccctcatgaaccggtcggcgccgcccgggcacgcgtccgggtgccaccgccgcgcggcgcgcctgtacgccgccttgatctcctccggccccgccgcgttccccaccgccagcacgtcgtacatcgtcaccctctccggcgccg

SEQ ID NO: 30080 - DNA, 743 bp, Triticum aestivum
  unsure (1)..(743): unsure at all n locations
  Clone ID: PAT_TA_30080
tggcgatgcgcctttgaggaggacggggacttggcgtctccgttggctgcggcattcgtggcggtgattgtggcgtcgtcttcagagtcagcggcgttggggtcgcggccgtgcttgtcggaggaggggcgccagatgttgcgagcgatctcgaagacggcctgctcgtgaggggagcggaaggagaacgtgttgccggagcaacggaggcgctcgacgcagttgcggtacttgcgcttaaggcggcgaagcttctcggcgagctggctcttggagaaatcgagctggaggcggcggcgcatctcctcgtagaagggctccgtgtcgtactggtgggacgcgaacgccgtaccccgctgcgccgtaaactcggcgaacgcgcgtaggatcacgatctcatcctcctccgtccatagccgctggaacaggggccgccgctccccgaccgtggccgtggcggaggcgggggcggcgacgggagcagaggagaagggagggttgggaattggatcgactgggaagtcgatgtcttcagagtccccgttgccataggcgtcggcgtcagggaaggaggaggacgcagcggcgccggcagcggaggggtcgtcgaccatgggaagcatcggatcggatcggagatggggatcgcctcgagtcggtgttagggttgggggttttcgctggattgggctcgagcctcgtgcnnnnnnnnnnnnnnnnnnnnnnnnnnnnnnnnnnnnnnn

SEQ ID NO: 30081 - DNA, 383 bp, Triticum aestivum
  Clone ID: PAT_TA_30081
ccttgataattcaactggataacgaaggcattcaaacattcttcgagagctttttccggttacccaaatggatgtcgcgaggattccttggttcgacgctttcgtcagcggatctcatgctgtttgcactctacatgtttgcaattgcgccaaacactttgcgaatgaacctcgtcagacacctcctctcggacccgactggttcggcaatgatcaggacctacctgaccttgtaaaaccatttgatgactagtctgcgagaaatctagaaagtgtacagttttgtagttgtacataacatagttagagatgttgggggatatcacctgccatgtgttgcctctgcctatgcctagtagtggagtaaagcgtggatcttgtat

SEQ ID NO: 30082 - DNA, 560 bp, Triticum aestivum
  Clone ID: PAT_TA_30082
atcgctcaacctcacccgatatctcgacgataaatcatggccctcatccgcgctgctgtcgcgcccctgcgcgccgcacgctgccttcgacagcccctctcctccagaggcttctccgtgtccgcccgacgacaaggaggtggtggctcgcaccaattcgaccctcccaccggttggctttggggtgttaagcctggcgagaaggctgagcccgagggctgggagtggcctacctatatccttctcggaagccttgccgccactgctgtagcgctcgccttcaagcctgatactactgtttctacctgggccctcgaggaggcacgaagaaggttagaggaggagggagttctgcccgacccatccaagcagggcaagaagaactaagccgaagattttgacatacgaagagtgaaagttggtcaattgtacatgttatttgcatttgaagaatggtattgctagacgtgctggggttctgccgtctaaaacgggtctgtgacataacctcggactttctttagcattgctgattgtaagccttaacaagcaattgtggc

SEQ ID NO: 30083 - DNA, 1692 bp, Triticum aestivum
  Clone ID: PAT_TA_30083
tcgagggccggccgtcgcgtgccggccgggggacggaccgggagtcgaactcttacttcctctcattgttggtaatattatcgtccttttttctcttcacgccactcgttacctgtcaggcttcattgtgacttttcgtccatacgccagacttattacaattaattccaggaatatctatatctatactattccctgttgtatatctcgatctttcgccgagaaaccaccaaggactttttcttacgcaaacaccatccatacaatcacaggattctatccaattacacactaggtcataatgcattccgttaaggttctttccgccattgcggcactcggtatctctgccgtctccgccgccacctgcacaagtgacatcaaggttactgagcccacccctagcatcgactgcacagttgtcaagggagatatcgtcattgacaagaaggtcgccggtgccgttgtgatcaatggccccgagaagattgagggtaacttcgttgccaagaacggtggcgacatcgtctctatcgccagtacctcaattgagtccatcgatggcaacttccagctcgaaaacctcgaggctctcagcaacctcgagttctcctctctcaagagcctgtctggcctcagcttcatcaagcttcctcgtctcggagagctgaacttcggtaccgaaggtgtcactaagatcaagagcattcgaattaccgataccttcatcagcgatctgagcggtcttagcgtcgccaccgtcgagagcttccagatcgacaacaaccgaaagatgaacgctttccgatctgaccttgtcaacatcacctccgagctgaagatcttcgacaacggcaacgatgctatggaaatcatcatggacaagcttgagttggctgctgagatccagatctccagtgccaagaacttctccgtccccctcctcaaggaggtcaccaagagcttgaagctcaacgcgaacccctcgctcgagttcttcagcgcccccaacctgaccatcattgaggagacactctctctcattgacatgaagaagctcaccaacgtctctttccccctgcttgaggagattggtggtggtttcactatccagaacaacaccaagcttgaggctattgatgatttccccaagctcgagaaggttaccggtggtatggccctccgtggtagcttcgagaaggttaaactccccaagcttgaccaggtcagcggcagtgtcgtcgtttcatcaaccaccgatatcgaggagttctgcaaatactttgacgacctgaagaaggacaagaagattgacggcgaggagaagtgcaccttcaacaacaagaatgccaacaagggtgaggacggtggcgaggagagcgatggctctggttcttcccaaagcaacgaggacgacagcgccgctggcagcgtcagcatcaacatggctgtccttgccctcgccggtgtcgctgctctcgctcagatcttctaagcatagatgaggcaagattactagcttttctctttaaaggcgtcattctctgtcgtcatcatgtttcctgaaaaaaaaaatacgaaatggcgtctatgatcattcttcatggggcacaaattgcttttcatgggggcggtaactgcgtgtaaaggataacccgttagagcttaataatcgattgtatttggactttt

SEQ ID NO: 30084 - DNA, 1227 bp, Triticum aestivum
  Clone ID: PAT_TA_30084
gacaggaggtaccccgcagcccggctcaaaagctccaccgccgcgctccgcaaacccgaccgaattctcggcctctcgcccagggaggcgacgccaccgcgacttccctccccgccgtcgccgcctccggctccgccgccgcgcccgccgcgcggcctttgcttctctcctcggagaatcgaggcacgggtgtcttcaagatggccaaaaattcaaggagcatgaaatattcgtctggtgagctcagatcaacgcgttatttgaggcccttcagccattgtagtttcaagagagttgctacccaggagccaacattagcagcaacggagaaatgtgcatggaaagacgcgatctgtccagtctgcatcgaatgtccgcatgatgctgtccttctactctgttcatctcatgacaaaggctgccgtccatatgtatgtggaaccagcttcctccactcaaattgtctcgaccagcttatagagtcacgcagaagcccaggaagcggtgatgatccaggctcgatagtgctcacatgcccactttgccgtggtgaggttaagggatatacactggttgagcctgctcgggagcagctaaacagaaacaggaggagctgcatgcaagatggctgctcatacagtggtacataccgagaactctgcaggcatgcacgaaagaagcatccttcggcaaagcctcgtgctgcggaccctctacagacttatagatggaggcgactcatgttcagaaccacgttgcaagacatgatctgcgcgacgagctcgtcaatgctccaagggctattgtctgccatgttgcagtgggaggagcttctgtcatctggttggcgtggaggtgatgatcaccttggtgctgctaatgatactgcagtgtaaatggccaatatggactttgttgctctgtgatctctgaattgctggcagaaacatgagaaaatgatgtgccattaccgttagcgcaacctcctacagaagttgagacctgacagagtagcagttgcctggatctgttttagggagtatgagtgacctatattcagaagaaacattgaggctttcatggatttaaaggtactagcaaaatggtggaatggtttaaatagttttttaggaagttcatatctgtccattttatctggtgtgtgatgcactgctcttgtgcatccctgttgactgttgcattgtatgaacataacattttcttctg

SEQ ID NO: 30085 - DNA, 1255 bp, Triticum aestivum
  unsure (1)..(1255): unsure at all n locations
  Clone ID: PAT_TA_30085
gacagcgccaacaaggaacagttcaagagaagagaagatggcttcttcttcctcgtcggtgctgctggttgcggcggtgttggccgcggtggtgtgcggcgcgcacggcatccccaaggttccccctggccccaacatcacggcgtcgcctgcgagctacggcaacaagtggctggacgccaagaccacgtggtacggcaagccgacgggcgccgggcccaaggacaacggcggcgcctgcgggtacaaggaggtggacaaggcccccttccacggcatgacctcctgcggcaacatccccatcttcaaggacggccgcggctgcggctcctgcttcgagctcaagtgcaccaagcccgaggcctgctccggcgagcccaccatggtcaccatcaccgacaagaacgaggagcccatcgccccctaccacttcgacctctccggccacgccttcggctccatggccaagaagggcgaggagcagaagctgcgcgacgccggcgaggtggagatcaagttccggcgcgtcaagtgcaagtacccgccgggcaccaaggtgaacttccacgtggagaagtcctccaacgaaaactacctggccctggtgatcaagttcctccaaggcgacggcgacgtggtgggcgtggacatcaagcagaagggcgaggacaagtggaccgagctcaacgagtcgtggggagccgtgtggaggatcgacaccccccacaagctcatcggccccttctccgtccgctacaccaccgagggcggcaccaagaccgtcgtcgacgacgtcatccccaagggctggaagcccgacacctcctacgaggccaagggcgggtactgaagatgatgatgatgattcttcttccggccagcttaattaattaacttcttttggctccagaagaagaataaaccagccgcacatatatcatacatatgatgcgatgagagcatgagtatatatacttattcattcatttactatagggaaagagcgtgggcaactaataatttcttgttttgatgtatctaaacttgctcatgattgtaaacatgtcttattaatagaaattggtatgcacacattaattatgttttcttttctttaaaaaaacccaaaaagaggtcacaagggctcgagcaaaaaaaaaaaaanaaaaaaaantncgggggggggccagnnacccaaatcnccctatatnaattttttccnggggggggnccggggnccncattttncccaaaa

SEQ ID NO: 30086 - DNA, 797 bp, Triticum aestivum
  Clone ID: PAT_TA_30086
catcgagcgccaatccccaccacctcctcggcccacccagccaagccccaagccggtcccctcccttcctctctgtacttgccggtgcccgcgcagatggacggcggagcgacggccgcggcgctgggcgcgtgggaggccgtgcggggcctcttcacgccggccacgctcttcctcaccgtcaacctcgtcatcggcaccatcctgctcacctcccgctcccaccagcgccgacgccagggcggccatgacggcgaccaccaagagcagccgctccaacaagtggagccgcagcagcagcatcaggaggacctgtactaccgcgaccagcagcagcagcagcagtacgtgcccccgccgccggcgccggcgccgctcgcgcgcacctcgtcggtgctggaccgcctccgctccatcggcctctaccgctttcgctccggcgacttcccgcccgagtacgccgcgggcgccgtgaccgactcgcgggacgtgacggtctctccggagccggcgccgacggccggagatgcccaccacgccaggagccggtcggagcccccggcgcgtgtggagaggaggcgggcgccgccgtcgaagatgaagaggtccagctccgaggcgaggagggccgaggtggccccagcgccggcggctcgggtggtccagccggccgtgctggaggaggaggaggacgacgacgaccttgcagaggacggacaccgagttcaccgacaactacaacagctttacgacaccgccgctcgcgcgcgcgccgtccgtcctggagtacttgcgct

SEQ ID NO: 30087 - DNA, 748 bp, Triticum aestivum
  Clone ID: PAT_TA_30087
agcccacgcgcccgggacccgagcagcagccatggccaagggagcagccggaggagggggagggggcgccgtgaagacggccctggtcgtcaccggcggcctcgtcctcgcctggctcaccgtcgagtccgccttgaagcccttcctcgaccgcctccgcggcgccgtctcccgctccaccgaccccgcccgcgaccccgacgaggacaccaccgcccccgaggaggacaagtcgcccgccaccgctgccgccaccgccgccgtcgccgccgctgtcgcctcctccgtcgccgaggagaaggacccctctgtcgccgtcgccgcggccgagccgtccgcgcccccgctccctgccgaggctgtggagggcgaggacaagggagaggacaaggaggtcgaactgggagagaagtgggaggcggccgtggccgccaaggccgagtgaagacgacggtgctcgcctcgcctggctccacttctgaatcgtacgctgtgaatctaatctacgcgtttggaggttgtgatggatgatgcaatgttttgaactctgttatcggtatctgcatctttagggcccgtcttaagattgaggcttaccctgggtcaatttccgacattttgcattcagtacttgatgtcatgatatatacatctgtatggatggtttcatttcccatggaaaccgcttgctatcccggtggacagggaacttattgtcacatagttggctccccctcttgaaaaaaaa

SEQ ID NO: 30088 - DNA, 406 bp, Triticum aestivum
  Clone ID: PAT_TA_30088
tttttttttttttttttttttgtctatcatgtgaccaagcagaactgggagattctttcagatttacattgacggagcttcgttgagctcattacaatacatcttctataattagagtatacacctagtccgaattactcactactactgtacgaagctcactcccaattctagcttaggctttatccacacctcatcaaaaaggtaaaagaaaagaaaagaaaagtctcgcctgaaacatatttacagatcttgtagatatttgcgacggtacacacagctctattgtactactatgtgttctgtggtggtgttggtatgccatcacggacgcgtgggcagcgactccgtttcgtccaggttgacggcggccacctgcgacggccctacgcggacgacggccacg

SEQ ID NO: 30089 - DNA, 1465 bp, Triticum aestivum
  Clone ID: PAT_TA_30089
tttttttttgggcccttctcttggttggcttttgtgcgcacatatattgtgtgatatgtcttgtagtgcttttttttttttttttttttttttgctttaaatgtcctgtattacagtatatatttgcttaatttcaccttattacatgctgacatgttattagtgcatactgccatgcacatttattggcaaatctcgcaacgcaacaccttcagaagttatagaagtacctgcccgggcggccgctcgaagatcactgcaccttcacactctgttccactcacacacacaggacaatacactagttactgtgccttactgtgttcctgtcgttattgtgtcatttccgtcgagataagttggtttttatgacgacgtcgcacgtgcatgcttagtttaccaactgggcttgttgacgaccctgcaggatttcctgacctcgccgcggtcaccctccttgaggtcgatctgccccatcttgcccatcccctgcgtgaacgcgtagaagaagtagccctggttcatggcgaacatgttcacccgccgctgcgtctccggcgactcgtacagcgtctggtccgagctcagcaggcccctccgctgctgcagctccttgaagtagacgccgtcgaaggccgtgctcgtccggtcgaacgtcgccgacgccgagtccccgcccttgctgcacgtggccgccagcgacgacgcgaacccggcgtccagcgtggacgcctcgaacttgaggcggggcgtgaacgacgggcagtgcgccacgcccagggtgtgcccgccggagagcgccaccatgtcctgcacgttgaagccgtgggtgccgaagagggtgatgagcgccgaggcgttgaggaacggcgacgggagcgcggtcagcgtgtcggtgtcgacggagcgtctcccgtcgcgccggccctgaggcacgtcgtagtaggggcccccgaccatgagcacggcgtccctggccgccagcgcgaggatgtcggcgcaggtgacgacgccggggcactgagcctcgagggtgtccttgatcttgtcgatcacctcgaacccgcgcaggctcttgttcgccagcgcgtccttctccgccttgctgcccggcgccgcgtccagaagcacggacgcgtcgcatccctgtacgaagcagtcatggaagtggagccgaaggaggccggcggcgagggtgggcgcccatgacggcgtcactcacgacgctccggacgatgtactcggcgaacgggcagttcatgccgtagtagttcatgctgagcgcggcgacgccgggccccgccagggccacggccacctcgacgaggatcaagagcttcacaaggttcttgacagcacccatcttgattagttcagtgatcgaccctaatttgctaagtgctgttctcgagtgatcgatgacaggtacaagaagaagaagaagacgagtgagcgctgagcacca

SEQ ID NO: 30090 - DNA, 833 bp, Triticum aestivum
  Clone ID: PAT_TA_30090
gggttggtctatgttgtattgatctgacccaggtgtggggtatatatagagtacaatatgagggagagatttggagtaggggacaagtcgtacatggtttaaaccaatcctatctctaacttaaacataattatacttctaatattccccctcagtcgtagcgggagtgaagcgggcgacggcgactgaatttgaactcttatgcttccgtcgtcttctcttctccgccatcatcaattgagtctctgatgggtcggcacctagggcggtgactacgtccccttctggtgccttctcgccttctcctctattccctcccgcagtcacatggggagtggcgtggacgctagtgacgacgcggacgctgttgactgaagttgttgccgatgtgttgctgtagaccaagccattaatgtcgatgtcgaggtagccgatcatggtgatgtagccgtggtcgatgtagtcgtgatcgatggtgtggtcgtcgtggatgatgaagccgcacaaagccggaggcgcaaaaaatgcgctatgacggagctgcagacgtggacaatgcaccttgcgaatgtcagagggtgccgtcggcgatgagtccaccggttttgccaagaccggaggaggcccatcgagcacacatcgattttgccagaaccgtgtgcccgtgtaggggtcgtcaatgtagtgacgccgtgtcgatgcagtcatgccgtcatggatgacgcggtctatgccatcgtcgttacgcggtcattgccatcgtcgtggtcgcgtcttgcagaaaagtctgtcacaggacgctaggtgtccatcttgtggacgaggcggcggcc

SEQ ID NO: 30091 - DNA, 809 bp, Triticum aestivum
  Clone ID: PAT_TA_30091
gatgatcttaagaatttattgttgatatttcagaaaacattttgtggtcttctgagtaacttgtgcagccagccgaccgacaacctttcatttgtcctccgtgatcatgagcattaaacctggccaaacattatgggattcttaaatcttgttgctgttaaactccatctgcacatccccacaaacgaaaagataacataacacctttttaggggaaagttcattaccatcttacatgtaatcgaacccccaaaaaaaatgtgaaaaagagggctaggttgctagccatgaaagaagaatattaacagtacatttttcacaattagcagtacctatcttttctctagagagagaccggccgaagcctatacctatcgggaagaacaaatggaacagccggagcacaacatcagcaaaaactactgaaagagagagaccggtgatatgatacacttcacaactttacatagagaacccgctactagtgacccgcgcctcgcctgcttggccccgccctcgcgacgacaaacaccggcaagttcgccgtggacaagccgccccctccgtgggcatgatcgcgcaacggcctggagcactccgccaacagagcgcaggcgcacaagagcagcaacaccacggtgatcaccacacgtaagctcgccatcctctagcgccgcggcggtcgaaggcggtgttgatacgggctaggcctttgtcggcggtggtcgatcagcaagagagagtgctctggtttcagaaggagaggttgtgtgcgtaaggtgttggtcgtgttcccgaaaccggccggc

SEQ ID NO: 30092 - DNA, 976 bp, Triticum aestivum
  Clone ID: PAT_TA_30092
ttccactacaaccaatcaacatcttgcgtcggagcggcaagataacacagcacgaaaacagggcagtcggaaaatagcatcgagcttacaacagcagatgataaaaacagcttttaacacaacacgatcgttcgcgcgaccgacttaccagcaatcatcggtttcagacaaatggttacaaatgcaaactacggcgctaatttcccctcccctggcaatagactgatctacttcatcccaaaagagaacgacagctttggtcgcgacttgttcttgcccagcagcttaatctggttctgcttctgctgctgctcctccatttgcttctgcttcatggcttcctccctctccttctgaagcctctccagctcctggtaccgctccagctctttctgctgctgctccatcgctaccttcatctgagcctcctctgctttctttcgctcctcttcgagctccttctctagctcttctcgctctttcttctcacgttccgctctctgttgggcttcgaccaaggcggacaccttctctttctcaatttgggcaaccacctcctcgtgcatccttcctcgccctccatcgattcgacgctcctcctcttgttgcctctcctcagcttcctttcgacccccgccttggtgcctaatagcttgcgcggcgcactttgcaaaagaaaatattgacagatgccaacactcaaatcaaatatctaagggcacaaaagcaaggggcggatttagaatctttaacactatctatcatcgactatacctctcatcagcatagtgttgaatacagactaatgcattttaggcatacctctattatgattccagatccaaaaaatgaattagcaaaactggtcaagagtagataaaggatcaccaattgcatcatcaaatataacaagtggaactatagcagtatcttccttcagaaaagcctgtagagaagaatgtcaagagtaaccctc

SEQ ID NO: 30093 - DNA, 1070 bp, Triticum aestivum
  Clone ID: PAT_TA_30093
tgcagctggataggggccttttttttttttttttttcggaatcgacacttcgtgttgggcttaaatttatcttttatcatagcctcattggggctggctatctccaggttaggtagttaaacccgcaaagtaaacgtcaaatccggactccagaccacatgccattttttaccattcctatcgcaaatccacaatttagtgagagatggcgtaagcgcgtcggcggtcacgctcctcagcgatggtgagcttgacacccttgcccttgggcagagagatccagggcttgtcctggccaatgatgaaaacgttgctctcacgggtggcgaagctgttgtcaatggcatccttgacgtggacgatgttgaaaccaccatcgtgacgctcacggtgggtgatgacaccaacacgacccatgttgcgaccaccagtgaccatgacgacggcgccggtgtcgaacttgatgaagtcggtgatcttgccagtggcgaggtcaatcttgacagtgtcgttgaccttgatcagagggtcggggtatcggatggttcgtgcatcgtgcgtgaccaagaatgggattccaccgcgaccaagctggacacgcttgaccttgcccagcttgtactcggcctcctcgttctggattcggtggacggtgaatcgacccttggtatcgtagacgagacggaagttctcgccagtcttctcaatggtgatgacgtccatgaagccggaggggaaggtggaatcggtgcggaccttgccgtcgaccttgacaagtcgctgcatcaggatggccttgacctcgcggtagttgagagcatacttgagtcggtttcggatgaagacgatcaggggcatgcagtcgcggagcttgtgaggaccggcagaaggcttgggagcgtaggtgccggacagcttgtcaagcagccagtgcgagggggcgctgaggcgcttctggtgcttcttgattccgcgggccattgtgtcggttggctggtttgtcggcggtgatgaggaggatgcccgagagggacctacccgacacaggggaaatttttttttttttattt

SEQ ID NO: 30094 - DNA, 1160 bp, Triticum aestivum
  Clone ID: PAT_TA_30094
cgattcggacgagcttccaatggcggaaccctaagctaattccacgcctcccacctcgcccagcgcgcatggaccagccggcgtcggacgccggcgcctgcctcgaggtccgcctcttctacgtgcgcctatcgccccgcagctccggagctgccgccccgccacggctctcgctggccatccaccacgccgggaccgaggcctccccctcctcgctccctctccgcctcgaccgctgcgacccagtctctggcgaggccacctacgtctctaccgcggccgcgcgcctccccccacccgacgcctccttcgaggttgcagaccaccgcgacgccgccctcctccgaggcacccttcgacggtgccctgacgccaaggccgattcccctgcctgggcgatcgactgcgtccccgccgatgcagcggcggcctcagcctcggcctttgaggtctatgttgccgggtactgcgcaggcgaacccgccgttctcacgcgagccctgcggctggccaccccggaagaggctgctggcggattggttcggcggcgatcagcacctttggcggctatgtgtgatgaagacgagagtgacatgaacatgggaaccagggcataccctgaatgatggtactctgatgacgacgacgggcaactcacatggttcaacgctggtgttagggttggcgtcgggattgggctgggagtctgtgttggagttggtataggcgttgggctcctcatgagctcctaccaagcaacggccaggaacctgaagaggcggtttttctgacactgtcgctacaaagggctacgacggccagtaagtagagatggcccatccgatgatgttccgcgctgaaccaacccccgtatgtatagttggtggatttgttgttcgttgcattgttgctggtcgtctggagtttttgacttgtgtagctctcatatctgtgtatgtaatctgtgaaggtgtccctgaacttgtggaagtggcaaaaatggacttggcatggagcagacgcactgtggccttattttgtaagcttcagaattgtgctacaagtcaataatgtgtatacaagtgcgacagcctttcgctttgagcgaatgttgtcggatgtatgttttaaaaaaaaaaaaaaaaaaaaaaaaaaaaaaa

SEQ ID NO: 30095 - DNA, 1069 bp, Triticum aestivum
  Clone ID: PAT_TA_30095
aacgttgtgagtcgtgatgacgtggtctacctctagtctaatcaaaaactacccttgtttccctctctttctattttaaacatccatttgttttatgagttaactactcacgtccgacttcctcgagacccttgaccaggccttcgacagttcctttcaaggtctgacagttgactacaacccgaaagaagctgcccttaggcccgggtgcataatcaaccatgtatcctcgaagaattatcttctcaaccatcgtcttagttcggagtgtattctcctccttgtcctcggacagggttcctccaggggcgttgtaaaagcatatttgcagacagggaggaggatcttgcgacacaagaacaaagttgtcgctttgcttgatgaggttggctaagtaggcagcctgctcgaatgcgtgatcgatttgcttctcgaaaccggccgcaccgtagtagatccaagccaatgcaagcttgagactgtcaccgcgacggccacactgcagtgtcaggtctgcaagatcccagaagtcgccgccatcgttggtgtggaacaagtagccagcagcggtgctgttagccttgttgaagatacccatgtcgggacctaggaggaacgagcaggtgacagggacgttcatcatcttatgagggtttaccgtcagtgagtcagcaagatgggccccattaagcttatgcttgtgctttgaggagaagatggccggaccaccccagctggcatcgatgtgcatccagagaccaaattccttgcaaattttggagatttcttcgaaaggctcatatgaacccatgacagtggttcctgctgtggagttgacatacaggggggtcttgccctcagacttggccttgagaactaactctctcagagcatcaggcttcatgcatccgacctcatttacaggaacaggccaaacgctgttggaacccataccgcagatcatggcactcttttcaaccgagtaatgaccgtgcgcacttgtaaaaaccacaaaatcatgcttaccgttgccctcggttctacactctgggaacaaagtgttgcgagc

SEQ ID NO: 30096 - DNA, 411 bp, Triticum aestivum
  Clone ID: PAT_TA_30096
ggagcggaagcaagcctacatagcggagctcgagtcgctggtcacccagctcgaagaggagaacgcccacctgtccaaagaacaggaggaggcaaaccagagacggctgaaagagctcaaggaaaaattgactccagtcattattgcaaaaacgccgtcacaagatcttagaagaacaaactcaatggagtggtagacatgagccaagctcagtagccatccccttacagctatgtagattttgatttgtttgtctgtcattcctctgtttattggagttaactcagttgttgtaacttagtagatatagcataaacagcttaaatggaatcataatgtgtagagcggaaggctgcgtttgagcaaaatggaatctcatcagcagcttatattctgtctgatttgcctttc

SEQ ID NO: 30097 - DNA, 147 bp, Triticum aestivum
  Clone ID: PAT_TA_30097
cggacgcgtgggcggacgcgtgggagctagtctatctttttccggaaatgacattatctttgcaagcaaacatgggcatgctgcttttaaatttgtactgcaagggacaagaccattatttgaaaagctactagttttttttgggtg

SEQ ID NO: 30098 - DNA, 1057 bp, Triticum aestivum
  unsure (1)..(1057): unsure at all n locations
  Clone ID: PAT_TA_30098
ccccggcccccgctcgcggcgccagcaccggctccgccgccgccgcgccgccgacgccgccgggacggccgggcccgacacgctgggagctgggctcggacacggtcaaggaattccagttcggctgcacccgcgtcgaggagggcttcggcgacaagaccgacgggctcatggggctccgccgcgacgcgcagtcgctcatctcgcacaccgcggcgacgtacggcagggccttctcctactgcctcccgccttcccccggtccaaaggggttctcccacgcttccgcccaagagtgcgacgacgggcttcgcgacgacggggatgctccgaagcgagcaggccccgacgttctacggcgtgctcctccagggcatcaaggtcggcggggatcagatcagcgtggcgccctccgtcttctccgccgggtccgtgatggactccgggaccatcatcacgcggctgccgcccacggcgtacacggcgctcaagacggcgttcaaggacggcatgaagcagtacccgacggcgccgtccaggagcatcctggacacgtgcttcgacttcagcggccaggacaacgtcaccatacccaccgtcgctctgatgttcgacggcggcgcggtcgtcgacctcgatgccaacgggatcatattcggcagctgcctcgcgttcacgggcaccgacgacgacgagagcaccggcatcatcggcaacgtgcagcagaggacgctcgaggtgctctacgacgcaggccagagcgtcttcgggttcaagtccaacgcgtgctagctgctcatctgcgcgagagctcagtgctcgcgcgcgggaaggaatggtggctagctaggctgctctcatgtgcttgtctttttgtttgtagtcgcgaggtaagggacactgggccaaaatcatcatctagcagactatttaatttctctctgatagcagcaacttgatgcgacacatgtgtaatctttcaaatcaaacgatcaggataatcttctcctaaattttcattcatataaaantccaggggggggcccggtncccaatt

SEQ ID NO: 30099 - DNA, 481 bp, Triticum aestivum
  Clone ID: PAT_TA_30099
gctgggtcgaaggggacaacggcggcgtcagccgggactcgagagcctacggccctgtgccgcttggtctggtgcaggggagggtgacgcacgtggtgtggccgcctagcaagatgggccgcgtcgacaagagggtgccgtcggaaggaaggggaagggtcatgccacagcgcaatctctagcctcccttggcggccgctttgtcccgcagttttgttcgtcctcacagaagattgattcatcatgtaataacaaatgtaacatgaacagacattgcgcgttccagatgtagcagagcaatagagactttcttctgtaacattacctatcggctgtataagggaagggcaagcagaagctttggtaggaggagcctgctaggctaggcagtagctgcaggcaaattttgggtggatggtgatgatgcattgacgtgtataatgtatactccctccgttcctaaatatttgtccttctagac

SEQ ID NO: 30100 - DNA, 946 bp, Triticum aestivum
  Clone ID: PAT_TA_30100
tgctacgaccaggtcgtgcatgacgtggacctccagaagctcccggtgaggttcgccatggacagggcggggctggtcggcgcccacgggcccacccacggcggggccttcgacgtggcgttcatggcgtgcctacccaacatggtcgtcatggccccgtccgacgaggccgagctgctgaacatggtggccaccgccgcggccatcgacgaccgcccctcgtgcttccgctatccgaggggcaacggcatcggcgtcccgttgccggaaaactacaaaggcaccgccatcgaggtcggcaaaggcaggatcatgatcgagggcgagagggtggcgctgctggggtacgggtcggcggtgcagtactgcatggccgcctcgtccatcgtggcgcaccacggcctcagggtcaccgtcgccgacgccaggttctgcaagccgttggaccacgccctcatcaggagcctcgccaagtcccacgaggtgatcatcaccgtcgaggaaggctccatcggcggcttcggttcacacgtggctcagttcatggccctggatggccttctggacggcaaacttaagtggcggccggtggtgcttcccgacaagtacatcgaccatggatcaccggccgatcagctggtggaagccgggctgacgccgtcgcacatcgccgcgacggtgttcaacatcctggggcaggcaagagaggccctcgccatcatgacggtgcagaatgcctagagccagtgtgctgcctcctatagagaaccttgtacattttggtcgttaggtgattcagagagattagtcggcgtcagaaaattaaatgatcctcatcaagggaaacgttggtagtttttcgttctttggtgcactgacgttgatgtacatggttaattgttcgtggagtggacacatacgttgtctttgttttcttggagtgggc

SEQ ID NO: 30101 - DNA, 598 bp, Triticum aestivum
  unsure (1)..(598): unsure at all n locations
  Clone ID: PAT_TA_30101
gctttcttccttcttcctccccaactcctccgccctctcgacctcatcgcccaccacccacgcaagcgcctggatcgccgccggtcccgaccatggatccctacaagcaccggccgacgagcggggccaactccggctactggaccaccaactccggcgcgcccgtctggaacaacaacaacgccctcaccgtcggggcaagcgaggacctatcctccttgaggattaacatctgattgaaaagcttgcgcagtttgaccgggaagcgtatcccttaaacgtgttgttcaatgcacgggggaancaattgcaaaagggattcttttgagggtgactcatgaatgtttcctcaaactcaanaatgtggcttgacttttctccgggggctcctgggggggttaanaacccccgggntaattggtcccgggttctctaactggtcccttgcaataagcgttggnaancccctganaaccntttaangggattccaancgttggntttttgcnggtggaaanttntaanaaccaaaanaaangggnaaanttttgacccttgttttgggaaanaaaaaatgccttggtgnttttttaaaccc

SEQ ID NO: 30102 - DNA, 344 bp, Triticum aestivum
  unsure (1)..(344): unsure at all n locations
  Clone ID: PAT_TA_30102
gcaccccataggtgacgtgggtgcacccgcctcaactcccaggcctgaaatgtgatggtcctccgatcttaatagaataaagctaagtaagtgaattgctgggagctaagtatagcaaagctgccgtgtaatggatacggntaatacgtaccgagtgagtacctcctagatggccagagcagtgttgtcgaggaggaaataagcctcggacaacgatggttgttcaatatatttgaatcaaatgttttaccgctttgcatccatggtaaattgcatttggtgtgtatcaactatctaaaaaatgaatttgacacaaattgagagagagagagaaaaaaaaaaaa

SEQ ID NO: 30103 - DNA, 824 bp, Triticum aestivum
  unsure (1)..(824): unsure at all n locations
  Clone ID: PAT_TA_30103
attcactcaactggagaacaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccctcgttttgcaacagcaacaacaattggtacaaggtatttccacccaacctcagcagcaacaacaacaaggtcaacaacaacaaggtcagggttctagccagccacaacaacaaacacaactggatcanggttggaatgcggtgatangggacatggtgattcagaccattcccgcaatgtggcacgtgcatgttccaccatactgctacaccaccatatcaccatccaattgacgcactacccgcatgggcggctactggagagtctagtatcccgaaaaacggaccaagcatggnttagtcaatgggtccgattcatgtttacggtgaaaaaataaagggccatgcattattcatgtgtggattagactgggnactaatttcaaacttggggaaaataaagggcaaacctaagtttttttttgcgaaaaaaaaaaa

SEQ ID NO: 30104 - DNA, 777 bp, Triticum aestivum
  unsure (1)..(777): unsure at all n locations
  Clone ID: PAT_TA_30104
gagaacaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagacccatttccgcnatgtgcgacgtgcatgttccaccatactgctacaccacctatcaccattcattggacgtactaccggcatgggcggctactgagaggtctaagaatccaaaaacggaccacatttgttaaagccaagggccgacccatggacgggggaaaaataaggggcatgccatatcatggggggctaaactggcaccaatttcaaatttgggaaaaaaaaggcaaacttaat

SEQ ID NO: 30105 - DNA, 908 bp, Triticum aestivum
  Clone ID: PAT_TA_30105
tttgattcccctgctcgaaattaaccctcactaaagggaacaaaagctggagctccaccgcggtggcggccgctctagaactagtggatcccccgggctgcaggaattcggcacgagtaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgatccccaagcagtcaagatgtgaggccatccacaacgtcgtgcacgccattattttgcaacaagcaaaaacaattgggtacaaggtacttcaacccaacctcagcagcagcaacaacaaggtcaacaagaacatggtcagggttctagccagccacaacaccaacaacaacaacagcaactggatcagggttggatcgtggcgatagggacatggggtgattcaaaccgttccggcaatgtgcgacgtgcatgttccaccatactgctacaccaccatatcatcatcgagtgacgtcactaccggaatgggcggctactgagaagatgagagctctagtatccgaaaaatggaccaccaatgtttagtcaatggtccgatccatatgtagcggtgaaaaataaagtgccatgcattatcatgtgtggcaagtactagttgcaatatggaaatgatgaataaatggcaaactaagttattttc

SEQ ID NO: 30106 - DNA, 768 bp, Triticum aestivum
  Clone ID: PAT_TA_30106
actcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcagaccatcccggcaatgtgcgacgtgcatgttccaccatactgctacaccaccatatcaccatccaatgacgtcactaccgacattggcggctcctgagaagacgagagttctagtattcgaaaaatggaccaccaatgtttagtcaatgatccgaaccatggtacggtgaaaaataaaggccatgcattatcaggtgtggactagaattgggcctagtc

SEQ ID NO: 30107 - DNA, 921 bp, Triticum aestivum
  Clone ID: PAT_TA_30107
aggatatgcattgctcagcataactttgttaagtagacatgtttacactcttgtttcatacaacaacacaataatgatctttcgctcatacacaaacatgataacgatgaggggctccaggctgaattgtgaacgacggaagcgtcacttcatgtacctctgaagaaatttacggtggaaatcactcctgatggtgtcgttgatgaaccgtttcggtgtcttggtctctcctcgtgcttgattcttgaataccacgtcgtcgtcccaccttctcttaacactgaaggatccagcattgttgatattaatcaacgggtttccccgcatcagttcagcctccttcatcttggcctcctcttctgcttgttgccgctcctttctaagcttctcctcggctctttctttcttaatcctctcaagctctgccattagagcttcagtgtcgtcgtcatcatcatcttcatcgctctcgtcatcgcttttaggctccacatcggagtcatcagcatcgatttctcgtggaactatcttatcctctgcctctctctttgaaccttctaagagtagctggcttgagcttttccgccggtctctttcttcagaataggacttatccttggaagagtagtgcttgcgctcgcgttcctcaagttcctccctgaggttcctcttctgtaactcctcttgggtctgttgaccatcttttctgggcttgagggaggtgtgcgcggcgaggtcgcgggaggagtacttctgggaggggccgaagatgcgggtgcccccctgctcgttgccgcccttggccggcgcccaggtggggcgcgccgccgtcgtcatctgcaaaccctagcctgcaagggaagctgcggacgcgagaggagaggagaggagacgaggagggagacgacgcgggggaccctc

SEQ ID NO: 30108 - DNA, 683 bp, Triticum aestivum
  Clone ID: PAT_TA_30108
ctgctccagacaaggattttctcctatgctgatacccaaaggcaccgtcttggtccaaactacttgatgcttcctgtgaacgccccgaaatgtgctcaccacaacaaccatcatgatggcttaatgaatttcatgcacagggatgaggaggtgaactacttcccttcaaggtttgatcctactcgtcatgctgaacagtaccctatccctcctcgcgttctatctggctgccgggagaagtgcattatcgagaaggagaacaatttcaagcaggctggcgagagataccgatccttcgaccctgccaggcaagaccgtttcctacagcggtgggttgatgcgctcacggatgctcgcgtaacccatgaaatccagggcatctgggtctcatactggtcacagtgtgacgcgtccctcgggcagaagctggcatcgcggctcaagattaagccgagcatgtagatggaaaaggaggagggaaccagtcgctcactaacctcggttggtgtctcaatcgagccaaggagggtgcacatgaactgaataaaaatgtgtaacagtgaaatgaatatcgtgtgtaataccgatgaacaatgatggtgggtgttgtgagccggtgttgccgggttcgtctgtcgtactgtgtctgtgcaaaagaggaaataaaagacattgtgttggtt

SEQ ID NO: 30109 - DNA, 713 bp, Triticum aestivum
  Clone ID: PAT_TA_30109
catttacacagcaacaacaaccatcgttttcacaacagccaccaatttcacagcagcagcagcagcaacaacaacaacaacaaccatttacacagcaacaacaaccaccattttcacaacagccaccaatttcacagcagcaacaaccaccattttcgcagcaacaacaaccaccattttcacagcaacaacaaataccagttattcatccatctgttttgcagctgctaaacccatgcaaggtattcctccagcagcagtgcatccctgtggcaatgcagcgatgtcttgctaggtcacaaatgttgcagcagagcatttgccatgtgatgcagcaacaatgttgccagcagttgcggcaaatccccgagcaatcccgccatgagtcaatccgtgctatcatctactctatcatcctgcagcagcagcagcagcaacaacaacaacaacaacagggtcagagtatcatccaatatcagcaacaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcatgggcggctactgagaggtctagtatccgaaaaaggaccagcattgtttagtcaat

SEQ ID NO: 30110 - DNA, 1186 bp, Triticum aestivum
  Clone ID: PAT_TA_30110
aacgtgtcaacacctacaccttaatcagcaggggatgaaaggctcaccttgttaagttccattggaagcctacttgtggcgtgaaatgcttgcttgatgatgaagctgtgactgttggaggtacctgccatagccatgcgacaaaggatctatatgattccattgcagctgggaattaccctgaatggaagctctacatccagactatcgatcttgaccatgaggataagtttgacttcgacccgcttgatgtcaccaagacctggcctgaggatatcatcccactgcaacctgttggacggatggtcctgaacaagaacattgataacttctttgcggagaatgaacaaattgctttctgcccagcgattattgtccctggaatccactattctgatgataagctgctccagacgagaatcttctcctatgctgatacccagaggcaccgccttggtccaaactatctgatgcttcctgtgaatgcaccaaaatgtgcccaccacaacaaccaccatgaagggttcatgaacttcatgcacagggatgaagaggtgaactacttcccttcaaggtttgatcctacccgtcatgctgagaaggtccctattcctccccgtgttctaacaggctgccgcgagaagtgcatcatcgagaaggagaacaacttcaagcaggctggtgagagatttcgatcctttgaccctgccaggcaagaccggtttatccaacgatgggttgacgcactgtcagaccctcgtgttacccatgaacaccatacgatttggatcaactactggtctcagtgtgatgcctctcttggccagaagctggcttctaggctgaacctgaagccgaacatgtaagattgacaaggaagaaagcaggcgccggtggccgaggatgcaacatggagcgtgatgcaacacatgttggatcgtgcgatgttgagaacggctgttacacctatataatcgaataaacagggatgtgcgcgttgtagtatgctgatgatcggtggtggttatatatcctggaacttttggtgtacacatcttttctggaaagacgtaataataaagaagaatgtgtcaatgtggtgggcaacagtagcagacgatgtagtttacggtggcgttgtttttgtcgcctgtaatgcaaaaccctgctgtgtgctcgcctgtct

SEQ ID NO: 30111 - DNA, 531 bp, Triticum aestivum
  Clone ID: PAT_TA_30111
ttacccggtcacctatcaagcacagatggcaaagctagcgatgccgctcgctgcgacgttcctgacactcgggctggcagtgctcctcctgtccgccgccggtccggcggtcgcgcagaactgcaactgcccggcgggcatgtgctgcagccagtggggttactgcggcacgggcccagactactgcggcgcggggtgccagtcggggccgtgcacggtggtgagcagtggcgccgcagccgcggagacgtccggcggcaaacccgtggggagcgagcgcacccgataggtgacacgtatgcacgcctgcctcaactcccagggctggaatgtgatgatcatccgatcttataatagaataaagctaagtaattgaattactgggagctaagtaaagcaaagcttgtaatggtacggctaatacgtaccgagtgagtacctcctagatggccagagcagtattgttgagaaggaaataagccacggacaacaacggttgtttgatatatttgaataaaaagtgttttaccg

SEQ ID NO: 30112 - DNA, 733 bp, Triticum aestivum
  Clone ID: PAT_TA_30112
gatgcatgcatgcatgcatggggagatctcgccctgacgggttcgtgcataacggcgttgatgggttgttgaagctgcgcaagagctgcagctttgttgtagccatgaacctgtttttcgtttctctccagaaattctgtaccaagagcctgtgaaaagctatgtgtgtatgagactatgagctagtaaaaagagctgttccacacaacagcaggaccttaaccagttacccggcaacttgtcaagcacagatggcaaagctagcgatgccgctcgctgcgacgttcctggcactcgggctggcagtgctcctcctgtccgccgccggtccggcggtcgcgcagaactgcaactgcccggcgggcatgtgctgcagccagtggggttactgcggcacgggcccggactactgcggcgccgggtgccagtcgggcccgtgcacggtggcgagcagtggcgccgcagctgcggaggcgtccgtcggcaagcccgtggggagcaaccgcaccccataggtgacgcgggtgcacctgcctcaactcccaggcctgaaatgtgatgatcgtccgatcttaatagaataaagctaagtaagtgggttactgggagctaagtgtagcaaatacgtaccgagtgagtacctcgtagatggccagagcagtgttgtcgagaaggaaataagccatggacaacaacggttgttcgatatatttgaataaaaaatgttttaccg

SEQ ID NO: 30113 - DNA, 799 bp, Triticum aestivum
  Clone ID: PAT_TA_30113
tatatcctcccggcctgcacacgcacaagcagcgagccttcctcctccagtcctcatctttctgccatgaagccccctcacttcaccggggaggccgccgccggcgcctcctgggctcacgaggtcaagcaggcccttcgtgacaagctccggtggacacccgccgcgggcaccacgggcaccggcggccacggcgccgcgaggccgccggcggcctcctcggctgtgaccgccgagccggtggcgcagccggcccacggcgccgactgccggggcttggccgccgccgaggaccccatcaggagggtcatgttcttggccccctggggccacacataaacggaaaaagcaagtgcacgcgcgcacggccatgccttggccggatctgcaactgcacctcaacaaaaatatggactactacgtacatatatatatgtggccgtatggaccatgaactgaacatgaactcatcaaggaccaattaaaaactgggactagatcgggagaagaagaagatgtggtgcttgagttatttgttcattcatgtttctcttgggagagatgcatgcatgcatgcatggggagatctcgccctgacgggttcgtgcataacggcgttgatgggttgttgaagctgcgcaagagctgcagctttgttgtagccatgaacctgtttttcgtttctctccagaaattctgtaccaagagcctgtgaaaagctatgtgtgtatgagactatgagctagtaaaaagaactgttcctcctttcaaagaaaaaaaaaaaaaaaaaaggccccta

SEQ ID NO: 30114 - DNA, 738 bp, Triticum aestivum
  Clone ID: PAT_TA_30114
agaaatatttgcactgcgtgatacaaccccaggaggaccccagagaggtggctgctgctaaagcagatttgaactacatcgggcttgatggagagattggttgcatggtgaatggtgcaggattggcaatggctacgatggacatcattaagctgcatggtggtacacctgccaattttcttgatgttggtggtagtgcatccgagggacaggttgtggaagcatttaagatattgacttcagacgatagagtgaaggcaattctagtgaacatttttggaggtatcatgaaatgtgacgtgatagcaagtggaatagtgaatgcagctaaacaggttgatcttaaggtccctgttgttgttcggctagaaggcaccaatgtagaccaagggaaaaggattcttaaggagagtggaatgacattgatcactgcagaggatcttgatgatgctgcagagaaggctgtaaaagcatcagtcaaatgattaatgattgtaccatatcagtctaaagttctgttttcactggcacaagaggagtggtgctctcttagtgattttgggggccgtaatcttgaagtgcatttttttttgaagtggagtgattccacttttgagttttccttaaaacttgtgatctttgtgttaataaacctatatgggcacaaaattgagcagccactgttatgaagttcaagtaggatttacctgttattgacccggatcagcaggggtacat

SEQ ID NO: 30115 - DNA, 569 bp, Triticum aestivum
  Clone ID: PAT_TA_30115
gcagaaccttaaccagttacccggccacttatcaagcacagatggcaaagctagcgatgccgctcactgcgacattcctggccttcgggctggcagtgctcctcctgtccgccgctggtccggcggtcgcgcagaactgcaactgcccggcgggcatgtgctgcagccagtggggttactgcggcacgggcccggactactgcggcgccgggtgccagtcgggcccgtgcacggtggcgagcagtggcgccgcagctgcggaggcgtccggcggcaagcccgtggggagcgggcgcaccccataggtgacgtgggtgcacccgcctcaactcccaggcctgaaatgtgatggtcctccgatcctaatagaataaagctaagtaagtgaattgctgggagctaagtaaagcaacgctgccgtgtaatggatatggctaatacgtaccgagtgagtacctcgtagatggccagagcagtgttgttgagaaggaaataagccacggacaacaacggttgttcgatatatttgaatcaaaaatgttttaccgaattatcattttgcatccatc

SEQ ID NO: 30116 - DNA, 651 bp, Triticum aestivum
  Clone ID: PAT_TA_30116
ccttaaccgttacccggccacttatcaagcacagatggcaaagctagcgatgccgctcactgcgacattcctggccttcgggctggcagtgctcctcctgtccgccgccggtccggcggtcgcgcagaactgcaactgcccggcgggcatgtgctgcagccagtggggttactgcggcacgggcccggactactgcggcgccgggtgccagtcgggcccgtgcacggtggcgagcagtggtgccgcagctgcggaggcgtccggcggcaagcccgtggggagcaaccgcaccccataggcgacgcgggtgcacctgcctcaactcccaggcctggaatgtgatgatagtccgagcttataatagaataaagctaagtaagtgaattttactgggagctaagtaaagcaacgctgccgtgtaatggatatggctaatacgtaccgagtgagtacctcgtagatggccagagcagtgttgttgagaaggaaataagccacggacaacaacggttgttcgatatatttgaatcaaaaatgttttaccgagttatcattttgcatccatcataaattgcacttggtatttgctcctgcatagcctacaaaaacgttttgtattttgatatgaaggtaatatctactataacaatg

SEQ ID NO: 30117 - DNA, 940 bp, Triticum aestivum
  Clone ID: PAT_TA_30117
cagtaaaacacaagcagtgggttcttttctttactcttaggaacagggtaaacatatcaccgtacaggtaacatatatgttacagttatgtcgtacaaattgatcttcagaattcagaaacatcacaggctcctcttccagcatgcatacagtccagacaacataaagcataaagcagcatcatttcatgtacctatgcagaaacttgcggtgaaaatcacttctgatggtgtcgttgatgaaccgtttcggtgtcttagtctctccacgagcttggttcttgaatacaacatcatcatcccaccttctcttcacattgaaggagccagagttattcatattgatcagtgggtttcctcgcatcagctcagcctccttcatcttggcctcttcttctgcttgctgacgctcctttctaaacctgtcctcagctctttcttttttaatcctttcgagctctgccatgagtgcctcagtgtcatcgtcatcgtcgtcatcatcgctttcatcatcacttttgagctccacgtcagagtcatctgcatcaatttcacgtggaactatcttatcctcatcccgttttgaaccttctaagagcaggctcgaactttttcgtcggtccctctcatcaacataggacttatccttggatgagaagtgcttgcgctcacgctcctcaagttcgtccctgagattcctcttctgtacctcctcttgagtttgctggccctcttttctgggcttgagggaggtgtgggcggcgaggtcgcgggacgagtacttcccggagggaccgaagatgcgcgtgcccccctgctcgttcccgcccttggccggcgcccacgtcggccgcgccgccgtcgtcatccttcaaccgggggattgctttgctctgctttgctttggtttggaggattattgcggccgcagcccggccggc

SEQ ID NO: 30118 - DNA, 965 bp, Triticum aestivum
  Clone ID: PAT_TA_30118
tcgcggccgcgtcgacttttttttttttttttttttggggtatcaaccactcaatgaactttccaagacactgctgggcagtcaaacaaactgagtacacgacaagcatacatattttccaggtcaatgtaccagtagaaacatcctgaggtctcagcgaagcatcagtaatacacaagcagtgggttcttttctttactcttaggaacagggtaaagatatcacattaagataacgtggctgttacagtaatgtcatacaaatcgatcttcagaatacagaaacatcacatcacaggctctttcagcatgcatactgtggaaatcacttcatgtacctatgcagaaacttgcgatggaaatcacttctgatggtatcgttgatgaaccgtttcggtgtcttggtctctccacgagcctggttcttgaatacaacatcatcatcccaccttctcttcacattgaaggaaccggagttattcatattgatcagtgggtttcctcgcatcagctcagcctccttcatcttggcctcttcttctgcttgctgacgctcctttctaagcctgtcatcagctctttcttttttaatcctttcaagctccgccattagtgcctcagtgtcatcgtcgtcgtcgtcgcagccgctaggaggggggaggagacgaatccaccccatgagaagcaaccgtccattgagaggcacgccatccaccattagtaatagtgggctcgtcagggacggccaagggtgcaggactggcaccttttgttacttggcatcagggcctcccaatttgcttggggtttcttctccatctgcgaccttccgtccctgcttgtggttgtttcacctggtgccttctaatcaattattgtgatagatgcgctctagcaagcaaattcaggatctatcctctactctctccatgtgtggcggtcggatcggaatcgacgatgtcatcc

SEQ ID NO: 30119 - DNA, 608 bp, Triticum aestivum
  unsure (1)..(608): unsure at all n locations
  Clone ID: PAT_TA_30119
ccaccattcactcaactggagaacaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccaagttgctgatatgtcgttcctccggtcacaggtggtgcaacatagcaagctgcttgggtaatgtgggaagcaagtgttgtcaagcaactaaaagccgattcccaaagcaatcaaagatgtgagggcatccacaacggtcgtgcacgccatccgtttttgcaaacaagcaacaaacaatttgggtaaaaaggtattttccaaccaaacctcaagcagcaacaacaacaagggtcaacaacaacaaagggcaaggggttctaaccagccacaacaacaaacacaacggttnaaggttggttgccgtgataaggaatgggtgatcaaacatcccgnaatgtgcgactgatgtcacata

SEQ ID NO: 30120 - DNA, 991 bp, Triticum aestivum
  Clone ID: PAT_TA_30120
gccggccgggttcggaaaatctaccaccgctctccctctcccggcctgcactcacaagcagcggcgaagccttctctgccttcctcctcctctctctttctgccatgaagccccctcacttcactggggaagcggcagccagcgcctcatgggctcacgaggtcaagcaggccctccgtgacaagctccggtggacacccgccgcgggcaccacgggcaccggcggccacggcgccgcgaggccgccgacggcctcctcggctgtgaccgccgagccggcggtgcagccggcccacggcgccgactgccggggcttggccgccgccgaggaccccatcaggagggtcatgttcttggccccctggggccacacataaacgagaaaagcaagtgcacgcacggccatgccttgtcttggccggatctgcaattgcacctcaacaaaaatatggactagtacgtatatatatgtggccgtatggaccatcaactgatgaacatgaactcatcaaggaccaattaaaaactgggactagatcgggagaagaagatgtggtgcttgaggtatttgttcatgtttctcttggagagatgcatgcatgcatggggagatctcgcctgacgggtttggtgcatatatatggcctatgggtgttgctgcctggccggttgaagctgcagctttgttgtagccatgaacctgttttttttgtttctctccagaaaatctgtaccaagagcctgtgaaaagctatgtgtgtatgagagactatgagctagcaaaaagttcttcctccttcaccatgccatgtttatccggttgttccttgccttgttggtttctcctgtgcatccaaaataaccgtggtgttaattcctgcaatacgcagaggaagaaccagccatggtgcttaattctagtatgtggtggtgctaatttaagttgctggtgtgactatggattggtctccctttatgaaaaaaggggggg

SEQ ID NO: 30121 - DNA, 995 bp, Triticum aestivum
  Clone ID: PAT_TA_30121
tttttttttaatacacaagcagtgggttcttttctttactcttaggaacagggtaaacatatcaccattaagataacgtagctgttacagttatgtcatacaaatcgatcttcagaatacagaaacatcacaggctctttcagcatgcacactgtccagacaacataaagcatacagcagcatcatttcatgtacctatgcagaaacttgcggtggaaatcacttctgatggtgtcattgatgaaccgtttcggtgtcttagtctctccacgagcctggttcttgaatacaacatcatcatcccaccttctcttcacattgaaggagccagagttattcatattgatcagtgggtttcctcgcatcagctcagcctccttcatcttggcctcttcttctgcttgctgacgctcctttctaagcctgtcctcagctctttcttttttaatcctttcaagctctgccattagtgcctcagtgtcatcgtcgtcgtcatcatcgtcgctttcatcatcacttttgagttccacgtcagagtcatctgcatcaatttcacgtggaactatcttatcctcatcccgttttgagccttctaagagcaggcttgaactttttcgccggtccctctcgtcaacataggacttatccttggatgagaagtgcttgcgttcacgctcctcaagttcatccctaagattcctcttctgtacctcctcttgagtttgttgtccctcttttctgggcttgagggaggtgtgggcggcgaggtcgcgggaggagtacttcccggagggcccgaagatgcgcgtgccgccctgctcgttcccgcccttcgccggcgcccacgtcggccgcgccgccgtcgtcatcccctctctctctctctccggccggcgggaggcggaaccctagctagcctcttcctccttcgggtttggatttggagtggcgttggtggagacgacggggaaaaactggcgttggtggagacgacg

SEQ ID NO: 30122 - DNA, 839 bp, Triticum aestivum
  unsure (1)..(839): unsure at all n locations
  Clone ID: PAT_TA_30122
ctcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcaagctgcttggtaatgtgggagcaagtgctgtcaagcaactaaaagcgatccccaaagcaagtcaaagatggcgagggccatccacaacgtcgtgcacgccattattttgcaacaacaacaacaattggtacaagctacttccacccaacctcaagcaagcaagcaacaacaaggtcaacaacaacaacagggtctgggttctagccagccacaacaacaaacacaactggatcagggttggattgcggtgatagggacatgggtgattcagaccatcccggcaatgtgcgacgtgcatgttccaccatactgctacaccaccatatcaccatccagtgacgtcactaccgacatgggcggctactgagaagacgagagttctaggaacccaanaatggaccaaccatgtttagtccaaggtccgatccatggtacggggaaaaaataaagggccatgcattatcatggggggaactaaactggcactagttcaaactttgggaataaaagcaaactaagtatttttttgcaaaaaaaaaaaaaaaaaaat

SEQ ID NO: 30123 - DNA, 992 bp, Triticum aestivum
  Clone ID: PAT_TA_30123
gaattcggcacgaggagagagagagagagagagagagagagagagagagagagagagagagagagagagagagagagagagagagagagagagagctcgtgccgctctccctcccggcctgcacacgcacaagcagcggcgaagccttctcagctgccttcttcctcctccctctctttctgccatgaagccccctcacttcaccggggaggccgccgccggcgcctcatgggctcacgaggtcaagcaggccctccgtgacaagctccggtgggcacccgccgcgggcaccacgggcaccggcggccacggcgccgcgaggccgccgacggcctccttggctgtgaccgccgagccggcggcgcagccggcccacggcgccgactgccggggcttggccgccgccgaggaccccatcaggagggtcatgttcttggccccctggggccacacataaacggaaaagcaagtgcacgcacgcacggccatgccctggccggacctgcaatggctcctcaaccaaaatatggactactacatatatatatgtggccgtatggaccatgcatgaactgatgatgaacatgaactcatcaaggaccaactaaaaaccgggactagatcgatcgggagaagaagatgtggtgcttgagttgtttgttcatgtttctcttggagagatgcatgcatgcatgcatggggagatctcgccgtgacggccgggttcgtgcatatatatggcctatgggtgttgctggccctgggttgaagctgcgcaagagctagctgcagctttgttgtagccatgaacctgttttttctttctctccagaaattctgtaccaagagcctgtgaaaagctatgtgtgtatgagactatgagctagttaaaaaaaactcttcctcctttccatggcatggcatctctctccagttgttaatcttgccccagttggtttctgtgcatccaaaaccatggtgttgattcctgc

SEQ ID NO: 30124 - DNA, 1143 bp, Triticum aestivum
  unsure (1)..(1143): unsure at all n locations
  Clone ID: PAT_TA_30124
ccacgcgtccgactcaactggagaacaaacattatctaacacaaatcaaccatgaagaaattcctcgtccttgccctcattgttgtcgcggcgacctccacggccgccgaaccctttactgcattccgtgctgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggcggtgcaacctaggagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcatgggcggctactgagaggtctagtatccgaaaaacggaccagcattgtttagtcaatggtccgatccatgtagcggtgaaaaataaagtgccatgcattatcatgtgtggactagactggcactagttcaaacttgggaaataaaaggcaaactaagttattttctgcaaaaaaaaaaaaaaaaaaaaaacggtccgcggccgccacccgcggtggagctccagcttttgttccctttagtganggttaattgcgcgcttggcgtaatcatggtcatagctgtttcctgtgtgaaattgttatccgctcacaattccacacaacatacgagccggaagcnttaaagtgtaaagcctggggtgcctaatgagngagctaactcacattaattgcgttgcnctcactgcccgctttccantcgggaaccctgtcgngccanctgcnttaatgaatcggccacncccgggaaaaggcgnttngngttttgggccctnttcncttct

SEQ ID NO: 30125 - DNA, 1906 bp, Triticum aestivum
  Clone ID: PAT_TA_30125
gcacgagggctctctctcttccttcttcctccccctctctcgacctcatcgcccaccaccctcccccatccggacacgcgagcgcccgggtcgccggcgccggccatggatccctacaagcaccggccgacgagcggggccaactccggctactggaccaccaactccggcgcgcccgtctggaacaacaacaacgccctcaccgtcggccagcgaggacctatccttcttgaggattaccatctgattgaaaagcttgcacagtttgaccgggagcgtatccctgaacgtgttgttcatgcacggggagccagtgctaaggggttctttgaggtgactcatgatgtttctcagctcacttgcgctgatttcctccgggctcctggggttcagaccccggttattgtccggttctctaccgttgtgcatgagcgtggaagccctgagaccttgagggatccacgtggttttgcagtgaagttctacaccagagagggtaactttgaccttgttgggaacaatatgcctgtgtttttcatccgagatgggatgaagttccctgacatggtccatgctttcaagccaagtccaaagaccaacatgcaggagaactggagaatagttgacttcttctcgcaccacccggagagtctgcacatgttcaccttcctctttgatgatgttggcattccactcaactacaggcacatggacggttttggtgtcaacacctacaccttaatcagcagggatggaaaggcgcaccttgttaagttccattggaagcctacatgtggtgtgaagtgcctcttagatgatgaagccgttactgtaggaggcacctgccacacccatgccacaaaggacctgactgatgctattgcagctgggaattacccagaatggaagcttttcattcagaccattgatgctgatcatgaggataaatttgactttgaccctcttgatgtcaccaagacctggccagaggatatcatcccactgcaaccagttggacggatggtgctcaacaagaacattgataatttctttgcagaaaatgaacaacttgctttctgcccagcagtcactgtccctggaatccactactctgatgataagctgctccagacaaggattttctcctatgctgatacacaaaggcaccgtctcggtccaaactacttgatgcttcctgtgaatgccccgaaatgtgctcaccacaacaaccatcatgatggcttaatgaatttcatgcacagggatgaggaggtgaactacttcccttcaaggtttgatcctactcgtcatgctgaacagtaccctatccctcctcgcgttctatctggctgccgggagaagtgcatcatcgaaaaggagaacaatttcaagcaggctggcgagagataccgttccttcgaccctgccaggcaagaccgtttcctacagcgctgggttgatgcgctcactgatgctcgtgttacccatgaaatccagggcatctgggtctcatactggtcacagtgtgacgcgtccctcgggcagaagctggcattgcggctcaagattaagccgagcatgtagatggaaaaggaggagggaaccagtcgctcacccgcctcggttggcgtcgatcgagccaaggagggtgcagcatgaactgaatctgtctctgtgtgggtgtagccatgaataaaaatgtgtaatgaatattgtatgtaatacccatgatggtgggtgttgtgatacagttcgtctgtcgtattgtgtctgtgcaaaagagaaaataaaagacaatgtgttggttaatctttgctgtgttccatcttcagtctgatagtagaagtttttgatgatccaaaaaaaaaaaaaaaaaaagcaaaaaaaaaaaaaaaaaaggccccta

SEQ ID NO: 30126 - DNA, 2447 bp, Triticum aestivum
  Clone ID: PAT_TA_30126
ttcggcacgaggccgccctctcgacctcatcgcccaccacccacgcaagcgcctggatcgccgccggtcccgaccatggatccctacaaggtatgtaccccaccgatcctcccccagccgacccggtcccgccagctggctggcccggatcgccgattcggctgtccctgtcgccccgcgatccgctcatctgacgcgctcggttttcctggtttcttgtgttgttcgcagcaccggccgacgagcggggccaactccggctactggaccaccaactccggcgcgcccgtgctggaacaacaacaacgccctcaccgtcgggcagcgaggacctatcctccttgaggattaccatctgattgaaaagcttgcgcagtttgaccgggagcgtatccctgaacgtgttgttcatgcacggggagccagtgcaaagggattctttgaggtgactcatgatgtttctcagctcacatgtgctgactttctccgggctcctggggttcagaccccggttattgtccggttctctactgtcgtgcatgagcgtggaagccctgagaccttgagggatccacgtggttttgcggtgaagttctacaccagagagggtaactttgaccttgttgggaacaacatgcctgtgtttttcatccgagatgggatgaagttccctgacatggtccatgctttcaagccaagtccaaagaccaacatgcaggagaactggagaatagttgacttcttttcgcaccacccggagagtctgcacatgttcaccttcctctttgatgatgttggcattccactcaactacaggcacatggacggttttggtgtcaacacctacaccttaatcagcagggatggaaaggcgcaccttgttaagttccattggaagcctacatgtggtgtgaagtgcctcttagatgatgaagccgttactgtaggaggcacctgccacacccatgctacaaaggacttgaccgattctattgcagctgggaattacccagaatggaagctcttcattcagaccattgatgctgatcatgaggataaatttgactttgaccctcttgatgtcaccaagacctggccagaggatatcatcccactgcaaccagttggacggatggtgctcaacaagaacattgataatttcttcgcagaaaatgaacagcttgctttctgcccagcaatcactgtccctggaatccactactctgatgataagctgctccagacaaggattttctcctatgctgatacccaaaggcaccgtcttggtccaaactacttgatgcttcctgtgaacgccccgaaatgtgctcaccacaacaaccatcatgatggcttaatgaatttcatgcacagggatgaggaggtgaactacttcccttcaaggtttgatcctactcgtcatgctgaacagtaccctatccctcctcgcgttctatctggctgccgggagaagtgcattatcgagaaggagaacaatttcaagcaggctggcgagagataccgatccttcgaccctgccaggcaagaccgtttcctacagcggtgggttgatgcgctcacggatgctcgcgtaacccatgaactgaatctgttctgtgggggtgtagccatgaataaaaaagtgtaacagtgaaatgaatatcgtgtgtaataccgatgaacaatgttggtgggtgttgtgagccggtgttgccgggttcgtcacttcgtctgtcgtactgttgctgcgaaaatggcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcatgggcggctactgagaggtctagtatccgaaaaacggaccagcattgtttagtcaatggtccgatccatgtagcggtgaaaaataaagtgccatgcattatcatgtgtggactagactggcactagttcaaacttgggaa

SEQ ID NO: 30127 - DNA, 1905 bp, Triticum aestivum
  Clone ID: PAT_TA_30127
ctcgtgccgaattcggcacgagaactcctccaccccctctcgacctcatcgcccacccccctcccccatccggacacggtcgccggtcccggccatggatccctacaagcaccggccgacgagcggggccaacgccggctactggaccaccaactccggcgcgcccgtctggaacaacaacaacgccctcaccgtcggccagcgaggacctatcctccttgaggattaccatctgattgaaaagcttgcgcagtttgaccgggaacgtatccctgaacgtgttgttcatgcgcggggagccagtgccaaggggttcttttgaggtgactcatgatgtttctcagctcacttgcgctgactttctccgggctcccggggttcagaccccagttattgtccggttctctactgttgtgcatgagcgtggaagccctgagaccttgagggatccgcgtggttttgcagtgaagttctacaccaagagagggtaactttgaccttgttggggaacaacatgcctgtgttcttcatccgagatgggatgaagttccctgacatggtccatgctttcaagccaagtccaaagaccaatatgcaggagaactggagaatagttgacttcttttcgcaccacccggagagtctgcacatgttcaccttcctctttgatgatgttggcattccactcaactacaggcacatggacggttttggtgtcaacacctacaccttaatcagcagggatggaaaggcgcacctcgttaagttccattggaagcctacatgtggtgtgaaatgcctcttagatgatgaagccgttactgttggaggcacctgccacacccatgccacaaaggacttgactgatgctattgcagctgggaattacccagaatggaagcttttcattcagaccattgatgctgatcatgaggataaatttgactttgaccctcttgatgtcaccaagacctggccagaggacatcatcccactgcaaccagttggacggatggtcctgaacaagaacattgataatttcttcgcagaaaatgaacagcttgctttctgcccagcagtcactgtccctggaatccactactctgatgataagctgctccagacaaggattttctcctacgctgatacccaaaggcaccgtcttggcccaaactacttgatgctccccgtgaattccccgaaatgtgctcaccacaacaaccatcatgatggcttaatgaatttcatgcacagggatgaggaggtgaactacttcccttcaaggtttgatcctacccgtcatgctgaacagtaccctatccctcctcgtgttctatctggctgccgggagaagtgcattatcaagaaggagaacaatttcaagcaggctggcgagagataccggtccttcgaccctgccaggcaagaccgtttcctccagcggtgggttgatgccctcacggatgctcgcgttacccatgaaatccagggcatctgggtctcatactggtcacagtgcgacgcatccctcgggcagaagctggcgtcgcggctcaagatgaagccgaacatgtagatgggcaaggaggatcggaccagtcgctcactcgcctcgcttggtgtcgatcaagcgaagaaagggtgcggcatgaactgaatctgtctttgtgtgggtgtagccatgaataaaaatgtgtaacagtgaaatgaatatcgtatgtaataccgatgaacgatgatggtgggtgttgtgacccggtgtttgccgggttcgtccgtcgtattgtgtctgtgcaaaagagaaaataaaagacagttagttggttaatctttgctgtgaaaataaaagacagtctgatagaagctttgatgaaaaaaaaaaaaaaaaaaaactcgaattctctc

SEQ ID NO: 30128 - DNA, 1154 bp, Triticum aestivum
  Clone ID: PAT_TA_30128
tctgattacgccagctcgaaattaaccctcactaaagggaacaaaagctggagctccaccgcggtggcggccgctctagaactagtggatcccccgggctgcaggaattcggcaccagctcaacttgagaacaaacattatctaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgatccccaagcagtcaagatgtgaggccatccacaatgtcgtgcacgccattattttgcaacagcaaaaacaattggtacaaggtacttcaacccaacctcagcagcagcaacaacaaggtcaacaagaacatggtcagggttctagccagccacaacaccaacaacaacaacagcaactggatcagggttggatcgtggcgatagggacatgggtgattcagaccgttccggcaatgtgcgacgtgcatgttccaccatactgctacaccaccatatcatcatcgagtgacgtcactaccggaatgggcggctactgagaagatgagagctctagtatccgaaaaatggaccaccaatgtttagtcaatggtccgatccatatgtagcggtgaaaaataaagtgccatgcattatcatgtgtggactagactggcactagttcaaacttgggaataaaaggcaaactaagttattttctgcatatagcgttatccgcgtgtttccattcgggcacacgtggatatgttcattcctaaccacaatattatgcattaactatctttgtactccctccgtttttacttactccgcgtattagttttgactcaagtcaaactttataaagtttgaccaagtttgtacaaaacaatatgaacatttacagtaataattttatatgatgtggaaatatatgcaatgatg

SEQ ID NO: 30129 - DNA, 933 bp, Triticum aestivum
  Clone ID: PAT_TA_30129
tccgccagctcgaaattaaccctcactaaagggaacaaaagctggagctccaccgcggtggcggccgctctagaactagtggatcccccgggctgcaggaattcggcaccagctcaactggagaacaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcatgggcggctactgagaggtctagtatccgaaaaacggaccagcattgtttagtcaatggtccgatccatgtagcggtgaaaaataaagtgccatgcattatcatgtgtggaactagactggcactagttcaaacttgggaaataaaaagccaaactaagttattttctgcaaaaaaaaaaaaaaaaaaccctc

SEQ ID NO: 30130 - DNA, 1210 bp, Triticum aestivum
  unsure (1)..(1210): unsure at all n locations
  Clone ID: PAT_TA_30130
tggtttaatgggagacataccagaataccggtgatggttaagttcaaccagaagattcaaaattttcatctatcatggaaatatgtagttttattcagacaaatgctttattcaggaacatttattcatcatttccatattgcaactagtacttgccacacatgatgatgcatgacatttttattttgccaccgctacatagatcatctagcacgcaccaccagtgtaggtagccaccaatggaatgttgtaggtggtgggggcggggcattgtactgggatgtagatgctacacatcgaccgcagggcctgaagcgacatcctaatgctctcaagttgtgctggctgctggggctggtacataccctgccattgttgttggggttgttgttgcctgatagcctccgccacgttgtggatggcttggcaacggaattgctctgggatctgtgatagctgtcggcaacattggtgctgcacattttggcagctggtaggctgatccaccggtatctgggggaatggcactgtcactgggctacactgctgttgcaggaatgtcgtgcacggtgtcaactgctcctgcaactgttgttgttgttgttgccccagttgttgttgctgctggcattgtaccgggacgtagatgttgcacatcaatgataggttctcaagcaacatcctcatgctcttatgttgtgcttgctgttggggctcctgccattgttgttgggattgttgttgaatgatagcctctaccacgatgtggatggcatggcaccgggttcgctctgggatctgcgccaactgctggcagcattggtattgcacgatctggcagctgctaagttgctcgacttgtgtctggaggaatggcattctcagtgggctacacttttgttgcaggaatgccacacacggcttcatctgcttcagcaactgtcgttgacccaggttgttgttgttgttgggattgtccaaagccctggctacatgtggtttcccaactgggcaatggcggtggttgctgcgagggcaaggagagccaggatgaagaccttcatggtggctagcctcaagtttgctttgttgctggtgccgaattcctgcagcccgggggatccacatagttctagagcggccgccaccgcggtggagctccagcttttgttccctttagtagggttnanttcgagcaaagggnntcctc

SEQ ID NO: 30131 - DNA, 1779 bp, Triticum aestivum
  Clone ID: PAT_TA_30131
cgaaagaaaaggaggggaggggagaacagaataacatcagacccgcaaagaggaggagcgaaacagcatccctgccttcctccacgcccgtagggtttccggatcggaggagcccaagccgccgcagccatggttcgcggatcgctcgggaggttggcgtcgcgcaccctctccgtcgccggcaaatggcagcaccagcagctccgccgcctcaacatccacgagtaccagggcgcggagttgatggggaagttcgggatcaacgtgcccaagggcgccgtggtggggtcagtgcaggaggtcaaggaagttttgaagaacgtcttccccagtgagaaagagatagttgtgaaaagccaaatccttgccggtggccgtggattgggaactttcaaaagtggactgaagggtggtgttcatattgttaaggctgaggaggctgaaagccttgcagctaaaatgcttaaccaggtcctggtaacaaaacaaactggtccacaggggaaggttgtgggcaaggtctacttatgtgagaaaatgtcacttgttaatgagatgtactttgcgatcacccttgataggaagactgctggtccactcattatagcttgtgctgagggaggaacgagcattgaagatcttgcagagaagttccctgataagattgttaaggttcctgttgatgtattcaagggaatcactgatgaggatgcagctaaagttgttgatggtctggcaccaaagacagcagacaggcaatcttctatagaacagattaagaagctatatgaacttttctgcaagaccgactgcacaatgctggagataaatcctcttgccgagacagctgataaaaagctagttgctgctgatgcaaagttgaacttcgatgataatgctgcgtttaggcagaaagaaatatttgcactgcgtgatacaacacaggaggaccccagagaggtggctgctgctaaagcagatttgaactacatcgggcttgatggagagattggttgcatggtgaatggtgcaggattggcaatggctacgatggacatcattaagctgcatggtggtacacctgccaattttcttgatgttggtgggagtgcatccgagggacaggttgtggaagcatttaagatattgacttcagacgatagagtgaaggcaattctagtgaacatttttggaggtatcatgaaatgtgacgtgatagcaagtggaatagtgaatgcagctaaacaggttgatcttaaggtccctgttgttgttcggctagaaggcaccaatgtagaccaagggaaaaggattcttaaggaaagtggaatgacattgatcactgcagaggatcttgatgatgctgcagagaaggctgtaaaagcatcagtcaaatgattaatgattgtaccatatcagtctaaagttctgttttcactggtacaagaggagtggtgctctcttggtgattttgggggccgaaatcttgaagtatatttttttttgaagtggggtgattccactttgagttttccttcaaacttgtgatctttgtgttaataaacctatatgggcacaaaattgagcagccactgttatgaagttcaagtaggatttacctgttttgtgcggatcaacacggtacgtgttgacgcttcatttgccctgtcaattactgcatcttgcatcgtaactgcgcagcctaagctgttaaaatcatacaaactggaaatcttatttaggagtattattttcaataccgcaccatgtttgcgcgtt

SEQ ID NO: 30132 - DNA, 1940 bp, Triticum aestivum
  Clone ID: PAT_TA_30132
atcatggaaatatgtagttttattcaggcaaatgctttattcaggaacgtttattcatcatttccatattgcaactagtatttgccacacatgatgatgcatggcatttttatttttcggccgctacattgatcatctagcatgcaccactagtgcaggtagccaccatgggaatgttgtaggcggtgggggcggggcattgtaccggtatgtagatgttgcacatcgaccgcagggcctgaagcgacatccgaatgctctcatgttgtgctggctgctgcggctggtacataccctgccattgttgttggggttgttgttgcctgatagcctcagccacgttatggatggcttggcaacgaaattgctccgggatctgtgatagctgtcggcaacattggtgctgcacattctggcagctggtaggctgatccaccggtatctgggggaatggcactgtcactgggctacactgatgttggaggaatgtcgcacacggtgtcaactgctcctgcaactgttgttgttgttgttgttgccccatttgttgttgctgctggcattgtaccgggacatagatgttgcacatcaatgataggttctcaagcaacatcctcatgctcttatgttgtgcttgctgttggcgctcctgccattgttgttgggattgttgttgcatgatagcctctaccacgctgtggatggcatggcaccggattcgctctgggatctgcgctagctgctggcagcattggtgttgcacgatctggcagctgctaagctgctccacctgtgtctggaggaatggcattctccagtggcctacactgttgttgcaggaatgccacacacggcttcatctgctccagcaactgtcgtttgcccaggttgttgctgttgttgggtattgtccgaagcccctggctacatgtggtttccaactgaggcaatggcggtggttgctgtgagggcgaggagagccaggatgaagaccttcatggtggctagcctcaagtttgctttgctgtttgtgcaaacagtgggttcttttctttactcttaggaacagggtaaatatatcaccgtacaggtaacatagatgttacagttatgtcatacaaattgatcttcagaattcagaaacatcacaggctcctcttccagcatgtatactgtaaagcatacagcagcatcatttcatgtacctatgcagaaacttgcggtggaaatcacttctgatggtgtcgttgatgaaccgtttcggtgtcttagtctctccacgagcttggttcttgaatacaacatcatcatcccaccttctcttcacattgaaggagccagagttattcatattgatcagtgggtttcctcgcatcagctcagcctccttcatcttggcctcttcttctgcttgctgacgctcctttctaagcctgtcctcagctctttcttttttaatcctttcaagctctgccatgagtgcctcagtgtcatcgtcgtcgtcatcatcatcgctttcatcatcacttttgagctccacgtcagagtcgtctgcatcaatttcacgtggaactatcttatcctcatcccgttttgaaccttctaagagcaggctcgaactttttcgccggtccctctcatcaacatatgacttatccttggatgagaagtgcttgcgttcacgctcctcaagttcgtccctgagattcctcttctgtacctcctcttgagtttgctgaccctcttttctgggcttgagggaggtgtgggcggcgaggtcgcgggaggagtacttcccggagggcccgaagatgcgcgtgcccccctgctcgttcccgcccttggccggcgcccacgtcggccgcgccgccgtcgtcatccttccaccgcgattcctctgctttggtttggtggagaccagacgagacgacgggaggatt

SEQ ID NO: 30133 - DNA, 1092 bp, Triticum aestivum
  unsure (1)..(1092): unsure at all n locations
  Clone ID: PAT_TA_30133
tagctcgaaattaaccctactaaagggaacaaaagctggagctccaccgcggtggcggccgctctagaactagtggatcccccgggctgcaggaattcggcacgaggctcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcagaccatcccggcaatgtgcgacgtgcatgttccaccatactgctacaccaccatatcaccatccagtgacgtcactaccgacatgggcggctactgagaagacgagagctctagtatccgaaaaatggaccaccaatgtttagtcaatggtccgatccatgtagcggtgaaaaataaagtgcaatgcattatcatgtgtggactagactggcactagttcaaacttgggaataaaaggcaaactaagttattttctcgtgcccgaattttttttttttttacttatgaaccccgcgagggatcctattaaatattcatgcgcaatttacatggcttattcatcaatgcancaatcaagtcacatgctttaattacacatcttgtacaactgtcgggcaaagacgaagcatcgtttgctaaggangggagggccgcca

SEQ ID NO: 30134 - DNA, 684 bp, Triticum aestivum
  unsure (1)..(684): unsure at all n locations
  Clone ID: PAT_TA_30134
ccctttgggggatttggtnnccccattcngnttgancccaccattgggagggcatctgtgcaggtgtgcccatgatcacatggccgcactttggggagcagtttttgaatgaggagctgctggtggatgtgctgaaaatcgggatggaggttggagtgaaaggagttacacagtggggaagtgaaaaccaggaggttatggttacaagagatgaggtgcagaaagctgtgaacaccctgatggatgagggagtggctgcagaagagatgagggtgagagcaaaagactgcgccattaaggcaaggagggctttcgatgagggaggttcttcgtatgacaacataaggctattaattcaagaaatggaaatcaagacgaatgcatgtcgttcagtggttgatacagatggtaataagctctcttttttggtgtaaacataaagtaaaagagcctatagcgtatttatcattataaaggatttcttttacaaacaaccggtagcttgtatcaggatcactgtctattctgttgcgcagatttcatatttttgggaaaggggatatccccgacctctgcatcatactgatccacacagccatatttattaaaaacaatcagaagttcggtagtttcataaaaaaaaaaaaaaaaaaaactcgagacacctcggccgcgccacgctaa

SEQ ID NO: 30135 - DNA, 642 bp, Triticum aestivum
  Clone ID: PAT_TA_30135
ggcggtggggcggggcgctacggggctgcttggactcgttcgggcggcccaagagattgttcgtgctcatcaacccctacggcggcgaaagacgggcaagcaagatctacgaggcagaaatcaagcccctgctccaagccgccggcgtcgaagtcacaaggcaagagacccggtaccgggggcatgcccgggaggtggcgtcctctctggaccttgcgagagacgacgggatcgtctgcgtcagcggcgatggcgtcctcgtggagcttgtgaatgggattctgcaaagatcagactgggaggaagcaataaaaatgccaattggggtagttccagctggcacaggaaacggcatggccaaatcgcttctgcatgctgccagcgagacgtgctcagtttcagacgccgtatttgccattatcagaggtcacaagcagcttttggatgtttgcactatagcgcaaggggagaagattgttttcagcgtgctgtcaaccacctggggtttggtggcggatgttgacatcgagtccgagaaatacaggtggatggggagcgcgcggttcgacttttatgctctggttcgcataatgaacttgcgccgataccgcggaagtgtccacttcgtgcctgccccgggct

SEQ ID NO: 30136 - DNA, 292 bp, Triticum aestivum
  Clone ID: PAT_TA_30136
ttttcggccacgcgtccgcccacgcgtccggccacgcgtccgcccacgcgtccgcccacgcgtccgcccacgcgtccgcaaagccaaaggctacgtacgtggatgggaagaaggaacgtactatggcgaacctgtggctgtggagcattgttgcgccacatgttgtgttctaattaaccgcccttctttttgtggggatgtataccgtacctaccgattatgcatgcatgtaaattacctttgtccacgtacaaggggaggaaccatggaataaagaaagagcaacctgagt

SEQ ID NO: 30137 - DNA, 836 bp, Triticum aestivum
  unsure (1)..(836): unsure at all n locations
  Clone ID: PAT_TA_30137
caagttctgcgtgtcagttcacttcagatgggtcgacgaaaagagctggggcgcgctggcggagacggtgaagggcgtgatgcgggagtacccgaagctgcgcatgtcgcaggggcggatggtgttcgaggtgcggcccaccatcaagtgggacaagggcaaggccctcgagttcctgctcgagtcgctgggcttcgccgactgccccaacgtgctgcccgtctacatcggcgacgaccgcaccgacgaggacgccttcaaggtgctgcgccggcggggccagggcgtcgggatcctcgtctccaagcaccccaaggacaccagcgcctccttctcgctgcaggagccggccgaggtcatggagttcctgctccgcctcgtcgagtggaagcagctctccaaggcgcgcctcaggctgcggcggcaggccgacgcctgatcggacgacgaggatcggccggccggcgggaatggccggactaattatttcactgctacgtgtagcttagctagttaatgaaaatcccctgcttgctcatccgaacaaagccaaaggctacgtacgtggatgggaagaaggaacgtactacggcgaacctgcggagcattgttgcgccacatgttgtgttctaattaaccgtccttctttttgtggggatgtataccgtacctaccgattatgcatgcatgtaaattacctttgtccacgtacaaggggaggaaccatggaataaacaaagagaaacctgagtaaatagcaaaaaaaaaaaaaaaaaaaaaaaaaaaaaaaaactcgagggggggcccggtacccaattcgccctatagtggntcgt

SEQ ID NO: 30138 - DNA, 1207 bp, Triticum aestivum
  Clone ID: PAT_TA_30138
gcaagctactgtacgaggccctcctgaaggtgaaggaggagctgatgctgatggggttcatctcgctgctgctcaccgtcttccagggtcccgtggggaaggtgtgtgtccgccagagtgccatgcacatcatgcttccctgcaagccgccgccacatccacccagcaaaaccgagcacctccgctacgccatgttcaccagcgtcatgggcagagggaggcgtcttctggctggaggaggcacctcggaggactactgcctcaagaagggcaaagtttcaatactttcagctgaagctattcatcagttacacatatttatctttgtgttggcggtcactcatttcctttttagtgctattacagttcttctaggaattgcacagacgagaaattggcggcattgggagaccaaaatccaaataaatgatgatagtgcacctcaaatgatcaagcatgttcaagagttcaaatttattgaagaccattttaaagtgttccttcttcaaacaattatatggatctgtcaccgaggaggactacacaactatgcgacttggtttcatcatgaaacattgtagcgggaacccaaaattcaacttttacagttacatgattagagcactggaggttgatttcaagaaggttcttggtattagttggtacctttggattatgttaatgacattcctattgttgaatgttcaaggatggtatgtctacttttggatatcgccagttccattcattatgctacttttggttggatgtaaaatggagcacatcattacggatctggcttatgaggttgcccaaaagcatacagcaattcaaggcgtcgttagccaattcctttgcggctacagtacactaccactttacgccattgtctcccatatggggaattcattcaagaaatctatatttgacaagaatgtggctgaaggccttgtcaactgggctgaaaatgctagaagacggaaaagaatgccaaacagaacaactatagatgcaagtagttcaccagttgatgaagcagcaggtggtgcatttcaaatgacaaatataccgtctgaatcatcagtggagcaagggactgcaaggctaatataattgtatgcatagtttgggcaaacaaaggcttgtacagtaccattttggcaaattgtactattattttgattgaacaacaggatattgatagcac

SEQ ID NO: 30139 - DNA, 1006 bp, Triticum aestivum
  Clone ID: PAT_TA_30139
cggacgcgtgggcggacgcgtgggcagctcgaggcccggaaccctcacctccgcctcctctcccagcgatggcttccgccgccatggtcgcctcttccagagccttgttccgtccgcatcgcctcctcctcctccctgaccctcgccgccgccgccacctctccgccagtgctgtggcctcagcaaacgctgcagccaggaccgtacggcgcggagtagtcgacgttctccgggagcgcgggctcgtggaggctaccacctccgaggcgctcggttcgtcctcggcagtttctggggagcagcagcagctcaaggtttactgcggcttcgaccccacggccgagagcctgcatctcggcaacctcctcggccttgtcgcgctctcctggttccgtcgttgcggccacacagccgtcgcgctcgtcggcggagcgaccggccgcgtcggagatccctccggaaaaagcgccgagcgccctgagctagacctcgccgccgtggtcgccaactctgacgcaatcaagtcgctcatcgctcagatcctcagccgcgctcccgaaccatctcatcacggccaatctggtaaaagcgcaattttggacaaacatgaagatgctctggccaattctgaccaggatttatcagagaaatcgggtaatgcgggggaaagtatgggttcctttgttatcttggataactatgactggtggaaggacatcacattgcttgatttcctcaaggaggtgggccagttcgcgctgtcgggacgatgattgccaaggagagtgtgaagaagcggctcaattcagaagatggtatgagctacactgagttcacctaccagcttctccagggctatgacttcctgtacatgttcaggaacatgggtgtcaatgtgcagattggggggtagtgatcagtggggaaacatcaccgcgggtaccgacttgatccggaaaattctccaggttgagggagcgcacggtctgacattcccactcttgct

SEQ ID NO: 30140 - DNA, 1012 bp, Triticum aestivum
  Clone ID: PAT_TA_30140
cgccgcccgaccacagcaccacgaatgtctactccggccggcgacggcgaggaccccggcgcagggacgccggaagcagcagcgccattctctgccgactggaaggagcggatcttggtccccgtcgtggccgccggtgttgtcggagctgggttcgggctggtgtcgcggcacagggcgcgccttggcccgatccgcgctgccgctacctatgcggctaacctctccatcgtggccggatgctacggaggtgcacgtgaacttgcaagagatgctcgagctacaacacctgatgacctcatgaattctgttgttggtgggctagcaagtggagctgttcttggccgaatacaaggtggtcactttggggcggtgaagtatgcagtcaccctagcggttgctggtactgcactggactacgccgcgatgaagctaagccctcaatggcgtgattggaaagagcatttgtccgttgatacgaaagactggtttactgtacccgaatggtcacctatccaagtgctcgatgaggaggccttggcgaagaaacgagagcgagaggagttgctgtttgctcagcgagcacttggtaaagttagcaaggaggagccttagctgccgtgcttcagagaagtgcatactgatatataggttcgacgattttgtcaaggcgttgtatgtctccaagccgttgtgtcgggaaggttgccagttgcacctatcttgccctgagctttatattaaccttttgacatatatctttttttttgtccaagacatatatctttataatcttgttttattctacttattagtatgtctgtacaataccaatggctctttgggcatcctaggaagaataaatatgggaaacccaatccaagatgggacttggtgtgagagttccaatgaatttccattccctgcaattatctctctaatcatgtactctctccgtttaagtaatctttttctgattcagatgtttatagaaaaaaaaaaaaaaaaaaaa

SEQ ID NO: 30141 - DNA, 701 bp, Triticum aestivum
  unsure (1)..(701): unsure at all n locations
  Clone ID: PAT_TA_30141
gggattgggccgaatccccatccccaaattcgagcgccgctgtgatttcctcgccccgcctccctccttccccggtgagtttccttggagtaggggagatacccctttgcgaccaatggcaggatcttccatcagcaccacttcggtcctccaattcctcccatcttggcgcccgcatcgctgtccatggcgcacccctttggtgtcctccagagtggtcgccggtgctggcacttgtgctcgttggatacaacatgctcttctttgacaaccatggtgcacggcgacgaggtgccttgttccgtgcggttcgttgttcatcggagtcacctcgttttttttgcagtacagagaagctacggtgcagtcccttaacctgagcatgatactcacctccccctgacattgcagttcgctgtagtactccggtaatgccatggcgctggagttcacagtgtacttcaaagtttttttgggtcgttcatatttgcacggcagtgcagtgcacttcacccctgggtgtgctcccatgtaattcattttttttgcttaatcaatttttgttttgttgtacttgtgaagggaanttcgcttgcngaggtgctctagtttgcttcnggtgaaaantgcnacggacnccgtatggnatgacatacncaatacacaactccaanagctcnttgtaccancaattataaccg

SEQ ID NO: 30142 - DNA, 782 bp, Triticum aestivum
  Clone ID: PAT_TA_30142
gccggccggccgggccgggaagctccatttggtgatatgccgacttcaacccacaaacgactcgacttcgtgcagactttacaatctcccacccgcacgtcaaaatccattcacaatgtctcacgccgagctcgcttcgtcctacgcggccctgatcctcgccgacgacggcattgagatcaccgccgacaagctccagaccctcatcaaggccgccaacgtcgaggaggttgagcccatctggacctccatcttcgccaaggctcttgagggcaaggatgtcaaggaccttctcgtgaacgtcggctctggtggcggtgctgcccctgccgccggtggtgccgccgctgctggtggtgccgaggaggctgctcctgaggaggccaaggaggaggagaaggaggagtctgacgaggatatgggcttcggtctcttcgactaagcggttacgccgtcacgactgtttccttgttctttgtacttcgactgcatggcttcggggtttccaatcaatcgatcataaaggatggaatgcgggcactataccctgcgccctggacagagttgcttctttcatacgatgctatgacgaatgcgctcaacggagtttcgcggagggagaattggtcaattcaaaggctctgataaaaaaaagtcccgccatgggtggtttgagttcaaaaaaaaaaaaaaaaaaaaaaaaaaaaaaaaagaccctaaaaagaaataaccaagctcctaggatattccacgacctacatcctgtttcgttgttccaaggc

SEQ ID NO: 30143 - DNA, 786 bp, Triticum aestivum
  Clone ID: PAT_TA_30143
aattgatcaatcggatctggggtgatggacggaacgctcgacggctgcaatctctagctcttcctcgctgcggcaccaagctcactctactcgtccggaagagaaaagggtcacgcctcactgcctcacgcgtcacgctcccccgcctctgctccgccgtgccgccgcgccgccctagcatcttgctgcgtcgcgccgtcgccccccgcctccgcgacggccctgctggtccagctcgtcgctcgccgacgcgttccccaccggcttgtcgcgtgggcccgcgcggctgcgttgctgctgctcccagttccggctgctccagacagcgtcaggagcaagtaaatgagattatgagttgcattgaaaggtagttcatgaacacagtgctaaccatgtctggtatcgatgatgaggagccacatcaggttcatcagtttatgaacagagcagtagctatgtcagctatggatgttaaggaaccaccttcagtggtttccattgatccatcacggtcagtgaatatagttgacgaggacgatgattgggttatagtcaagaaacagcggatcaccatattgatccctccactatcacctgcggctgcaagccctcaagctggcacacccaagttaagttctagacaagttagcctaccaagaatgagcaggagaaactgcaatgctgccacaaagaagcatccaaaacatttttctacgaagaaatctttggggggccttggcgtcgtcgcccctttcctgaaagctcggacctgcccttcgggaggat

SEQ ID NO: 30144 - DNA, 197 bp, Triticum aestivum
  Clone ID: PAT_TA_30144
gcgttgccgcagcaacttgtgctttctgcggtagttaagtggctaccagcagttgttcgtcgtccatggctgggctggctgctactttattcgtgtgtgcgatgaaaccctccagcatctgagactgttagtgttctatatgggatgacactaaccggggaagtattagttatatgtatttagctatgtgaaggatt

SEQ ID NO: 30145 - DNA, 1239 bp, Triticum aestivum
  Clone ID: PAT_TA_30145
cccacgcgtccggcaagattaacaaatgtgtcacttttcctgatatgttggacatggttccttttgtgactggggctggtgatcacccgcctctttacttcttgtatgctgtggttgtacatgtggatacagaaaatgcatctttctctggtcactacatatcgtatgtcaaagatatgcagggaacatggttaagaattgatgactcagaggtcaaggctgtatcattgaatcaagttatgtcagaaggtgcatatatgctattctacttgagatcttttcctcgccctccgaggatatacattgagaaaggcctattgcctgatccatcatcttcatatcgtcactcatcaaaatcctccaagggctcttctaaacaagagcagaagcagacagaatcactctttacttctgatgatcaaatccgtggtatttatgattttagaccagaggaggaaggttacaggcaagatcagcatgccaagttgaggtcccaaaatttatatcacaccgatgatgcttttgctgattcggttagcacggacttctcggacgctacatcaagtgaatggtccctgtttaccagctctgatgaatcttcgtttaccacggaaagcactagagattcattcagtgttgcggattatggtgacaatgctggccttgatccaatcacctcaatttttgggccatattatgctcctgaccatcctcttggcaactttgtctcgtgtacaaggccctcgccttccaatccgcaaacaaggtacttcccggaaagcatgggttttgtctcagattcttccttgccaactcaaccctacggcaatgtacatagaggaagatatccggacagggcttgcgcgtcttcagccgaacctctcgcttcagcaaaccagcgaagcttgtacggtaggtataaccatagtagagatggtattgttcaaacatctgggttttgtcatatgtaatggtctacatctgatagtttttagctggagctgggctgatatggttagcagtgctgttaatatcgcctcatgttcttttatttcagatgaggcatatttaattgtagctgcacattctagatgtagttcactcagtgtagtgaagtaactagatctgtctagatgcctagcttttgggttgacatgttagaacaaagggactggctttgtgaaagcaaagatgaccaagcatttgtttattatgtgtgaaaagcttccatttgcttcc

SEQ ID NO: 30146 - DNA, 835 bp, Triticum aestivum
  Clone ID: PAT_TA_30146
cccacgcgtccgcggacgcgtgggcgctggccaaggggcagcgcgtcaacgccgtgttcccgctggcccagctcggcccggcattgctgctgctgctgcaggcgtcggcgctggcgttccggaacgaggccgacggcgacatccggtacgcggtgctggaggcctccacggtctccggcgtgctgcacgccagcctctacctggacgccgtggtgctgccctactacacggggctggaggcgctccgctggtcgcgcttctccggggagtgcgcgtcctgcctctgccgcatggagccgctggtcgtcggcggcacggcgatgcggtaccggggcctgtccaagacggcgctggccatcatcttcgcgctctgctccaggatggtgtgccggatctacggcgaggagcggctgagcgcgtggacgcggtcggcgcttgagggcgtcgggtgggtgttcgtggcggccgacgccgtgtacctcgtcggctgggtggcggcggagggcggcgccgtgggcgtggcggcatacagcctggtggccgggctcgtcttcctctgcgtcttcggcaaggtgtacagattcttggcgtgggtggagtcgcggcagtcgcagtggaaatccagcctctgccacgccgtcgtctgatcgccgtaaaatcttctcccgtccgtctgtatgtagagaaaaaaaaacaagaaattaagagaaacaaatctcctcctcctccatttcttagttcaccttttgtttcttcattttgatgtacaaatttacaatgcatgacacaatgggaagaaaggcaagaaattctgcaaaaatttccccaaaaaaaa

SEQ ID NO: 30147 - DNA, 499 bp, Triticum aestivum
  Clone ID: PAT_TA_30147
gattctcacccccagcatagagctcaaatcgaagaagctcaatccaactcgcagcaatggttaggatgctggatcttgccgcgaccaagggcttcgccgcgcccggcaatgtcatcggcctagccttcgtcttcgtggccgtggtcgcggtcgtggccatcgccgtgttcagctgcttcgacggggcggacgagtcagacggcaagcgcaaaaagaaacgcaaggcccaacccgtcgttattgtttacggtggtggaggctgctgaggaagcgcgtcgtgcacactagtcctcccggcgtgggggcaaatgcgttgcagagtattcttaccactacgttctttaatattacagcaatgtattgcagcctgttgtaacttctctagtactctctctgtaaacaaatataagagcatttatgtcacttatgtacttacacccgtccaagaaaagaaaacacttgcactcgtgtaatttacagccggtaatttcagcgatcg

SEQ ID NO: 30148 - DNA, 2051 bp, Triticum aestivum
  Clone ID: PAT_TA_30148
gaatcggccgagccccttccctcccctccccacgccgcacggccccgccagtcctcgcttccacgctcctagggttttcagccgccgccgcgcctcccgagcatgtcggcgccgccctctctcaagtccccggccaccgccgccttcctcgcctccccacgcttggccgtcgccccgagagccgccgtgctcggcgccaccgcgcagccgccgcggcgcctaagctgctctgcagccgttggagccgaagccagggatctcgagatgagtgctcccctggactgggcggcgaggtcggtgggggagctggagcaagcgacagacctggacactttctgtatgatggcgctatcacctctggacggccgatacttcaggtttattaaggacttgatgcccttcttcagtgagttcggcctcatcagataccgcgtcttagtcgaggtcagatggttgctgaagctttctcaaattcctgaggtcaaggaggtgccgccgtttagtgaggaggcccaactatttctggatgcaatcatccaagattttagcatcaatgatgctaaagaggtgaaacaaattgagaaaataactaaccacgatgtgaaggctgttgagtactatctgaagcagaaatgcagctcaaatccagaggttgcaaaggttttggaattcttccattttggatgcacttctgaagatatcaacaacttgtcacatgcattagctctaaaagagggggtaaacacaattatgttccctgtgatgatcgatgtatgcagtgcaatatgttccttggcaacggaaaatgcacacgtccctttgctgtctaaaactcacggacagccggcatcaccaacaactctgggaaaagagatggcaaattttgcagccagattatctgatatcgggaagagtttttctgaggttaagatactagggaaatttgctggcgctgttggaaattacaatgctgatgtagttgcatatccggaaattgactggcctaagatgacagaagagtttgtcaggtccttaggtttggagttcaatccttacgttactcagattgaacctcatgactatatctcaaagctcttcaatctatttgtccagtttaacattgtcttgactgattttgacagagacatgtggtcttacatatcagcaggctacttcaagcagataccaaaggctggtgaagttggatcctccaccatgcctcacaaaatcaatcccatcaactttgaaaatagtgaaggcaatcttagcgtgtcgaatggtcttttatgtactttaagtatgaagctaccaatatcaaggttgcagcgtgatctcacagattcaactgttttgagaaacttgggtgttggattagggcattcactcttggcttacaaagcacaatgcagggaatcaagaagctagaggtgaacaaagtccgtttggatgaggacttggagcaaacatgggaagtccttgcagagccaatacagactgtgatgcgaaggtatgggatccccgaaccctttgagaaactgaaggaaatgactagaggccaggctgtaaccaaagacagcatacgcaagttcattgaaggtcttgacctgccggaggatgcgcagtcaagtcttttgaagttaacaccacactcttacactggagaggcggagaatctggctgcaaatatttggaatgtggttgacctgaaatctggatttaagatcaagtgagcttctaccctggccctgggtaatctgcccacttttttgacgatgacagcgacaataacatcgaaagcttcaaggggaacatcacatggtagcttagcgttcaaagattgtttgtcacgctaatttatctggttctcactgaaaaagcttgtggtgcgtgtggcatgcggcccacggaattgtaccatcactattcgttctgccgtgtggacttccacttacgtggctgcttggtggattgatagccgcacatgagcaaattgtttcatcccccaagagaccaaaagtaaaaactaggggaaaattttgggatcggtggag

SEQ ID NO: 30149 - DNA, 1392 bp, Triticum aestivum
  Clone ID: PAT_TA_30149
agtaaagaaaaatcttcatccattctgtgggttttgtgtggtatctatacaaaaggtggttgcataattgtcttatgttctttcaagaaaatctagagagtgttgatgtactaggattggttgcatgagatagtcatgtcacaaatttagagaggggagggaatacaggagcaagtctcaaggtctagctcccatttgtgttggatcagtgaagtgtgcggcttgcggcatgttaaattggagttggagttaagaaagatcaatctccttggattgtctggtagatggggtttcatttgttctaggattacttttgaactgcaagtgagcaaaacctatattcagcttagactagttaagtcattcaccaggaattgctgcgatgaatatgcaatcaggcccatcccttaaacactcatatgatgtaacatggaaggtacaagggaaatggtggccattttcttcgcaaaagcaaaatgctgctcatctggtttgcctgacgtcttcagtgtttgcagttactccggaaatcctattatgctgcactctcgcagcagacataaagatggggacaaaaaaaagataaaaggaaacaaaaaggaacagaagttatatttgaaatactcttcatccggtcacatttatttaagtgggaggagtgcaggacgaagaggatagtcactgtcctccctccaccaaatccccaagaggttcatcatgtcatagcggcatattgggaggtcgggaggtggcagtggtgtgcgatatgggcggcggcgaagtgcatgagaggggtagtgacgatgctagccgttcgtggtggatgaatggacagggttggtggtgaaagaacataatggcatctcgatatgatcaacgtcctattatgctcactgtgtggcctgtcatcctttgaagaacctgcatccagtgacacgggctttcagatacccttgcccatctggtgtgctcgatcgaaacacgttcaacagtgcgctcctcaagccgctgctggatcgaatgggctttggtcagttcatcagggtggtggcaattcgtgatgcttctggttcttgcatggatggcggtgttacgtctgcaagcttcttgcggtttcaagttgaacctggccaccaagccctcccaacccttgataaactccaggtgctaagctcacagtttctagattttagacttgttttcgttgcacggtggaggtgagctacgcagacgagctgtgaaagcgttacatgtttatggtcaggtgctatgctatatttgctttctctcttttcaatatgtactcaacatgattgtaaattgattgatgatgattgaataataaagtaagcatctgactgactccaaaaaaaaaaaaaaaaaaaaaaaaaa

SEQ ID NO: 30150 - DNA, 1062 bp, Triticum aestivum
  Clone ID: PAT_TA_30150
catacacatcatgtcgtctactgttgatctgagtgctttccctacagctgctcccgctgctccatcagctgagattcgctacgcggatgtcgctgtcacagcaactgcgaaagagttcaagggtgtataccgtgatgacaagcagtgccacgaaccagactttatcaatactctcgaccgagccaaagatgcaggtgttagcaaggtcatgttgacaggcatgtctctttcagacgcatcgcacaacgacagcatcaccaagcagcgtcctgcacaggcttactataccattggcgtgcacccgtaccatgctgctgaactggaacagggcggaaaggcgtaccttgctgagctggagcagaaagtcaaaaacgccctggctcaagattcgccgcatatcgccgcctttggtgagcttggtctggattatgataaggaggaacatgcatccaaggatgtacagaagaaggctttcgtggcgcagctcgacctttttgtcaagaaccaatgggacctccctctgtttctgcactgtcgcaatgcctttgatgatttcgttgagataatgaccccatatatggagaagctgccccgcggtgggctggtacacagctttgttggaagcgcatcacagatggagaagctcgtatcaatgggttttggtgtcagtgtcaatggcttcagtttccagaccacagaaagcctggaaatggtatccaaggtccctcttgatgcgttgcagctcgagacggatgcaccatggggcgaactcaagagcacatctgaagtagtcaagcaatactgcgccaacgcgagacctcttccggcgtccaagaagagagataaatgggatgccaagtgtatggtcaaggagaggaatgaaagctgtaccatggagagggttgctttggtagtggcagggttgaagggtgtcgctgttgatgaggttgccgaagcggcgtggaggaatagtgtgagaatgtttggacttggacgacgctagatgttcaaagtaaataatagttatataaataaagcgaccaagtcgccaattctgttgag

SEQ ID NO: 30151 - DNA, 1017 bp, Triticum aestivum
  Clone ID: PAT_TA_30151
cccagcgcctgcgcctgattccatcgagccccgctcgatccccttgcgcaccccatctccctcgaaccccctcctcctccttcgtcccttttccctcgcgctgccagaagctcccccgacctgcccgcgcccctgctggccctcctccgacctcatcctcacgagcaaggccaccgggacgccacttcgtcggtccccgtcgctccgcctctccaggagccagcaggcgcgccgccgcctcgccaggagatcgccgcatcgtcggagtacgccgagcgccaccaccccgttcggctccctcatcggaggccgccaccgcgaccctgccggcgcctgccgtcctccacgagcagccaagccccaccatggtcgcccccatcctgctgcttcacctcgcccggccctgtgccacctcgtccacatcgctcttcagttcgtggccgccggcgaccaccttgtcctgttgccaccttgcaccagcgccgtgactttctcctttgctcgcgagtccctgcttcgccgctgcgcctcccctggcctcgctgcagtgttcttcctcaagtcaccccttcatggttcctctttgctgtggaccgccaagtaccaccgccccgagtctttgcctttgcttcgttttggactgaagaccgagacgagaccgccaagatgcatcctggtgtcgccgacccgccaagaccgactacgatgcccgaacgagcactgttttcgcggatggcgccaagttccactaccgtcgacctcgaagacctcggattcacaagttcccacgacgacaagtgtgacccttcggatgcgccaagttcgtctacacaaaaacgcctcatgtcggcaagacccgcaagtcggaccccgaacgattgatgtctcgtggaccttgtacaactaccgtcgctcgaacgtttacagaacatgtaccgtcgaccctcgaagactggtggacggcaagttccttgttgaccccgaacacctatggagtgtgaacatctacgaagcgag

SEQ ID NO: 30152 - DNA, 3321 bp, Triticum aestivum
  unsure (1)..(3321): unsure at all n locations
  Clone ID: PAT_TA_30152
ccacgcgtccgggggaccacagctctggaggctgatactcttacttaaggcacagtgcatcttgtacaagagatatggacatgtcttggaaccattcaaatatgctggctatcctatgttgctaaatgcagttactgtagacaaggatgatagcaatttcctttcatctgatagagcccctcttttgatagccgcttcagagctgatttggctgacatgtgcatcatcttcactaaatggagaagagcttatacgagacagcggtatcccgttgttggcaacactgctttcacgttgcatgtgcatcgttcagcccacaactccggcacatgaaccagcggctaaaatagtcaccaatataatgcacacattttcagcgctcagcctgtttgagtcaggaagagttgagattcttacgtttgctggccttgttgaggacattgtgcactgtacagaacttgaatttgttccatcggctgtggatgctgctctgcagacagctgctaatgtttcagtttcatctgaactgcaaaatgctctgcttgccgctggctttttatggtttgtcttgcccttactgcttcaatacgattcaacagcagaagagaatgagacaaatgaatcacatggtgttggggcaagggtgcagattgccaaaaatcttcatgcagtacatgcagctcaggctttgtcaaagctttgtggtcttggtggtgacggaatatcaagcccatctaactttcctgctttcaatacattaagagcacttcttactcccaagcttgctgacatgctgagaaaccggccacccaaagatctattatcaaatctgaattcaaacttggagtcaccagagatcatatggaattcttcaaccagaggagagctcctccggtccggagttccgcggcgacccacccgtccgcccgatggttcgtacgatttgacagaatcagagtctttcaactatgaagctttgtcaaaagaattgaatgttggtgatgtctacttgagagtttacaacaatcaaccagattatgaaataagtgatcaggaaggattttgcattgctcttcttaagtttatagcaggtctagtgcaaaagtggaattccataaattcggaggaaaatatgacgcatgaacatgattcggttattgatacatctactgaaaatggtggagccagtgattcaactaatgaaggaaaagaggataattcatttgaaaaaggcggtaaatatgaaactggcggagattgtgaagttattacaaacctcagaagtgggttaacatcgcttcagaatcttctgacaagtaatccaggcttggctgctgtttttgcttccaaggaacgattgacacctctatttgaatgccttgcgctgcctgttcctcctgaaagcaatattccacaaatttgtttaagtgttctttctctcttgacaaagcatgctccttgtttggaggccatggtcgcagaaaggacgagtctcattttgctatttcagatactacactgcaatccttcttgtagggatggggcgcttgctgtcctctattctttggccagcacgccagagttggcctgggctgctgccaagcatggtggtgtaatgtacattctcgaacttatgttaccccttcaagaggaaatccctatgcagcaaagagctgcagctgcatccttattgggcaaactcgctgggcagccgatgcatggtcccagggtggccatcacgcttgctagattcttgcccgatggtttggtttctgcaattagagatggacctggtgaagctgttgtttcatctcttgaacagacaacagaaactcctgaacttgtatgggacacctgcaatggcagcttctctttctgcgcagctgtctaccatggcggcagacctttaccaagagcagatgaaaggacgtcttgttgattgggatgtgccggaacaaccatctggccaacatgtaatgaaggatgaaccacaggttggtggaatatatgtgagacttttcctaaaggatcccaagtttccactgagaaaccctaaaagattccttgaagggctcctagatcagtatgtttcttcagttgctgctacccactatgaagcaaatgcagttgatccagaacttcctttgctgctttctgccgcacttgtttctttgttgcgtgttcatccggcacttgcagaccatgttggttacctaggttatgttccaaagctggttgcagctatggcttatgagggaagaagggagactatggcatctggacaggacacaagtagagtgcaagcagaacctattgagcacgataactctgatggtgtccctgagaccactgtgcagactccacaagagagggttcgccttagttgtttgcgagtactacatcagctggcgtctagcaccacttgtgctgaagctatggcggcaacaagtgcaggaactcctcaggttgttgcactgcttatgaaagcaattggatggcaaggtggaagtatactggcattagagacactaaagcgtgttgttggcgctggtaatcgagctagagacgcgcttgttgcacaggggttaaaggttggtcttgttgatgtgctccttggcattcttgactggcgagctggtggaaggcagggactctgtaaccaaatgaagtggaatgaatcagaggcttcaattgggcgtgtactagcagtggaggtacttcatgcttttgcaacggaaggcgctcactgtgctaaagttcgagaaatccttaattcttctgatgtatggagcgcttacaaagaccagaaacatgacctgttccttccatccaacgcacaaacttctgctgccggagttgcagggcttattgagagctcatcttcaaggctcacctatgccctcacggcggcgccctcgcctcaacccgccctggtccgtctaccatcgtcatctcctcctccaccgactggtcctgtaaatcctgccagcgggcggcggcattcgtagcgcacaagttgaaaaacacgctgatctcagcttcttgacgatggcgtgaacattttggagttggttagctcttcagagcgactgcaggtggattgcaagtacatagcatgtacagttttttctgttacagaggtcgggtgtcgtgtgcgtttcttgtacatgtaaaagcactcctttttgtgagtttcacctgtccatagaaaatatccgggatggaaatgattgcatcgattcgtttcggcttgatgccatgccaatacattgtccttttcacataagaggaatgagttgcatggtaaaaaananannnnna

SEQ ID NO: 30153 - DNA, 1235 bp, Triticum aestivum
  unsure (1)..(1235): unsure at all n locations
  Clone ID: PAT_TA_30153
atgtgcttcgctgaggacggctcaaatttatgatgctcacaaccctctttgccgagacatattgaggccaaataacaacatggacttagcaagtctcaccgcagtgtggtgggctgtggctcttcttctcgtccccgcgtccctctccgccgtgtcatgtgcggccgtctccccccttggtcttcaccggtcttcccgccgtctgccgccccggggctctgctgttcatcaccgtgttagtcaccaagatttcaagagcaagagtcaccaccgttgatctacatcgcacaacaggtcaacttcctcccctggtgaatggagttgctctcctaaaactattacctacccttttcaacaagggtctaccggcaatggtgaatgatctatatgtcaaatatggcagtgtattcatggtaagttcatttggagtgaaggtaacactcttgatcgggccagaggtgacggctcatttcttccaaggtctggagtcggagattagccacggtaatctgtttgagttcactgtgcccatgtttggtgaagcagtgggttatggcagagataccgccacccgaactgaacaaatgcgcttccatatcgaagcactgagaccatcaaggttgaggagccatgtttatcccatgcttcaagaagtggagggttactttgcaaaatggggagaggaaggcattgttgatctaaagcttgagttcgagaagttactcatgttgatctcaagcagatgtttgctcggaaaagaggttcgggagaacatgtttgatgaagtctacacactttttcaccagattgaagataatggtgtgaccttgattagcttcttgttcccatatctcccaactccagcaaatcggaagcgagataaagcgcgcatcaggctaacacaaatcctttctgatgtcgtcgattcccgtaagaactccgcgcaagagttgtggatgatacattgcagaaattggtcgactccaaagtacaaagatggtcgnccccacaacnggtagtagangtagccgggctaatcattggcccccggttggctggctgacacacaactctcacactagtacttggacgcanctgtttaccagcatccaacttcttgaaactgcattgaggacaacacaaacanttcaatacaagacatgggctagacacatcattatnagtggtaccacatattcanaagagnctaggacacctcaaacaatcngtcnagg

SEQ ID NO: 30154 - DNA, 997 bp, Triticum aestivum
  Clone ID: PAT_TA_30154
cccacgcgtccgcccacgcgtccgcccacgcgtccgcccacgcgtccgcccacgcgtccgcccacgcgtccgcccacgcgtccggcatttcaagcttgtaagattatctcaacaacagaaatctcacataatggcatccgatactgtatttgtactacccggagatagcattgacccgtctctcattccttcgcatcctaagaaacctcttcgtctcggtcctggtctgcgacatgtccctcccaacgacatcattcccacgctcgcgggtcagcttgtaaccgatcgacaaaagaatgctatacgggtagagaatgctcgaggaagatacaccccacgcgttggtgaactcgtcatcggaacaatccagcgcagtgctgcagacttcttcttcgttaccctctccgactacaccgcacccgcacaactcccacagctctcctttgagggtgctacaaagaagactcgtcctcagcttgctgcgggcgcactcgtatacgcacgtgtagctctcgccaatcgccacatggacccagagatagaatgtgtgtccgcatcaacaggaaagtcggaaggtctgggtcctttagcaggcggtatgctatacaacgtgtcacttgggatggctaggcgtctcatgatgcccaagagcgtgcaggaaggccgtgtcgtcgtgttagaagagcttggaaatgcaggtcttcagttcgaaaccgcaacaggacgtaatggcaagttctgggtcgacagcgaaaacgtgaagacggttattgctgtaggcagggcagtacaagagacggacgagaagaatctagatgtcgaggaccagaagaagttggtgaggaaaatcatcaaggagctaagctagcgaggttgcattggtgaagaatgtggtgctacgtggcactcttttcattgaaaccgatcaggtatacatacactgccgtacttaatagatacccgagaacgaacacgtctagctcgttctttttcagac

SEQ ID NO: 30155 - DNA, 1727 bp, Triticum aestivum
  unsure (1)..(1727): unsure at all n locations
  Clone ID: PAT_TA_30155
gggaatctgctccgggcgcacgccggccggatcgccggcctcccgccgtcggcgcaccccaggaagagagatcggctcggctcatctgaggatttgcggagggcggccatggagggggcggaagctcctctccccgtccccacggagaagctctccatggatccaaatcgggatggggggaatcgaggtggtgtggtgctggtggccaccggcagcttcaatccccccacctacatgcacctgcgcatgttcgagcttgcaaaggacgagctgcagcagcgagggtactgtgttttgggtggatacatgtcgccggtgaacgacgcctacaagaagaaggacctcttgccggctgctcaccgggttcgcctctgcgaattggcgtgccgaagctcatctttcgtgatggttgatccctgggaggcaatgcagaaaggttatcagcgcaccttgaccgttctatctcgagttaagaactctctatgcaaggatggcttagctgatcaaggtggtgtcagggtaatgctgttatgtggttctgaccttctcgagtcattcagcacgccaggggtttggattccagatcaggtcagggccatatgtaaagactttggtgttgtttgtatacgtagggaaggaaaagatgttcaaaagctaatatccagcagcgagacactgcaagaatgcagggataacatcatttcggttgatgagattgtgccaaatcagatcagttcatctagagtaagagaatgtataagaaaacatctctcaataaagtatcttacttgcgatgaagtaatcgagtacattagagagcacaaactttacatggaaacagaagagggtgataccaaatcatgacaatgttgcaagccttttgaaacgaccatgtagcaaggactgacaccttgggcatcgatgttatgatacaatctgaactatcagcgacgagctacgattatctgaagtaaaagggcctgactgccttattattattagcatcatgactggatgtaaatgtatggagaccagtatgccatacacaatatttactagtagaaggttcttgaatcttcctcacattgttgtcaatgtatcagtctttcgaccaacagaatatattgctaataaagcatttatatgacatgaaactctcggtcacagtaatagtctgccattttgtttctccctctatatgtaccaaggtattattcagtaagtaatttgatgtgctacacaattcagctacactctgtaatcctagccaacaacactagcagccgctcctagctgcctaccatcagcagcagcagcagcaacagaaggcattgcctctctgccatgaggcttcatgagggcctcccggctgcagctcgccggcacgacnggcaggatcccgccggggttgagcgggaagagcgtcccaaagtacccgtcggcgatggnggcatgtcgcagtctcggcggcgccgggcaactggtagatntcccgcatgtagcgtggaggctggggtaccaaccagcttctccggctgcacggaacatggttgtaacaagtcgaacttatnncctggtgaanaggaanctcggcancgcangccggnncggggnaaggtacgggaccganaggggccccagattcanncgccaaaanncccccncgttctagccctggnnggnaacccacnnaaccttttgggggccggtcnatncccaanagcntg

SEQ ID NO: 30156 - DNA, 576 bp, Triticum aestivum
  Clone ID: PAT_TA_30156
gagaagtggagcgacgatgaagccttctttgcctggaaagatgatcctgacaagtatggcaagtatcttgaggagctgaaagctgagagagcgtccacactgctgtcgaatctcgctgaaacctctgacgccaaggccttgcccaacggtctctcgctcctcctcagcaaaatggatcctgcaaagagggagcaggtaatggatggcctcaggcagcttcttggttgatgactggcctgccctttgataacgcatccattcagccagcataaaccggccttgcttgttgccaccaaacaagtcctgtctatggtggactgggtaccaacggaagtgcagacgacaagcaaattttacttgtgtggcgatctacaggagaggggagggttcagtggaagaagactgaacacattgtttgcacataggtaggtggcattccagaaacatttgtatattttattattacaaataggcacacacaaagcatatgtatgctggatagatattcagtgtgagttgttgcaatgcaagattcatcatcttaatttacgagatatgtgtgatgatcgtcgtgct

SEQ ID NO: 30157 - DNA, 7517 bp, Triticum aestivum
  Clone ID: PAT_TA_30157
cccggcccgcgttcccccgctctcccccccctcccgcaacgcccccgcccccccgagaacgatgacctgcaagctgttcctgctctctcggaatggcccggccatgttcctccctatgttggcgccgctcttcctgctgcccaaccgcttgatccccatgagagacctgtagcatacgccgcagccaactccgccgccgcccccctcctcacaatcgaccctccggacaccgacggcgggaagtgggtcgtcggcgagcttctcggtggaagccttccgggcccattggcatggtgggccttgaaggtgagtaaatcgggggcacctctcggcgggaatccagtcatttccatagccgtggagatcgcgacagcgctgcaggccatccctccggaccctagccagcttgattctcccgagcgtgtagtccctcaagcgggacaggtgtggatccgggtttcggccgcgaaaacggccgaggcactgctggagttcaaccgggaagagctcccattgttcatacttgctaacaggagaggcgtttctggtgggcaaagggatctgtttgaaggaatccttcaggctggttctaggaatgttgagaatctgaggccgtataagcagcctgtttttgtgtacataccagattctggagacctgcgtggcggtgctcgggttgtggcggacagcaaatttccggcggcgcacattgagaagggagccgtttggcctgggagagggaaagtccttgaggcaccagtagtcgataagatcaatttttatcctaatgaacaggaagaaagagttctaaggcttgaacctgggttgttacgtgtgaaagttcagcaccaaaaagaaaattgtacaacccataggccttgtgaaaaggctgcggcgtcgacgacaatcgaaacgagcgttgcttctcagatgatgcagcatcctccaataaacactgcagtagcgggcgggggtggtaagggaataaggaaggtagacagaatggatgcgataagcgtattgattaaggaagtggaatgggaggtgtccggagcggttatatatattatacaggtggcatctctggcccagcatttagacgttaagttggtctgagacgacgacggcaaggtggaagcaccgaaccgtcgagactcttgtgttcaaagcaggcaatggtacctcgctgctcaaggaggaaacggcgtgaagcgtggcgaagataaagccttcttcacctggaaagatgatcctgacgagtatggcaagtatcttgaggagctgaaagccgagagagcgtctacactgctgtcgcatctcgctgaaacctcggacgccaaggccttgcccaacggtctctcgctcctcctcagcaaaatggatcctgcaaagagggaacctgcatctcaagttgtagtaggaatgggcataccactctacaatattccagagatcagacgcttttatggaatagaacatggaggtggctatcacgcttggaaggaaatatcagctgtagcaactaaatttgatttggacaaagcacagtctgtaaagccaaagggtcattgtgtagcagttagagttactagcgaggatccagatgatgggtttaagcctaccagtggaagagtggaagagctgaactttaaaagcaaacccaatgtttgggcctacttctccgttaagtccggaggtgcaattcatgagttctctgattcccagtttggtcatgtttttgcttttggggaatctaggtcattggcaatagccaatatggtacttgggttaaaagagatccaaattcgtggagagatacgcactaatgttgactacactgtggatctcttgaatgctgcagagtaccgagaaaataagattcacactggttggctagacagcagaatagctatgcgtgttagagcagagaggcccccatggtacctttcagttgttggtggagctctatatgaagcatcaagcaggagctcgagcgttgtaaccgattatgttggttatctcagtaaaggtcaaataccaccaaagcacatctctcttgtcaatttgactgtgacactgaatatagatgggggcaaatatacgattgagacagtacgaggtggaccccgtagctacaaattaagaattaatgaatcagaggttgaagcagagatacattctctgcgagatggcggactcttaatgcagttggatggaaacagtcatgtaatttacgccgagacagaagctgctggcacgcgccttctaatcaatgggagaacatgcttattacagaaagagcatgatccttccaggttgttggctgatacaccgtgcaaacttcttcggtttttggtcgcggatggttctcatgtggttgctgatacgccatatgctgaggtggaggttatgaaaatgtgcatgccactgttactaccggcctctggtgtcattcactttgtcatgcctgagggtcaggccatgcaggcaagtgatctgatagcaaggttggatcttgatgacccatcttctgtgagaagagctgaaccatttcatggcacctttccaaaacttggacctcctactgctatttctggcaaagttcaccaaaagtttgctgcaagtgtgaattctgcccacatgatccttgcaggatatgaacataacatcaatcatgttgtacaagatttgctaaactgcctagacagccctgagctccctttcctacagtggcaagaactcatgtccgttttggcaacccgactcccgaaagatcttaggaatgagttggatgctaagtacaaggagtatgagttgaatgctgacttccggaagagcaaggatttccctgccaagttgctaaggggagtcattgaggctaatcttgcatactgttccgagaaggatagggttactagtgagaggcttgtagagccacttatgagcctggtcaagtcatatgagggtggaagagaaagccatgctcgtgcggttgtcaagtctctgtttgaggagtatttatctgttgaagaactcttcagcgatgacattcagtctgatgtgatagaacgtctacgacttcaacatgcaaaagaccttgagaaggtcgtatatattgtgttctcccaccagggcgtgaaaagtaaaaataaattaatacttcggcttatggaagcattggtctatccaaatccatctgcgtacagggaccagttgattcgcttttctgcccttaaccatacagcatactctgggctggcgcttaaagcaagccaacttcttgagcacactaaattgagtgaactccgcacaagcatagcaagaagcctttcagagctggagatgtttactgaggaaggagagcggatttcaacacctaggaggaagatggctatcaatgaaaggatggaagatttagtatgtgccccggttgcagttgaagacgcccttgtggctttgtttgatcacagtgatcctactcttcagcggagagttgttgagacatacatacgcagattgtatcagcattatcttgtaaggggcagtgtccggatgcaatggcacaggtctggtctaattgctttatgggaattctctgaggaacatattgaacaaagaaatgggcaatctgcgtcacttctaaagccacaagtagaggatccaattggcaggcgatggggtgtaatggttgtaatcaagtctcttcagcttctgtcaactgcaattgaagctgcattaaaggagacttcacattacggagcaggtgttggaggtgtctcaaatggtaatcctataaattctaacagtagcaatatgctgcatattgctttggttggtatcaacaatcagatgagcactcttcaagacagtggtgatgaggatcaagcgcaagaaaggatcaacaaactctccaagattttgaaggataacactataacatcacatctcaatggtgctggtgttagggttgtcagctgcattatccaaagagatgaagggcgttcaccaatgcgccactccttcaaatggtcatctgacaagttatattatgaggaggacccgatgctccgccatgtggaacctcctttgtccaccttccttgaattggacaaagtgaatttagaaggttacaatgacgcgaaatacaccccatcacgtgatcgccagtggcacatgtacacactagtaaagaacaagaaagatccgagatcaaatgaccaaaggatgtttcttcgtaccatagtcagacagccaagtgtgaccaatgggtttttgtttggaagtattgataatgaagttcaagcctcatcatcattcacatctaacagcatactcagatcattgatggcagcgctagaagaaatagagttgcgcgctcacagtgagactgggatgtcaggccactcccacatgtatctgtgcataatgagagaacagcggttgtttgatctaattccatcttcaaggatgacgaatgaagttggtcaagatgagaagacagcatgcacattattgaagcatatgggtatgatatatatgagcatgtggtgtcaggatgcatcgctttctgtgtgccagtgggaagtgaagctatggttggattgtgatgggcaggctaatggtgcttggagagttgttgttaccagtgtaactgggcatacctgcactgttgatatttaccgagaagtggaggaccccaatacacatcagcttttctaccgctctgccacacccacagctggtcctttgcatggcattgcattgcatgagccatacaaacctttggatgctattgacctgaaacgtgccgctgctaggaaaaatgaaaccacatactgctatgatttcccattggcatttgaaacagcattgaagaagtcatgggaatctggtatttcacatgttgcagaatctaacgagcataaccagcggtatgctgaagtgacagagcttatatttgctgattcaactggatcatggggtactcctttggttccagttgagcgtcctccaggtagcaacaattttggtgttgttgcttggaacatgaagctctccacaccagaatttccaggcggccgggagattatagttgttgcaaatgatgtgacatttaaagctgggtcttttggtcctagagaagatgcattctttgatgctgtcaccaatcttgcttgtgagaggaaaattcctctaatttacttgtcagcaactgctggtgctaggctcggtgtagcagaggaaataaaggcgtgcttccatgttggatggtctgatgaccagagccctgaacgtggttttcactacatttacctcactgaacaagattattcacgtctaagctcttcagttatagcccatgagctaaaagtaccggaaagcggagaaaccagatgggttgttgataccattgttgggaaagaggacggacttggttgtgagaatctacatggaagtggtgccattgccagtgcctactctaaggcatacagagagacctttactctgacatttgtgactgggcgagctattggaattggggcttatcttgctcggttaggaatgcggtgtatacaacgtcttgatcaaccaattattttgactgggtattctgcactgaacaagctcctggggcgcgaggtgtatagctctcagatgcaactgggtggccccaaaatcatggctacaaatggagttgtccatctcactgtgtcagatgatcttgaaggtgtttctgctatcttgaaatggctcagctatgttcctccctatgttggcggtcctcttcctattgtgaaatctcttgatccaccagagagagctgtaacatatttcccagagaattcatgtgatgcccgtgccgccatctgtggcatccaggacactcaaggaggcaagtggttggatggtatgtttgacagagaaagctttgtggaaacattagaaggatgggccaaaactgttattactggaagggcaaagctaggtgggattccagttggtatcatagctgtggaaaccgagacagtgatgcaagtaatccctgctgaccctggtcagcttgattctgccgagcgtgtagtccctcaagctggacaggtgtggttcccagattcggccgcaaaaacgggccaggcactgctggatttcaaccgtgaagagctcccattgttcatacttgctaactggagaggcttttctggtgggcaaagggatctgtttgaaggaatccttcaggctggctctatgattgttgagaatctgaggacgtataagcagcctgcttttgtgtacataccaaaggctggagagctgcgtggaggtgcatgggttgtggtggacagcaagatcaatcctgagcacattgagatgtatgccgagaggactgcgagagggaatgtccttgaggcaccaggactcattgagatcaagttcaagccaaatgaactggaagagagtatgctaaggcttgaccctgagttgatcagcctcaatgccaaactcctcaaagaaactagtgctagccctagtccttgggaaacggcggcggcggcggagaccatcaggaggagcatggctgctcggaggaagcagctgatgcccatatatactcaggttgccacccggtttgctgagttgcacgacacctctgcgagaatggctgccaaaggcgtgatcagtaaggtggtggactgggaggagtcccgagccttcttctacaggagactgcgaaggaggcttgccgaggactcgctcgccaaacaagtcagagaagccgccggcgagcagcagatgcccactcacagatcggccttggaatgcatcaagaaatggtacctggcctctcagggaggagacggcgagaagtggggagacgatgaagccttcttcgcctggaaagatgatcctgacaagtatggcaagtatcttgaggagctgaaagccgagagagcgtctacactgctgtcgcatctcgctgaaacctctgatgccaaggccttgcccaacggtctatcgctcctcctcagcaaaatggatcctgcaaagagggagcaggttatggatggcctcaggcagcttcttggttgatgactggcccaccctttgataacgggagcatccattcagccagcataaaccggccttgcttgttgccaccaagcaagtcctgtctatggtggactgggtaccaacggaagcgcagacgacgacaagcaaattttacttgcgtggcgagctacaggagggggaggtttttcaactgaaacacattgtttgcacataggtaggaggcatctcatctcaggacaatttgtatgtttattgttattacagataggtacacacaaagcatatgtatgctggatagatattcggtgtgagttgttgcaatgcaagattcatcatcttaatttacgagatacgtgtgatggtcgatgtgatagtcctagtttcctcggtggcgaggaacgctgagtttccttttgctgcagttatgtgatgtataccctgagaac

SEQ ID NO: 30158 - DNA, 844 bp, Triticum aestivum
  Clone ID: PAT_TA_30158
gacacgaggagtcgcggcgacctgaccgacgacgagcgcaaagcgctgcgggggagcaagttcgcgcccctcccggcgccaccgccgtcctcccgccccaacccgaggatggcccatcctggaggaccactgactacaaataaggctgctgctttagcgaaattcctcgagagaaaactacagcaacctgatggcttggactctctaaatcctgatcttgtaaatttggctgtgaaaaatgcaaaggaaaccataaaggcaagcaagggtgaggcctcaacttctgggagagtagtacggcatgttccatcatttgaggattcctctgaggtttccaatcaagatgacggggagcagagacaggaaaagaagaaaaagaaaaagaaaaagagaaaaacaaaggccgctaaagataagctccacaatacatcaaagaagaaaaagaagttatcgctatgactcttgaatatccatgggaccatggagttaaaagaaggcagccgtccacacttttgcacttcttagatctcttggtttcatctgaacctcaatcagcactgtaaagtgtaaacctagcagtggcatcaggcatcaaggtgacccgtcacagtgaacaaaagaacatttatgaaccccagagtgcaaaactgaatgtagttggttctggtctaacggtccctataccatcagaattgcttggaaagttttatatattctgcaatttattactgttgccggttccggtcctgcggtcccgatgccgctgcagtggcgaggcaactcccctgtattcagcactttattactgctgttgaatgctgttctgagtttgtgaaaaaaaaaa

SEQ ID NO: 30159 - DNA, 716 bp, Triticum aestivum
  Clone ID: PAT_TA_30159
ccaggaaggacgcgacgctgccggaggtgaacctcgccgacggcgtcctccgcaggcctacgttcggcctgccgcccgagaaccggacgacactcgccttcttcgccggcgggatgcacggcgagatacgcaggagcctcctgcagcactgggtcggcagaggacccggacatgcacgtccacgagtacctccacgccgggcaggactaccacgcgctcatggccagggcgcggttctgcctctgccccagcggcttcgaggtggcgagcccgagggtggtggagtctgtcttcgccggctgcgtgccggtgatcatctcggaggggtacccgctgcccttcagtgacgtgccggactggagcaagatgtcggtgacggtgccggcggctaggataccggagctgaaggtcatcctgcggggcgtgtcagagaggaggtaccgtgtgctgcatgccagggtgctgcaggcgcagcggcacttcgtgctccaccggccggcgaggcggttcgacatgattcacatggtgctgcactccatctggctcaggaggctcaacgtcaggctaccatactgattcccggtgtcggtgtctgtatgtacatctatcgtgtgtagtatttgattttgtaggaattatcggtcggaagaaattttggtcacagtgctatttgcatgaaactgaattgaacactactagtacatattttgtttatt

SEQ ID NO: 30160 - DNA, 813 bp, Triticum aestivum
  Clone ID: PAT_TA_30160
ctttgatgtgtcatacaataatttgactggagatatcccaaccgggggccagtttttgaccttcgcggttgaaggctttctgggcaatcctgcgctctgcctccttcggaatgcctcctgctccgagaaggctcgagttgtggaagcagcacaccgtaagaagagcaaagccagccttgctgcagttggagtaggaactgcagtcggggttatctttgtcttgtggattacttatgtgattttggcaagggttgtccgttcaagaatgcacgagtgcaatccaaaggcggttgctaatgctgaagactcctcctcagggtctgctaactcaagcttggtgctgctattccagaacaataaagatctcagcatcgaggacatcttgaagtccacgaaccactttgatcaagcatacatagttggatgtggtggttttggcctcgtctacaaatcaacgctgccggatgggcggagggttgcgatcaagcgcctttcaggcgactactctcagatcgagagggagtttcaggccgaggtggagacactttcaagggcccagcatgagaaccttgtgttgctgcaggggtactgcaagatcggcaacgacaggctgctgatctactcatacatggagaatggcagcttggattactggcttcacgagaggacggatagcggtgcgctgctggattggcagaagcggctgcggatagcacagggttcggcaagggggttggcatacctgcacatgtcatgtgagccacacatactgcaccgagacatcaagtcaagcaacatccttctggatgagaa

SEQ ID NO: 30161 - DNA, 1289 bp, Triticum aestivum
  Clone ID: PAT_TA_30161
gtcgccgcggccccctcggcccatctcagcagtgagcgacgttgtctcgtcccgtctgggtccctccgacgccaagccaccgtcggtgcccatgccgccgagacctccgcttcccctctccgtcgccgtcgccgtactctccgtcctcctcctcacggcggaggcggtgcccttcgtcgtcctgcacgggattggggaccagtgcgccaaccgcggcgtcgccgagttcacccgcctcctcgccgactggtccgccgccgacggccactgcctagaaatcggaagcgggacatgggactcctggctcatgcctctccaccaacaggctgatgccatttgcaacaaggtgaaggagatgaaagagctgagcggcggctataacatcgttggcctgtctcaggggaacttgattggccgtgcagtgctccagtattgtgatgatggaccaccggtcaagaatttcatctcactcgcggggcctcatgctggcaccgcttccgtgccgctttgtggttctggtattttctgtgttattgctgatgccctgattaaattggagatctactcggactacgtacaggcacatcttgcaccaagtggctacatcaaaatcccaacggatatggatgattatctgaagggatgcaggtttcttcccaaacttaacaatgagatacccggtgaaagaaatgctacctacaaggaacggttcagcagcttagagaatttagtattgatcatgtttgagaatgatgtcgtcgtcataccccgggaaacttcgtggtttgggtattatcctgatggagcctttgagccagtcctacctcctcagcagacaaagctgtatcaggaagactggattggtctgaaggccctggacaaggccgggcgagtcaagttcgtctccgtgccaggaggtcacctgggcatctccaacagtgacatgaggaaacacattgtgccttacttgaaggacaaaccatctgtttctgcttcactcgccgccacctggcacgccgtcggggaagcgctcgggctgatgggggacgatgtcggcgtcctccttcagtcctcgacatgatgatgatgatccaccatcttgttgtcaggggtatatatagtgttggagtggtcagtggtgtacatgtcattctttgttcaagcttttttgcttgaagcgccgctttgtagaagactgcagcagctgtaaaaacaagaaccacaggttccatgtcaggtccttaattagcttcattcacatggtttgctcatgttggttttatatgcaa

SEQ ID NO: 30162 - DNA, 1415 bp, Triticum aestivum
  Clone ID: PAT_TA_30162
cttgctcatccaaagcaaacaaagctccctctctgcaggttcgccatctcgtgactgatccgtccatggacgtcgccgtcgagaggccgccgccggtgaaagaggagaacaagccggagaccatggagatcgcaagcgcgcttccaatggtcctcgagagtttcccgtccacgcaaagaaattcgatcaccaccagcaaggacgacaagctggaggcgaccaaggcggagatgggcgaggtgagggaggagaacgagcgcctcaagacgctgctctcccacatcgtcagggactaccagtcgctccagacgcacttccaggacgccgtcaaggtcaagcaccaagcaccggccgccgacaagctccctgccgcccccgcgccggcgcctaccgctaccaccgacgatctcgtctctctgtgcctcggcagcggcggttacgctcgcccgaagggcgcccaccagaggtcgctgtcgtcgtcgtcgtccggcaccgagaccgaccccgacgatcagctgtcgctcgggctgagcagccgtcgctctacggacggcgacgacaggcaggccgcccgcccgtcggctacgccccttatgaacctcagctccgacagcagcgcggacgacgacgccgcgcccggtagcgggctgccggccgccgcgtgcccgccggcgaccaaagcgcgcaagagccccggcgccggggtcgacggagccgacgacgaggtgctccagcagcaggccaagaaggctagggtttccgtccgtgtcaaatgcgacacccccacgatgaacgatgggtgccaatggcggaagtacgggcagaagatctccaaggggaacccgtgcccgcgcgcctactaccggtgcaccgtggcgccgtcctgcccggtgcggaagcaggtgcagagatgcgccgacgacatgtccatcctgatcacgacgtacgagggcacgcacagccacccgctgccgccggccgccgcggccatggcgtccaccacctccgccgctgcttccatgctgctcgccggctcttcctcgtcctcgtcccacgggcaccacctccctttcccgtccgcggggctcctgggcccgaccaccatctccaccatcgcgtcctgccccaccgtcacgctcgacctcaccgccccgcactcgctcatgcagcagcagtaccagtctccctacgcggcagggtacgagtccaaggcgctgccggcggcgtggagcagcggctacctggcgccgtacgccggggggctgccgtactacggcaagagctccttgccggcgatggggcagcatttcggcctgggcatggcgacgacgagggcggagcagctgtacggcgccgcccattcgtcctcgtacctgcagagaacgtccagcggcggcgtcgtccatggcgcgccc

SEQ ID NO: 30163 - DNA, 755 bp, Triticum aestivum
  unsure (1)..(755): unsure at all n locations
  Clone ID: PAT_TA_30163
gtggagttggcctcatccccgcgaggaggaggctcagacgggccgacccgtcctgggctacggatcagacgccagctaatccaccggaagattcgttcccctctgcccccctctcattatcttcttcaacctcgtcggcaggaaccagatcgggattcgggaacgatgactacctcatcttcttcctcccagcccgacgaggtactcccgctgattccttgcccaaccggtggtgacaaggtggtcaccttcatctcccaaggtggaccacgcttctacaagtgcgtcagagaagatgctgggttgtgtcagtttttgagatccacggacacctacctgccggagctcactcgccacgacttgtcccagccgtacgtgctgcaccagcctctagccgtgcacccatccgcttcccttcacaagagatacaggcgcgagcacaatctcgcggacggcggcagccaagcagagatccaaccagctcatggacgtccccggccacagcttgagcagtcgcgccccccttgcgctgcaccgcactgctgctcgatggacagccaaagcacagcgctgctgatggctagcaccaacctgctcctgttcttatctttgtgcagcagagcagttacttccgtgtacaagagtcctgtaatggggagagtcgtgtgattttgattttgctaattccattatgtagtacggacccgtgtaagctggcaactggcatgctaatatctctgaacgttctctcaana

SEQ ID NO: 30164 - DNA, 729 bp, Triticum aestivum
  unsure (1)..(729): unsure at all n locations
  Clone ID: PAT_TA_30164
gcacgagggttgctctctagctagctagctcgaacccggccaagcacttgtagctgatctcgatcgtcctagcaggcatggatggcaagacggagatgcctcttccgcgccctgtgaccgtggccaagaagaagatcccaggatctgtctggctggcctgcggatgggcgctcctcagcgcctgcaccatcgccttgggccactaccatctcccctgcagccaggccacgttcgttctgcggtgcggctgcgatgagctgacggacaccaaggccgcctggttgagcgccgcctggatcggggccctgctctgcaccgcgtcccaggcagccgcggcggcgctggcgctgctgctcccacgcctccaccccgagcttcccttgctctcgctctcgctcacgctcgctgccgccggccactggatggccagcggcgccgtcgtcatcgtccgcttcgccgagccatgcccaggatgctgcttccacagcacactcttcctcctggccctctgcttgttggagttgggcgacgtcatcggctccatggctctcgtcgtgggagcgctgaggagtagggcacacagcatgtagccgattagcccagcaagctgcaggggactgtatgcgtccatggatcagctcaagatcgaggtactgatgagctagntctcgccaggaagaataatctattgtagtagtatgcagtatatatgctgcgaagagtgatgga

SEQ ID NO: 30165 - DNA, 821 bp, Triticum aestivum
  unsure (1)..(821): unsure at all n locations
  Clone ID: PAT_TA_30165
caccaccaccaccaccaccgccgccggttaccgtcacggcgtgtcatacacctctctctttccctctccccctctgacaaggacaaggacggccatggcggcggcaggccggcggcaagccgacgacgagctcctcctccttcctcactgactccgcgtcgtcctcgtccccgaatacccctcaccctcagcccctctcacgcagcaccaaggataccccagaataataccaccatgaccggtggcaagatccagaagaagcgccacggtggcggcggcgggggcggtggcgcgcggctgcagggtgggatcccgttcgagaagtccaagggccagcacatcctgcggaacccggcgctggtggactccatcatcgccaaggccggcctcaagcccactgacaccgtcctcgagatcggacccggaacgggaaatctcaccaagcggctgctcgacgccggcgtcaaggtcgttgttgccgtcgagctcgacccgcggatggttctcgagctgagccgcaggttccagggccaccccctctcctctcgcctcaaggttatccaaggagatgttcttaaatgtgatcttccttacttcgatatctgcgtggcaaacatcccataccagatatcatccccccttacattcaagcttctgtcacaccgtccgatcttcaggtgtgctgtgatcatgtttcaacgtgaatcgcctctggtcaccgtaaccacaagctcggtcacgtcgaagacgcagngctcctccccttcctctttgacgagcagtataacacttttcatcgctttggctacgcatctgacccc

SEQ ID NO: 30166 - DNA, 1424 bp, Triticum aestivum
  unsure (1)..(1424): unsure at all n locations
  Clone ID: PAT_TA_30166
cgcggccccacgccacgcgcgcgccacagtacggccgccgcctcaccaccgctgagacctcctcctccccaggcaggcgcgagagtataccccagaataatacctccatggccggcggcaagatccagaagaagcgccacggaccgcggtggcggcggcggcggcgcgcggctgcagggtgggatcccgttcgagaacgtccaagggccagcacatcctgcggaacccggcgctggtggactccatcatcgccaaggccggcctcaagcccaccgacaccgtcctcgagatcgggcccggaacgggaaatctcaccaagcggctgctcgagcccggcgtcaaggccgttgtcgccgtcgagctcgacccgcggatggttctcgagctgagccgccggttccaggggcaccccctctcctcacgcctcaaggttatccaaggaagatgttctggaatgtgatcttccgtactttgatatctgcgtggcaaacatcccgtaccagatatcttccccccttacattcaagcttctgtcacaccgtccgatcttcaggtgtgctgtgatcatgtttcaacgtgaatttgccatgtgacttttagcaaaccctggttacactttggactgccgtctgtcagtgaacgtgcagctcatagcccgcgtgtcgcatctgcgcaaggttgggctgacgacccccacgccttcacccatggtagatacaacagttgttcgcattgagccaaggaaacccctcccgcccgtcacctgccaagagtgcgcctgccttgtaacaacttcaatcaatcggaaaaacaaaactctgggctcccttttcaagcagaagcgcgtccttgagttgctagagaagaattacaagacaatgcaatccctccgacgtgccccaggacctggcatgcgcgccgactagccctcgcctcatgatgtcgcagtgctggcctgaatatggtcgaaggacctgagcatggagatcggtgacgagaaagaggacgacgacatggaaatggatgacgcggcagatgcccgtgctagcttcaaagaaacgattatgggcatattgccgcgcggcgattttgcagagaagaggtcattccagactgagccttgttcatttccgctacttgctgtctctgttcaacttagcaggtatacctttttcatgcgggcccgcttagtcagctagcttgtgatggatcttgaaaagccatgcttattttttggttgatgtcatgtaagttctatataagttagtcatctatgtgatattgcgctctgagatatttttgatactgtcgattttgcccaggctttagagaagtcgaatatttcaaggcaaagatgttcaaacggtgttgttggtgccgatttcctcgcataaagatgtccaaacggtttgtaactgtaaaan

SEQ ID NO: 30167 - DNA, 1302 bp, Triticum aestivum
  Clone ID: PAT_TA_30167
gctctgcccgtctccggcgaccgtgatctgctctgctctgctccggtggtctccgccgccacggaacttaatacacatctgccgcagaacccatgagcaggggcgccgcggcgagcggcagcctgcggacggccctctcgtactgcgtccagcaggtgcgcagctacgactaccacaactacctctgcctgctccacctgccgcctgccatgcgcaaggccgcgttcaccttccgggccttcaacgtcgagacggccaaggccatagacgtcgtgtccgacccccgcaagggcctcatgcgcctcctctggtggaaggacgtggtcgacaaggtctgcgccggcaagaaggtcgagcaccccgtcgcgctcgcgctctcctcggtgctctccgagcacaaggtcagcaagcactggctcaagcggtcgctggaggccaggatcaacgacgggaaccgggacgaggacgccatccctgagaacgtcccggagctggagaggtacgcggaggacacccagtcgaccatcctgtacatgacgctgcaggccggcgggatacagtccactgttgctgaccatgccgcctcgcacatcggcaaggcgagtgggctgctgctgctgctcaaggcgctgcctcaccacgtgagcaagcaagggaagataccgtacatcccggcgagtgtggccgaggagtgcgggctgcttgcgcgggagggtggccggacagaggtcaggatgggcgacgcgctcccggatgcagttttcaaggttgcgtctgttgccgaagctcacctgcagaaggcgcgggagctggccacgtctgtgccggcagaggcggtccccgtgctcctcccagccgtgccggcccaggtccttctggactcgctgcgacgccgcgaattcaatgtcttcgactcgcgcttgtccagtggagtccatggcatatcccctctgtggtaccagctgaagctcaactggcacgcgtggcgaaacaagtactgaattcatccatgccgtgtgaaccgtgtttgttgaaagcgcgggtcagcatgcgttttagcccagactaaacctggggtatccatttacgggaatgtaataagcttgatgatgaagaaaagctctgctacctgctccaactggctgtttctgagcaattttgatgtagcttcctttttcattggatacatgctttgttgagggttgtttgtttcgtttgtattcgagtatcgacatgaggtggatgaatgttatttgttgagcttgtcctttcagtttgttgcttgccccagattgttccaat

SEQ ID NO: 30168 - DNA, 961 bp, Triticum aestivum
  Clone ID: PAT_TA_30168
ttttttttttttttttttgcttccaggtcgtgaaatgtaaattatgctacatatttccgccgcttttctttgccggctgttatgcttctcccggtcgctgcatctccctcccgccgtattgccctcccgccgggctggcccatcccacggccggccggccagcagacgttcccgccgtccccccggtggccctgcccgcttgcccattgacccactccggcggcgtcgagtgcagagaaagccggaccaccggtgcgatgtccccggcctcccctgagctgctccatcggggtcctctccagcggcccgcctcaccgtctcgttgctcttcccccggcgaagaacatgtccgttggccgtggcccccggagccacgcagttggccgtgacgcgcgtgcccttgagctccttggccatcgtccgcaccatcgcctccacggccgccttggacgccgtgtaggcggagtaccccgtcgggttcgacccgaccacggacgacgtcacggccacgatccggccgccgccgccgcggggcagccggttggcagcctcgcggaggcagaggaacgcgccgcgcgcgttcacggcgagcacgcggtcgaagtccgccgtggcggtgtcggcgagggacgggtactagtcgtcgagcacgccggcgttggcgaccaggatgtgcggcgccgcgcagccgaaggccgactcggcggcgtcgaagagggagcgcgcgccggcctcctcggacacgtcggccctcacggccacggcgcgcgggagctccgcggcgagcgcgtcggcctcggctgcgctggccgcgtagcccaggacgacgctcgcgccgagggacgagaggtgggccgcgatggcccgtccgatgccgcgcgacgcgccggtcacgatggccacgcgcccgccgagcggcaacgccgcgggacccgacgagccggcgacggcggcgacggcc

SEQ ID NO: 30169 - DNA, 1162 bp, Triticum aestivum
  Clone ID: PAT_TA_30169
accggctcggcgcttgttctgacgaaaccacagcgccgccgctcatggtgtgcggcggagccatgagcaggtggctcgtcctcctcgtcggtcttctcaccatctctctggtaccatcatgtgccgccgcggaggtgaagatcagcccaacggagtggagccttcgcctacccctgcccgacggcgtcaccggtgccgagagcctggccttcgacgcgcttggccagggcccctacaccggcgtctccgacggccgcgtcctcaagtgggacggcagcgccgtcggctggacgaccttcgcccaccacgccaactacaggaagctccccatgtgcaccgtggccatggcgccgtcggaggagacggaaggcttgtgcgggcggcttctggggctcgcgttccaccttgagtccggagacctctacatggccgacgcgtacaatgggctcatgagggtcggccccgacggcggcgaggccgaggtgctcgcgaccgcagccgacggcgtccagttcaacttcgtcaacggcctggacattgatcaggtcaccggtgatgtatacttcaccgacagcagcgtgacatatccacgaaggtttaatacggaaatcatgatgaacgccgacgcgacggggaggctgctcaagtacgacgcgcggacgaagcaggtcaccgtgctcaagtacagcttgccataccccaacggcgtcgcggtcagccatgaccggatgcacatcgtcgttgcgcacaccctgccgtgccaggcatacaggtactatttccagggaccaaaggctggccactacgagctgctcgccgatttgcctggctacccggacaacgtgcggcgcgacgagaatggcggctactgggtggcgttgaaccaggaaagggggcgcccgggcgggaccacacgccccgtgaggcacttggtcggtgtccggttaaacggcaacggcgtggaggtaaaaaagctgacccctgccaagggcgtgacactcagtgaggtgaccgaaaggaaaggaaagctgtggctcggctccatcgagctcgattacatcggcctactagttcccttgtactaatttgtttacattcaccagcaccccatttcctgctgggtgcatccctgtcccccaatatagagttgggtacgtccctt

SEQ ID NO: 30170 - DNA, 966 bp, Triticum aestivum
  Clone ID: PAT_TA_30170
cccacgcgtccgaaatgagctggtccgctacatcaaagagtctaccaagattcccgtccttggccacgccgatggtctctgccacatctacctgacggcttcggccgacaaggaaaaggccatcactgccattgttgattccaagactagctaccccgctgcctgcaacgccgtcgagactcttcttgtgcaagagtccgctctaaactctgtcttccccggtgttgcttccgctcttgctgccaagggcgtttccctccgcgttgacgaagccagcaaggctgccattacctctctgtcattagaaggtgtccaggatgccaccactcaagactacgataccgagcatctctctcttactattggtgttaagactgtctcctccattgatgaggccatcactcacatcaacactcacggctcacaccacaccgatgccatcatgacttctgattctgccgaggctgagcgtttcatgaacgaggttgactctgctggtgtgtactggaacgctgccactcgtcttgccgatggtatgcgatatggcttcggcaccgaggtcggtatcagcacaaacaagattcactctcgtggtcctgtcggtcttgatggtctcaccatctacaagtacaagatcaggggcgattatcaagcaacagccgactatggagatggcgaaggaaagaaaccttggaagcacgagaagttgtccctctgaacgaccatttgcaaaaagatggacggtgcaagtcaaggcgttggtataaaagtgtatcagatatctcaatagtagggtgcctagtgggtagcagaaaagttggcctcgtaagtcttagagtatagaaataagtagtctaagaagcatagtccaagtggcataagctgccctaatcattttgtctcttatgcttctagcggccaatttttctaataccccaagggccgcctcggccacggtttcaatcc

SEQ ID NO: 30171 - DNA, 679 bp, Triticum aestivum
  unsure (1)..(679): unsure at all n locations
  Clone ID: PAT_TA_30171
ctgctcccacgcgtccgcccacgcgtccggccccttcctcatcgatccccacaacccctccctcctcctcgttcctcgccagggcccatccccacaacccctccctcctcctcgctcctcgccgtggcctccgccctaggagcctcgcccgggcctcctactccctctccaccatcgtaggtgcacacagacggcggatctgtgccggagaagagcagctctggtggggtgcagctgcaacagagatgaaggaggtccgccgcccgtctttgcctcctcaacgtgtccttgttgctgagcctagcagcgcagcagtcggggacaaggggaaggagcaggccgacccgaccgcatctctttgcacgaggactggaggagcaagtcgcgagggaagccggcacggccagcggcggcgctgcacagggacgcccgcctccggttttctatcctgtctcccaatcccccctcactcctcctcgctccgaggaattgggcaatggcacgggggtggaactggccgaggaagagggcgaccgtgatgggttggaggccaaggaagagggcgacaacgcaagggtgaacgagggtatgcctgtggtcgtcgcgttgtgaaacgacgcgactggngatacagatttgtttccttcctcgcctcaacgatgagctctgcttcttgagc

SEQ ID NO: 30172 - DNA, 721 bp, Triticum aestivum
  Clone ID: PAT_TA_30172
atcccaacccagcactatgccgccgccgccccctatcctctttctctatacgggcgcgcagcctcatcctcccccaacctggtcgccggcagcccctgcgtcaggccctctgttccccccagcgaggccgagatggtagcacggcgcgcagccccatcctccccagcctggtcgccggccagcccctagcgctaggccctccgtttatcggtggcggtgttggcgttgaaggatggggcgatgatgccgtcggactcttggaaaagcaacgcaggcagaggaagagcacgcgccccggcgtcggaggaggcttggcaggagatggttgttctgctgcaggtacgtgaacggggtggctaggttgacaagctggcctcctccggcatcctctcttcgccccgctccggctccagcccctcgcttgccgcctcctgcgacgccgatgttgagctctcttgcgaggtgttctatcaattgaccaaactaagccaagtctgagtacggacgatggtcatgtactttccttcttcaagtactcctcctcctcggtgttctcctccgcaggcgtgttccgcccgagccaggagttcgtcgagcgcggcctcccccaacggggagttctacatctggcagtggcgcgttggcgtgccgcacgacgctgggatgtacttgtggatggacgggtggatgtaccagggggagtggtggcacgggccggggc

SEQ ID NO: 30173 - DNA, 812 bp, Triticum aestivum
  Clone ID: PAT_TA_30173
ctcgaggtttttttttttttttttttggatttgagtactaggtaacaagtgaaaaacaagctcattagaacaaatcttgctgcaattgagagcaagatgaatctactacaccgatgaagtagaaatcataaaagtaatgaaatctaagggttaacacgatagaacaacatctgatatattatggagaacaaggctgatattacgaagaacgatgcctttacaccgtgttagcctgccatgtgagccactgagactacgaaacagcaagccctttttcttttctgtggtggtcactatattggtagtatatatgatgatcagcattgctgctactgtgcaaagggatcgttagttgtgtgcttcgacggggatctttgcggggttgggtcttaatgccgcagagaccttacaggcgatgttggtgcttcggctcaccatattgctgcccttcaaagaactcgttcaggagtttgtccaccagttcagggctgtatctgatgtacttcagcggattcttgccgctcccaacaacattgccaaaacgttttatgaaagatcgataggctggtaacagaacctcagctatagcaagcctcaacgattcacgcaattcttgatcaggtacaatccatagagattgcttcgcatgaagttcttcaaattgcgtattgaaagctttaaaccgttctttgatcacagctcttgaaactccgctgctgttaaggtctgctggtgtcgacgaaccagtgctgcctggcgcaccttgtacggaaagtgcctgaagaacctttgcccaagcacacgtttgtact

SEQ ID NO: 30174 - DNA, 587 bp, Triticum aestivum
  unsure (1)..(587): unsure at all n locations
  Clone ID: PAT_TA_30174
tnnnnnnnnttttttttttttttttttttttgaggggcagaccatcatggctatctttattaattatttaaaccatgcttacatcgtttgctaaagaaaaaggggactaaacgcacaagcatgtagccggtcgagattttaggtacaagtagtcattttgatggtcaattgaaactgtgataccagatgacgattcgactcaaatggccgatcacatcttggaaaacgtgtcagccaatgccgggcgcatgagcttgcccatctcgttaacaaacttgtccatggtggggccgggcatgcacacggggactgtgataccctcctcgcccgtggcgttccttgcagcaatgaagaagctgccgatgcctggtaaggcaacgactccgccatttgctggaccggcatacaccggcttgccccagccaaagtcaaggtcgcggattccaacattggtcacgtccgacacgaggtaggcgcgcgccaccgcaaagtgtggccgcccgcgttgtgccatgaacgctgccacggagaggatgtactccacatccacctgccgcttcgcccggacgcgtgggcggacgcgtggg

SEQ ID NO: 30175 - DNA, 767 bp, Triticum aestivum
  unsure (1)..(767): unsure at all n locations
  Clone ID: PAT_TA_30175
acatctttgctagnggtacactacctgtgaaagagcgggtaaacaaatattcatacatatacagtataaagaagagccatttcgaatctgactaaaatcattaccaccatcgctaatctgaagaaacattagttcagttcactcactcactggacgagcgttcttcagttgccgcagacttttcttcgtcagcatcgtcttcctcctcggccgcgagctcccgctccacctcgtcgccgacgcgctcgtcgtcggaccgggagggcatcgcgaagcggcacatcgggcagagccggctgacgtgcagccagcggaagatgcagcgctggtggaagcagtgggagcagtccatcttcctgagcttcctgcctccggccaccaggtcctcaaggcacaccgcgcactccagatcccgcacctccgccgccgccggcacgagcagccccgccatggagttcttggaggccggcggctctctgcgacactctgcttccgcctcgaactcggtctccgcccgggcggcgggtcgcctcagcgtctccgcgcgtctccgtatgaagtcctggttacgcgcccaccacccgccgacccgttgggggcggacggcgatgagggggtcgtcgggatccccgctcgctgcctccattactggatcgatctgccgctcctggcccagatttattatccgctcctggtcggattcatgctggtctcggcttccgattcgacttctgacggggagtgccctgcataggaaggggatgaac

SEQ ID NO: 30176 - DNA, 462 bp, Triticum aestivum
  Clone ID: PAT_TA_30176
agaaaaatatgcatgcttacattgaatgcatctgtagaggcaagaaatgtaatgttaccacatcaatttttggaagagcggaacaaaagaagagccatattttcagaactgaatttatgtctgaactgaaaaaagagagcatgaacgtcatcctgtatacaagggaaaaactgctatgccagagagatagcaccggctaggtgggaactctcccacacttccacaactggcatgtcttctctggtcacaaataagcggtctccgccgccttccatcatctctatcattccacgcttagaatcctcttcggtatccacatagctgcttctgaaactattttcattaattccttttctgtcaagtgtctcctttgctcccggttgctccggaaagttgcatgtgtcatctcgttgttcttccagtctggaccaaacctccaatccatccttccggctgacaaac

SEQ ID NO: 30177 - DNA, 1297 bp, Triticum aestivum
  Clone ID: PAT_TA_30177
agaaaaatatgtttatgccagagaaggttacttcagtctaagacattttgctcacattgaatacatctgtagaggcaagaatgtaatgttaccacatcaaattttggaagaatggaacacaagaagagccatattttcagaactgaatttatgtctgaactgaaaaaagagagcatgaacgtcatcctgtatacaagggggaaactgctatgccagagagatagcaccggctaggcgggaactctcccacacttccacaactggcatgtcttctctggtcacaaataagcggtctccgccgccttccatcatctctatcattccacgcttagaatcctcttccgtatccacatagctgcttctgaaactattttcattaattccttttctgtcaagtgtctcctttgctccccgttgctccggcaagttgcatgtgtcatctcgttgttcttccagtctggaccaaacctccaatccatccttccggctgacaaacacctgggacttatagcaatgcagaacactgccatgaccccctccactcccctttggtcctgatgacatgtacacccaagggtcgttatcgagccgcctcaggtctgcagctccaatatctcctgattttgagcacaccttgtagagcatcagctgcttcacgtccacgtctgcatctgaaaatggatctcccaaacctgctgcttcttccggatccccctggctcgcttgtctcccagaccacattcccagatcgaatgtcccacagcctcatgtatccagaatagccaaatgcgcccgagctcacagatgaagcaaacaccagcccaagctcctgcaggtgcactagtcgatccggcgaagatgacttagccgcactcccactttgccggccaatctcctgtatgggcttcagagttacagggtcaatcgccaggatgcagttctcccggtgtgggcactcgaatgtagcgaggatcggtgaatttgtgtcagtggcgtcagcaggaggacgggcggcgatggcgatgacctttgctttgaggacgcgtaggtcggtcgggtctgaccattcaacggaggcgacgtgccagccttcgaggaggtcgtacacatggagccccgggggagggagctggacccgacaacggcgaggctggagggcagcagcctgatgcgaggtggcgcggtggtggtgggtgcggaaggtggtgagacggtccagcgccggggagtagtaggtgagctggccggcgccgtgggcaaggcagagggagccgtcgtggtgcgcggcgagggcggt

SEQ ID NO: 30178 - DNA, 773 bp, Triticum aestivum
  unsure (1)..(773): unsure at all n locations
  Clone ID: PAT_TA_30178
cgtccgcggacgcgtgggttgcggcagaagcaccccgctgtccggcgaggcgagtctgcggcggcgagatggacggcggcggtgaggaagggaagcagcagccgcagctggtgctggcgcacaagctgttcctcctctcgcagccagacgtggacgacctcgccaaggtcggcctccgcgacgacgtcctcgccgcagtgaaatccgacgacatggcggcgctgtacgagtcgctggcggccgacggcatgctggagatggacgcggcgctgctcgcggagatgcgcggccggatcgaggaggagaccaagaagttcgacgagaagatcgcggatgctgaagagaatttgggtgagagcgaagtgcgtgaagcccatctagccaaatccttatacttcataagggttggcgagaaagaaaaagcgctggagcagcttaaagttactgaaggcaaaactgtagctgtggggcagaagatggaccttgttttctacactttacagattggccttttccatatggactttgatctcatctcaaagtccgttgacaaggccaaaatcttgtttgaagagggtggtgattgggagaggaagaacagattgaaagtgtacgaaggcttgtactgcatggccactagaaatttcaagaaggctactagcttatttttggattctgtttcaactttcacaacttatgangtgttcccctatgatacgttcatcttttacacagtccttanncagtgtatcacattggaccgcgtatctctg

SEQ ID NO: 30179 - DNA, 1573 bp, Triticum aestivum
  Clone ID: PAT_TA_30179
cccacgcgtccgcccacgcgtcgggagaaactcccgacgccgtgcgatccaagcgaaccaaccggacggaagtgcccccaacccaaacgagcggcgacgagatggacggcggcggtggcggcggaagcacaagcggcgacgacgggaagcaggagaagcacctggtgcttgcccacaagctcttcctgctctcccaccccgatgttgacgacctctcgaaggtcgacctccgctccgacgtcctctccgccgtcaaatccgatgacatggcgccgctgttcgagtcgctggccgccgcgggcgtgctggagccggatgccgtgctgctctccgagatgcgcgcccggatcgacgaggagatccgcaagctcgatgagaaaattgccgatgctgaagagaatttgggcgagagtgaagtgcgtgaagcccatcttgccaagtccttgtactttgtaaaggttggcgagaaggaaaaagcactggaacaacttaaagttactgaaggaaaaactgtagccattggccagaagatggatcttgtgttctacactttgcaaattggccttttctacatggactttgatctcatctcaaaatccattgataaggcaaagaagttgtttgaggagggaggtgactgggagagaaagaacagattgaaagtgtatgaaggcttatactgcatggcaaccagaaacttcaagaaagctaccagcctgtttttggactccatctcaactttcacaacctatgagttgtttccatatgacactttcatcttctatacagtcctcacaagtatcatctcattggatcgtgtatctctaaaacaaaaggtggtggatgcacctgaaatccttgcagtgattagcaaagtaccacacctctcggagtttctcaactctctgtacaattgccagtacaagtcattttttgtggcattctctggcttgacggagcagatcaagttagaccgatacttgcaaccgcatttccgctacttcatgcgtgaagtgcgcactgttgtctactcacagttcctcgagtcatacaagagtgtgacgatggaagcaatggctgcctcatttggcgtgactgttgatttcatagaccaggaattgtcacgctttattgctgctgggaaacttcactgcaagattgataaggttgctggtgtcctggagacgaaccgacctgatgcacgtaatgccttctaccagtcgaccatcaagcagggagacttcctgctgaatcgcatacagaagctgtcgcgagtcattgacctgtaggctttctttgtgttggaggtttggagcagctccttggcacaaccctaccctactcaagcttcccttgcaagactttgctttggctcctgtggagtactggcagtattgcattttgcgtttcagatcggtcaaaaggaaaggggtagtttttttttttcaatctgaggatttgacttgtaacctaactatatggatcgagggaattgcagaccattgtttctagatggttgtttccacgatgaattcatccattttttataaaaattgtgtgaccagcgttttac

SEQ ID NO: 30180 - DNA, 1578 bp, Triticum aestivum
  Clone ID: PAT_TA_30180
ctatccgactccactcccccgcctcgcgtcgccgcccggcccaccccaaccctccacccccaactctccaagtccaaccccacgaccatggcgaccaagcagagcctcctcgccgtcgcagccgtttgtctccgtcctcctcctccgcgcgcctacgccgtcaccgatgagcgagtactgcaataagggcaaaaactacccggtgaaggtgagcggcgtggagatcgtacctgatccggtcggagcgcggcgtgccggccaccttcaagatctccgctacaactgcataaaaacatcaccggaggggaacctggattattgatgttaaatattgggattttcaatgtttactctgaaacggtatgacatcctgtacgaacgagcccaatgcccggcaacttcctgatttccgaatctatctcactctgcaaaccttaccatcaatcactcccaccaggttcttacaccattcatgatgaagatgcttggtagaagcagcgatagaggaattgaggctgcatcatccttcgggtttcatgcattggcttccgttgcgccgggttgcctcgaggcttgaaggcatgcacggggttgcattgcgcaactacaccatctatgtgggattgtaactcctagaaacctctttatcctagtatacgttttctgtgtaacactcgtgggtgccgcaacactttgtgttccgattaaagaagtttttatcaaggaagttgaacaatctacaaataaaatgaaaatctgagaattaattataatgagacatggaaccaatgttagtttctggagaagatccgcctagggggctcataaataactaagtaaaaaggtctagtaggcactataaattcttgctgtgattagcaaaacaacacacatctcagagtttctcctctctctgtgcaattgccaatccaagtcattttttgttgcattcactgccttgacttaacagatcaagttagaccgttatcttcaacctcatttccagctactacatggaggggaaatgcgcactgttgtctactcacagtttttggagtcatacaatacgtgtgacgatggaagctatggcttctgcatttgtgtgtgactgttgatttcataagacgcgaggaactttctcgctttattgcagctgggaagcttcactgcaagattgacaaggtcgctagagtgttctggagacaaaccggcctcgatgaaaggaatgctttctaccagtcggccatcaagcaaggggacttcttgctaaaccgcatcccagaagctatccccaagtcattgctctgtaaaagttgctgttcttgttggatagctctggccgctcagcaaaggttgtgcccggttgtgggacctatttcagctagcctcctagagtatatgaccagtgcctggctttgttgagcgtgtggaggaggaagtcttgtatgaattactatgaactcatatcccagaagatcaggctgaaggatgtttcttctgtgatgaacctgtttattcattccaagccttatcatctgtgctttaattgtaaatatatttgcttggcaaacaaaaaaa

SEQ ID NO: 30181 - DNA, 1056 bp, Triticum aestivum
  Clone ID: PAT_TA_30181
gaggagaaatttcggataataatctgttgggagcccacagcacaatcatacttctcattttttttttagcgagccaaaggcccaaagtaagaacacattcatctttatatcttgttctgtggtcacttacccagaagtacctgggctttttcctcacacaatcacactattatttcaggatgtctaatggatcaaccaccataaaatttgatccattcacccaacgaatgggcatggctataatatcaaagaactgtgacagaataaaccaattagccgatttcaaggtgctttgtgcataagctcaacaacacaacatgccccttctcctgaccaaagttgaatcgacaaatcaagcaggtgttgcttccttgctgctatctgctgcattgacacctttgaagttcaatattccagaaaggccccggcctttggcgaggcgctcaagttcagccagcttcagcttgagatcttctaaatctttagctaaaatctcttccttttgtctcagttcctcaagttcctgtttacgagcttcctcctttctagcctctgacctagcacttctttgcacctcgaaaattaaagcagcgacagcaaccgaaaagatgaagccttctccaatgagatctgtagcagcttgtactgccttctcctcatctaaaggtctgatagccacattagtagcatgcccataaatgcgcctttgtatccttgtagtgatacgatggtttgtctgggcgatgctgatgatgaagtcgcgaaacttggggtggacggcggcctggctcttgaggcggttggcgataggcttggacagcgtccgcagcagcagcgtccccagcttcatcaccggcagcgcggccatggcggcggcggcggcggcggtccttggcctcctcctcctccgctattcctcctccccgaatgttgggcgtgggcgatcaacggggatgagagggattcggttcgactcgggactcagtgagattcgattcgggactcagggtcgattcgtgtcgacgtgagaaacggaagccggcggaacggggggaa

SEQ ID NO: 30182 - DNA, 513 bp, Triticum aestivum
  Clone ID: PAT_TA_30182
aaattggatttcgaaggtccttttttttcagaatcctctattttagttcttccacccatgcaatagagagggaatgggaaaagaagggttacttttattttcatttttcccttaaaagatagactttgaaataggagtcttggaataatgctgaattcaaaggtttatttctttctatagtataagaaagaaataaaatttatttctatttctatagtataagaaaaacaaatagtataagaaaaacaaatcgaatcaaattcatggatttaccacgacctcggttgtgactccatagataaaaatgggaaatttctctcttcgagaccattgaaaaagggcgttgaacgagaaagaaatcgtccacagatgataaaactatcatatgccttggaaagtgatatgaggtgctcggaaatggttgaagtaattgaataggaggatcactatgactatagcccttggtagaattcctaaagaagaaaatgatctatttgatactatggatgactg

SEQ ID NO: 30183 - DNA, 601 bp, Triticum aestivum
  unsure (1)..(601): unsure at all n locations
  Clone ID: PAT_TA_30183
ttttnntttttntnnntaggagatagatgatacttagttacgtctcatttagataggagctaggcacacccggaaagaagagacaaatacaggaaaaaaaaggagatacatgtgattccatgaacactctcatgggccacgcattttctttgctttaaagaaagaaaacattttccttcattcgaacccaaggataacgtcgcggtgaacctggaactttatcagacatacgaacaaaagtaattcaaaccatgcgaagaataagttcataattgtcgccatccaaccacctaaatatatcatgatatcgtctagcactccttcgtgcacatgcagctcctcttcaagccggagcacttgccaccggtgaacccctccgcattgcacacaccggcgcagtttgcggacacgaagcacagcccgttgaaccgctcgctctctgtctcacactctcgtgcctgcgctggcaccacctcggtggcgacgacgagcaggaggaggatggctacggccgggaaaagcttgtgtgatgactccattcttccttatttgtatctgctaaaacgcaccctgtaaaatgtacacttatctgggattgtac

SEQ ID NO: 30184 - DNA, 1084 bp, Triticum aestivum
  Clone ID: PAT_TA_30184
tttttttttagtacagtatatataacatgaatcatcttaagaaaatatactcgtagttcaccagggcataagttacggataacacccagagcacaagaaaaatgcaatcgctacatgaaggctgcttgttctgtgccattgaagtaggatcccgtcggcccttcctttggcatgagtgccagcatcacagggcctctcgcgccttcctccacggtcagaaccccggtgtggaaattgatgtctgtcttaacatagccaggatctaaacagttgaggcgcatagaggtgtgcttcttggcgagaattcttgtgtaagcattgatcagggccttggacactttgtaggccgagaaccctccaactggccatccacggtgatccagccggccattcttgaagtccttgagaaacagccccgacagttcgtccagcctctccgcggataggttgtcgatgtcgtcaagctcgtgtttaagttcttctccgctgaaataccttagtaacccataggaagaggagacgttaacaacccttgcatcagaggaggatagaagcagaggaagcagcgcctccgtcacatttttggtgccgtggtagtttgttcttaggcattcttctgcctcctcgaaaggctctgccgtcctctggttgaaccactcgagcctctccgctgcactcatgctcgtacgcacttggtgaagagctgcggggtctccgacgtccattctcaccccggagactcccgcgttattcaccagtatgtctagcctgccaaacctatccctgaggaagtccgccagacgagcggcgctggacggctcgccgacgtccagctgacagaacacgacgtctgacagtccgagctcccggagcgcgtcgaccgcggcggcgcccctcttctcgtccctggccgtcaggacgaccgtggcgctgccggacgcgagctgcctgcacacctccagcccgatccctctgttggcccctgtcaccagggcgacccttctgcaagaggagcctccttccatggcgtggcctcaggaagagcttccggacgcgtgggcggacgcgtgggcggacgcgtggg

SEQ ID NO: 30185 - DNA, 730 bp, Triticum aestivum
  unsure (1)..(730): unsure at all n locations
  Clone ID: PAT_TA_30185
acatacatacatgacatgtncattnaaattgagatatactgcagataacacattacatgcatgggtggcaatcatatgggttctgctttgaatcacacgattcagacagttgtgaacattggtgatcatgattgtgtggtaactgtatataccgattacgaaccaggaaaagaaactaacggtagctcaaagttctttcagaaaaacataaaggtacaaagtggcagttatatttccaccatcactcctatttgtgacttcctacaagaaatgagaacgaaaatgatattacagcctcatgtcccttccttgtttggctgttatattcgacatgttccttcccatcagatgtcgatctctatatttccgctttgcaaatgatcccaatttaaagcttgatatcccttggaatcttcacattacactgcaacctacaaagcttaaataaggccactaacgttcagagcatagcttaaagaattgtgcaattagctcatgaaagccccctgatgtaacatttttacctgcttggtgatgcatggtggtctactatgcgcaataaaatacaacaagtaaaccagataatgatcatattaagtactacatcatcaataggctgatcatgtttgcactgccaattactacagacttacacacgctcccttcaaatttcaagaactgcttagccaacaattccaagttcaagcatgaagtagtcaaaatgaaataa

SEQ ID NO: 30186 - DNA, 681 bp, Triticum aestivum
  Clone ID: PAT_TA_30186
actcaacatcatttggtgtgctctgtttttcttttgccgccgctgccgctgctgctgcctgcctttgtcgagcctcagcagcagctctttccaccgcaagctcgctcagctctcttccttgcttcttgctgaactctctccgcagcagctctttctgctgcagccctccccctagcagcaggcctctccctgtccctggcttcagcagcagccctctccctttcttctgcagcagccctctccctttcctctgcagcagcccttgcaaccctatctttagcctcagctgcagccctctcacgggcttcctgatgagccctctgcacagcagcacgctgtgagcgttggcgggcatccctttcagcttttgcatgagcttcagcagctgctctctcccgtgcctccttcgtagccctctcaacagcttgtttctctctttgctgttccaataccctctccttttcaactcttcgctgttcctcccttagtctcatttctcgcgcatgttccaatctttcctggctttctctctcttcacgagctgatgaatttgaatcaaactcttcgtcatcatcaaaagcatttttatcataataagcaggcatctgatgctttcccatggcaacaccttctgattcatctactgaagaatcatctgcttgctcgggcgtatctttgtac

SEQ ID NO: 30187 - DNA, 1335 bp, Triticum aestivum
  Clone ID: PAT_TA_30187
ttttttttttgcttcctgtttgagatcaagtgcccagaaaccattcgacattatcattaagaccagacgacaacccaagtagccaaatacagatacttgcagtacatgaaaccaactacagaactataaggtacatgatgaagttgcaactggaaaagtacatagttggcaatagaaacaacataaatacttcaagaaagttccttctgcaaatactgccacaaaggtatctgattcgaaagcatctgacagtaaaagtcaacagcccttctgcaatacttcggcaccaacacaggttcaaaatccatccgaatgcaaaaccacacgaacgaaccacgaccagcagatgccaaactagtgctgtcaatagccaccctgaaaaccagtgccaccaatctgggtattggacacttggccctgcccagcagccccagcctgataaccaccagcagcaccagtggccgctgcagttgtgcccgtttgggaagctgcttggccgacctgaaacccagcagaagtggggaacccaggtgtcccctgaaaaccaggaggccctccttgatatgctgcagctccctgaagacctgctgcatttggaaaattgacgccagcagccccaaacccttgtgtcccaaagccctgagctccaaaaccaggaatgccagattgccccccggcgcccaatgcagcagcagcaaaagctggatttagcgatgcaagcatggctgggttctgcatcgcggctgccatcatggccagcattgcagtattgggctgcgcaaacgcttgctgctgtgcacccatccccagcaaggcagcttgctgggcgaaccccatgtcatgaacagcagcggcaccatacgctgatggatcatatggattaatggcggcaatagagggcatggtcatttgtgtagaagcagcggtggcattggcattgttagcactcgagttggacccggatgagccctttgtcctccctgccgtggccttctgcacattgagcatcttgccatcaaaattcctcataggctcctccagggcgcggcgagcactgtccacagacttgtaaacaaacagcgcaaaccccttgggcttgccggtgctcttgtcaaagcccagcggcccctcttcaatctcaccaaactgcgagaagtactcatagaggcgatttacatcaacatcagcgtgcacgttgccaacaaagatcttgcgctgcatgttgtcaggcagcgaggaggaggaagcgggggcgttgttgttggtggtgcctgagctggcgttggcgttggagctagggttatgggactggaggccgggggtgcagggccccct

SEQ ID NO: 30188 - DNA, 660 bp, Triticum aestivum
  unsure (1)..(660): unsure at all n locations
  Clone ID: PAT_TA_30188
tttttttgctcatttagattactcgcggccgcggcgacctgtgtcattcatgacatgcaatgaccatattcgcaactcaacaggtacggaccgagctgccagtgagcaatctaattggcttcccttctaaggaatgtcccacagcaaagccagcaaagccggcaccggctcccaagaggggaaacgccacatgcacgccgatgttgcgaagtagttatgccaaaactggtcccagcgtgttcaaacatgccgcattcacaactgaaaaaactctcttcatcatccacttcgattgtgaactcaaccttactccatttctctcttgctgcagcatctacatgtgttgatctgtaaaccttccttggtacaatctcatccaatacatgtgcaccacacttatacagctcttcaccgaacttctcaaacatagctctcgtgtacaccttgctagcatgcctctctagtggcaggttatttctaagcgacacaccactcaacaatgttctcttctcctggaagctctgctccgactccctgttaaattggagttgcggccgttgtttcaaaaacaggtgcataggacaccctggcggcatgtaacctttcaacatgtgatttgcactctcactccgttgngtgctagtcatttttcgcacaaaa

SEQ ID NO: 30189 - DNA, 1244 bp, Triticum aestivum
  unsure (1)..(1244): unsure at all n locations
  Clone ID: PAT_TA_30189
cccacgcgtccgcccacgcgtccggcaaagacgcccccaccaaaaggccaaaaccaaaacacgaagctcgagccctagaaccgcgacgggaaccaatggactcagggggcggaggaggggggtcgcacaaggccgcgtcgggctccgcgccgtcggcggcggcggcggcgccgaaccccacggcgatgctctcggccctgatgggcaagcgcgccaagctccaggaggaggtccgctccatcgagcggcaggtttatgatatggagaccacctacctacaagaatctaatcaattcggaagcgtgctgaagggttttgaatcattcttgtcatcgtcaaaaaacactgctaacctcaagcggtcaaggaagtttcaggttgatgagagactattctctctgtcatcggttacttctccagcggttgaagaacaactggctgcgcgagatgaggcaagagaatatgcaggtcgttcaaagggcgcaagcactccagctaatggccaagggaaaccaaagaagggagggcgtcctggagggagagacggcaagagaatacgcccatcgaacgcgccagacttggacgatgaagatgactactaaccctcgcatgtttcaggcatcttttaactttgtgtccgcgtctagttccgtctttgtgtcaacctttaggctttacccttgttctcttgcaaatccaaaccagcgttgaggaatctcctgtattatgtcccagctcatctgcttgcttgagcgtgcttcttttcctgccctttgcctgtttcccccttcgcttcatattccgtaccagcgcggtggtttctcctgtattattggttcccagctcatctgcttgcttgggcgtgcgtctttgccttgccttttcgtcgttttgccctttgtcacatntaangtagcaancaagttaattancatggtgaaaagttgtgtggacaataatccaatttctaatanacaaacttgtggnaaacccccgtttggtggnnggaaataannttggcccngttccccgtngggaaattcctgggnccngggtcaattttttaagaagttggccggatnaatcctttttanaagtgggtcccgggtnaantncgtaaatnggaaacagggcgggaaccctatgggcttttaaaangnaacaaantaacgngggggggggcccgggttnaaatntcnccnaaagggtcccantaatggggncaaaggcgcngttttaaaggg

SEQ ID NO: 30190 - DNA, 522 bp, Triticum aestivum
  Clone ID: PAT_TA_30190
catttgttcatgcgccgcagtttctgggtgaagatgaatgccaatccagccgcgcccatcttgctcctcctgctccttgttggatgccacgccttctccgcacacggtgatgacgccgagggatcgggcggcggtcgccgtgagctgggcgacggcggcggcagcggcagcaaggctcaggtcgccgggttgtgcgtcgacagcccgtgcgacgcggaccccaaccggacgtgcttctgctgcacgaggctggccaacgagccctgctacgacacgctgaggcagtgcttcagcgtctgccccaactgtaacttccccgtctgcccgccggcggcggcctcggcgggccggcgtactcggttcgtgttagctccggcgtcggcgtgatctgtgtgccggcgatggttagctagtaatgattgatgtcacgaggcatccagaatgcagaggatgggaaatcatatcatgtctaaccgtgtaagcgtggagttaattataaatcgacagcgtcttcttttcgtg

SEQ ID NO: 30191 - DNA, 748 bp, Triticum aestivum
  Clone ID: PAT_TA_30191
cccagccatcgcacccacctgcagcggccagctcaggagcgggcaagaagagaagacatttattttcttcccccgcggggagatcgatcacagccgggcagccatgggcgaggaggccccggccgcggtcaccgcggcggcgacgacgtcgccggcgccccacctgctcctcatatgcttcccgggccagggccacgtcaaccccatgctccgcctcgccaagcgcttcgcggccaagggcctcctcgtcaccttctcctccacctcctacgttggaggcaagatcacggcctcctccggggtggaggccggcggcgacggcgtgccgctcggccgcggaaggatccggttcgagttcttggacgacgatttcgacgggaatgacctcgacgacctgatgaggcacctggagacgaccggccccgtggtgttcgcggagctgctgaggcgccaggaggaggcgggccggccggtgacgtgcatcgtcgggaacccgttcctcccgtgggcgatcgacgtcgcccacgatgccggcatccccacggcggtgctgtgggtgcagtcgtgcgccgtgttctcgctctactaccaccacgtgcacgggctcgtggagttcccgcccgaggacgacctcgacgcccgggtcaacctcccgggcctcccgccgctgtccgtcgccgacgtgccgtcgttcctgctgccgtccaacccctacaagctcctcaccgacgcgatactggaagcagtt

SEQ ID NO: 30192 - DNA, 1130 bp, Triticum aestivum
  unsure (1)..(1130): unsure at all n locations
  Clone ID: PAT_TA_30192
ggtcttcagatccagcgagagaaatccgcaatccaccaaaacctaaccctaaccaccagcagaggaggggagaggcggagcagatccagccatgttcgtcgagaagatgttcgccgtcccgatggccgccggctacgagggtttccccttcatcgcgacacaggcggagaaggagatggcggaggcgttcgccggcaaggccagggcggagcggcagccgtacgccctcaaggccaaggcggagggggcgaggttcgttgtcaaggcggggtgtggctctaagaggaaggcggaggaggaccgtgaggaggacgcggcgttcaccttcaaggccaagtcagaggaggaggcggcgttcaccttcaaggccaagtcggaggaggaggcggcgttcaccttgaaggctaagtcggaggaggaggcggtgttcaccgtgaaggccaaggcggaggaggaggaggaggaggaggaggatgactgcgactcggtcgaagaggaggggttcatggtcaggcttatcgcagactacaacgcccatgccgacaagctcagggctgaccatccagggatgaagtacaaggactacagcactgaggaatacgcctacatgcgcctccagccggaggaggtggaggacgatgactgcaacaagatcgagaagctcagggctgaatatgcctacttgttctgcaagctggaggaagagggttcccatggtgttgatgggcttgttcgggcgtgagattgttcctcttgtaatttgactgactgggatgaagaggtttaccaatgctatctatctacactagtagttgattgatccggaggattagtcatcaacctatctgtgtgtgtggtcttagtattataactttaaaggcgcccttgaaccaatggcaatggcatgtatctactattagcattatctcattttaactctgctattcctctnctcannccttaantnctgnctattcccccaaattggtccngtgaaagtttgnattttaacctgaagcctcccccntnccctgaanggaattngttanaaatgggnanggtggttgggtttnanaatnggtaangngttgntttggcccgncttncttgcaaaacaatttcngatttta

SEQ ID NO: 30193 - DNA, 694 bp, Triticum aestivum
  Clone ID: PAT_TA_30193
ggttggcttcttttgtagccccaaagccgcgccggcggcggcgtcggaagggcgacgggtgcgggagaggcgtgggaaacggctttgtgtatctcaagtcgaggaaagccctcttttgtatctcaaatcaatggatatgttactataagctctggggaaatggaaatgggtgacaaggtcatccctctcttcctactgaacatgccgggttaatccctttttatttactgcacatgaccggtttatcatcctgcaatttgttcatcatgattattttatcctccaatacttgttacctcgagggatgctccattttcttccctgtgtttgccggcgttctgcttcttctgttcccaaagtatatagaacgctcttggaatgatgtagtgagtagaaaaagatgcccgcttgattgatttgttggttcccccactgtttcaacggggttcctggtttatttaatcctagtaaacagctttcgtggaagattgtatttcattgagctcacttgtgatctaaggctttctcgtggcacttacaagcgggtatttgcgtgttggtaattattgatcgcaagaataaacattgttcaaatatcaagtgttgttacatcgataaaactcggatgatatgttagatcaatgtagtcggcactcaacatgtatcatgcttctgcttctgtgtagtttgacat

SEQ ID NO: 30194 - DNA, 1200 bp, Triticum aestivum
  Clone ID: PAT_TA_30194
gcccggcgacagccgcacccggagcgcgcggcggtcgccaggccggtcgacgacgccagcgagccggtgctgtccgtcccatgtccaccgctggggagcgcggcgttcgcccgggcgttcgaggccgccaaggcgcaggagctgtaccggtgcttcgaccctgtctggaagtacacgaggctcgtcaacgtcacgtcggagacggccaggaagcggtcggtgtgcgccatcaacgacttcgtgcacgccgtcatccacaaggaggtcgagcagatgggcagatatgaacacgaatacgccatgaaggagaacatactgtcgtgattcctgcctggcgacggagaaagaccggggctgctttcatgacaagtccaccccgggacatgagaccaaagcttcgtgatcgcggtccccgacacgttcggcggggcaccctgtcgtgggttcctcatacgtggctgtgcgagcaagcagcgcatctgcgtacaaaatgacgacggaggcaggcggcactacctccacgcggcactcacggagaccctcccaaggtatcaggcggtgcctgacgaaagacgccatcagcaacatgccgtacctccacgccgcgctgacggagaccctccggctgtacccggcggtgcccatcgatgtcaagtactgcttttctgatgacacgctgccggacggccacgccgtgaggaaaggggacatggtgaactaccagccgtacccgatgggcaggatgaagttcctgtggggcgacgacgccgaggagttcaggccggatcggtggctcgacggcgacggcgtgttcgtcccggagagcccctacaagttcacggcattccaggcggggcctcggatctgcctggggaaggagtttgcgtacaggcagatgaagatatttgcggctgttcttctctgcctctacaggtttgagatgtgggagcgcgactcgatgatggggtaccgcccgatgctcacgcttaaaatggatggcccgctccgtgttcgtgtgtcgccccggcgagcaagcgggtagcgtgcttggtataagactagaagcagacgcgcgctttgctgcaccgttttacttgtaaatggggacacaatgttgactattacatgcaaccaagatgtctttaactttcaacaacaaatattctacctgaacaattctacaaaaaaaaaaaaaaaaaa

SEQ ID NO: 30195 - DNA, 776 bp, Triticum aestivum
  Clone ID: PAT_TA_30195
cgcccacgcgtccggaaaaagaaagggatcaaccttgccatgaccccatatttctgtaggctaatatcccttatttgcactatcctacaccgaatacttatagggttatgtgcctttgccatgcagcacatgtcaatggcagttcaggaagagatgacatcacaagtgagctaaattgataagcccactagcagaaaaatgtggtttgagcctgctccaacccctcctctgatgtggtgtggtgggaggaggaagaagagcatgcatgctctctgtctacatccagcatccacacggctagatcgacgggtctaaactatggggatccgcggcacagtaggagaggtgacgccggccggcagcgcctcaccgccagctattgtttggcgccggcaaggagaagggcgcttaggatctgcttcgctgtgcatggctgttgaagttcagcatcgccatgatgtgtatggtttctctattttcctcatattgccctattcccaattttacaaactgctatgtgacgcacaatggccacgccacgcactggtgagattcaaggtgcagttgagcaagagtcagttcgaggtgaggtgtctcacgtcgatctcctgctgctcaccagcaaggctcgctgacgagcggccagatccacacgaggtggatgtcacacacacggccctctcccctccatcctttctctttcctacaactattatgtctttgtaccttgttatattgctctttcatccatggtgataaagatgttaactcagttt

SEQ ID NO: 30196 - DNA, 761 bp, Triticum aestivum
  Clone ID: PAT_TA_30196
atctgagctagctgatttgcagtacaccgagtcggttgatggtgatactgaaactcttagtgctcctctaccttcatctgctgcaacagatatttgaagcaggttaaatgataaagctgcacgtgtttcagtagaatggtcaactgctgaataacctcacaagagcatctaaaagcttgcaactggagctggttctgttgtgctttttgtaaagcttctaatactggagaagtgcagattggagattgttcttgttagttttgtgtgctcagaggacgacggaaagaagtccaatacatggagtttttgtacaaagtaatacgggagttctcaaaatcatcatcttgaggtgaaaaatcggaatcgcctctgatagagttgcttgcgcttggagtggaaatgccctagttcttgccttttgccatcaagaatctaggatttgatgaaagacaaggctatctttcattgttttgtctctctttgttttttagtttgggttgaagttgtatagttctgtatatctgggtaaatatactgccagcagtagcccatgtataatatgtcatagtgtgatattctttaggcagtggtactttgcatgagtgcctcatttggtgccttttttttgtatgagttgaagggtattaaagcattgcaattttacaacagaagtttctgttttgattttggtaatgagtaaaagcgagagattcttcctgtgcacttcaagttggtacatctaatatattacttctagcacc

SEQ ID NO: 30197 - DNA, 449 bp, Triticum aestivum
  Clone ID: PAT_TA_30197
gataaaaaaaaatctcaattgggcataactgcacaagctctggacaaacattattctgccagtttagaataaatacacaacaaactgtaactatgtcctgacgatactgcaagtggtcgttaaatcgattacatatggacttgaagaacaaagaatatacatatagatagatatagaacacaatcttcatgagaaaggggtggacaccagttgcatcttctttacatagcaaaaaaagtggagtgctgccattgtttgatgaatgaatgataatctatcgcacgcctgcttccatcaagggcgtgacgacttgtgggcacggggccggttcgtgaacacccggccattgcttctcacaaagtgtgtgatcccgatacaaagaccggcccagagaagtgacagcagtaaatgacgagcgtcatgccgagcatgtctcagtgacatcatca

SEQ ID NO: 30198 - DNA, 1312 bp, Triticum aestivum
  Clone ID: PAT_TA_30198
ccccatacttgcgattgacgttctctaagttaaatttttacagaaacaacaaatctcaattggcataactgaaaagctctgcacaacatcacttcgccactttggcataaatacaccggaaagccgtatctctatataccttttatcgcgggaagctgtaactatgtcctggtactggaaaatgtgattgttgcaactagcaacagctgtttatttactggtcaaaagatcgattatgcatacggacttgaagaacaaagaatatagataggataatagaacacaatcttcaggaagaaagggatggacacaaattacatctctatcatagaaaaaagtggagtactgccattgtttgatgaacgtaatgataatctatcaccccgcctgctttcaatcaagggtgtgacaaattgagggcacgggaccggtgcgtgagtaccaggccatggcttcccaccaagggttttatccggatgcacagcctagccaagaaatgtgacaacattaagtcactagcaacgtgccggggcatctcgctgtgtactaatcgtgaacttgttagagccggaaaccaatgcaaaagcaaggcgatcggacgcattgctctctgcaaatcctgctcctgttggaggtgccatgtctcgactaacagatgtgatgtaacgtccttgaagaagatccatggcatcctgcttcgtcccatctgcgaagttggcctcgtaggatggatcattggtgattgtatcgttaccaccaaaaactcctagttgttggagctggctctccagaattcttcttgcaatcatgctctgagttacattggtacgatctaagcaatcaatacaattatttctgacagtgccgagctgctcctgaattttctcgcctttctcattcaacaggaagtacttgtgtttcttcaggtaatcctcaatttgctcatacaactgtgagaggcgctcaaagtgaacatggccacaaatacgatggaagtcaaaatgcacatatatcttcactgagaattggttcgatagattttgcatatctttcatggagtcggccttcaccaccttgtgtattgacaagatcaacagccaagacagctccatatttcttttgtaagtctttgaagtgcctctcaagtacactaggcgcttcctcttgtctaacaaggtcgaagctaggtttgtatgtcaaatcaacaatctgctcccacaagaatggcatagaacctcgaacttgtacataggatgctgtatacccttttgattgcattatctgctctgattcaacgaagtttgcagcataa

SEQ ID NO: 30199 - DNA, 1524 bp, Triticum aestivum
  Clone ID: PAT_TA_30199
ttttttttttttttttttttttttttttttagcagaatttgcctcgttgtttatcacatgtgtacagtctcgtgaccagtgagcccgggcaagtgcccggggtggccgggcgctggctccgccactgcccctagtggagtactagtaatttccacaaggtttacatttcaaaacagctgtcgcccccacaagccatacattgatctctactttaaataagcttagtagcagtggattattcgttgcattattggaagcgatgtgtagcaggaggaggtccgtcgcctacttcgcccacggcagccaccggctgctcccagcggacgctgatgacgacggcgagttcacgtgcgacggctgtctggttgccggcgccgggccccggtacctgtgcggccaccccggctgtggcttcaagctccacgaggtatgcgcgcgcagcttccccaggacgctcaagtccatcgtccactcccagcacaggctgaaacagcgcgagagcgccgccgccgccaccgcggaccacggcaccggcggcggcaacgtcaggtgcgaggtgtgcggggaggacgtgaagggcgcgtgctacggctgcagcaccggtgcgtgcgcctccgcgacagtcgtcgtgcacccgctctgcgtccgcctgccgcccgtggcgcggggtccggccgtggcgcacccctgcggccacgacgcgtggctcgtcaagaagtcggatggcggcgtggcgtccatgtgcgcggcgtcgacgtggcgtggaggtaccggtgcgggacgtgccgggtggacgtgcacccgcggtgcttcgtgccgcctgcggaccagtgccgcggcggcgaggcgtcggccatctccatggggaagcgctgctgccttgtgtttgggcaggacttgacgagctgcctcaacatcagctactactaccgtggtgctgggtagtactatagtcaaagaaaaaacaaccatgtttcaaacaaaaacagcatgatgttgctagactcctctattccacgttactacatatagcaaatggcatggcatttctaataagaacaatccggtcatgcaaatggaagaagaaggtaccatgtctctttctattttcctgaactggaactagcggccgcttccgctcgcagtctcgccatcactgcaacgacaacaacctcgccgaggacgcgcgcagaagcatcaatcctccgggcgcagcggagaccacagccacgaaacgccgggccgagggccctcggcctggctctccgcagcgcagccgcatcacgcggtggaggtggccccgcgcccggcagcccggcctccgcgccgtgcccccgcgctcctcccgtggctgcgctgcgctcggctgcctcccggccaccgcgccgagtcccacgcccggccgtgcgccgcgctacgctggccgccctgcggcccggcctccgcccggccacgcgccctcttgcacgcagccaagaccgcccgactgtggccgccgccctccaaccgccggcgtcgtgtagg

SEQ ID NO: 30200 - DNA, 671 bp, Triticum aestivum
  Clone ID: PAT_TA_30200
gaaatccgaacacatactcctccagaatgttcccttctacctctgccacggcctcccgtctcctcgtccccgccgcctctcgccgcgccatggccgctgccgcctccgccaacccgccgcccccgcagcaatcgccccccaaggcggtgcgggtcgtggtgaagggccgcgtgcagggcgtcttcttccgcgactggacggtggagacggcccgcgcgctcgggctcgccggctgggtccgcaaccgccacgacggtaccgtggaggccctcctgtccggcgaacccgccagggtcgacgagatggtctcccggcgccttcccgtagggcctcccgccgccgccgtcaccgcggtgctgccttccccagccgatccgctcgacccttccgagggcttccaccgcaagccgaccgcctgacgacggctggttcttgtcattgacatgatcatcctcttcactgatgcttgaggactgccacaaaggatatgccactacttaagaatgtgccatcacagacgatttagaaaatccatcatatacatcttcccggtgacatggtttatgtcatcacaacctggacattttgtaataagataagagatgactgaaaggttcataatgtgaaatggtttgtgatttggtctttttatagacagttcgtgcttgagg

SEQ ID NO: 30201 - DNA, 674 bp, Triticum aestivum
  Clone ID: PAT_TA_30201
taaatttcatgacctggaatctactagtacggatgtttgttttgcatacgacggaggttatgagaggcctttacagcctgttcccggagactgtgggtatcacttgcatgctcattggctggtcctttctcatccaaccacgaataagatgctgaagataaccgcccctctgccgcatatcctacaaactcgagaggagcattgcgatccgcaagttgatacttgagctcataactttccatttgaaactatgtgcatccaatgagttgagcaatcagtaagagttcacaggccatgttctacgagcctgtggagatggaggctattggacgctaacgtacgcatatgaggtgttgagtgtatcttacagagtgtcagactgagtttttgcgtgtggcgcagcgtgggcaatacaggaagtggtattgatgagtttaaatggtcactggacactaacatttgtgttagatgatacgtagaacagagtaaacttttcaggtcactgcatctgaagatgcatgcacacggccaaaggatgtactagctgctttctgtgtttgtttgtgttgtatatatgaccgaaaccaattttgcacttattatgcaaatgtatgcatattttggctaagattatcatctgcaagcatgtagaaactaaataaaaaaaaaaaaaa

SEQ ID NO: 30202 - DNA, 874 bp, Triticum aestivum
  unsure (1)..(874): unsure at all n locations
  Clone ID: PAT_TA_30202
agtttctgttgctgtaatggaagaaagtcacaagaaaccatggaaggggaagtagctgttgctgtaatggaagaaaatcaaatggcggacctggtttggccatacttgaggttggtttatcagccgcccgaggaatctgcgcggcgtcgtcgccgcgaacagtactcgatattcaccattatggaggctagccgcctcatgattaggctttgaatcgtttacgagccctcatatgaggatcgcgcccaagtatgccagtgcacgtcacccactggtccgcatgatgctttttgctcgcaatatgcttgacgataaattttcctgcccggaagctatggtgccaagaagcatcctcgacatgattcggaaatcgcgctcggtatcacgcagcactggaatcactggagaacctccagtggaaagtatcggcatgtatgctgagagtgaactaggttgcactgctataccatcagcaatacccctggcaatcgccgctaaagaagacgaagacgctgcttatcacgacgatgcaatgggtggcgctgacacccttgctgatactgagagtatagcagcagggttgacgacagcggcatctccgcacgagcaaaacgaaattatgaattctcgcatcaatggttgggacaattacacaggatacatggatggtgtacgtgaggtaactcacactgaacccgaacataacagaatcatggaggcaaaggagaagaaaacttcagctacctgggtggtcgccaccgccgctgcataccacgcgacggggaaccgcggnctnctattcngttngacgccctatcagcccggcgggcttcgtttgagtcagccgacggggcgggcgcccatgcaggtcctc

SEQ ID NO: 30203 - DNA, 869 bp, Triticum aestivum
  Clone ID: PAT_TA_30203
cccacgcgtccgaccagacaccttcatctttgccatcctcctgcctatgcaaattgcactctccttcgttcgctcgctgtcctccctttcacctttcagcatatttgcagatgcatgcaatgtcctagcgatggccatagttatcaaagaggacatacggcttttcgaccatccatttgcagatagaagtgcttttaatgggctttgggcgatacctttctcttttggggttgcacttttctgctttgaagggttcagcatgactctggcactggaagcatcgatggcggaacggaaaaaattcaaatgggtgctttctcaagcacttgtatgtatcatgtttgtgtatgcgtgttttggagtgtgcggatacttggcttatggtgaagccaccaaggacatcgtaacacttaatcttcccaacagctggtcttcttctgcagttaagattggcctatgcattgcactagcattcacatttccggtcatgatgcacccgatccatgagattgttgaggcgagaatcagatcgagtcggtgctttcagaagttttcacaaaatgtcggtggccccaattggttagccttgcacgcaagccgcatcatggtggtgatcatccttgctgtggtggcctcgtacgtgcctgcatttggggccttcatcgccttcgtcgggagcacggtgtgtgctctgctcgctttcgtgctgcctaccgccttccatctcagcattgtggggtcttcgatgagcttgtggcgacgcctgctggactacggtttccttctctttggccttgtttttgttgtctatggaaccttcactgctctctagcttgtcacattgaccaagatcaaaatggccaagaact

SEQ ID NO: 30204 - DNA, 509 bp, Triticum aestivum
  Clone ID: PAT_TA_30204
gggtaaatctgatcttttatatgtccgcggacaagtctggacgtccgctttgagccccattttcattgcaaacaaccacatccccgtattgaccttcccaccttcaggcattttaacaagcatgttgtgtgcgacagcagagagcacacgacggacgtcatggcggccaactcaccgggcgtgctacccgcctagccagcgccggccggccctcctggccgtggcggcgagcgagcgccaggatgcagtgctccggacgtggcgctgctgggcgatcggcgcaaggtacgcgagccgagcgtcttgccggtgccatgccagtcgccgccttcacaagccttggaggtgggcacagagggtggggtggaggcgggcacagaggtcggcaaaggaagcgcgaggagaagagcccctccgcgtccttctccttcaccttcgccttcggcgccgccggcgacttcccgagattggcgcggacgcgtgggcggacgcgtgggcggacgcgtggg

SEQ ID NO: 30205 - DNA, 1154 bp, Triticum aestivum
  Clone ID: PAT_TA_30205
cggcccgagcatagcctgcggggcgggccctcataggagcccgtctctgccatacctggggggctgtctctctccttgcctccaggcccgcctcccacaatctcgctctgttgccctatctcgccgactcccggcctccgtgcgtcctgccccgcctgccactggccgggtctgcagtccttgctggccgggtcccggcctctctgggtccggccggggctgccattgcctgtgttcgcgagttctggcggtcggtcggctgtctcgctcctgccgtgtgcgggccccggctcagccgtgcccgcgctcctgccatgcccgtgctgtgtatggcatgcagtcaggggagtgatgctttttcacagtctgggctgtactcgaacccccaggatataggaccgcgttacgcgggggtgcttcttgggctggcgagcaccgccggcgtgcctccaggactttgggccacggctgccgcgggctcctcccggccggtcggcccctgcggccgcgcgtgccggggggctgggctccgctgcctagtagggacagtggtgtggaacgtcttttcgaccggagagaggatcctcgaataagccatgggacggacgctcctatgcgccgctatacgaaaataagctgatttttgctgatgtctgtctttttggcatacgcaagaagtaaaccagagcgagagataccctatgaaaaaactcgcgttttttagcaagagatacagtgactgcatttgatgttcgggctgcggaaagagtgaagatcacacaaaagagccgcacttgatgtttacacttggttaaattttagctgtcaaagtcaagatgcgaggcctggaccctacacttggaactggagataattcttgtacacaaagtaactgcaccaagggcacgccagattttgcagttgtttctttgtccaggcttctgccaagatcaccaccaatccacagctttttgttttaaaataattggcagttaagtcgtgtttcaccttgcctttgattaaggcgctacagctacttgcgtcattgctactattgtttcgtgtaagctgcataatgatattatatggtgatggtgtcaattttttttttgacatcatagtgccttgaagaacagtagatttaatcgacaaaa

SEQ ID NO: 30206 - DNA, 876 bp, Triticum aestivum
  Clone ID: PAT_TA_30206
cgggtccgtctcagcatgttcattctgtggtttgatgaggttactgaatgaaaacttggtgtgatgtttctctgtgatacatgcactagctatcagtgtgtggatttggtctctagataatgactgcctgtgccttttgatctttgtttttccagggaccgagatcatgacagagatcgggatcacgacagggactatggaagaggccgggaaagagatcgagacagagatagaggccgtgaaagagatagagagagggatagggaacgagaccgtcaccgcatccgagatgacgactacaaccgagatcgagaccgggatggcagggaaagggaacgccgggacagagaccgtggcaggcacaggagccgctcaaggagcagaagccgggatcggcgtgaaagagaccgtgaagtgggagagctccgtaagaggcgtggccgtggtagtgccagtcctcctcgagggcgtgccgaggatggtccgagggaggagcctaagaagaggagaaaggaaaagaaagagaagaagggcagcgggaacggtccagatcctaatgatccagagattatagagatgaacaagctgcgtgcatcgatagggttgggaccactgaagtagtggcacattgctgtaatgtattttgaagctccaagcttaaaaccaacaaaggattagctagcatttttcttttaacactgcaagcttgtcaaaataccctgtaatgtaactttggcggtttggcctgcttttctggctctaccttccgcggtcttttttgcatttttcttgagacacagtgaaggctgatgaaggaaagcatttgatttcaactgtattgtgttgacaaaatcgactagatatttctgttcacta

SEQ ID NO: 30207 - DNA, 772 bp, Triticum aestivum
  unsure (1)..(772): unsure at all n locations
  Clone ID: PAT_TA_30207
tcgacccacgcccacgcgtccgacaacacctcctcccccctcacgccaccgccgccgccgccgcgctcgctcgccggattcccccgcatttttttccggcccgagccctcctcgccccgtcccacagtctcgctgctgcggcaagctccttattccaaatttcgccacgacgagctgacatcggcgagtgaccccacccgcgggccatggcgtcgctggcttctctctccatctacaccgtgccggggcgcgcagtccgtgcggagtccgttcaagcccctcgccggcggcgtatggcggtggtgcgggcgaaggtgcgcgagatcttcatgcctgcgctgagctcgacgatgacggaaggcaagatcgtctcctggacgaccgccgagggagaccgcgtctccaagggcgaccccgtggtggtcgtagagtccgacaaggcagacatggatgtggagaccttccacgacggcatcatcgccgccgtcctcgtcccggccggtgggaccgcccccgtcggcgcccccatcgccctcctcgccgagtccgaggaggatgtcgccctcgcgcaggcgcgtgcccaggccctatccaaggccctgggcgaagaaacccctcctccccatgctgccgccacggctccacctaccgtggtacctgctccggcaccagtaaggtcgcaccgacgaatggcatcgctacgcctcatgcgaagaagctcgcgaagcagcacagaatggacatctncaatgttatcggcaccgggctaaac

SEQ ID NO: 30208 - DNA, 1130 bp, Triticum aestivum
  Clone ID: PAT_TA_30208
cccacgcgtccgatcttctcgaatttttggtgatacacaatgaacaacacatttgaatgggagacattgagggtgtgtttggttcaagaaccaagtggaatggaatttcatatttccattccacgggaatgggttggttccgttcctgtgtttggctatgggtattagatggaatggaatggttacgttctggtgtttggttccacagttggaatggagtaattttccgcaacaatatgaatagtttaactctttgtattttcaggaacataatattcaaattttgagaaaacatttgaattttatttgcaacacgcacagtttataaatacattcaagcatatatcaaacataaattcacactattttgtagtatttaacaagttacatatataggtagaaattccaacatacacatcaagcagaaataatgaaagactagatgttgctgtactaatgaagctctctgtgccggccggagcaggaataggtgcctggttggtggtgggacgagataaccagcagaagagaggggacaacatcggggaaaatgtgagagacgggaggcgttccgccaccgattcggaggtactagtgcgttccggatctaggaggaatatgccattcctgagaacgagtgagttccgattcctcgacccaaccaaacaggagaacgacctctagggacgagatgggcccgtttccacctggtgacacaaaccaaatacatcccgagtggacgaattcaacgattagtgagtttacaggtttgagagccgacggacgtggcggctgctgcggctggtggtgctctgtgtgtgcatggggtagcgcggtcctcctgctcgtcaagacactacaacacagcagcgtcgacctcggcggcaagtgcagccactggctgcactacggcgtgcaagaattctgtgtcaacgagatatcagcgttccgcttccaccccctcgagtaggcaatgatgaaggtgagtgtcggctcggtggggttggcggagggcgtttattctacgtgtacctgaactgcagcgacaagtctagagtttgggagtacaacgacatgatgaacatgaacatttgatagatatagtgttaagattgcatgtttatttgctg

SEQ ID NO: 30209 - DNA, 329 bp, Triticum aestivum
  Clone ID: PAT_TA_30209
ttcgcccgtcgacggggtgtgagtatcatccctaccttctccatttagcgcgcgaacgagacaatttgtggccatccgcgtgattggaatttcgatttgtaggctttcaatactactatatatgctacaaataacatttgtaggctttcaataatatttgtcttgcaacggggacataatatttctagtgattaaaacaacattgttgattctccacaaaaaagtgatcaaggcggtgacgcaaataagaagcacgcctcaatttaatagtaatcccacttcactacgctgtcaaaatggcccctccatacaagtaaaaacccgtcgtt

SEQ ID NO: 30210 - DNA, 627 bp, Triticum aestivum
  Clone ID: PAT_TA_30210
cgggtctttccggatgggcacgttcccctggatcgtcaactcagagatctacccgctgcggcaccgcggtgtgtgcggtggcgtggcggcgaccgcgaactgggtgtccaacctcgttccggcgcagtcgttcgtcacgctgacgggggccaacggccccgcgtggacgttcctcatcttcggttgcctgtccgtggcagcgctcgccttcgtgctcgtctgcgtgccggagaccaagggactccccatcgaggaggtggagaagatgctggagaagcgggaggtcaggctcaagttctgggcaccgcgtggccgcggcagcaagaacgacggggtgtgagtgtcatccctaccttctccatttagcgcgcgaacgagacaatctgtggccatccttgtaattggaatttctatttgtaggctttgcttcctataacatttgttggctttcaataatatttaccgtcactaatattacaaatgccactcgcacgcgtccaaaaaaacctgtccgccgtcgcgccgtctctgtacgctgccgcgggacctgcatatctctctattcctaatggacgagttgattgaatagtcataccattttcgtctaaaaaaaaaaaaaaaaaaaaa

SEQ ID NO: 30211 - DNA, 1262 bp, Triticum aestivum
  Clone ID: PAT_TA_30211
gataactttgatgaaaggaataaacttggtgaaggagggtttggtgtggtttataagggaatccttcctgacaatgaagaaatagcagttaaaaggctctcacaaagttctcgccaagggatagaggagctgaaaaatgagcttgttttggttgctaagcttcaacacaagaatttagtgagacttcttggtgtttgcttggaggaacaagaaaagttacttgcgtatgaatacatgcccaacaaaagccttgacaccattctttttgatcctgataggagcagtcagctagattgggggatgagatttaggatagtcaatgggattgctcgaggcttacaataccttcatgaagattctcagctgaagataattcaccgggacctcaaagcgagcaatgttcttttagactctgaatttaatcctaaaatttcagattttggcttagcaaggctatttggcagtgaccaatcccatgatgtcaccaaccgtgttgtcggaacctatggatacatggcccctgagtatgctatgcgtgggaattactctatcaagtcagacgtgttcagcttcggcgtcttgattttagaaattgtcactggaaaaagaaacagcatcgcatatgactccgagcaagctgtagatctcttaagtttggtgtgggagcactggacgatgggaacaattgtagagatcatggattcgtctatgacaagccattctcctggagaccagatgctcaagtgcatgcacatcggacttctgtgcgttcaagaagaccccgctgatagaccgatgatgtcggttgtgactgtcatgctaagcagcagcactgtgtctctccaagctccatcaaggccagcattttgcatccaaaagagtggcatgaactactcaggcatgcacacggatccatatccaggagttacgcattctaccagcagatcacctatgtcaccgaacgaagtttcgattactgaacttgagccgagataagtccgagactgatgatatattcagtatgtacgccattcttgccaaaataacctattttgatgtagggaaagaccctacatcatatgtataatctactcgaccccctggtggcagaaattttactgagcaatggcataatacggcagtataattatattgttggggttgtctatttgtcgggttacggcaacattttaagatacgctatcatttcatcttgtggatcactatcctgttataaggcttatgtgagtccctcgtgccga

SEQ ID NO: 30212 - DNA, 1173 bp, Triticum aestivum
  unsure (1)..(1173): unsure at all n locations
  Clone ID: PAT_TA_30212
cccacgcgtccgcgcaccagtctgcgaggcagcagcagaagacgacgacgccgacgcgcgcggagctcgagagaggctgacgacgaggacgacgacgccggtggccatgtcggcggagacggagcggagctccacggagtcgtccggggcgtccgggctcgacttcgaggacaccgcgctcaagctcaccgtgcgcctgcccggcgaccccgaccgcaaccgcggcgcctcctccccctcccgctgctccctcgccgaccgctcctccctcctcgccgaggctccgccggcccccaaggcgcgggtggtggcctcgccgccggtgagggcgttccgcaacgcacgcgctcgagaacgtcgccgccgggtccaccagggcgccgtgcgcgccggccaagttcgtcaaggtgggccgtcgacggcgcggctggcctgccgcaaaggtgaacctgcgggaactatgccgggctacgaccagctcctccgcgcgctccagggcaagttctgctcccccttcaccatccggaatttcgcgaatgacgagatgaagctggtgggacgcgggtgaacgggacggagtacgtgcccacctacgaggacaaggacggcgactggatgctcgtcggcgacgtcccctggaagatgtttgaggaagcctgccaacgcgtccgcctgatgaagaactccgaggccgtgaacatagcacccagagctgcccggtgaggcatgctacggacggtgctgcctgaaaggaggaggctttgctctgccgaggagataggaatgtgtacagctatcggttacttactgctttgggtttacttgatgctcttgggtcgtgaaaagttgttggtttcattactcgtctgtagcagcaccaccatagtctctactactaccacatatagaaagatggtgatggtgaaagaaagtactgggagctttaaatatacacctttttacagatagttttgttggtttgtttgtttgcccccttgcttgaataagaccaaacttgcagttaacccggattcctcctgcgcaccgtccccaacgaggtaccctgtgacacacaagtgttgcctttggttttgccttgggaaacctgantttttgggggggtgcaaaaaaaagggggggcccngtaccaattcncccaaaanganccnatan

SEQ ID NO: 30213 - DNA, 897 bp, Triticum aestivum
  Clone ID: PAT_TA_30213
cccccaccccccctccccctccccccccccccccctccccccacccccccccaatcccccgctcttacatcctctcactaggcgtcccccacaacgagaatgttgaggcgcttcccgatttgcggcggctgcttccgaatccgccgagcagcgccagaggtcggctccttctccgcgttgttctgcgccaaggtgaggcactcaataccgtggccggatggaggttgggcgatttccttccctgacctcgctgcctatccactccaccgcgagcttctcgcccccagcggcgtacaagacgtcctcctcctcgatgcaagccattcccaatgagttctctttgccggaagaggtgcagaagcaagtccagcacccccttcgcccctgcatcctgtcctacatcgcctggacgagctcactgatggttgcgtccttacctcctagcgtggagatattggtttatgggatcattttcaataacaaagatatgacgagcagatccacggccaggaatgcggggtcccttggttgtacgacgagcattgtgcgttgcctgatgggtgtggtgctggctgtagagtagcatagtgttctccgaggcatgcctgtggaattaatcttttttgggttctttttttgctcctgtacaggtgtatctggggtgtgtttatgtaattttttgtttttaaggacctgagcatatattttcttttaaattattattggcttaaaatttcaaaaaaaaaattttttgcttttaaggacctgaacatatattttctattaaattattattggcttaaaatttccatggaccaagagaaatgtgtgatgggctaatgtcctggactgagaaattagtgggcctttccttgaagttaaggacctagattcaaa

SEQ ID NO: 30214 - DNA, 476 bp, Triticum aestivum
  Clone ID: PAT_TA_30214
cacccgaggtgagcacgcctgctcctccccctcccctacctctgcctagctagggttcttcaaattttagttgcatcaaattagttagggttcatctatgggtggaaatgaatcggatacggatgcggctcagatgttttcttagatattgctcaaataggatatgtgcttgcccaagtggccggtcatgtttgcaggttacacctctgactggcctatgttttgccggagtgttgattcatttccgttccgacaaatttcaggcgctcgatatgtcctattttagcaaaggtcatgccggatttgttcgtgaattttggcatgacttgtgccagaatttgtaggaaatattgagtgccccggatttgtgtgttgagtatcctggtagctgtcttcgactcgacagatcgattgtcagcccgtgatgaataataatgatccaatctaggttttttagtacatatatttacttgtac

SEQ ID NO: 30215 - DNA, 645 bp, Triticum aestivum
  Clone ID: PAT_TA_30215
atgatgcttaccttgctagagtgcgtcaaccccgaccatggcacaacattcacagtcttgaggtagccgtgctgcaactgcatcaatgatatcctctctgactagataagtcttcggtctatcccattattttcttttgttctttggtcgatgggccatgattccatgacatatactattgtgttgattccctatgtgatgcagaagctatggtgttttgttttaagtctgttgtaaattgtaattgataatgatttgtgtaaaattagtgtagaacatatgtcttgttatcttaaatcgttcgtgtcgtgcgccatttctggaacttttggtattcatgcaacagctagtccttgtggttattacggttacatgttacatgtagagatgcttcatgatttagtccctagctgctttctatatttgtttttattttgtttctaactcttttggttaattgttagatgcctttgttcagcctgtacggacatatccagaaatggtgtttcctctcatgtaaggagctccagcctgaaagtgaacaagcctggagtgtatttgtagtagtatcacatgtaatggtgaaatgaattatgtaaagattgtgctattagctgaaattggcatttggtttgataattcccc

SEQ ID NO: 30216 - DNA, 837 bp, Triticum aestivum
  Clone ID: PAT_TA_30216
cccacgcgtccgcccacgcgtccgactagttctagatcgcgagctgccgcaggtggtgttcgaccgcatcctccggcggatcctgttcacggtgggcgtcccgatggcgtcgggcgtggcgctcctcaacgtgtacgacgcgctcaagcgcgggggcggcgcggaggtgccgtcgtgggtgcagctgctcaccatcctcctctccttcggcacgtcggcgctcggcatcgcctacgggacgctgtcggcgagctgggacccggagaaagaaggctcgctgctcggcatcgacgaggcccggaccaactggccggagctgtggaaggaagagatcgagaaggataacaagtagtaactgtaaatagactagatattttctccactggaaatagcagtacgcttgttgtcgacacttgatactcgtacaggctacagcagtgaaactatgaaacaattcgcagtggctttgcaaggtctctgcaataggtagaatggccaaaactgaacacttggcagcaaaaatgagaaaactgaatgaacccccaggccggccagaatacaacactgatgagtcagttgctttctgttctcctaaagcagatggatgggttattttgatcaatcgagccacctggtgacgccatcttcttcgctcaccgctgcgaggatctcgatatagacctccaatacagcctgcagacaattttaactaccatcaggaaacaagatactaccaacagaactgtttattttcgagttagtcaatggcagtggaaatttcctggtccagaacattaatgggtcctgttttgtgataaaaagtaaagattcgctatt

SEQ ID NO: 30217 - DNA, 1672 bp, Triticum aestivum
  Clone ID: PAT_TA_30217
ctcacgccgcatctggccctaccccctccgcctcgcgtgtcctcctctcccccaattccactccgctctccgccacgcgccgctccccggccccctcctcctgcctgcctccccctgggcgcggtctcgcccccgcctccgacgccgcctcgacctccgcagaaccactcgctctcgatcccagcgaccagcgcccggaagagggcgaggacgagcccgcccatgctgacctcctcgctcggcccctaggctcttagacagcgccacaaggacgcgcgcgtgtcgcggagggatggggtacctgccgtcgctgggcggcaaggcggcgcacctcgtctccgacctcgccaccgtcatcctcaaccccgtctccggccacgagcgggagcgctcctcccacctccccgaggccactgaagggcaggaaaatctttatggtgatgaagaatctgaaattcctaatggccccgacacatcttcgtttcgagcatttctgatgtcatttatgtctgcgtcaagctctagcaatgattcgatggagatcatacctgagaaggatctggatatggaatacccaactttaacacctgttgggaggggaatcaaggaaaggaaggggttgcttagtagaggcaagcattccattggaaagattattaacaaggcaggtagacttggtggtttcagacaaaaatccggccacatcgttgataacgaaatagcaaatcaaatagagtcaatgtcgtccggtttcgctctcaaggtatcaaaggggtctgcttcaaatcataagttgccgcctatgtctgaaccatcgatgcttttatccgaagtgacgcgaaatgttctttatccatctcttcctgttcttgttcaaggaaagaactggatgctggtttacagtacctggaggcacggggtatctctatctactctgtacagaaggagcatgctttgctctggtgattcacttctgataattggggataaaaagggagcagtttttggtggtttggtagaggcccctttgcggccgatcatgcaaaggaaatatcaggggaccaagaattgcttcgtgttcaccaatgtagctggccgccctgttgtatatcgtcaaacaggtgctaataactatttcacgttttgttcccccgagtatttggcaatgggaggtggtggtcactttgcactttatcttggtgaagacctcctgaatggttcaagttctacctcagaaacgtttaacaacccatgcctgtcactttcccaggactttgaagtcaaacatgttgagttgtggggcttcgtcaatgcttccaagtatgatgagatgctcaccgtctgccgcaccgagaaacctggaatttggaatttgtgaatgttcacaacttttcggaaccgttgagacttgatgccaggtgtttttttgatggcttgtacagtttcgtaagtatataggcctcgttaaagtttgcctggaagtggtaaagtaaaaggtttgtaggaaaactagttcgcttgtcgatttatgggggtgaaacaagagcgcaacttcctatttggccggagcaacttcctgatcgcgttggtttttattgctttgaactcgaactcgtatcctttccctatgttccgctttttttcccaataaggctttttaattcccgggccc

SEQ ID NO: 30218 - DNA, 556 bp, Triticum aestivum
  Clone ID: PAT_TA_30218
cccacgcgtccgctccggcggcggcggcggcagcaccagcagcagcaaacaacgtgctcgatcatctggcggcggcggaggcagcagcagcaaacaacgtggccaattttctggcgctgcagcgcaggagcggcgccgcaaggaagacaaggattgtgcgtgcttgtgctgtgtgtacatcttgggcgtgctgctcttctttgcagtgatgattctgctgacatcgaagccatggaatcgaggctagagagcacgaacgtgccgtacgtgatgatatctggagcatcgacttccttggaactaattaatgacttaccaggtggttttctctagtagtagtactaccattgtgtccgagatcaggtaatctgttggtgggaaagaagaactagtaccgtctagagtggtgggtagatttgatcatgtaaaaagccgagtaagatttcagtttatgtgacgcctagtactgcagtctttgagtttgagggtgtgcaaaacttgagtgagatatatattagcgcaacttcactgaagatcgcgaaaaattgggtcaact

SEQ ID NO: 30219 - DNA, 795 bp, Triticum aestivum
  Clone ID: PAT_TA_30219
attcgagctcatctctccccacgcacacacacgcttctccgtcaacccaaaccctcctctctgcacgggcacgccatggacactcctccggtccggcaacgtggcccatcctctggcagcggcggcggcggcgggcaacaatgtggccaaccctccggcggcggcggcgaacagcacacaggcaaacaacgtcgtccaacccccctcgggggggggggagagctgaaaacctcgcggcctatcctacggccgcgggagccgcaaacaacgtgctcgagcagctggcggcgaggcaggcagcagcagaacacaacgcggccaattttcgggcgcgcccagcagcagcggcagcagcggcggcggcggcggcggatgctgcagcagtggctggcgcttcagcgctgcagcggcgccgcaaggaagacaaggattgtgcgtgcttgtgttgtgtgtacatcttcggcgtgctgctcttctttggtgtcatgattctcctggcgtctaagccatggaatcgaggctagagagcatcaacgtaccaggatgatctctggagcatgcacttccttggaactgatgacctaccaggttgtttcctctagtagtagtactattgctgggaagaagaactggtaccgtctagagtggtgtgtagactgatcattgtgataagccgagtaagatttcagtttatgtgacgcctagtactgcagtctttgagtttgagggtgtgcaaaacttgagggagatctatatattagcgcaacttcactgaagattgcaaaaatttgggtc

SEQ ID NO: 30220 - DNA, 375 bp, Triticum aestivum
  Clone ID: PAT_TA_30220
ggcaacgccggcttctacaaggacagccggagcgcgccagagcaagaaggcgagggtggagctgcccgacgacgacgacgaggactacctcatcgttcccgatcttggatgagatatctgaactgaatatatagttcgtatgtgtgatgcactatgtagtaaactaatacgcgtgtgtgtatgtatgcaaacggattctgccatctttttgtgccgatcgcttagttgccgtggaaaatacagtatgaaattgcaaggcgattcggggaaatactttcagaaacgagatgggtttataagtgtaatatactgtggaaaacatgtgctgcttttaagtttatactgtggaaaattcaaccacctataaaaaaaaaa

SEQ ID NO: 30221 - DNA, 1116 bp, Triticum aestivum
  Clone ID: PAT_TA_30221
acggggatacaatcggtttccacttctctcctcacctcgcattctctactcaggctcagatccgatagcccccccgcctccaaccccgctgcgcccaatcggaatgtagctctcccctgaaggggtagtttaagagcagaagaatatagttaatggttcctggatgagaagtggaaatgctactggctgtggaaggaggaggtttcttctcatcgtcagcttcaggatacagtcatggccttgctcttttgctgcttggacggaaagaagaagagaagcctgtcaaggcatggagtcagtaccgactagtcgatggggaagctgagcatgtgtgtcatctggcttccacgaaaaaccaagctccccgtaaatgtgctcccttcatctgcttcggtagcactgctttggagctcgaaggggcgtctcctccgaaactgagttcaagcaacactttggactctttggaggagccatcccgttcaacaaagaagaaggttaccactaatggttccataactggagatgagagaaaaggttgtcttaagagcaactcaaaaagggattcgtcagagcattgtatagtggtgagtgaagatgaagaaccacgtgagtcactggaagaggtgcaaaccttgaaatctggtatagaacggagaaaagttcaatggactgatacatgtggaaagaagctttttgagataagggaattcgaagccagcgatggaagtttgtcagatgatgaactggaaaatgagggtttcaggaagtgtgagtgtgtgattcagtagatttttcgtctgccatttgaaacaatggatagctgcagcttttctgctaggatatgcttatgctgccaacttctcaacaatctgggtgatacctgtggcttgaagttaaacaagcaaaggatgatcatatatgtctgctttcctgttagctagcttgtacggtagggttgcagttttgatgcccgctgtatcatatcaagatttgacccatttatttattttcgccttattttccttcaattgtgttcacatgctccaggttgtaacatacaaggctgctagcaaaaaaaaaaaaaaaaaaaaaaaagtcgacgcggccgcgaattcg

SEQ ID NO: 30222 - DNA, 1084 bp, Triticum aestivum
  Clone ID: PAT_TA_30222
gcggcgtccgcctccgcgtccggcccagccgccgctaataaaatccgcggcggcgccgcgccggggagtccacctgcgccttctccccctccttcacccaagcggcggaggagccctgccgtctcaagcccgtccgcgccccgcctctccctctccggttggagcgccgccttgctttatgacgggttcttcttcatcttggtctgttccgccagcctctggggaatgttctttacaaaatggcgaacgttatgagataaccaaggccttattgaagtgcaaaatggcagaaggaagctcagtgagccaacacctggtcaagctagttggttacatgtggaggttggaagctttgggctctgcgatccccgcttggctttgtactgatcttatccttctgtctctcccgccaagctttaatggctttatcatgaattacatgatgtacaagatggacaagagcgtgaatgaattgctcgggatgctcaagaacgcggagttttggatacagaaagacaccaatcatgtgacgaagaagaccactagtttcaagaagaagggcaaagtcaaaaatggcaagggcgtcagtaagaccgacaccaagggaaagcctaaacgcgggcctactaaagagacagagtgcttcttctgcaaggacaagggtcactggaaaaggaattgcaaaaagtttttggcagaaaagaagtctggaaagtccagcacaaggacttccgaggacacaaggactgctgaagaatgaggtgcagttccgtgtcgaaacggtgttgaagttgccgctcaggccgtcggcgtgatgccctacatctacctttataattcatactcccaccgtcccaaaaacttcgtattaaacctagtataaagttgagacatatatttaagaccgagggagtactataacttagtaattgttattttgtttccgcgttatgtaaaaacattatattaggatcttgtttcttacgtgatagatatatctatatctatatgtactatactaataataaagtaaggtgtgattctctgtgttttttaagaaaaagggggggggggggggggaggg

SEQ ID NO: 30223 - DNA, 1416 bp, Triticum aestivum
  Clone ID: PAT_TA_30223
cgtgtactagattttgaaggttgccggggcgtggcgcagtatgatatgaaaggtatggaaaccctgttccagctgaagtacctaagctttagcggaacaggcatatcggagctaccatctggaattgtgatgctgcgtgatctagagacgctagatttaaggagtacaaaaatcagagacttgccagatggaattgtacagctcactaaactacaacatctactcggtaacagatatgagaagaagaagataccaatcgggattgggaatatgacaaacttaagggagatctcaggctttgatattaccatgagttcaataggtgcagtgaaggagctagggagcctgatcaatttgaaggtactccatgtacggttcagggtgaaaggtgcagaatctcaagaatacaagattcatgcagagatgtttcattcctcactatgcaagcttggcagctacaaactccagtccgtgttgatagagggtggtaattcatccctattcgagttactagattgttggtctcctcttccatcttgcctccaaagattagagatgggcccgtactgtttatcaaaactgccaaagtggattattccagcactcacaagtcttgcatacctggacattgatttaagtgtaataacagaggaggttcttggcatatttggagagctgcctgcattactttctctgaaactttataccaacacggtccataaagacaggcttgttttgccagccagaggattcccatgtttgaaggagttcgtttataaaccttttggtgaaggtgcagggatccttctgtttgaggaaggggcactgccgaagctcgagaagcttcatctgtgcttctctgtacaaatggcaaaggcctatgggttctacttaggtcttgagcacctcccgtatctgaaagatgtgcgggttattcttcagaagcggtatcccacatctcctgaagttgacgctgctgcagctgccataaggaaggaagcaaatctccatcccaaccatcccaggtttattgttgcttgaagaaatgaaagaatagcaggaggtattgctactacttttattattacgaaattcaaacagtccatactgtctgcaatcaggtctattggttttctttttgagtatatgtattttctccatatcttcaagaagcttcctaacgggcagacattccatcagttcaacttaattacaagtgcgcctggctcaactggagtggagtcctgaagctgttattcttgttgtctgaagctcttataaaagtggccatcgttgccattagaatcctgattttctttcttgctttgggtgtgaacttggaatcagactatttcttcacgtacacaagtactacttgattgtaacttcaatattcagacaaaagttggttcactc

SEQ ID NO: 30224 - DNA, 968 bp, Triticum aestivum
  unsure (1)..(968): unsure at all n locations
  Clone ID: PAT_TA_30224
ggcctccgtgccgagattagcctccttgccgcctctatctctgacctcttcttccacccccgctccggcccctctccctcccatctccggcggccacggtggccggcggtgagtgggtggggggctcggttcttgtgccatatgtatagttgtagtagtaggactttcctccacagtaaaccagatctgaggtcttctttcttgcttcgtgggatctttgttttggccatgctgactggaataaaggtcaccggagctgaccatatgcctggatctgatgctcttcccctaaataaaggtgtggatgaaggttatggtgtgcttgattcagatttttcttcttcccgagtcgctcttgtcttcatggagaagagaagagaggcagaggaggtgaagaatgcctggatctggcgttgtatgtcgtgtatctccctgatgtggaaaaggatcttccgctcattttcgatttcggatgccgccgtggtggtggataaggagaaggggaggagcagagagatggaaacaacagatggggtgagagctcaccatcgatggtgcttcaggcaaggctacggcgcccatgattggcagccggcctttctcaccacgccatcgattcttctggccgaaaggcggccatggttattcctcccggcctcgatgccaaaggggaggcaggtcagtttctgttcggagtccatgagttccttcttcagtgagcttggttgccggaggcgaagccatggagattgcggcgacccaagtggtttcgtcccccgtgtcgtcgtggttgaatccgataggaaactgtgttggacccccccccctctttcattctctgtatggggtccaaataacaaaagtcagggattgttctgtagtttctcttttatgttgggtccttttgtaatatgtactgcaatgcctatctaatgaagtntgggtccccccggaccctccttctgttc

SEQ ID NO: 30225 - DNA, 157 bp, Triticum aestivum
  Clone ID: PAT_TA_30225
gggggctgttcttcgcttcgctggtccaagtgaatcgctgtatggatcccctgctgaagcttaggcacagggtcatgtcagattgttaactcatacggaatgtactatttacatattgatattgatgtggaaatgatgtagcgaaatttttgcgtct

SEQ ID NO: 30226 - DNA, 773 bp, Triticum aestivum
  Clone ID: PAT_TA_30226
gaaagattttgcctacgccttcgatgcaaaagctcgatgacttcggttgctgaaatgttcttcaaagaactcttctttctctgcggttgctatgccgccatccaacgaaatgttcaaattcacggatccatcaggcagcaagttgcttgcagcggattgggttccagaagaaaagcaaatgggatcaacaaaagttgcaggtttatccctgccctccattaacttgagcatcgcgctcggatctcctccgtgccgtgccatatcgcagtgttgtgacaggaccggagccaatccaacaagagcacatgtcgtgcagctcgtgttggtcattgtcactttgtcatggacacatggactgaggcgaagacaggagcagtgcttttggttgatccgggatgagcagttggctggtgaagtttatcttgcttgccagacaagaaattcatgtgactctttttcataaacaatatttgtagctataagtaaaccgtggtaatcactgcgttagagcatctctagtcctttccctgtgatgctttaatcccctatacaatatgttttggcctcctccaatacattagtgtttagctgaggtgttaagtgattgaaaaacttagcaattaagctgctcaatgcataggggcttagttttttagataaactttcttcgtttaattgtttagcaacaaaacatctttgtgcattggttgataggaattttggagtcgcttgacatccgtttcttttttaggtcaccaaattgttcgctcctc

SEQ ID NO: 30227 - DNA, 606 bp, Triticum aestivum
  Clone ID: PAT_TA_30227
cggacgcgtgggtaaaaagatgactataactgagaagcaaaagatgattagaggcgaggtatataatcctcgtgatgaggagcttgtacaagatagacgcaccaacatgcttcgacttattgaattcaacacgtccactgacgatgtggagcgtctcaagttagctcgcaaaatctttggttcttttggtgaagggacatttataaaccctacctttcgatgtgattatggctatcaaatctttataggcaacaatgtcgagatcaattatgactgctgctttttagatattgccagaatcaccattggaaacaatgtctttttcggtcctaatgttcatctctatactgtcaatcaccctttggaccccacagaacgaagaaaaggagtggaaattcccaaggcaatcacgattggtgatgattgttggattggtggatgtgtcgtggtctgtcctggtgtgacgattggaaaaggcgttacgattggtgctgggtctgttgttacaagggatattccagattatagccttgctgtcggaagtccggctaaggtgatcaagaccattgttcctacttaaaaaataaaatataagatttgatactt

SEQ ID NO: 30228 - DNA, 1063 bp, Triticum aestivum
  Clone ID: PAT_TA_30228
ctcgtgccgaattcggcacgatccaccttctctcccaaaaaaaaaagagagcaaaaggacgattctcggcggcggaggcggtttgatctcatcggcggcgatctactccttccttcaccacccgccctctccctttctctctccagttacaggagcggtcgatccatctgtggccatgtcgtcggccaacgcaacctcttgtgtttatggggaaatttggattgacggctttgccagactgcacaaaggggatgatttcacttctagcccatcatcaaatactctccaggagttcagtgatgtttggcttgctgccgccgagcgccagctcagcctcaggcccaagtcgccgtcgcctgaggagctgacgaaacgcagacaggagcgtaagcgcaagggcttggtcatagcgctcaacacatatgccaagcgaaacaacatgcagctcactgatttagaatttgtggaagagaaagagaggaaccaagtctatggatgcggagcactatatgtgcactccaactttctggtgaaaggttcagatggcaaacctactatgttctttgctgagatgcatcctgactgcacacaggaagaggatgttgtctgctgcactcctttggaagaaaacgactatggtcattgtgtcgagtgtgacgatcgagcaaaggagcttaggcatccctcgggcggtggctacttgggtggacatgatgagatgatttttcactttgaggagctggacagtgatgatgactgttttatgtgaaaggaatctatatatccaacacagaaccacaaactgatctgtttggtcttggatgtggatttgtggcacctgagagctcccatgcatttcccgtttggtttttgtctactatatggttcaggtgtatggcgagaagttctttttagagtgtggcaagaggtgatgcatgtgacatgcagggtgtgtaagggaaggaaccgaagcatatgtatctttaatattaactgaaattatgcctgaatcggtgcaataagttattgtaactgaacgagtgtaggatgatgtgtcataaaa

SEQ ID NO: 30229 - DNA, 1212 bp, Triticum aestivum
  Clone ID: PAT_TA_30229
cccggcccctccccgctaggttccgtccccgcgctgtcttcggacgcgtgggcggacgcgtgggcggacgcgtgggctagttttgtaatttatgagtctagttcaggggagactctagctagctctggtgaagaagaaccaacaagagtttggagagggagaaagggatggaaggcgacgagcttctcggggatgggcaatgggagccggtctccccctctctctctctctctccttgtgtgtgtgttttttgctgggagaagaaagagggacagagagagaggaataaaaaggtgggcaaggacatggagatggccatgatttcacctcaggcccttcctctctccccaaacacttcccgatagattccatcccctctctatcatcctgggtttcctcccaccttttcctcatcttaattgcaaaggtttctgcgggataacatttgttttggggagactctagcttggtctgctctagtaggagcgcgactcctcgggcaggatgcgctcctcacgatgccgccgcgagagcctccgccgggccggacagaagcgcgtccggcccggctagcttggcccgaccggatggtccctgggtggacttggcatcgatatggatgctgtgtagcagctagcgagaaaggatgtgagttactgatgagatgtttgctactcctacttactactagtactagaacaattcatccttgcttaacttcttgccttacctctaatgtcggactcacgcagggtgcttaataaaccctgacgccgcgtcaaaggctcaatgtcctcttcaagtcctcgtgacgatgagcaaaaaacaccagttcttgatgctcctcggagggcgcctcttcgggcacgctgcgctcctccgatgccgccggccgcgccgccgccgccgccggacagaagcgcgtccgacccggctagcttggcccgaccggatggtgcctgccgtttcttggcatcgccatggatgctgcactagcgagaaaggatgtgagttactgatgagatgtttgctactcctacttactagtactaggctagttcttccttgcttaatttcttgctgtgcttcttcttctttgccgcaaagtgcttttcctcaacccttgatggtgagaaaaaggaaaacttttctgtacaagtccatgtgacgatgagcaaaaaacaccagttcttgagaaactgcagccttact

SEQ ID NO: 30230 - DNA, 798 bp, Triticum aestivum
  Clone ID: PAT_TA_30230
cccacgcgtccgcccacgcgtccgacgggcgcccgaagaaggggacaggcaaggctctccctcccggcccgccggggctgctcttcctggccaggttcctggcactccggcgatccgtcttccacctcggcccgatcctccgcgacctgcacgcgcgctacggccccgtcatctccgtccgcctctcccgcacgctcgtcttcgtcgccgaccgccgcctcgcgcaccgcgtgctcgtccagggcggcgccaccttcgccgaccgcccgccgctctccgaccccgggctgctcttcacctccggcgcccgcgacatcagcacctcgccctacggcgcctactggcgcatggtccgccgcaacctcgccgccgaggccctgcacccgtcccgcgtcgcgctctacgcgccggcgaggcggcgcgcgcgggactcgctcgtccgcgacctcctccgcgcgcgcggcgctggcgatgacgtcgcggtgaggccggcgttccggcgcgccatgttcgagctgctcgtgtacatgagcctcggcgcaaggcttgggacggagacgctcgaggaggtccaggagctgcagctgcggatcctgcgctccatcaccagcttccccatcttctccttcttcccggcgctcaccaagcggctcttccggcggcggtggaacgggtacgtggccgtgggccgcaggcaggacgagatcttcctcccgctgatccgcgccaggcgagagcggggcgctgacggccctccgtgctacgccgactccctcctcgcgctgcgcgtggccgagg

SEQ ID NO: 30231 - DNA, 1535 bp, Triticum aestivum
  Clone ID: PAT_TA_30231
cccacgcgtccgctccgccatgctcgtctgcgccaccggctgctccaacgcgcggagatagggaacctgctctccacggtggccatgatcatctccgccgtcgtcgaggaccggcgcactgttcatcgcgcgcacgcagcccaacatcggcaccacgccgacgggctcccccatctccgccatgtccagcttctgcgcggcgccgcagcccatgatcccgggcctgtccgagacgtacaccaagaaggacctgatcgacccgccgcacacggagcgccatcgtcaccaagctcgcgcacacggaccagttccggtgcctcgacaaggccgccatggtggcctaccccaagggggtgcgctacggcggcgccgccgcgggcaacacgtggcggcggtgaacagtgcagcaggtggaggaggtcaacagccgcaaccgcctcgtgcccgtctggtacactgggatcatttacttcgtggcagtggtgcagcagaccacctactgcgtgttgtccgcgctgcagtcgggaccgccgcctcggcagcagcttccacgtccccgcggcgtcattcaccgtcttcgccatgctcgcgcagacgctctggatccccatctacgaccgcctcctcgtgccgcgcctccgcaaggtcaccggcaaggacgagggcttcacgctgctccagcgccagggcatcgggatcgcgctctccaccgtggccatgatcatctccgccgtcgtcgaggaccggcgcagggacatcgcgctcaaccagccgaccatcggcacgacgcagacggggggcggcatctccgccatgtccagcttctggatggtgccgcagctcatgatcctgggcctctccgaggcattcaacctcatcagccagatagagttctactacaaggagatcccggagcacatgaggagcgtcgccggcgcgctcgccttctgcaacctcgcgctcgggaactacctcagcggcttcctgacgacgatcgtgcaccggaccacggggggcgggcagaactggctggcgcaggacctcaacaagggcaggctcgacctcttctactggatgatcgccggcatcggcgtcttcaacttcgtctacttcatgatctgcgccaggtggtacaggttcaaggggaccagggatgcttgatgcaatttggatgatcaaaagaagggggtagaataaggtcaggtgattaattcacgtgtcttataccacagtagctatttcccttttgcgttcttataattttttggttctgctgttatgaaatcgatcaatcaatctatagatgaagtgggcggggaaagagaggaagaaatgtactgtagacaacagtggggtggttaattccttgtaagttgttaaaaatgaaagaaacaacaatggggtggttgatttcttgtaagttgttcaaatgaaagataaacgatttcactgtaaaaaaaaaaaaaaaaaaaaaaaaaaaaaaaaaaaaaactcgagacacctcggccgcgaccacgctaatcactagtgaattc

SEQ ID NO: 30232 - DNA, 774 bp, Triticum aestivum
  Clone ID: PAT_TA_30232
gatggttacggaccatgacgatgacgttgtgttccatttagctccgtgctgcgtgcttttgtataaaagaagtggttcgatgtcgcaatcccttagtttatctgacgatgcggtttttggctgttttagtttttgtttggtcaggttcaggttagggcgaaaacgataaccttgcgtcattgggcagcttttagagtcttttttttgtttcctggtagaaatctgtgtgcttagcttagcctgttgtattagcccccagtgcaggttatgtcgtcgtcggtggaaggatgtgtgctctctgcttttacttatctcttacattatgacgatggcggcgtggaaggtgttctaatactgcgggcgtcggccagagacccacggtgagctcagggcgatgaacgtttttgttttcggcgtctgccgttcaggctccaggactgcctaactatagtgtgttggtgcctttttcggtcgccaatcactaaataagaaccgtggcggtgctttctgtacaggggtgacgaaaagtcaccgatggcgtctggatctcgctcccgggagagacccgtcggtgaggagagatcctaagagttatctaggctcgggtagatcgatctaaactcctctaatcgacgtagagtcgaagagaagcgaagaatttggggattgagaggctaaactagaactagactagaacttttcctaattgtataatgcgagataaaagtgttattgatttgattgatgattataaatcggccggtatactttttt

SEQ ID NO: 30233 - DNA, 1566 bp, Triticum aestivum
  Clone ID: PAT_TA_30233
ggaattcactaagtgatttcgggccgcggcccaggctagaaacacgcaaatttttttttttttttttttaaaatttttgaccttaccaggaaccgaaagtgcccagaccttattacacactagtacgaagttctcaaaaaaataattacacgctaaaaaactatgtccaaattattacggaaattaaaagtatgaaaaaatgtactgtatttgtataatcagttttgggcgtttttggaagcgggttttcccccatgtcgtttttccttaatccacctgggacttgacgaggcgtgagcatgaacatcctggtccgcactgcggcgtcacgtggaatcgtcgtcttgtcccgtgaacttgagatgtcccaggcgtccttgtgcatcccggaggtccctgggcctccatctgacggctgcctggcgggggagtcccgatgtcggcccagttgcggccgtgatcctgggccctcgtccttgtcggtgccggttcagcaacagcacccccgtcctgtacccgtcagaggccctggccatacctgtgaggatcttcggttgatggcgaatcacctccttcgttggcgaggatgtcatacgtgttctgcgacatgtgcctcacgtcgcagccgaatgatcagaggcgcctttgagatcgcccagatgctgaagtgcacgatgtactcgtcgttggtcatccctccgttgcccacctccagcatgtcggggtcgttccagccgccggggcgcgcgtactcggcccacacctcgttctggtccgccctcgacatcatgctgttccaggtgtcctcgatgtcgttggtggttctccagctgttgccgtacgccgcgccccaccgcgccgggtgcatacctcggcagtcgccgagcttgacgcagatgggtccgccggcctgcatcagagccttgctcatgtcagggtacctctgcagcggcttcgtgtcgccgttgttgcagttgtcgtacttgaggtagtcgactccccaggaggcaaaggtcttggcgtcctgctcctcgtggccgagggacccaggctgagccttggcgcatgtcttgtatccagcatcggagtagatgccgagcttgagccccttgctgtggacgtagtctgcgagtgcctttatcccgtgcgggaacgtcttcttgttcgccgcaagattgcccttcgcatcacgttcgggttctgcccagcaatcatcaagattgacgtatttgtagccggcagcggcgagcccggtggacacaagcgcatcggcggtctccctgatgacaacctcgccgttgccgtcgcaggcgaagtgattccagctattccaccccatgggcggcgtcgcgccgaggccattggccagcatgctccgccggtgcgcctctcccacgtgcaccaccctgcactcgcccacggcggcggcggcggcgcaggccagcagcagcgccggtagcctggtccatggccggccacgataaccttccattgatctctcgccgagtctccccccgcctgttgacctggacgtagccgccgatatacgtgtctggcccgcgtccc

SEQ ID NO: 30234 - DNA, 525 bp, Triticum aestivum
  unsure (1)..(525): unsure at all n locations
  Clone ID: PAT_TA_30234
tttttttttgttgagaagtacaacatatctctactgtaatgctgcctatgcagtgagtgaaaaatacaaagtcagtccattagtccacctcttcagtacaaacgaaaggtgaaataaaacagtataaaacttcaacatgagtaatgagatactgaacgacatgtgtagattaacctgcatatgaatgaacatattccatagaaatgcaagaattagttccttgtcgccattaagaatatattctgctgaaactctgactgcatctgcatcagatatcagaaccggagcttccttcatatactggacagccatgatgcagttgtgcaatttctttttatgtgaatctgatggagcaaacacttttcaaaatatttgatgggtcagaaagcaggagctgaacaactgtacctagaatcgccatcaatcatatcttcaatacatatgtaaagaattgccatcattgagatcttcaatcaaattttctataatgaatcacactctgacagtgcctgaataatttgatng

SEQ ID NO: 30235 - DNA, 1029 bp, Triticum aestivum
  unsure (1)..(1029): unsure at all n locations
  Clone ID: PAT_TA_30235
aatgtatttcnctncttattttgctagaggtntaccaacagtgacacacataggtctctctgtgctttctctcttgtagttcaacaccgtcattctagaggtaagtacattgtgctgccgtattcacaaaatgtattttacaacatctaccaaaaggaacacaaacctagcaacatttaaaaactgcatgtgtacactcctagtgtgttacagcctgctgcaaatctatagccacaagcacaacaaccaacatctaggtcaggtaagcattcatagatggcatacaggtgtacaacacagccacaaacctagaaaaagcaaacacttcagtgcaactacctccaggcaaggacgagccacatgaatgttggatgttggatcacttgtccaccagcagcagagataattcagaaaagaaaggcaaaagtcataatacaaggttacagaccagtcgatcatcctaatacatagtaaatggtacattctcgcactcacggtgttctttcctcgcatgataataaagtaaacaaaaagagtatttaggggaatcacaacacgtttgacaggtttttccggcaatattatgccactcggcgactatatttaaggtaggggcaggtaggggtaggcaggcaggcggcagcatatcttgtatccgaggaagctggaatcatgacttcgcacttattcgaactgcttgtatggatctcagttaatgctacaacagatccctggagacacaagcagttataagcagtgaagggttgaaagttggcatgtgcaaaaatatgccacctcggattgccgctgcccctacactaggcatccaggaacatcactcgtgcgacattcgtcgccgctttgagtgatcaacctcccttgacctgcttcgtctcccagatgatcttcctctatcccagtcttcagtacgatcagaatcacgctccctgtgtctgtgataatcaccatggcgatctctgtcatccctgtgtctgtccctatctcctctatccctctcggaagcgtggg

SEQ ID NO: 30236 - DNA, 1181 bp, Triticum aestivum
  unsure (1)..(1181): unsure at all n locations
  Clone ID: PAT_TA_30236
caagaaagtagcccttccaggattgaagttttccaacttgacattcaaaatacgtgcaccttgtccattcattcctagaacaatttcttaccagagatacatgtcatctacctcaatacactgagaccaatatggctccctattctaaataatgacaagaggcacgagaaattcgacacgtctcatccgaaatacaacagacagtacaatgttttacatgagaagtacaacaggcagaagcacggcagctaggtaagtcaaccagcaagactgtgattgtgaggcaaaactgtcttggctcacaggaccagcagccgcatcaccactgctgccattggcaccgttgcttcctgcgaaaacacatgatccatggcttggatccgtagatgatatggttgctgtgccattaaagttgcatgtaccgccactcgcttgtgttctatgataataatcgttgaaagcatacgaagcaacagctacaatgtcatctgctttatagcattgctgcccaggttgaatggcactgcagtttgcggagccagggccacatacccaatccaagctttgcttcaacgcactatgggttgcacttgaatttgccacacaaaacatcccgtgcaaagccggtgaatcagtactagctgtagctacatcttcaaatgtcagggagtacactgcacttgcattgctaaacataatcccccaactttcccccgaaacagatcctgaccgaagatcctcactgaacaactcaaacaggtatgtgcttacttgattatttcgctggctaggggtaccagagttatttagtacatggcgtatgagatttgtattgtaggccagagcattatcaacatccgcagccggttctttgcgtgcaccatgccatggccaaccagaagctgtgaccataacaggaatatcggtgaaattcattgctttcattgagttgtatgtggcatcaaccatagcatcaaacatattggtatagaacaaattggtgttcggatctgcaatctgactgttgggattgagtgatcgaaacctcgtgccgaattcctgcagcccgggggatccactagttctagagcggccgccaccgcggtggagctccagcttttgttccctttagtagggttnatttcgagctggcgtatccacaccnaanggnntncanncnc

SEQ ID NO: 30237 - DNA, 886 bp, Triticum aestivum
  unsure (1)..(886): unsure at all n locations
  Clone ID: PAT_TA_30237
caacgcaatcattgatatatattgctatcaattaggcaacataaacactcatggatccgccatgacgaagatgaacaaggagtggtttaacagcggcatgatgcataagccggtcaacgttcagggctaaacagagggaaatacctaggaaatatccaagtagagagcattatacaagaaacaactcgtggccgcacttcctacacaacaccaaggacaagctaacagagcctaatattcacactgcccggttccggattcaacctaagccgtagcttgcatttggggcatcaaggctgctgccgaaggggatctcaactctttccttcacaacgcagtgcgcccggccatctccaccaagcaccattaccttcccaggagggcactgtagagtaggaggaacctgctcttttgcaccagccgcctctttacccaacagacctgcaatgtccagttttatgccgctcctccctattgtgggctcgtagccagcagccttcatgattgatacggcgcccacaatcatgaccgctgttttagccaaccatccaatcaaagatctgatccctcctgctgaattacggctcgacatgataggaattctgttttgcaccccgtttgtccctgtaccatcttcagtcattccattagaacgcagtccattgtgcaggcacttgggcttggacacgtagtttgcaggatagagatcatcgagcacaaatgaattggtgacatggcccgagtaaggaggtaggatgagaccatcatcattttcgattttttcaccagcaaaagcagcagcctcgtggattgcttcacagtcctctcccttgtattctttcagncttgttaaggagagatgttcgactgcgcctcgtgccgaatt

SEQ ID NO: 30238 - DNA, 617 bp, Triticum aestivum
  unsure (1)..(617): unsure at all n locations
  Clone ID: PAT_TA_30238
gtttttttttttttttttttttttttttttttttctgtgttttcaccttcaaaattcactttcatgtcacttgaccagtgacagttcaaagtttgtgcagaaattctgcagaaaaaatattagaccttttatgtctatcgggatcacaataaagtgctattctctcagtgtcctcttcaaatttctgccttgacccaggtgcatacactatctaattatctatggggaggtttgagggagtaaggcatacaatctaagtgaaacctacatccatacatcacagtctacaatcacttatgcaccgtacagtccggatttaatccgtgtgaagtattgcattcttcattcccagcagccattgactgcaactccgctaccgctaccgggcaaaaagcaaagcatgcaaggccatcatgttgttcaaatgataatacttgtagcgcaatccccaggagggtgagacaacatctttctggtgatcgagattcaaagtcaagggtattgtccttgatcgccttcaaaagctctcaaacccttttaaaatttaagggtcaacaaatcccttgcctggccaaagggaaatgnccccccggcgggcggtaaaagcaanaattnng

SEQ ID NO: 30239 - DNA, 628 bp, Triticum aestivum
  Clone ID: PAT_TA_30239
cttacaacaccaacattataaccatagaccataggaaaaatattgatagttgcatatatttttgcatacagtgcgattagcacttgacctctttcagctcatgtgcgaaatacaggaaagttggctcaacagctccttctttgtaccaagctaccatcatcatacatactctcgccccataaagctaccatcatcacatcttgactgaatcatatcatcaccagcaatcaaggtgtgatcaccttcaatctcagtggagtcgtaattaatttgttcaataaccattgattttgggtcctttagaaaggaagtgtctgtgtggtctttatgccttcgagtatttcctccgcatcctgcgggcgtgagggctgtacagaagtatctctgccccagcgccgtgtgaacgaccacgagccagcggagctcctcgcggtgaccctctcccgtccaccgccgcacctccctctcctctttctccaggcgatgtgtacgacgacgagccggcggtgctcgttccggtggtcctctcatgtccgccgccgtgaggatgcgtaataccctagtcctgctttgatggatgtatttgagtgttcttgtgttcttgagctagctgcggggtgtgacttgc

SEQ ID NO: 30240 - DNA, 738 bp, Triticum aestivum
  Clone ID: PAT_TA_30240
taaagcaatgggggactgactctggtggctccgattgtttcttagtaaaatcaattttttcgatgatgggaccgaaattcagtaaaagaaaaatcatttttcttgaaccattttcttcgcagcaagaaaagcagctttgtcaagctggaagcatcaggtcgccgtccccttgatgcggttgccggccggcagcaggccgcgcgacctcatgccgccgccgaacacacccgtctgcgtgacccaaccctcaatcatctcctgtgtcgcgcgcccgttgtccgccggcacgaggtgcccagcgccgtacaccaccacatgcgtcagcgcccccgaccgctgcacgtacccggcgagctcctgcccgtccccttcgccggtccgccacacggcgcgctcggcgtccaggaacgcgcgcaggccgccccactttagctccttcatccacgcctcctgggacacgacgccgtcccggaggtcgcggatgccctggtagagcagcacgcgcgtctgccggagcagcgcctccacctccggcagcacgctcttcataatgtcctcgtgcatcgccgcgcccaccgcgtcgctgcactcctcccacgtcacgtccgggcgcgcgcccagcgccgccttgacctccggccggttgacgaacttccccacgcccgcggacgcgtacggccgctgcttggcgaagtcgtagagcgtggcgaggcccgtggcgtctcagcggaagcgggg

SEQ ID NO: 30241 - DNA, 773 bp, Triticum aestivum
  unsure (1)..(773): unsure at all n locations
  Clone ID: PAT_TA_30241
cggncgcgtgggccctcccgtccatttccacctccgagtctctcctggtggtcgcggcttcctcctcgccttcgatctccttcgcctcgtgcccggcggccagtcgggcagtcgtctgaatccttcctactcgcgcgggctagctcgatggccatggcgaaccccacgaaatccggacactacgcgcagaacaagggccggtcgctgcccaagttcggggagtgggacgtgaagaacccggcgacggccgacggcttcaccgtcatattccagagagcccgtgacgacaagaagacgaccgccggccccgggaggccgggcatcccgccggccttcaggaacgccgacggcggctacggcaccatcaaaaccggctacggctacaagtacaccagggtggcgacacccaaacggtccaagaagaagagctggttctcctgcaccagctgccgattctgatgccgtagctgcttgccgtcgttggtgagagagatccgatacttcgccgcgccacgaccagaagcacgcactccgggaggcgacggtggaacttttggcgatcttggcgtttttgtccctgctcggtcgccgcacttggcgtgcagagcatcatcgacaactgatggctcccgttcatatgtacgaataatttgtggcgaataaaaggggggaagtgactagtaaagtaaaacgacctgtgacttgttaccctattcttttccaaatgttcatgctaatcatgccataaaaaaaaaaaaaaagctgcccctagg

SEQ ID NO: 30242 - DNA, 977 bp, Triticum aestivum
  unsure (1)..(977): unsure at all n locations
  Clone ID: PAT_TA_30242
gcccgatttccacctcctaattctctcctggtggtcgcgccgaccttctcccggtggtcccggcttccccctcgcctgcgagcccgttcgcctcgtgcccggcggccagtcgggcgggcgtctgaatccttcctactcgcgcgagctagctcgatggccatggcgaacaaccccaacgaaatccggacactacgcgcaggaacaagggccggtcgctgcccaagttcggggagtgggacgtgaagaacccggcgacggccgacggcttcaccgtcatattccagagagcccgcgacgacaagaagacgaccgccggccccgggaggccgggcatcccgccggcattcaggaacgccgacggccgctacggcaccatcaaaaccggcaacggctacccgtacgccagggtggcgacacccaaacggtccaagaagaagagttggttctcctgcaccagctgccgattctgatgccgtagctgcttgccgtcgttggtgagtgatccgatacttcgccgcgccacgaccagaagcacgtgctcgacgggatgcgacggtggaactcttggcgatcgtggcggctttgtccctgctcggtcgccgcatttgacgtgcagtacatcatcgatgagtgatgtcacccgttgatctgtatgaataatttgtgtcaaataaaaggggggaagtgactagtgaagtaaaacgacctgtaacttgttaccctattcttttgcaaatgttcatgctaatcatgccataaacacgaactgttcgcttcaacaaaaaaaaaaaaaaaaaaaaaaaaaaaaaaaaaaaaaaaaaaaaaaaaaaaaaaaaaaaaaaaaaaaaaaaaaaaaaaaaaagaagaccaaatcaaaaaactaaaaaagaaaaatcggggccccccaaaaggttccaccctaaattccccctcaatgcaaagggggcgtgcggngtaaaagagtctgtattatggcg

SEQ ID NO: 30243 - DNA, 677 bp, Triticum aestivum
  Clone ID: PAT_TA_30243
gttgttaatatggggacagatcgattgataaaatcatagcataataaattaaggactgagatgtagcacataacataacgtggcatgacatactttagcaatctaaagcagctcacgttttgccttgcataagcagttatagttcctagaaaaataacacggaccacgttataaagcacttatgttgattccccatggccatggcggggtatactttagcaatcagccgcagctcacgtggtgtaaggaggagggaggtgtttatacctatgaaaataacacggacctcgtttcggtccctggcccctcacgccccgcgcccgtggtgccccggcgcccgatcatcagcctgcgccgctccgctcgagctagctgacgccgcacctcgggcccctggcttcttcgcgctccgccgcccccctccgacccctgcgggctctcttgcctcacgtgcgctcgctccccccccctctccctcgtggatctacgtgcccgaggtcacaggctgacgcggcgctgctgaccccgtagggcccctcgcgcccccggcagcacgactgcttcttggaagttgggggatgaggaggactgggaggcgctcctagcatcacacggggaagtaggtgccggaggaaagaggaggaggtggtggtgatgatggcgaagggcccaaggtg

SEQ ID NO: 30244 - DNA, 644 bp, Triticum aestivum
  unsure (1)..(644): unsure at all n locations
  Clone ID: PAT_TA_30244
ttttttttttttgcgctgataaggatcattacttgcagcacttgacaggttgcaagcgattcacnttacaaagtcagtaccagtagttatcagcagagaaaaacatgcccataattctgtagcttgttagtcatttccatttagataatgcacatatcacgttattgctatgacaagaaaacgtgcagccggaaacgttgccccactccacagactggcaaaagaaagaaagaaagaaaacctctatgtatacaagactatttcacgatcatagaacgcgagcacgggtattcaattataaagcacaggtggtctatgtgaacaccagccctgcacagtgggcaggaggcgttcctctgaagccagtcatcgatgcatcgcacgtggaaaatgtgctggcactgaggcaaggctctcacaaattgctgcggtctcaagtcctgaaggcatacagaacagcagctcttattggtttcctgatcagaatcggttgcagcgctgaacctgattgctgggatcttattgatcagggctcttgacataccacccgtgcagccggtttcgaaaaggtcattgttgtcaatgaaaggtgtactcattaaactcatctgactttgcactgcacgctggagtgctggactgac

SEQ ID NO: 30245 - DNA, 361 bp, Triticum aestivum
  Clone ID: PAT_TA_30245
gcgagtgaaggagggcgctccattttgagcgggcatagttacttaacaaaattaccaaggggcaagataataaaaatagatttgcattactgtgccaccggaatgttcagtcgcagatgaagaattattccagatatcatggagcatcaaccagtatatggctttcgcatttggagtttgtgacgatctgctcagtccatctaatgagcagagcaccaccgttcgtctgctccttggtctccgagtcgcatgaggtcgccgtccgcgtcgaactttctcgggggcaggtgtgccttggtgaagacctccggcctgttgatgaagtggatgtcaagaaacaccccgacctgccggatgtggt

SEQ ID NO: 30246 - DNA, 1555 bp, Triticum aestivum
  Clone ID: PAT_TA_30246
ggtctttttttttttttttcacagaaagacattgtgaacattcattcaaggagatacaaatcttcggttgtgttctttacagacacgctttatgatctatatataaatgaaaggaacttgccattgacatacccatatgcattccatctcattcatttatactgaaaacttctggaacttctgcctagtgactagacacgatggtttaagactgactatatccgtataatttttttcatcaatttatagatgaaaagggcatgaaaataaggtctatctctagaccactaacatacacgatgcaaatagtcatataagaaatgtggagtgagtttgttgcatgtacttcatggtggggcgggaaggagcaaactggaggtttgcagttgatcaacgaacagagacgtttttcatctttccggacctgtgcctgacaaagaaagcagctagcatacttttggtgcggacgggagccttttggatttgacgccctcttgtgttgtcgagagaactgaatgatgccaaatgccttgcaccaggctgatccttcatgccaatgttacgcgtaacaatgttcgagctgctcacattcgactgcagactcctgggcaagggccgctgccgaagggtcctgccgccccgggcctttgggcggctggagctcctcgccgaagctttcgttgccccattgcccaactcagattgttgtcccccagtggttttggtgttctgccctcaagccaagtgccagaaaagagtcttctctgagggataaggtttaggcttcaagtcaaactcggcgtctgtttgcatctcagaaaaggcctgcattcttttgtttccccgccgttggtacgcatgtaatgtttgtggtgtcttgtggcgtttccgatcatctgctgctgcctaaggccttctttatcggtgtaagtttggcaagtcaggacttgctggttcaaggatgctactttcagctcgacagttgagacctctgaaacctgttgttcatacaggtctgtcaatttgtaggcaacggtgccaaggtggtcgaccgcgttgaccagcgccctgacagcataatccttcaagttgtccagcacgatatgcttctgctcgctgtggaggtacgacttctcgcagtactccgcggcggagtaaagctgtgggcgcaggttcttgagctcctggagcgccttgacaaagctcttgctccgctccatggacgcctcgtcgaaggtggtgggagcagggcgggcggggtccgggcccggacgcccacgagggcggcgcctgcagctgcggctgctgcatcgcggtcctctgctcgctcctgtcgtcggtgggaacgggaagcggggaggccaaggcacgtcaggaggaagcaaggcaaggtagcgaatgcgattcgcctctccggcgcgcccgcctgccgagtgctgcagcagcagcagctcgcgtattggaggtagctgctctccggctccggctgcgtgcgggagtggaggcaggtggtggagtgggggcggggcagcgaccagcgagcgaggaggtgagc

SEQ ID NO: 30247 - DNA, 398 bp, Triticum aestivum
  Clone ID: PAT_TA_30247
cgaagcggtacggcagcttcttcgagccttgctcctaccttgccgaaagagcggcaaaagggattcctctgagtgcaccagcagcaagtcaagtcaaggcccggctataggtgatggtaggtctggtatttctgtcagctgaaggaaattatgtcaccgagtaataatgcgcgatgaaggtggtgattagtggaaggggctgaataataataacaacacgtgagctgtatattgggaagcaaaggaaaccgtaactgattgcggttggacccttggaagagttttatgtaatatgcgcaatgattcttaaataatattgcaaatatgctctgtcaattcttttgttacgcaccgaatctgtcccgcaacagcggtgaatgtccaaacctgaatttctg

SEQ ID NO: 30248 - DNA, 570 bp, Triticum aestivum
  unsure (1)..(570): unsure at all n locations
  Clone ID: PAT_TA_30248
attcttctctcagcgtgcaacatcaaaggttcctggtgctacagacttgggtttgatgcctaggaaaataacgaaagtcgccattctaggtggtgggcttatgggttctggaattgctaccgcaatgatactaagtaactatcctgtgctgctgaaagaagtaaatgagaaatttctgaatgctggaattgacaggatcaaagccaatttgcagagtcgtgtgaggaaaggaaaaatgacagaggagagatacgggaaggctttatctcttctcagtggtgcccttggttatgaaaagttcaaagaagtggacttagttatcgaggctgttattgagaatgtgaagttgaagcagcaaatatttgctgacttggagaagtactgcccttcccattgcatccttgctaccaacacatctacgattgatcttaatctaattggagagaaaacaaagtnccaagaccgtattgttggtgcacacttctttagtnctgcgcatgtgatgccactcttggaaatagttcgnacccagcacacctaagnacaggtttgttgttgacttgctggatg

SEQ ID NO: 30249 - DNA, 2625 bp, Triticum aestivum
  Clone ID: PAT_TA_30249
ccacgcgtccggcggcaggcgggatcgacctcgcgaaacggattttacaagtgcgaggcatagggaggaaggcaactccggagcctgagatgatgacgtagattccgaaatctgggagccggccgggaggtcctccaaacgctaagtcgatgaaactaagtaacaaggctatggtgcagatagtattatttgcgatcttaaaggaagcttgctttgaccggaaggaggccaatgctctgaaggattcgaatctagacactgtgtcaatctttggagtgggcttccctccttacaggggaagggtcatgttatggtgtgaatccttcggcgcaaaatacatcgacggcaagttgcatgagtggatggagcggtacgacagtttcttcgtgccttgctcctacctcgccgaacgtgcagaaaaggggattcctctgagtgcacctgcaattgatcatgttaagttcggcgtagaattaatggtaggcctgggacttctgtccgcttaatgcaattatgccgccgagtaaaagtgcgcgatgaagtctggttatccgcagcccagcggaggggggtaaataaggataacaacccgtgagttggctataagatctccaagaaatcagtagcgtattgcagttggttcggtgttggaattcacagaatgtgggtagcgatgattcaatagtctctccaaatgatttattctggaatgcctgtgtgaggccttggagattctgaaatctgaaagggctctagctcgaaagcagtctgccaatcttgaccacctggttatttttattgaggtcattgaagaaggtatagtttcaggacctcgagctgggctctggaaggaagcatacgcattccagggcctttgtttctcagatacttgtaaaagcttacttcatgggtttcttctctcaacgtgcatcaaaggagggccattcctgatcctgaatttatgacgtacattcagaaatctaggagcatggcaggagtcactccagatgctgagttgatgaagctaagtgacaaggacatagtagagatggtgttcttcccagtcataaacgaagcatgccgtgtccttgatgagggcattgcggtcaaggcgtcggatcttgacatcgcctcaatctttggcatgggtttcccaccttacaggggaggggtcatgctatggggggattccatcggcgcaaaatacatccacggcaagttggcggagtgggcgaagcggtacggcagcttcttcgagccttgctcctaccttgccgaaagagcggcaaaagggattcctctgagtgcaccagcagcaagtcaagtcaaggcccggctataggtgatggtaggtctggtatttctgtcagctgaaggaaattatgtcaccgagtaataatgcgcgatgaaggtggtgattagtggaaggggctgaataataataacaacacgtgagctgtatattgggaagcaaaggaaaccgtaactgattgcggttggacccttggaagagttttatgtaatatgcgcaatgattcttaaataatattgcaaatatgctctgtcaattcttttgtcaccaaccgtggttgggaattatactggttttgccgtcaacaggatgttctttccttacacccagtcagcactcctgtttgttgattatggtatggatgtttacaagatcgatcgtgcatgtaccaaatttggaatgcccatgggtccattcaggcttgcagatcttgttggttttggtgccgctgcggcggcgggtatacagtaccgggcgcgtggcccggagagagtctacaagtccatgttaatccctattatgatggaggccacgcgtccgggcgaagccagtcggaagggattttacaagtacgaggataggaggaaggcaactcctgatcctgaaattatgacgtatattcagaaatctaggagcatggcaggagttactcccgacgctgagttgatgaagctaagtgacaaggacatagtcgagatggtgttcttcccggtcataaacgaagcatgccgtgtccttgatgagggcattgcggtcaaggcgtcggatcttgatatcgcctcaatcttcggcatgggtttcccaccttacaggggaggggtcatgttatggggagattcaatcggcgcaaaatacatccacggcaagttgcaggagtgggcgaagcggtacggcagcttcttcgagccttgctcctacctcgccgaaagagcagcgaaggggattcctctgagtgcaccagcagcaagtcaagtcaaggcccggctataggtgatggtaggcctggtatttctgtcagctgaaggaaattatgtcaccgggtaataatgcgtgatgaaggtggtgattagtggaaggggctgaataataataacaacacgtgagctgtatattaggaagcaaaggaaaccgtaactaattgcggttggacccttggaagagttttatgtaatatgtgcaatgattgttatataatattgcaaatatgctctgtcaattcttttgttacacaccgaatttgtcccgtaacagcgtgaatgtttaaacctgaatttttgaaaaaaaaaaaaaacaaaaaaaaaaaaaaaaaaaaa

SEQ ID NO: 30250 - DNA, 614 bp, Triticum aestivum
  unsure (1)..(614): unsure at all n locations
  Clone ID: PAT_TA_30250
nnnnntagctgagctgatgcgatnnnnnccacnnngnnnnntagtttctccatcgctgttgtatgaggagccggtagatagcagggtagacccacagtgtgcgccaggaaggaacatggaaaatcacagagccggggtcattgatgggaggcagcaaatcagacgcacaattggaatgatgatctgcaaaagcgcagcgccccagcccatgccgtcgaacccggcaggcaacaacgcacaaaacggagcaggtcccgtgggaaggactgttggccggcaatctgtcgtagcagcgccacgatccgatctgatttggggattccatcgagggactcgtgtcctttctgtatggcgagtactaggcgtcatccggatgacaggagccaattgtaaaccgcctctcccgccgttggattaaactctgcgcagccgtctgatttgacaaaaaggaccacaagcgcaacgctatggaatttgaatccgtcgcctctgcagcgcgacaccaatccatcgccgatgatccattgcagttccatggaagcacagatagccagccccccggcaatgctccggggcagcactgcacggtgcagcaaagctccgtcacctcgtgc

SEQ ID NO: 30251 - DNA, 1130 bp, Triticum aestivum
  Clone ID: PAT_TA_30251
atgccaacagtgaagtgccacctggtgcaactccacaacaagcccttgacgttccacgttcgagagaatgatagctcttcagattcaagaagcctcggcgtaccgaatgaccatcgtcttccgcaactagcgagagatcaaaagggatggttttattacagaaactagtttagaactgtcatcgggaaacaccctccggatacttcaggttgcaatgcgatgggcgagcatccgcacattaggcagaacgtgtctcctccagcgttggaaggggaaattgtcaggttcccaactttccaccgcattttcgtagcaggaggcagcaaggatcatctcatcttagatgtttgctaccccgactacgtacgcgttccaagcatctgcctggttgaaatgctggagctcctcgtacttcacgtcgcggtcggcagtgtactcggcgtttccgcttgatttggtgtccggcatctccctgacccagacgtggatggacttaaatccagcttcctccaaacagtccttgatttctggtatcgaccacaggcgccaatggtacgtgaaagcatgccgtatcatttgcttctttccaacttgaaagtggaggctgatccttgtttcacgagttatgatatcaaactcttcttgctcccagaaataagtgaagctggggaatctcctctggagacgaagcttgcattcagatgatgtgccaccatatacatccatcacaaatataccgcctcttttagaaagtgcattgaaagcatgcctgaaatacaaaaccaagtcctttctcttgtgaaggcaacaacaactgtagttgaatgcacaaattatgtctcttccaggcaaaactgcatctgacatggtcgaattggcttcacatttcgtaaatgaagaatctgactgctcgcagctgttcttttcagtacagccatcgtcactggtaacatttagaccttgtacgagatcactgatcttttgcttgacaaggcgagattcatttggctgcagaacatttccatcaaaaagcaacaatctcgaagacccatcagctccaatcttgctcagattgttctcaagacaccactcaagtgactcacggtcaaagtctaagcccactgctgttc

SEQ ID NO: 30252 - DNA, 693 bp, Triticum aestivum
  Clone ID: PAT_TA_30252
gaagaataagagaccttttacggtaccttttattctcgtatacatgagtacaaaatcagcacatatggcaccatacaagagcaagtacgatcggtcgagtagaaatcaaagagtgcacattgatctaggacttgaaagaacgaagcacgtacgctcggccttttattttggttattatcaggaattaagtttcgctcgtcgtgtcacgtaacatcgcgcgtacgatgtaggaggttaggcggcggtgacggcgatcttcatgccggactggcagtgtccggggatgctgcagatgaagtagtttgtgccgcgggcgagcgtgacgcggtcggcgccggacttgtagaccttggctcccttggctggcttggcgcaggccctgtaccccgccgcgctcaccgccaccacgtcgtgcgccgtcgcgtcgtacttgaacactaggacgtcgccggccttgaagcgcttgccggtgggccaggagttggtgttgaaggaccagccgccgcggtcgccgacgttgaacaccgccgcctgcgccaccgccgcgctcaggagcacgcagacgagcagcacgcccacgaccacggctgcactgcctcttccctgggctgccattgctagctagcttaggagcgcctaccaatcaaacagtcactcgagagtaggaggagaagcagaggaggtcagagagtg

SEQ ID NO: 30253 - DNA, 839 bp, Triticum aestivum
  Clone ID: PAT_TA_30253
tttttttcagttctattttattttacatagcaatataggacaccaaattttagtctttggtctctatgcagcagataatacaatacacacacccttacaataaatactaagatcaattgatcaataatcagaaagacccaagcacgtacgctcgtccttttatgttggtcattaggaattataagttgcgtacgatgattaatgtaacgtcgcgcgtacggatacacggtgtcgcatgtgccgatggaggtacgctaggccggtagtgaggttctttcttcgttactggatgtgcagtgtccggggcacgctacagcgtgacgtagtttgttgcacgccgggcgagggtgagcgcggtcggcggccacggcggtcttcatgccggcccttggccggggccgggcagtgcttgcagaccacctcgttcgccccccgcccgtcgtgcgccgcctcggggtgcctgaccactaggcacgtccccggcctggccgggctggccgcaggccttggagcccgtggcgctggcccacccgccgcggtgccccacgtcgaaccccgccgccctccgacgtgagagggcagagaacacgcacggcaaggcgcgcggccgcgttggaagtgcctcccgccgcgtgcggccacgttgctagctaccttagctaggacgggcctaccgatcaaatgccagccgaggacgacgcacacacgaggactgaggcttgcctgcggcagcattgctagctaggttagcagctaccgatcaagcaggtacgaggagaggcaggttgagaggagaaattcagagagccgcgtgccgaattcggcacgaggcctcgtgc

SEQ ID NO: 30254 - DNA, 616 bp, Triticum aestivum
  Clone ID: PAT_TA_30254
gatgaatgcgactttgggtacttcttaccactttctttcaaaaagaaaaggtgaaaaaagctacatatttgcgcacacacacaaacacagtcgtgagactttacttattttaaagcgcatcttttgttgtgatcacatatagatcggctgctgaccaacatgtcagtggagtaaaatcctcgtggccctgccgtactcaataaggtcatccaaaatctcacccaggctctcgtacttgaagacaaacccttccccaacaagcttctgtgacgaaatgcacactttcggttgctcggggcacccacgaaatcgatcggcattcacattgtattgcgggtatttctgtgccatgagacgagcgagctgtaaggcggtgatgttgtggctgcagcagatgtacctcccagatgaggactcattctcggcgacgaacacctcggcgcgacagagatcctccacgtggactatcgacacggtgccggtgacggactgcaagccttccaagatggccaactgcgcctcgtcacctgacaacaaggagagggtgacgggaacgctggatgctgctttggagaccggcgcggcgcccaaggtggacacgggcaacacggtgacg

SEQ ID NO: 30255 - DNA, 708 bp, Triticum aestivum
  unsure (1)..(708): unsure at all n locations
  Clone ID: PAT_TA_30255
gaatggaacaaaacacatcaacagaagcttcccataccaacagacagacactagagtctacatacagagttgcatttaaaaaatgaacatcatccaaatacagtcgatgacaaatgaacatcatccaaatacagtcgatgacaaaggagcaacaatctagctggcatgtcttggaaccggacagaactccctgaagccttataaatagaccaccacgcagggagcagacatcaagcataagtgcaagcaagcaaccaaggaagctcacagaaagtcattctccttcagcaccatgggcgagaaagtttgtgccagcgatctcatcagagtctacaagggtgaaaggcggagcggggttcggccgctgccgcgtcgtgggcagataaagctgaggatcgcacacatcgtgatgcactccgtcgcttcggcgctcctccccaggactactacgtcgcatcttccagttcttgaccacaagtgaatgtgactgactctgtacatgttaggatttgtctaaaccgctcccctttgtaaccatttttatcggttcgagaaagttgcttctctttctgcacatcgtggtgtgggcttcatgaatgatgattgggtggttcgctctcgcttttcgtgctttgatcttcttgtcttgcatccttttcgnccttgntttgatcactaccaggctgtttacgatctgatttgctcgca

SEQ ID NO: 30256 - DNA, 263 bp, Triticum aestivum
  Clone ID: PAT_TA_30256
gaaaagtacgaaaaaaatattgtagagaactgtctttgttcccatttatcagtagcaaaacaatgtacgggttccataaaacagagctcaaacggcttgtacaaactcttatggtgtgggattctgagagtgaacatggcatacacgcatgctctgtgtttctgcaggatttggtcgtctcagtaaatgttgttgtcaaacacccagggttcatgcttgaacagctctcggccattcatcggacgcgtgggcgaacgcgtggg

SEQ ID NO: 30257 - DNA, 704 bp, Triticum aestivum
  unsure (1)..(704): unsure at all n locations
  Clone ID: PAT_TA_30257
cttttttttagagaatgtctttgttcccatttatcagtagcaaaacaatgtacgggtcccataaaacagagctcaaacggcttgtacaaacttttatggtgtgggattctgacagtgaacatggcatacatgcatgcaatgggtcgtaataaaatattgtagagaactgtctttgttcccatttatcagtagcaaaacaatgtacgggttccataaaacagagctcaaacggcttgtacaaactcttatggtgtgggattctgacagtgaacatggcatacacgcatgctctgtgtttctgcaggatttggtcgtctcagtaaatgttgttgtcaaacacccagggttcatgctggaacagctctcggccattcatttgcactgcacctgaagctatatccgcggctcgcttctgagctgcttcagctttctctgcagcttcttctgcatccttccgctgcttccaggagaggaactgggctggggtgatgggcggcggcgccgtgcccgcggttgcggcgggctggccaggggtgggctctggcggcggcggccgccggctaccctcgtcttgtgcccccatcacgagggacgctggaagctcgacccacacgaacagaagccgggccccgccggcntgagcctataagcgcgccacggcgtcgnttaaangtcngacggaaaacctgngtaccaattanccc

SEQ ID NO: 30258 - DNA, 681 bp, Triticum aestivum
  Clone ID: PAT_TA_30258
ccctatatatatataataataaagcacagattgactttgtcgggttcaccgtcacaatacgctttttcccgtgaatttacgctttcagtttaaaaaaaaaggaaacaaagagacgtaacaggcccggtaaaaaaggaaaccttcccgattgcatcggccgtcatctgatcacttctccttcccgattggatctcttcttgcttatcccaacccatggacgcagtcttttctggacttcgcttcctcagccttgcttctcaaccgtcgcggccttctcctcctagctctcggccaccatgctggggcccttcgtcgacgtcgtttgctccgaagaggtcggcgccataaccacgtcgatctcgctcgatgcgagaatcatgctggcacagagatttggtgttagggttccgtggatgaaagcggtttcaagtggtggagggaggtggcttctgtggcggcggatgcggtgagcgccggcttcgatgtgctggagcggcagcagcagctacacgtcccgctttgacgccatctgacacaagcgtcgtgcagccgaggtctgcactagacgtgtgctcgactccctcgtcgccacgatctagctctccgtcgacagctccctgtcgtgctgtcaagcagtctgagactactgccgatgtgttgtggagatatgatgaagaagtg

SEQ ID NO: 30259 - DNA, 906 bp, Triticum aestivum
  Clone ID: PAT_TA_30259
gacaaattaatcatgaaatgaaccagtcacccaggcacatgcttcgcagtaatacagtatatcagtacaagctttgacaaatcaagaactacaaggcgacgacacgtcactcaaacatcacaggtcacaccaccaccacactttgactttagtctttgcacccagacgaccaagttgatcatgcaaacactgcgaagaaattgacgccatgaattagctcggaaggagtagcaagcaaagctagtgcttgtgctcgaagtcctcggtcgcgcgcgtgggctggtagccgatgccgtggcggttgttggggaacatcatgaaggcgtagctggcgacgccgccgacgaccggcggcagcacggccatcatggtcctctcgccggcctccaactccgggtagaggcaggacacggtgtccctgtccagcagcgcgagggtggcgaacacgatgagcgagagcgcggcgtgcacgaagtcgccggcgcggaggcggtacccggacaggtccctggtggcgccggcgtccgggtcggcggagaaggtgcgcatcccgcggcgcgtgacgacgccgtagtagaccctgccgtcggagccgacgtagctgtcggtgaaggaggagaaggcgcagaaggcgccgcagagcgcgaggagcgcgccggagagcaccttgttgtaggcggcgcagtggccgttgttggtgacgagcgggctgaggaactggaacatgaagaccgtgccgctcggcagcagcttgatcaggtccgccaccccgcgcagcgcccgctccgccacgcccacgctcctcggcgccggtgccgccatcagtggccgcctcgtcgcgtcctggctccctatcttggatcgcactgttgactagctagactgcgctgccactgcgttcgtgct

SEQ ID NO: 30260 - DNA, 789 bp, Triticum aestivum
  unsure (1)..(789): unsure at all n locations
  Clone ID: PAT_TA_30260
caattatttgtttttaaggttattattttgtttttttttttttgtctgaaaactaagctgccactacaattaccaaaactctacatgagcgatcaaatgtcactgcggtgaatagatacagaaatttacacggaccaaaacttcagaattttttgccatcgaagctaacaaaacaggaaaaggaatttttccaactctgaaacaaaagcgagttaacagaaggaagatgccactggtttaatactaggcttctctaagttacaaaaaaaaatctcaaaaccctattcaagatttctttcctttttcctgctcctgccaatcaaatccatatatagaagagctttacagaaatttgttagcatctgcatccttcaacgccagcagttataggtcacggtcgacaactcttcagtttctcaggggaatggacattttctatctttgccagcaacatccaagagtgaaggcacagttttggagaatggcccaataattaatatttgcagaacttaattgtctttattttccaaagagaagacttagtcagcccttagtcttaagatttccttagctgttctcctccgaaagtattccatgtgttcctgaccaaaagataagctgactcctctgctgaggaaatcaatgtacttgagcataaacataccacaatccaacccattctcttgtaaaggaatacaatcaatagattctttggtcccanaacttatgtcaatctctttattactcttgtccttcacttcatctacaatatatctagccagcatttcg

SEQ ID NO: 30261 - DNA, 1293 bp, Triticum aestivum
  Clone ID: PAT_TA_30261
aaaaacgaaaatgcgtaaatttctcattttttcgatagtacatcacatgatacatactcccgccaactaaaacaaggccaagcgccaggtttacatgtaacgaaaaagaatggaaagccacaaaaatgatatcaaaactatgcaacacaacattacaggtttttcgacgagcctgcccaatcgctcagcactccgcgtataaatgcatatatgcgaaccaggacaacacaaagcgttggtcccagtttatccacttgatgcagtggccaccgccttctgcaaaaatagcagtatctggctgcctcagctcctggatcctgctgtatgagctgccttgtccaacatccaattcaaatgagcagctgcacaattggactcgcactccacgcagaggggttcaaccacagaagatatagagtaattaatactctgctaattcctactatgaccttcctgctgagacggcagacgatgcgtgtatctccaaagagtgctccggtatgtacgtaagacctttctcctttatggttatttgcaatgtatctagtgtaatgatcccatctgttaacgggagtagctcgagcttgacagtggtgcttgaccgtgcaggaacacaccctaggggaactgcactctgcaaccacaaatgagtacagcctgctgaagtgctcattctatttcctccattgtcactttcttttggagatccgacaacaacagaattcagtctccgaaaaccagttccatgttttcccaagccagaccttcccgtcgcctcggtcggcggatcataagaaccatcaggtgtggttggagctgagttcaatgatacaactgaagaagaaccagatgcttctggagcaagaacagttaatgtgaggttttctgaagtcatattagtagcttcaagggttaagacctgcacggggagttgaggaactcgagcactcgggctaggatttcgtaatgacagttcagaagacacagagatcataagatcactagctgcacagggttgccagcttgtggcttgcttgaagaaaagttttgattctgtataattgcagcgatatgatataagcacagcatactgatcagtaagaccagtgctgagctcgctaaccctaggcgtggaagtatttgtggcagctccactcatctttgggagtgacaaagtcagaggtacatcactgttgatcctccgatccctggaggacataattgctggcttcaaaataaacgagtgctcttcaccccgcctgagtgacagatttggtaaactgtaaccatgtc

SEQ ID NO: 30262 - DNA, 757 bp, Triticum aestivum
  unsure (1)..(757): unsure at all n locations
  Clone ID: PAT_TA_30262
ttttttttttttttttttttttttttgacggtagaaaggcacacacaaagtacgtttcttgacataagttgtcttgtagttcaactcatacaatcgtcttcaatcacatccagatagtttcagctgcatctcaataatattaagcttcaattgccatcaagagtagaccacgctcagtcaatcagtcggaccaaggcgaagtcttgtcgatgcggacgttgaggggcatctccatggcgcccccgtccgctcctgggaccaggtacacctgcggcaccgcaaggaacgtcggctcgccggcggcgaccacggcgccgggcgaggtgctgctcctcatctgcatctccaccagcacgatgtccgccttgccgccgttcgcgaccgccgacgccgccaggttcacccacatcttgcacgtgaatcgtggccgcgtcgccgcgctcgccctggcgcagaccacggacagggcggtcgccgcggcgccgagcgcgcccacggtgaggacgaacacgcggccgtcgtcctcgttgaccagcagcagccgcggcgtcgacacggttacctggaaccggctcaccttgccgtattggatggtgcgcaccgttaccaaatggtcgtttctgaggtgttcagttagatccgtttgcgttccgtcgaagacgcattcggtctcctttcattttagagcgcgttcggaaccacactgcgannnnnnnnnnnnnnnnnnnnnnnnnnnnnnnnnnnnnnnnnnnnnnnn

SEQ ID NO: 30263 - DNA, 1404 bp, Triticum aestivum
  Clone ID: PAT_TA_30263
cggccgcgtcgactttttttttttttttttttgcaagaatcaggggggagtgtctccctgaattatacctgtttgaaatttcatattacatttctttctctctgagttttatgtttcaggttctcatcaagaatattaatgaagaattgctggagaagaatccttttgaggtgatgatgcaactagagagggcaaagggaagtgccctccccatcaaatttgtcattgctttcttgcagatcagttctgctcggtcttaaccaaggaccgaaccaaagttccgatggactgaagtctgggttgttgcttttggaggaaaccaatcagtctgcaatttcagtaaaccaaatttctcaattacccgaagcaccgaaccaatcggttcgggggaaccgaatgcccagccctaactgttatatgtaacatttcgatgtggatgggttcttcaccctctctcctttaagatatgatacgcatgcttgcatattcaagaaaaaaaatgctgcaagaatctggtttttgacaattatttaccacaataccaagtttaaaaccatcttttcaccattttgtacacaaccgcaacttcagcaggtcattcctatgatagtccagctaatccgatgcgatcctcttcttcagcactgggtccatggtgtgctacagtgccccgatttcgagttgtaacattggtgataatattggtggtcttttgagaagcaagagcttttaacttgttccctgtagctagcagaagtaagctccgcatatgttgcttctgctcttttggactagcagttttgctcaaacaatcatcaaaagctagcaaatcttcctgcttcatgtctgagagggatagaagaacctgtttaggtgcaggatctttgtctgacagataaagatatatttctcgacaaagtccaataagctctgcactaacaacggcattcaactcaacagataagccctgtattatagaagaaaatagatcgttcccaacaaacccccgcccctctgcccggtttgttgcaacagcaaggtgaatcaatgcaccacaaaagggtattactttagtcactgcttcactatctgtccaactgaacacttcaacagttattctcaaagcaggaagggcagtgccaacattaagcataagaaatccagtaagagagctggaagcaaatgactccagacttttaagagaagaatcaatccggttgacaggtccaagttgttccaaagatggaagtccactgttcaaaccaggtaatgctaaaacccaaagcacagaacaaacttcacgagtcaagtctcgtaacagcttctcttccatcacctcaaccttaagttctgacccagaaagattaccgaagctatcaggaaccttagctcgtcccctcgtgc

SEQ ID NO: 30264 - DNA, 834 bp, Triticum aestivum
  Clone ID: PAT_TA_30264
ctgaaccgatttggtgctgcatatatgtatatatatatacatggcaaaagagcggagatcttacatacatgaacaactcggtacgccggcccgtgatactgttctaataagttacaattccagaaacagaatggattgcagaattgttcagcaaaactgaacggctactacattgcagaataggacccctcgcggtgcgcctgccaggcgaaactcgtcaagcttggttcgctttactagcgatggcggaggcgtactcggagatcgtttggtcaggcgactgcctgagatgcacgatgatggggagcagctcggatgaccgcaggaagagcctgcacacggtgtggtcgcacatcttgcgcagcgcgaagagcacgattcttagtggggattcggttagagcatcctttctgctggggctcagagcaaccgcggagtagctgctgaccatcttcagtagggcctgaattgcgccttgggatacaatgtctccacagagtacgtcagagttcctgactagattactcagggcccctgcagcattgcctttggttttatcttcctcaggagcaagaagtagcttagtgagctgaggtatagatcgtctgagttcttcatacagcttgtcattgtgataagcagcattgcctacagcaaaacatgcaaacttccgcgtccgcttgtcagggtcagaacacctgtcaactacaagctcaatcaccttatttgctgcaaatggaccatagaagtagggactgtgtcggcacatgttgccaatggcactgcaagcttttgctcttatatcggggtcctcatttgatagaaaattcttca

SEQ ID NO: 30265 - DNA, 630 bp, Triticum aestivum
  Clone ID: PAT_TA_30265
atgcgattaactgatatactcaaaaccaatccttatgctaagtacatgaaagatattattacaaataaaagaaagataccgaaagctgaaatttccaccacgcttgtatctctccctaataataaagtatcgattgagtctccgggttcaccgtcacaatgcgctttctttcccatgtcataatacgcttcttcctgtccgttttttcttgatttgatatttttcttaatatccaagtgtactatctatatgcgtccgtacgtgcactaattatatattttccatatgcgctcttgctcgggccttgccttgcgatcattcgtggctgatgcgttgccacttgggccttagcccgtctgcgtgagatgttccagcgagtgtttctcaatcaaaggaaataaaaagtgtagaaggaactcaggtcatgtcatggttggaagggaggcagcggtcgactgtgggatggcaaaagaacagaggcaagcccggacccggcctcagagcagaggacgaaaggggcaccggccgggagcacgtcggacaccgccgccaccggcgcctcgctcgacggatccaagcaaggcagctcgtcagagcagaggaagaaaggggatggacaccacagccacc

SEQ ID NO: 30266 - DNA, 1397 bp, Triticum aestivum
  Clone ID: PAT_TA_30266
gggctcccgccggctgctctccgcccagctgtcccgggtgccgggtacaggtagttctcccaattagcagcacttccttctaccaagctagagatcgatgcagcttcaattcaaaactgggtatcaaagaacaatgtacggaagaacatgccatttagttcggcatgatcatcacggtctacaataacaatacaacatggccttctggttctttagctaatcagtacacataaggtagaatcctccagggcacaagcttgcagtactctgcccagatgtccttgtacttctccgagcacctcgcctcgtctcttctctccctccatatcagcaggatcagcaggtaggtcgggtagaagtacgggatcacggagctggctccacaaggcaagctgaatgagagagccagaagcagatctccaaggtaattgcagtgccttgcaatgccccagtagccagatacaagtagttttcccccaacaactttgggaggtttaccccatataggagctttaggatccttcttgaacaaatgtttctgtttgttggcacctctgaacactagatagccaataaggaaaatgatgcagttagcaacggaagccaacagtggcagctccactttgtttccaagaagccaccaaccctgaatagtgaaggtaaaaggaatgaaaactagatcaccaaacaccagcatgaatcccaacctttcagcaataatgtcccatgtggaggtcatgaattcttcatgaatgaagtaatctataatatacccacccacaaaagaatggtaaagaatgactgcacggttaactgaaccagctaggtagctctttgcaagcaaagagaggttgataaacaaccatgccatcattccagcccttatgaaaaagaacttgaggtcaactcccatgaaatggggattaagctgcactccgaaccaccaatcttctatgaagctcccagtagcatgtggtttcaatgaagaactttgatggcgggaccttaacccagtataatagagcaggaaactgacaatgacactgaaagtgaaggtggtcgacagcagctcgagcccacggtcagccacgaccgtgggagtcatccagcccgtgtagacgccgagcgcggagagccccaggagcagcaggagcgagagcagaccattgcaacggtagtggaggcgggaggagtcggggaggacggcgccggcgacgagcttgccggggaggagggcgcccgcggcggcgaggtacgcgaggtaggaggccagcaccaccgccgcgctccaggagggcgccagcgccgcgagcacgccggcggcggccgccgcgtccatccccgtcgtcgcggcgaaaggggatctcagctagtcactctgaagccaaccggccggc

SEQ ID NO: 30267 - DNA, 528 bp, Triticum aestivum
  Clone ID: PAT_TA_30267
attcgcgggccgacgggaccatttaccgggaccctctcaactttcttgcacatgctctgtggatgaaatgatgataccatgccaactttcaaccttttcagagttcattttgaaatgcttttcattttcagggccatatagctcaaaataatcagtaaatgcatgaaaaataacaaatgaagtcagaaaggtttgagaattgatgatgtggctttgaatggtgcattttgaacacacaaaaagtctcgagttcaagtaatttcaaaaaatcaaatccctttgtaacagacgagtttccgtatgaaatcctgatacttcgaaagagattgtccgttttgtacacgaagtgcatccaggttttgccgtaaccctctcaactttttagcacattctatgtgggtgaaatgatgataccctgccaactttcaaccttttcagagttcatttgtagtgcttttcattttcagggtcatatagctcagaaaatcagtaaatgcatgaaaaataacaaatgaagtcagaaaggtt

SEQ ID NO: 30268 - DNA, 663 bp, Triticum aestivum
  unsure (1)..(663): unsure at all n locations
  Clone ID: PAT_TA_30268
gatctaatccaaccaagatttgccggtttatatatacgacaaagcggttgcaattgtaagagcgcgagaaaactagcatgttgcaaggaagcgaaatcttatgtactaggaagtttttctctggcatctaaaattaatctatacaaacgcttagactctggcaaaatatcgaaaactacctaataccaccaccaccctatccatatcattccttgggcgcttgttgaaaatgacacctcaacaaactgctaatccagcgttatgtgaaaaccttgatcatcatatttgtaccaaagaaagcaccggtgaagcttggcgaatcccgcagcaacaaacttatgcacacgaagcaccacatgagcctctgagcaagatgcacaatcccattccatcatttgtaggaaacttcaattgggcgtacaaaaccagcgacagatgtagtaaacctcaattgggcggtcaaagccagcgacggatccgaccaatctgttggtaatcacctctgctgacctgaatcctaccttatcaagaagtacctcccggaatttctcagggtatatacagatatatttgaagttttctttggcaaactctgacactaatctgtttttcctatacgaggtnccaaggttgaggctccatgataaaaatcctcgtgccgaa

SEQ ID NO: 30269 - DNA, 798 bp, Triticum aestivum
  Clone ID: PAT_TA_30269
gcctggccgctgccaccgggtttggcattacccgcgtacctgcgctccatggagggtcccacgttgtgcaccgctaagtgtccctgatttgggatggctgcaagcagatgctcggagctcccggatggcaaccgtgcatgtcgacactggaaccagcagtggtgcagagattagcgagatatggggtctgacggcgccgcgccaccgattctcgctataccaccaccatcggggtcaagccatcagaaaaggatggaagggcatgagattgggtcggtcaggtgtcctagcgtgttgcacattgtgtggtttcctatatgatgatgcgattggttgattgattctgcctgggttggttggttggctggtgttgtatactgtcctctggttatacaggtctgctcaaagtgtagcgtgactgagtcgagcggtaagaattgaattgcgatgggaggaactctgtttttgtcgagtcggagaaggcggtgcgggtgcgcgccttgtggggtggtcggtcgggcgggccgatctgtcgagtcgctggttgcagtggcgcctttctgggggttctcttgtcacaacactggcaaccccagcagcagcactgaaagagttttttttgtagaatgtattctatgtgagagaaaagagagagagagagagagagggggggggggtttaggtctagggtttgtttttgtaatccttgattaataggaagggcgtccttgtattgattcattcccaacaataataaaaaaaaagattggagcagcgtcggaacagcaaaaaaaaaaa

SEQ ID NO: 30270 - DNA, 1044 bp, Triticum aestivum
  Clone ID: PAT_TA_30270
ctctgaatgaagaaaattgcaatgaagataatgcatgatgttgtttcgcagattacatttgcattcaatggcatctgaaattgtacaacttctgcttcacgcccatggtaaattaatcaaacaaatgtgcttttggtatgtctgaattctgaaactatcaagaatttattttctccagcagtgttacaaacacctcactgtaccattcaagcaaaatgcattctaaacactgaagcaattccaacccagactcttttaactggaacagacttttcagtcatccctgatatataccactatgttgttctgaggtaaaccatccacataagtactggtttgctattcagtaatactgatacaacagcctacatataacagacacttttatgttaagagcaccgcatctgaggctaagaagacactatttcatcttaacatttgcacggtggaacacacacttatgcagagaggaacagcaacgaacacatagtcatcaggactgtggtcaaaactgtgcttggaatgtataaactcaccattaaccagatagcgcgatagacaatcaaggccacagtgtgaccaccgatacaatatgacgatccttgccctcgttcgaacggcaggtagacatatgagcttgcaaattcattgtagatctctccggtgagctccccatgcagcgcacggcagtgcatatacaataccacgttgatcaccattccatacagcatcattgcggccaacaccgccgctccaaccatggccttgaccacagccggccccatgccagcccaaccggtggcagcatcatatgtctccatggccaccccactgaaaccccagagtactaccccaatgcctgcggcaaagaccaagaacgcggagagcgccgccaggcgtgcgccggagagcagccggcagctctggcggagcggggagggcccagcagtggactccacgatggctgcggcgccggcgagggaccagaaggggactaagagggcgacgccgagaagagcaatacctgtgctgatttcagcgggc

SEQ ID NO: 30271 - DNA, 3649 bp, Triticum aestivum
  Clone ID: PAT_TA_30271
cggtctcctccctcttctccctccctccaaggttctaccgaggtttctccccctcctccccggcgacctccacctcgccggctccaaattccggccgccggtgcttttttggcataggcgaatcaactcgtcgagccctagaagccatgccaaatggtaacaagcctgaactgaacaagcctcaagtggttggtgctgatgattttttggttgacgcaagatctacaaggatgtgaagttcaattcaggcgctggctaccattattcaggccaaggtaaattatgaaataacgagttatcaacttgtgaagagtccagtcttgctgatgctgctgctgatgctgatcaatttttccatagatgagagttcgtaccctaattttactgtgtatacgttttttgatctcttaggatttttgtagccgatggccctgcatgcgctgcaccatcaccttgtaataatgtgtagaatccgggcaccaaacagaaaccaaaaagtgtatatgagatccatagatgctgaggagtaccgccagctcgagggggagatgctcgaccgccacctcgccccccagctgccctacgtcaagtcgctcttcctcggctggttcgagccgctgcgcgacgccgtcgcccgggaccaggacgtgcagcgccgcaagcgggtcaagcacgtctacgccaagtacctgctcctgctccccgccgagaaggtcgccgtcatcgtcatgcacaagatgatgggcctcctcatgtccagcaaggacggctgcggcagcgtccgcgtcgtccaggccgcgcactccattggcgaggccgtcgagcgcgagtacaaagtccaggctttctttcagaagactaggagaaaaactaggagcaaaactgaaagtgaaaatgatccagggttagacaaggaacaggcaaaatgccggaaacttgttaagagtttggtgaggaggcgaaaatcgactgaagcacagaagcttgtgcaacaggagattgaattggaggagtggggcacagaagcccaagtgaagctaggaactcgcctgattgaattgttgttggattcggcatttgtgcagtcaccagccgaccaaacacccgacagttctcctgattttcgacccgcatttaagcatgtattgcgaaagcctattgtagaaaatgggagactaaagaagaagcacttcgtgatagagtgtgatcctcttgtgcatgaggggtttgaaagcactgctagacacgtggagataccctatcttcctatgctggtacctcctacaaaatggaagggctatgataaaggtggacacctttttctgccttcatatgttatgcggacacatggtgtgaaggatcagaaggaagccatcaagagtgttccaagaaaacagctgagaaaagtattcgaggcattagatatccttgggggtactaaatggagagtgaatagacgagtacatgacgttgttgagactatttggagtcgtggtgggggtattgcaggacttgttgataagggaaatattcctctacctgaacaacctgaaacagaagacccagatgaaatccagaaatggaagtggagcgtaaagaagacaaagaaagctaaccgcgaactgcatgctgagcgatgcgatacagaactaaaactctctgttgctcgtaaaatgagagaggaggatggcttctattatcctcataatctagatttccgtggtcgtgcataccctatgcatccacatctgagtcacctaggttcagatctatgccgaggtgttctagagtatgctgaagggcggccactcggaaaatctggtctacgctggttgaagatacatttggctaacaaatatggcggaggcattgaaaagctttctcatgagagcaaattaacgtttgtggaggatcatttgcctgatatatttgattcagcagcaaatcctgtcgatgggaactgttggtggattaatgctgaggatccatttcaatgtctagctgcatgcatggatctttctaatgccttagaaagttcatcacctcatggtgctgtctctcacctacctattcatcaggatggttcatgcaatgggttacaacactatgccgctcttggaagagactacatgggcgcggcagctgtcaacttggttcctggagagaaacctgcagatatctactcagaaatagctgctagggtactggatgttgtacgggaagactcaatgaaagatcctgctactgacccaagtgttccattagcaaaggttttagttgatgaggtggataggaagctggtcaagcagacagtgatgacgtcagtttatggtgtcacatttatcggtgctcgccagcaaattatgaagaggcttcaagagaaagggcacattacagatgacaaattgctctatgatgtgtcctgctatgctaccagggtaactttggatgcactaggacaaatgttccaatctgcccgtgctataatggcatggcttggtgactgtgcaaagatgattgcttcaaaaaatcaaccagtcagatggacgagtcctgttggtcttccagttgtgcagccatacaagaaatataaaaactatatgatacgaacttctttgcaatgtctggctttacgacgggagggtgatgcaattgcaacccaacggcaaaaggcagcttttccaccgaattttgtgcattctcttgatagttcacatatgatgatgacggcaattacctgcaaggaggctggtcttcattttgcaggagtgcacgactcattttgggtgcatgcatgtgatgtcgataaaatgaatcagatcttgagagagcaattcgtggagctgtacagcatgccaatccttgaaaacctattggaagagtttcagacattattcccgacagtagagtttcctccctgcccagcacaggggaattttgatgtgagagaagttctcacatctacctatttcttcaactaagctcaccgggagagttatatgtaacatgtcacgagctctgcgtggttggatagctgaattgcctgatcattattcacaaatcacaacatgatggttgtgcggcggccagcggctgatgggccaagaagctgagtttttcaaaatctttggcgtgagaagcaattacagcagcaagccattgcaactcagccttattggcacaccagcaatagaagcgtgaatggtgttttggcatcggcaaatcaactcgctggactctggacccaggagcatgccaaatggttagccgaagcctgatctgaacgagcctcaagtagttgatgctgatgattttttggttgacgcaagatctacgaggatgtgaagttcagttcaggcgctggttaccatcactcaggccaagaaggtaaattatgaaatatcaagttatcaattgctgaagagtccagtcttgctgatgctgctgattgaattttaccatagatgagagtttgaaccctaattttactgtctcatacgttttttgatctcttaggatttttgtagccgatggctctgcatgcgctgcaccatcaccatgtaataatgtgtagaatttgggcaccgaatagaaacctgaaaagtgtatatgagattcatatagatgttgacatggaataaaattgtac

SEQ ID NO: 30272 - DNA, 967 bp, Triticum aestivum
  unsure (1)..(967): unsure at all n locations
  Clone ID: PAT_TA_30272
ctgtctgactttcggtggtaggcgtatgcttatacatttgtaacagtttcagtaattttttttttttctttttttttttttttttctgtaaggatccatagctcttttttttttgtaaaattgtttcatttcatataatgtcataactcagaacgtatgtgtccgtatcaaaggcactcgagcaatgcacaaggttggggtagctagctgggtaactcaacgctatgaataaataaaatcctaacaaaggcttgggaagctctatcgtccttgccgagagtatttcctcccgtctcttgcagataaatatcggcctctgcgctccctgactgtgtactccacctcatcatactcatcaggaacaaagctccgctggtcatgaaaaggtttagcgatccggcgatggggagcagcaacttgatggattgggatgacttctacttatctcgctttgggacgcctgaaggcggctgctgctgtcttcctgacccttgttagcatttcgcgtcccgttaccacactgcaaggctagaaggcaataactctcgctcgacaccgcgccttgcctccttgcgctacgttactacttgacaactcggcgagcgcgtgctctgacttgttgatttagcctaccagcgatcccgctctgggtgctgcaagggcctcctcctgccctctccccctgggggcacccgcctcggctgcgcatcgcgggacgcccacgctgttacgctcgttccgccccgcgctccgcttccgcgcgctgaggtgctacttgagaagttgaagccaccgtgagctcatgctctgtcttattatagtagtctttctccgatccaccactggttgcagcaaattcatcaacattctcacactggtagtgatgaccagccttgccagcgctggagtaatgcccactctgataagcacttgagttatgatcacctctaatgcattncgggcaagc

SEQ ID NO: 30273 - DNA, 605 bp, Triticum aestivum
  Clone ID: PAT_TA_30273
agaaaattatggaggaacacaagaatggttcgatccattctcacttgaacatgcctgaatacaaaatgttcctgttacattctcatacctacaactagaatccaatgttcaaaggaagcttatgcttcctccactgggcatgccattgattagtcctcctccactttctaaatacacttctgaacatctcctgatcagacaaaatcttattgccactggtgatgagatcatcacatgtatttctcctgcatttctatcaagaatcaatgcatcatcatcagcaaggctcctccccctgtgaaatagtgacctcccatctaatgttgagcctcctggcccagtgacattaaacctgatatggagcagggacagcaacactggcgggccagagcgggtcacatggccgtcgcctgtccccttctgatcaaagatttcacaagggcatcgcccctttggtagcgccgaccggtgatcggacatcgccccttcggtgtcggagagttctcatcgatggcagttcctcgccagttcgagagttctccgcatgaaggcgtaaatgacccgcgaacgccccggccgcgacgcgggcatgccctagtgaattc

SEQ ID NO: 30274 - DNA, 964 bp, Triticum aestivum
  Clone ID: PAT_TA_30274
gaattcactagtgttttcgagcggccgcccgggcaggtttttcaacttcatcatatacatcattgctatcacgagcaccatatacatcttctgctgtactttgtactactttgacagttgatgaatagatcggaaattttttcgcaaaaaaattagtttgcatatcatgtcatgtatacatgactaaactcatagaggatttcttttccctttatttagagtagacttgggagaatctatgcacggacgtgttcatctcagtttatgtgtatagcctttttcctctgcatcatgtggtcagaggccagagggtaacagctactcagcccctgtgcagggtgaagctgtcgtacaccttgccgtcgctggaccgccggtactcgaactggagcgacctggcgtcggacgccgtgagcttgccgaacccgtagtccatctcccggtacacgctccacggcggggccacggcggtgaagttgctcaggtggctgccgccgcccccgacgacgacgtggacggtgccgtgcccgtccggcacgcacctctcctcgtagacggggcacgtccgctcgtactggtggacgtggccgtagaaggcgacgtccacccggtggcgccgccacagcccctccaggctctgccgcgccatgggctccgcgaacatcccgtcgtagccgtagaagaagcccgaggagtagccgaggacgcggtgcgcgatgaagaccacccacggctgcttcgcccggtccacgctgcccaggcagcggtccaggaacctgtactgctccgtgccctcccgccagtcgtgctcgctgtccgccacgcagaaccggaacatcccgtagtccatggagtaccagtagttgtccctcttctccgtcggcgcgtagtacatggtctcggccggcaccccgcactcgccgccggagtccgtgccgttgtacagcgacccactgttggggaa

SEQ ID NO: 30275 - DNA, 979 bp, Triticum aestivum
  Clone ID: PAT_TA_30275
ttttttttttttttttttttaccatcttaccaggggagtaatttgattgatttaagaggggctaactaattgagtacggaaaagagagagaaagattaggaaaacaaaggctagagttctggtgggtggccgcggtagaatctctcgtctgctcttcttcccgagtagagtagagtacgtacatctgacaagacgacacccaaacggccgcaaaaaagaaagcaaaacgccagaaaaacgcttcctcattcatcatcgttcgttcgctccgctacgcccggtccaccggtcgggcggtggactctccggtgctgctagttgcagcggtggttgcccgttggggcgggtcactgctgcggcgcggcggcggcgccgcccacgagccagcggtccatgggcacgcactgggccttgtgggcgcgcttccagtccagggcctggcacgcgcgggagcagtagttggccgcgccgcacacggagcagcgccggaactcgtgccgccgcgtctccttgcgcccgcaccgcatgtgggagcacagccgcagctcgccctcgccgtctccgccggtggccgccgcgtcggtcttcttggcgcacgcctgcacgccgcgcgacgcccaccagtctgacatgaactggttcgccgtgtgcggctctgcctccggcgggctccacccgaagtcggagaggagggggctgctggtgacgccgccggcgccgcctgcaacggcgccgatggggagggaggcgaaggggtaggttgcgcttgccgccgcggcggcgagcgcgagggagagctcgcgggcgttggcggcgacgaggaggcggcggccctcggccgggtcgcggcgcacgccgtagccgtcctggaggcagtgcccgagctcccggagcgcgtcgacgtggcccagcgcggcggagcgcgcgcagagcgccgccccggcgcgcaggtcgccggacgcgtgggcggacgcgtggg

SEQ ID NO: 30276 - DNA, 1280 bp, Triticum aestivum
  Clone ID: PAT_TA_30276
gcgatcttaaaagaaattgtcatatgaagaaaatccggttttttttttttttacagtatcttggcccttacagaatctgggaccaacaagtctcaaacaatacggttttatacagtttgtgttcttagtcatagaacaccatcatatgcttaatcgtaacctaagcatgcacgcaggtagcatggagatccacttattatgttccccagtaccataattcaaaagacaggaaaaagaagaaaaacaacaacaaaattgcaagagaaaaccaccaaactcttgcaatggcgccaccaccacctctgaccaaacaacttcaccctgtgcagccggtagatatcatagatcgcacacgcaaacgtatgatatcacgcctgacgcgtgccgttgatatcaacgtcagcgaccaaggggcaggtgagccggggtgtgggcacaacgtggagcctggtagcgcgcggcgcagtgaggccaaagatgtcgctcatgtcaagctccgacggcttcatgccgtcaggtagggcccagctgaacccgtgggcgagctggccgacggcgagctccagagcgtacaggccgagcgccatcccggggcatgagcgacgaccagacccgaacgggaggaactcaaagcagccgcccttaaagtcaaccccggcagcctccccttcccccgccacgaaccgagacggccggaacgtgtccggatccttccatgccttggcgtcgcgaccgatggcgaagacgttgatcatgacgcgggaggctcggggcacggtgtagccaccgacgacgcagtcctcggcagtctcgtggaggagcagcgggatgggcgggtgcagccggagcgtctccttgatgacacacttgaggaaggggagcttgtcgaggtccgactcatccacattccggtcaagacccaccgtgtcggcgagctccttctgcaatcggcgaaggtcgtccgggctgtgcatcatctctgccattgcccactcgatcgccgaggccaccgtctcagtcccgccaaacatcacatccatgatgatggccttgatgttgtcacgcgtgaggcggagcgtgctctgcagctcgtccccgccgtcgccggcggccttcttcggcttcgcctcggggaggaacgccagcatgtcgtccaccatgtccgcgtcgacgtcgtccgggctcttgcccctcgccatgtgctcgtcgatgatcttgtcgatgaactcgtcgagggcggcgcgcgcggcgcggaggcgcacgttgatgcctgcgggtcc

SEQ ID NO: 30277 - DNA, 808 bp, Triticum aestivum
  Clone ID: PAT_TA_30277
tggtttctgttgctcgtggatcaaaaccacgatgtgaatttgaaagaatttcatcaaagacggctactatttgtgtcgctggattaaatttcctacaaaaagaagaaaacgtcacatctctgattacatcagtactctttctgttgaggctgtggcgactccccttcttgatgtgtcctcctaggaaacagaagctcgtttatttgcttctctgcgctgaactccgaagtagcctttgtagggaaagcaaatctcaatgtctgcacttgtgttcccgagcacaatctcaggtcaaacccaaggcagtccacgccgatgattgctgcttcctctacttgaatggccttggacctccaacagaccgattcgagagcttgtgttatcttgactgcactggctctcaagggcgatattttgcccggggcagagtgcgcgatgatggccggcctaaatttccggtgtgctcctctctttaccttgggctctgtcccttatgcagggagcccctcttccctctgtgccgcctccgtgtggttcgtcgcccctcatcccttgccggcgtccctcggcgccccctccccctttcgcaggtccctgctgaccctcgtcctctccgctggcagcgcggcgctccgccctcccccgactacaaggcttgcaggtggccggtccaaccagtctatacttgatttgctcgcattctccacaatcatcctcgcaaagtatagtggatgacaggaatttacggtttcaaggttggaccagttaggtgcatcgtcttcttcatcatcatcatcgccgtcgtcat

SEQ ID NO: 30278 - DNA, 548 bp, Triticum aestivum
  Clone ID: PAT_TA_30278
tgcaagaccattggttcaatgacccggagaagtcgctgacgaggtatgagcagaggatgaggcgtgaggctgcgaggcaagagatggaccggcttcgactcgaggaattcaatcgcgcccaggaggagaagaagcgcgaggctgcgcaaatgtacgagcagtccttggcaaggaaacgagtcaacgaccagctgctcaaggacaagcttcgtgaggagaggatacggcagttgacgggacagtaggaggcagagacagcagctgagcggttgtgatggacctggttttgacatatttttgccctggactattaattttgcttgctcctccctttgtctggttccaaactgtctgtggaattgacttgattagtcagctttgaaatggtatacgtggcacgtgcacagcacaatgcaattttccaaactaaatataatatttatgtcctgatggaatgtcaagtctgctctattgtatgatatgaacctaggactgtatcttattgggaataaagagacacggagccaaaattgtactctgtttcgagc

SEQ ID NO: 30279 - DNA, 916 bp, Triticum aestivum
  Clone ID: PAT_TA_30279
ttttttttctctggttttcctctggtttcattaatccgacaatgactcgtgtggttttttataaacaagcaaacctgtaatacacgaaaatcgagatatgatataacagttcactaaaagctgtaaccacttcagtatttcttcaagacgaaattgcaacctcggattttagcaggaaatatacatcagtgtgattctgaacatgaatctcctctcattacatgtaccaaaaggtatggtgtatggacctcagatttccagtatagttcttatctgctccggcgaatgcttgaccaacgatcttgggtcaggataacagttctttggatccatcaccgccttgtaaatgagctcgtaagcttctgctagtgctctcgccaaaccatagcacgcgtctgagcgtaaccttggaacctgcagctgctcgaattccggcaaggagccttctgttccagtcacaataccatagaatgccttcaagcactccagaagcatttgtggtgatgtctccacaacatctgccagaggtcttgcatcatcctcgccgtcagtagagctgtagttcttcatgtatggcatcttacttgacaatccacacttactgagaatgctatcagcttctttatctaccaaggcacgcgtgtgtgtttcgatcatagagcgaaggtttttcacatagcttgtagcaacctcctgatccatcaatggttcctcaatagctgataagcagttgatgaggtaaactttggacgaagattcaccactcaggacagatgttgatgatttctttgatagaatagcatcaactgagattgaatctatcttacttccgataggttcagaactagttctaccacgccgtgcaagtgcaccttttgacttttgtgcctctgcggcttgctcgcacatatgaatt

SEQ ID NO: 30280 - DNA, 786 bp, Triticum aestivum
  Clone ID: PAT_TA_30280
agtgggcacacattaaaattctcaataattattcagcaaaccatacaccggatcgattatgaaaaggagatacattgcacaataactctgaaaaatctaaacatgaccatggtcgcctataataaaatatacgtccatatctagaattttttatgcttccactcttccacattattaatgtcaccaatcacaaccttattataagaggatggaatatatataattcaacaccgttgatgtaatttatagtttatacttcttcatgtattcaccgaatatgacttggtcataaatgggcttattgtcttctgataaaagctcctttataggcccatatggcctatcaagatcatcagtacttagaaagcatgcaattgagatacgtggctctacagttggtctcagcagaactcggtgctccacgctcttgaacttcccgtttgtaataatctgcatcatgtcagcaatattggccagcaacgcacccttgaccggaggaacatcaatccaaacatcttgatgaagaacttgaaggccgccgacactatcttggaggagcaaggtcaggaacccgaggtcagtatgcttggtcccacccatggtcaaatgtggctcgggacatatcgggaaatagtgacacgccattgaccttgcattgaagcatcttgtgcttgctagataatcacttccaagacctaaagcttccgaaaataactcagacaacttgatcagaactccatcgatgcctttcatgtactccttcacttcttctctgtacactttcac

SEQ ID NO: 30281 - DNA, 961 bp, Triticum aestivum
  Clone ID: PAT_TA_30281
aaaggcaacttatatatagccagtcccataatttacgtacgcgtatatgtacggtacaaaaataggggcacgcgccaaaaccacaagatccacctgaacaaatgccagccagtacgtacgtatatataatctcaaagctagctactacacggtgtgcggcgggcggccattgggttaggcggcgccgtggaaggtcttgccgtgctgctcggcctcgcggcgcctgatgaccacgctccacgtgaccgcctccagcgtcaccgccaccgcgccgagcacccagacggccgcgacgtaggctgtcctccaccgctgctccacgcccaggatggccatgcccttgaagatgttcatgatgccgaggatgatgacggcgtagcccaccgcgtggtggtacgcgttccagtacacgcggcacttgtgatccttcctcggcctcaggaacagcgcaaatacttgtagggtggcgagggcgaagacggcgatgccgatgctgcggtggagaccgtaggtgacgccgttggacgcgttgccgaggttgatgccggtggcccagccggcgacccccacggcgtatccgatgatctggcaggtcacgtggaggtagaaccacgcggggtctgccgacctgaacgtcttcaggtacctcgcgaagatggctcccatgggcagcagcaggccccagctcacggcgttgaggatgccatggatattgcgctccctggcgaggtcgctgccgccggagtcggaggaggtgctggtctgcctgaccagatccagcttcgccttggcggccaggttgtcgccgcccatggcgtgcggcgcgggaatgccgtccccggacaccgtggacccgacctgccagacctggttcaggacggacgcgccctggcccacgctcagcgtcccggagaccctgacgcggccgtcggcgccgcccacgcgtccgcccacgcgtccg

SEQ ID NO: 30282 - DNA, 739 bp, Triticum aestivum
  unsure (1)..(739): unsure at all n locations
  Clone ID: PAT_TA_30282
tttttgaatcntgcttgaanttttatcaaactaattnggtagtcaatcganntacgatttccgggaaantgccggcaaaagtaaaacaccatttcaaaaagaatgaagaaaatatatagtgaataacatactatctataatctagaaattacagttagaactttggaggtctacttttgctcaaaacaatacagaagaatggtaaggaccttcagcgaaccggccgaatcgcctccgagtaaaaaattgaaagcctttgatcttggccccaaattgcaactagaacacaagttacaattttcccctcatccatcctacttcgataggcaacacaaggcatggcggaactgaggcaaaactgttccagcatgggtatcaaaaccatcgagctcagcgtttgtatagttaggctttccctcatccaccctacttctttcggacaattctttttcgccgaagctttggagaggcatctttaggtgcaccatacttgatgcctagaagttctaagccagatacaattgcattcttggacatgaaccactctgcctgttgattgatgccaagctctgctgctgggccattgtatgttctcaacaaattatccgagttaagcagatctgctccctcaccaagccaggcacgtctcgatagctccccaatttgaatattcagcaacctcatcgctgtgccgaaaaagatgtacaccaaggacatcaaaatggtttgccattgatct

SEQ ID NO: 30283 - DNA, 1216 bp, Triticum aestivum
  Clone ID: PAT_TA_30283
aacccacaaactgcgccactgtattttcacaacctattaacagatatagattttgacaggcacaccaccaatttttttacgcgggggcaaatatatttaattgccaaagctaccaaattacaaattgaaaatttacaaggcttgaaattctaacacgccagaatttatcacgtcactgctggatgtagtggtcatagacataaattagatgagacaattggcgatagctaaaacgttctgcctagcataagctcggtgccagagagatattgtccaaatcaggtcagaatctgaagcgaccataacccggtcctcatcaacgatgttcgacgtgctaatcaatccatcgtagctcatagaagtattgtctgacgagaagatgcatcgaaaaactcagtgccggagcgatattgtccagatcaggtcagaatctgaagtgaccataacctggtcctcatcaactgtgtttgatgtgctaatcaatccaccgaagctcatatgagtattatctaaattccaccggagccccgtggtcgtggtgctagtcgaaggtgcgccaatgggaatcaacccacagtgggggccctcaactgatcgttcaatgtggatgttgtgagtgtgcgttcttgggagcagaaagatcaggcaatcatctgataggaggacgatcttaatgtttggaaagaggtggagtacattgatgtttcccatttcgtgatcaaacctacctcctagtgctccgaggacaaggatgcatagattcgatttgtcagggccaggtgaattgtcagtgataaatgctacacatttgtgcaagtcggtggtgtcctgatcatgtgattgatcaactattttggtgcccaaattagaataatattccttcacttctggtcgcactgaatccatatcccctttgattacatctggtttgtatctggagcgcacatcgtcgcgggcgtggccggggagcagctccggcatgccgtcgaacacgcgattagcgcccccgtcggcgcacacccgcacctgcgcgcggtcccagaggagaggggcgaagcggggcaggcgctggttgaggacgacgaccgcgtacgcgtccgctgaggcggctggggttgcggaggaggggaggaggaaggcggaggagtgggacatcgccggcctcgctcccgctggcgacgggggatccatggcggccgtcggagcgcgccgaggg

SEQ ID NO: 30284 - DNA, 881 bp, Triticum aestivum
  Clone ID: PAT_TA_30284
acacacaacaatggtgagctctttgatccaaagagaaaagcattacaagcaatgcaaatgaatctcgtcgagttccatacaagtgaaactgtagcacatcactaacaaactgcagcttagctgcttttcgggtgtggataagtaaaagtgttacaagagcgtttacggactgacagctccacaattttttactccctgctcggcgtccaacaccctcacctaaaggagatgcaaggcaatatcaggacaggaagggcagcggctgctcgccggagcaggaccagccgatgtgcgtgactggagccaccggctacatcatccagtggctcgaccacacccgcttcggcagggccaccgtgtccacgccacggcgtgggacccagatgcaccaatattgaaaaccaatcaataatggaacatgttcaattgtgtagcaaaccttctgtccgtcctttcctctcttctaatggccattcattataaatccttgtcacgggtgatgctactgatcagaaagatattaatctcacacgaagttccttctcttcaaatgtccaacgtttgaccaatccagcacaaagaatgatgatgctagttgctagcatagatctactttatcagactgaacaatttttcagttgttaatctctgaaaatgcagaatgcttgttctgaaacatagaacttgtgtggtgttgctccgtacaggaattacttgtatgcattcctaaatagtggacaggtggtagctagaccgaagctcgcttgtgaaacatcaatcataaacatgtagatgaccatggtttaaccagtgaaggggctaaaattcagtagcccaaattaggattacacttgaccttttctatagagaaacctaggtac

SEQ ID NO: 30285 - DNA, 1089 bp, Triticum aestivum
  Clone ID: PAT_TA_30285
atgtatatatagaaagtccttccacatcacacgcactcctccacacacacaaaaaaacaagtaaaaaaaaaactaactacagattattttctgtacctacgcatttcttctttggttacatgaagaatggtgagaggctgcatatgtacagcgttaacagtggagcagcttctccctgatttctggtaagcacactattacctcacccctatacaaaactgctacatcaatcaaacaagcaagagaaaatagactcagtcttacatgttccgcaggcggtgcaagtcatgcacctctgaggcgccgaaatgcgcgtcggaacgttgcagatgattcgactggctctttctggaagaacgttccgtggggccttcgctcgacggagcatcaccgggcggggcggtaatggacagtacattggccggtgcgggtggtgagcttgctgcgcagcaatgtcggacattgatcctgtgtgtaacggtttcagttgaggtgctgcctgtcacattcaccagcagaacagcctccttgtctctggtcagttcgcaccatccgccttgcacgactccgtcgacgaattcttcctgcgtgtagtagttctcgtgatgcacgttaacttccattgtttctccaggctcgatgagaccaatggacggttgaacctcaagccaatgtggaaggccaaaggatgcccttggaataaaatcagtttttgttccgtcctgcttgcttgtcgactggccttcacacaagatttcaaaagcagacttttttgatccacagttatttgttattcgaagaacaacagtttcttcgttttccaatataatgttgtttgtgctgattatagtgtctggaacatgacgggattcttgaagcaaacaatgtagcttttcattcgattcgattatttttccatactcctgccttcttatcagctcgttcactcttgcaagatcaacactgaacatacagttcactggtttatgatcgctatctgtcacatccatgcatgcttcatatgatgtaattgcagcaacaacaggacactctaatgagcattcgcgtatgtttcggagctcgtgccga

SEQ ID NO: 30286 - DNA, 564 bp, Triticum aestivum
  Clone ID: PAT_TA_30286
acatgattggctcaagccatattcatcattagaccgaagaacaaacggcacaagcatgacatatatgagtacatgattggctcaagccatattcatcattagaccgaagacagtaataataataaaatggcgaccaatgcagcagtgaaacttaaacttgacagctgcgacggagtgggtatatgttatggagtaggagagcagatggagatggagacggatggcaaaggcaacttaattagttctgctggaagccacggatgaaccagttgatcatctggagcatggggtgcttggggggcttgagaaagtggatgggcatgcagcgcacccccctggccttgttcaccatccggcagtcccgcctgatctgccccttgttcttcttcgcgaccccgaacctctgccggaactgcgcgtcgtcccttggcgtcctctgctggaacagcgcgtcgtccttggcgtactgctccaccagcggcctcgtctgcgggtccagcgccagcgtgttgtccgaagtcagcaggctccgccgcgccagcagctcctggtagtaggcgttgt

SEQ ID NO: 30287 - DNA, 951 bp, Triticum aestivum
  Clone ID: PAT_TA_30287
cctccccccccccccctctctcctcttttttttttttttttaaacaggaacaacctttattatgcatttcaacttctcaacaatgcctcgaacagaatgcctcacctcatgtaggaaaaaatatattttgtacaaagaacacacgcatgtaaaataggatcgttccagctgaaaactggacgaattcgcagaaccaaaactaaatactcaagattccaaaacctactctagctgctggtgggggtcatctccgtgccaggcccaaactatgtccttcagcgctggccggatgtcctccaatagctcccggtactccagcggatcaccacttgtttgtttcatctcaatgagggggggggaaggtgtgatctcgaagatctccatgtctaactgaacagcaccattccttccttccttcctcgcttgcatcttcaccacgccattgtccttcttccttaccctgagattcagcgccttcgcaacatattccagcttcgagatgatggttgaagcaggcttgtctgaagtgaaccttgtctcctttctgcagtcctctcggatgaataggccacacaggtcaaaccccgtggagctcttggtgatctcgaacgcacttatgtttcccagtagagaaggagatgatctcaaaggcatttaagtttttcaccgtcaggggctgcacatcttcataagtgttcttccttggcctcacaccagctgtaggaggagcatttgtggtgacattctcactgggagttctctccttcactgcaagggtgccccttggacctttccgaaaccaggtagactcttttatcttctggatagatgccctggtgcttggattggggtccaggatcttgcacaagagcttctggagtttgtgtgagaaccagctggggcacctgaaatctccttgttcaatcttccggtacctgcccgggcggccgc

SEQ ID NO: 30288 - DNA, 1007 bp, Triticum aestivum
  Clone ID: PAT_TA_30288
ccacgcgtccgactagttctagatcgcgagcggccgtccttttttttttttgatgagcgtggaaaacaatgcaccctttcatttcgccaaacaggcaccgcaacttacaacatccacggcaatatctgaccacccagagacgacggcgatgatccatgggcgtgcccgcccaatgctcacagcccttccgtgcggccggatcacacgaccgtggcactataaattacatacgtaatcacctagcgttagttacagctccctgggtcttcgtcaggatctttgcgtcagtcggaacgggatcagtgtgtagtgtcagctatagttgctgtccagatgacgattgggttcgcctgtgacgaggagactgcccgaggcacatcctcaggcgctgggagaggctgtcccccatctcctccctctcgcgcttgagcttcttccacagggcatggatcttcttctccttcgttttcgggggcgacgatttggccagtttcctctgttcgtgtctccgcggcgtggccagagcatttaccgtcatgttctcatgcttatcaccaaggccgcgtgagaatgatccatcactcgccgcacctaacgatgaacatctgccccaactttctctgtttgagcttgtgtatgagcaggactcctcgttgtgcctactggttttatcctgcaaatgcagtccaacactatcaccatccgcaccagataggttatgattctcatctaagaggaaatccaagtcactgtcattcttaatggacaactgattcgcgctctccgatagtaattcgactaccgaagttgtagcatttcgaaagccatgtgcatctgttgatgaactgcctgcatcggttctagctgccctcagaccattgatgatctcaaagaacaaactctcattggtcatggtaccgatttttacatgtagcttatttgagcctgatgcaggcaacggggagggcgcagagtgttgtagaaaaatattgaaaccgagtcatagt

SEQ ID NO: 30289 - DNA, 1079 bp, Triticum aestivum
  Clone ID: PAT_TA_30289
cgtccgcggacgcgtgggtagggggtcagggaccagacgctgggcaaacaaaaagtgatgagcaacaaggcttggccgatgatgctagtgtggagtctgctgcaacaactggacctaataagcacaccaatgaagatgacactaaggctccttattcgaatcctccagcatccgtagcagaaggcacccagctatctagagactctgatctatcacccgggcagcctatgcaagctggcatgccatcatctggtgttggtgttatcggccggaggagtgtatctgattttggagcaattggagacaatctcagtggagcttcggtagtttcgggtcacgatcacctttataatttgcaaatgctcgaagctgcataccacagggttctccagcccaaggaatctgagcgtgcgaaaacttatattccgaggcacccttcagtgacccctgctagttacccacagattcaggcaccgattgtgacaaatcctgctttttgggaaaggctcggtagtgatacattgtctacagatatgttattctttgcattctactatcagcagaactcgtaccaacagtatttggccgccaaagaactaaaaaagcagtcatggagatttcacaggaagtacaatacttggttccaacggcatgtggagccacaggtcacgaccgatgagtatgagcggggatcgtacgtgtactttgattttcatctcgcagatgacggcaatgggtggtgccaaaggatcaagaacgacttcacatttgaatacaacttccttgaggatgaactgtcagtacaaccaaactagggcactagggctgatcaaagcgtttgatcaatgcgactcatgtaattttcagaatggaactgttggaacctggaacaaattcaaattccccagttgtaagttgtaaccttgtgggcgaatttaaatttagagctgttgtgtgcattcctggtcccagccctcagagtctgaacctcattctgaattagttccagatttcctggaaactgggaactgggcatgtccaacgaatttgatggtacattaaaataaaggacttgatgc

SEQ ID NO: 30290 - DNA, 1012 bp, Triticum aestivum
  Clone ID: PAT_TA_30290
cccacgcgtccgactagttctagcgcgtgccgagggagtggaccgcgcaggtggagcccggcgtgcacatcactttcgtctccatccccggcggcgccggcaacgacctcaagcgcatccgcttcagccgggagatgttcaacaagtgggaggcgcagcggtggtggggcgagaactacgaccgcgtggtggagctgtacaacgtgcagacgttccgagggagagcccggtggtgctgccgccgccgtccgcgacggcggcgagcagggagcggcccatcacccggaccacgtcatacaaggcggcgtgccacccgtccacggccgtgccggacccgtcggaccacgtgtgggcgcaccacttcaacatgctcaactcggccgcgggggcgggcgcgtcgtcgatgccgtcgagcgccggcgccccggcgccctacgacccgtcgcgcgccacgacgtcgtcgctggacgaggcgtccgtgtcggtgagcaacgcgagcgacctggaggcggcggagtgggtggagcaggacgagcccggcgtgcacatcaccatccgcgagctcggcgacggcacccgcgagctccgccgcgtccgcttcagccgggagcggttcggcgaggagcgggccaaggtgtggtgggagcagaaccgggaccggatacacacgcagtatctgtagcgacgagcgagcgaggcacactgaactgaagcagccagctaacacgtacgtacgtcaggtgacccgggtccaggggggccttgtaggttagagtgatggtgatggtgtgatacttatactgtactaaagctagtgctgccgttagttctattcgtcttgagaggcggcaggttgatggttcaggctgctgcgccttgtgtaaaatgtgtttaccggacagttaccggttcttcctttttttggatcggtttgtatcttgctgaacagtgtgattcgtttgtttctttgttctttttttacctgctttgtgtgaaaaaaaaaaaaaaaaaa

SEQ ID NO: 30291 - DNA, 1388 bp, Triticum aestivum
  Clone ID: PAT_TA_30291
gccggccgggtcgggaaacctccaaccccacggccatggagctcctccccttcctcctcctgctactcgtgggcgccaccgtggcctccggcgaaccggcgtaccctggctacggcgccaccgaggccgagccggcgtgcggcgtgaaggaggaggcggcggtgcctgtgccggagaggcgcgaggagttcgacggggggcggatcctggacatcagccactactaccgggaggacatgccggcgttcgagtcggcggagggcacgcccgggttcctgcggctggcgcgctccatgcgcaacggctccgacatcgccaacttctccgagctccggctcacggcgcactccggcacccacgtcgacgcgccgggccacgtcttcgagcactactacgacgccggcttcgacgtcgacacgctcgatctcgccgtcctcaacgctgatgtcatggagtccttgcatattcctaaaggagtccgccgtgtactcttccgaaccttaaacaccgacagaaagcttatctggaagaaagagtttgattcaagttatgttgcttcatggaggacggtgctcagtggttgattgataacactgacatccaactagttggagttgattacttgtctgtgggagcatatgaggaatgtattccagctcatctagtatttcttgataaaagggaagtcatccttgtggaagccttgaaccttgaacatgttgccactggaatatacacattgcattgcttgccactaaggttgcgcggcgctgaaggctctccagcgagatgcatcctcatcaagtaacaattgtagcactgtgtgatatgaaataagaagatatgtgtatcacgtacatcaatatgaatttgcaaatggatgtgtccaatctccagtagataacagatgaaacatactagtttgtagatttctgcaagtacacttgctttgaatctggcatctctgtacaatgtaaaaggctactagcgactctgcgaatttcagtgttgcggcgctgaagattctccaagcgggatgcatccttcatcaagtaacaactgtagcatgtactccctccgttccaaaaatagatgatcccactttgtactaactttagtataaagctggagtcatctatttttggaacgggagggggtatatgatatgaaataagaagatatgtgtatccacgtacacggtacatcaatatgaatttgcaaatggatgtgtcccaatctcccagtagataacagatgaaacatgctagtctgtagatttctgcaagtacacttgctttgaatctggcatctctgtacaatgtaaaaggttactagcgactctgtgaatttcagtgttaaatttcagtatggttggactcaagccaacc

SEQ ID NO: 30292 - DNA, 1840 bp, Triticum aestivum
  unsure (1)..(1840): unsure at all n locations
  Clone ID: PAT_TA_30292
gcgctagtcctttcatcatcaaaccccacacacgcacacgcgcgcgcgcacacacacacacaaaaaaaaagcagagagggaggagatggccggagacgggcgtcgcgtggtggtcttccccttcccgttccacggccacgccacccccctcctccgcctcgccagcgttctccacacccgcggcttcgcggtgaccatcttccacaccgagctccgggcgcccgacccggccgagtaccccgcggactaccgcttcgtgcccctgcgcgtggacgtgcccccggagctgatggcgtccgaggacatcgcggggatggtcacggccatgagcgagtactccgaggcgcccttcaaggaacgcctgaccgcggcgctcgccgaggaaggcgccggtgtccggtgcgtcatcgccgacgtcgcctggtacaaggccctgtcggtgtccagcgccctcggcgtgccggcgatgggcgtcatgacggccagcgccgccaactaccgggtctacatggcgtacccgatgttgattgagaagggctacctgcctgtacaagaggcgcgcagggaggatctggtccaggagctgccgccgtaccgtgtgaaagatctgctacggctcgaggcatccagcctccagggcttcgccgacctgctccggcacaccatcgaggcaccgcgccagtccgcaggcctcatattcaacaccttgagggccatcgaggccgacgacctggacacgatccgccaggaggagtccctcccggtcttcgccctcgcccctctccacaagctggcgccgccgggcaactccagcagcagcctgtacggcgagacgcaggcggaccgcgagtgcctcgattggctcgacacgcaggaaccaggcagtgtggtgtacgtgagcttcgggagcctggccgccatggacccgcacgagttcgtggagctggcgtgggggctcgccgccagcaagcggccgttcctctgggtcgtcaggcccacgctcatccgcggctacgagtccggccagctgcccgacgggctcgacgagcagatccgtgatcatggcaggctcgtcagctgggcaccgcaggtggaggtgctcgcccaccctgcggtaggcgccttcatcacgcacagcggctggaactccacggtggaagccgtgtcggagggcgtgccgatgatatgcctcccgttgcacggagaccagttcagcaacgccaggtacgtgtgcgatgtctggaaggtgggagtggagatcgaggcgtcgtcggcggctgggcagaacctggagagagggaagatcaaggctgccatcgacaagattgtgcacgacaaagggattagagagaggatggatgccttcaaattagctgcagatgaagcagttaactcccaaactgaggtgaaagctttggttgatctcataaactcgttttaattaattcagagccttccacttcatatacctcacttaattatgtaatcatcatccatctttggcgatcgacctactgtactgctactccaccctctgtaataagtattcgatttccataccccttttcttttaatgtctccaactgtgatgattgattccaaatgtgatgatttctccaaatgtgatggttgattcgaataaagaaaagcttattttccaagagtaaaaaaaaaaaaaccaccaattcgcctaagtgatctataccgcctacggcgtctttaaactctacnggaaaacctgcgtaccactatcgcttagaaaccccttccacngntatacaaaggncgacgttnctncaatnccaccgatgaangaccccnaggataccgggttngtncn

SEQ ID NO: 30293 - DNA, 446 bp, Triticum aestivum
  Clone ID: PAT_TA_30293
tttcggccggaggagctctgtggctcacggtgtacccaaccgacgtcgtgaagagcgtgatccaggtggacgactacaagaagccaaggtactcggggtcgatcgacgctctcaagaagatcgtcgcggccgacggggtgaagggcctgtacaaggggttcggccccgccatggcacgcagtgtcccggcaaacgccgccaccttcgtggcctatgagatcacgcgatcggccttgggctgatccgcaaaggtcccagcgcggcctccgtctcttctccgatgcggcattacacagagcaactgagacagaattgaggaccatggcaaacaattcttctttactgcgacgttgtttccgaaaaccttgcatagactggcagcaatggcgggattgttgatgaaataaaggttgagctttacctgtccaaaacatacatacacaagt

SEQ ID NO: 30294 - DNA, 1335 bp, Triticum aestivum
  Clone ID: PAT_TA_30294
ccccgcgcgccaccccaaggccccatggatgtgcctccgcccgtcacgaggcacgctggcgtccaacgtctgttcaagcgccttctcccaacaatgggccgtggtttcccccccgagtcaccactcgctcgctcctcctcctctccgacggcgaggagacggagaggcctcggcagggttgcggtgatctcttctccttctcgcgatgggggacattgccaaggacttgacagccggaaccgtcggagggatcgccaatctggttgttgggcacccatttgacaccatcaaggtcaagctccagagccagcccagccctgctccaggccagcttcctaagtatgccggcgcctttgatgctgtcaagcaaacggttgcggccgaagggcccaggggactgtacaaggggatgggggctcctcgtgctactgttgcagccttcaacgctcttctgttgactgagagaggctcgctggagactctcttgaggtcagaccccggcggttcaagcagcataacgcagcaggtcgtcgctggtgctggtgccggtctcgcgctctccaaagtggaatgcaacacagagctgttcaagtgcaggtggcacgcccagagctcgctaactcaagcagctgctgcctgcggcgtggcgctaccaaaagggccaatggatgtggcgaggcatgtcatgagggacgctggcatcaaaggtctgttcaagggcattgtcccaacaatgggccgtgagatccccggcaacgccataatgttcggcgtgtacgaggccgtcaagcagtacatggctggtggtcgggacacttcaggcctcggccagggctctctcatcctcgccgggggcctcgccggaggagccctgtggctcacggtgtacccaaccgacgtcgtgaagagcgtgatccaggtggacgactacaagaagccgaggtactcggggtcgatcgacgcgctcaagaagatcgtcgcggccgacggggtcaagggcctgtacaaggggttcggccccgccatggcccgcagcgtcccggcaaatgccgccaccttcgtggcctacgagatcacgcggtcggccatgggctgactgacccaaggtcccggcgccgccctaagtctcttctccgacgcggctgaagcggcgttccacggagcaactgagagataattcaggaccatggcaaacaaaagaaaggaaaaattaaccattcttctttgctgcgacgttgtttctgaaaaccttgcatagactggcagcaatggcagaatcgttggtgataataaaggttgagctttacctgcgcacaaaaaaaaagacacgcacct

SEQ ID NO: 30295 - DNA, 686 bp, Triticum aestivum
  Clone ID: PAT_TA_30295
cccgagcgcaagccagctcgatcgaacgcccccccccgctggacggcggctcggcgccccccctcccctccccttctcgtcggagtttaattttattttaggtgaatataaaggaggactgaaatggctgaaaattgggtagaagaagcctcgaaaaatgcttctgctccgacgtcattctctggatcgccccctagttgtcaaacctcttcgacaagaagatcaaggcaaagaaacatattccatctattaagtcatcgagaggtgtctcctcgaacaaaacaccaagctaaaaggcattggaataagcctccgacttgcggcgctggttacagtgagttaagatattcagctacagatgctaaacatgatttattttcgtgggcagaatcacagtccctgcatcgttggtctgcaaagtattgccctcttatgccaccccctaggtcaactattgcagctgcattcagttcggatgggaaaacacttgcatcaacgcatggtgaccatactgttaaaataattgactgccaaacagggaaatgtttgaaagtgtttggtggacatcggcgcacaccttgggtgggtagataccatcccttacattctgatatacttgccagccgggggtttggatcatgaagtccgtctttgggatgctaatacctcagattgtattggatctc

SEQ ID NO: 30296 - DNA, 1720 bp, Triticum aestivum
  Clone ID: PAT_TA_30296
tcggcacgaggcagaatgttcttcctagcatctatgtacttcgcgtttccgcgtcgtgccggtgctcctggtcaagtttttgcagctggcctccctctctgggttcccaattctgggcgcaatgtattcccagccaattactgttaccggggataccttgcaagcacagcaggatttagaactatcttgctagtgccatttgagactggtgtgcttgagctgggttcgatgcagcaggtggctgagagttctgacactctccagaccataaagtctgtctttgcggggacaggtggcaataaggatataatcccgagtcgtgaaggaaatggtcacattgagaggtcaccaggtctggcaaagatttttggcaaggatttgaaccttggtcggtcttcagcagggccagtgattggggtatcgaaagtagatgaaaggccgtgggaacagaggactgctggtggagggagctcattgcttcccaatgtccagaaaggattgcagagtttcacttggagtcaggcccggggcctgaattctcaccagcagaagtttggcaatggtatactgatagtgagtaatgaagctacacacggcaacaatagaaccgcggacagctccactacaacacagtttcagcttcagaaagcacctcagctccagaaactaccacttcttcagaaaccaccacagctagtgaagccgctgcagatggtcaaccagcaacagctgcagccacaggcgcctaggcaaatagattttagtgcagggaccagttccaagtctggtgtcctggttacaagagcagctgttcttgatggagatagttcagaggtgaatggcttgtgtaaagaggaagggacaacacctgtcatagaggaccgacggccaaggaagaggggaagaaagcctgcgaatgggagagaggagccgctgaatcatgttgaggctgagcgtcaaaggagggagaagctcaaccagcggttctatgctttgagagccgttgtgcccaacatctcgaaaatggacaaggcctctctgttgggcgatgcaatagcatacatcactgaccttcaaaagaagctcaaagatatggagacggagagagaacgatttcttgagtctggtatggttgatcctagggagcgagcccctagaccagaggttgacatccaggtggtgcaagacgaggttctggttcgagttatgtctccattggagaaccatccggtaaagaaggtctttgaagcgtttgaagaggcggacgtccgggtaggggagtcgaaactcacaggcaacaatggaacggtagtgcattccttcatcatcaagtgccctggctccgaacagcaaacgagagagaaagtgattgctgcaatgtctcgcgccatgagctcagtgtagaatcggttgaggggagtcggtgcagtagaggttggttactctgctggtggcatacaagcagcaggcagcccctgaaaccttccattctgttgatagaagttgtaggtcgagacagcaagctgagatttctgacttagcaatgcaagaaaagcacaagctaaaccgccattgttgtaacggtaggttcttgtgctctttgtagttttgatgttttattgggaagaataccatgctcttagtgtattgcttaattagtgcggaaccataaaaagtacatgtcgcatgcatgagctagaaaattacttttttgtaaaaa

SEQ ID NO: 30297 - DNA, 1094 bp, Triticum aestivum
  unsure (1)..(1094): unsure at all n locations
  Clone ID: PAT_TA_30297
atcccgtcgccggaagccaagtccttcgagatgtcccccgaccagcagcacaccgtgttcaccgccagggagtacaacgcgacggtggagttctactgggcgcccttcctgctgcagtccaacgcggacgacgccgtggtgcacaagatctccgaccgcatggtgcgcaacggctccatcgcccaccacggccgccactgggagggcgccgacgtcctggtcttcaacacctacctctggtggtgcaccggcctgcgcttcagggtcgtgaacgggccgatcgcgggggccagggaggaggacgcggcgtgggtgtcgaccgaggaggcctacggcatggcgttccgcgacatgctgcagtgggtgagggacaagatggacttcaacaccaccagggtcttcttcaccagcatgtcgcccacccacggcaagagccaggactggggggacgcgccggggggcaactgctacaacgagacggcgatgatcgaggacgccgggtactggggcacggacgggcggcggagcgtgatgcgggtgatcagggagatcctcgacggcgacggcgccgacgtgccgctcacgttcctcaacgtgacgcagctgtccatgtaccgcaaggacgcgcacacctccatctacaagaagcagtggaacccgctgacgccggagcaggtcgccgaccccaggacctacgccgactgcgtccactggtgcctcccggggctccaggacacgtggaacgaactcctctactccaagctcttctacccttgatcacatttagtgtttacttactaggtggtggtaaccttgccatagccgtggcgtgggccccccgagtgtgggcctcccgagtacaaacctggtgtttgaattggtggcaactatcatgcgttttgattccatagccttaagacgctgccaaacagaataggcgatcttcttcttcctttccgtgagccgaagcgaggcaatcaggtgcagctgttaaacctgctaaagggaaagaacatgcaagagccgaccggaaaaacangattatcataaccataagataattgtgcgattnaagcaaatccaacccacgtccn

SEQ ID NO: 30298 - DNA, 754 bp, Triticum aestivum
  Clone ID: PAT_TA_30298
cccgctttcctctccagtccacccaaagtccgacgagcaaccacccggccttggccaccaccgccatccgcctctccatcgggcacccgacccgcttcgccctccgccgggcctccgccctctcctcgccctccctcgccatgggctccgctgccaacgccaccttctccccgctcgcgctccacgtggcgtttagcctcgtggcggccggctccggcggcgccacccgcgaccagctcgccgccgcgctcggctccgcggagaaaggcggggccgaggtcctccacgcgctcgccgagcaggtggctccggtcgtgctcgccgacgcgtcgggcgcccgcgccccgcgggcccccgtagccggatttcttcgcggatcaccctttcctcttccctatccgagaatacctcacaggggtggtgctattcgtcgggcatgtgttcaatcccttggtgtctgcatgatgtgtttgctctggatcgctgcattggcagtgacctcaactatcacatgtaagtggagggggtttcaactttagatcatgctgcctgtgcaataaatccggtggatgttttttgttttcgaataatggcttgcttgatgtatggaggttgtggtgagttagtgacaataatccagggttgccgtggagttttgtgctttcagttgaatgatactcctaaaggagatggccaaaaaaaaacgacaataatccaggattgctgtggagttttgtgctttcaaaaaaaaaaa

SEQ ID NO: 30299 - DNA, 715 bp, Triticum aestivum
  Clone ID: PAT_TA_30299
gccggccggccggcgcaaaccaattcggctccatccctcccacggaaaaatccccaattccttcgtcttcctcttcgcggacgcacacagcagagcacacagcgagaagatgtccgggcgcggcaagggcggcaaggggctgggcaagggcggggcgaagcggcacaggaaggtgctgcgggacaacatccaggggatcaccaagccggcgatccggcggctggcgcggaggggcggcgtgaagcgcatctccgggctcatctatgaggagacccgcggcgtgctcaagatcttcctcgagaacgtcatccgcgacgccgtcacctacaccgagcacgcgcgccgcaagaccgtcactgccatggacgtcgtgtacgcgctcaagcgccagggccgcaccctgtacggcttcggcggttaggggatagctagcttcagtgtgtctaccaggtcgctgctccgcgaatgcttgtgcctgtggtttaatttaatgcttgttgtgaggaagtgctatctggatttgtttctctgttcaatatcgtcagtccagccattgcttctgatttgacaccgtttgagtttgtgaaattcttttcattcggtcctgcaaatctaacttggcaaatttgtcatctggatttgtttaccatttgcgttttttgcatctctagattgtaatatgaatttctgaaactaaattgcagtgtgattttct

SEQ ID NO: 30300 - DNA, 718 bp, Triticum aestivum
  unsure (1)..(718): unsure at all n locations
  Clone ID: PAT_TA_30300
tcccctcccaattcatcacaggattcactccccagctgggtgtttctttcttttctccccttccttccttcctagcagcaggcagagccagccagtggtgtggtggtgcccccttgctctgatccaagcctttcgctcaaagcccccggcttttgccgattgtttggtcacttcaagaatctcggaatatgttcttgctcctgccgccgcccctgctctgatccgcccctccctccttcgagccaagccaggccagcccaggcccctgtcgcgctctctctctttctttctccggcggcatttgggttctctgcaaggaaaggattctggcggcctggttttggccgtgattgggatccaattttgggggcgggttcgccgtggtgtggagccaggttccttacttcctttcttggtgaggcaggaatttgggatgatttctcgggttcttgaaggcggggagactctctgacgacccgccccggcgccgtttctgggggaaattctgcgcggtttctgcggaatttgcgtcgattcggggccgttgagctcggttcttgatccgcgggctccatgggtctctgtcatggaaagccctcgcgaatcccggagcccaaggcggaggaggagccgcgcgtggcctcctccggcgcccgcgatgccgccggtggggtggccgcctcgccggcgcannnnnnnnngncgcgncgannncggg

SEQ ID NO: 30301 - DNA, 849 bp, Triticum aestivum
  Clone ID: PAT_TA_30301
cccccgcgcccgccctcccgtcccgcgccggcacccgcggccacctgctccgcctgtcgctgcagccggcgcctgtccccgcggcgctccgccgccaccgccagctcgtcctccaccggccgccccgccacgccggcaaccgccccgcccaccgggcacggccccccgccgccgccgctgacgacaacaacccgatgcagcagcaccaaggggggcctcaacccttccgtgtcggcaatcgggttcggtcccggcgtcagcttctccggattccgcgtccccgcgaggatgcagggcaacgaggagcacaacggcggcaatggcgacaagccgccgtccgtctcctcggcttcccaccactgacagcagcagtggatgacagatgacttcaccaccaacctccacagtgtaccagtaacgacatcggccatcagctcctccacttgcatcactggttctaatttgattctgcttcatcattcataagagctggcgattgcattgcaactaggaggagcaaaatcaggaactggttctatgtctggttggttgggcgcttcggcggccatcgcgtctgccccgtgtccctctccccggcgccccaccaccacccggagcttcttagaattaggcttgtgagagtgcagcggcatagctagctggtcagtcagccagcctctttgtggcattgcattaggtgtagttgatgctgtagtttgctgtaggtcaagctcgattgctttctttctttcacttgttgctgtatgctactactagatgttgttctcaaacttataaatgggtgaggatggggagaggagtctatcactccatcttcatgctttccat

SEQ ID NO: 30302 - DNA, 1263 bp, Triticum aestivum
  unsure (1)..(1263): unsure at all n locations
  Clone ID: PAT_TA_30302
gnacaagcacgctcggccggcgaggcgagtgagagagtcaactcgaccatggagtccggcggtgcaggcgaggtgcggcactggaacgccgacgtcaacggcgtctccctccacgtcgccgagcagggccccgccgccggcccggcggtgctcctcctccacggcttcccggagctctggctctcctggcgccaccagatggccgctctcgccgcccgcggcttccgcgccctcgcccccgacctccgcggctacggcgactccgacgcccccgcggaccccgccgcctacaccatgctccacgtcgtcggcgacgtggtcgcgctcctcgaccacctccgcctccccaaggtggtggtggtggggcacgactggggtgcgcaggtggcgtggcatttctgcctgttccggccggaccgggtgcgcgccgtcgtcgcgctggggatcccgttcttcccccgctcccctcgtccgatggcggagatgttcgcggggcgcggcgaagggttctacatcacgcaggcctaggagcctggaagagctgtttgctcggtacgatgtcgcaactttgcgactgaactaaagaagttctactccattcaattagatgaccttgctgctcctcctggagtagagatcatagattttttcgaggcgtcatcatccccacttccttggatgaccgaggaagaactggggcagtatgccgagaagtttcagaagtctggcttcaccggacccctcaactactaccgcgccatggacacgaactggaggcttacggcaccctggcacggtgcaaagatcacggagcctgcgaagttcatcgggggtgagaagtgtctagtcctttggtgtcaagcgctccatcgagagcgggagagcgggggtttcaagtccagtgttccaggttttgaggtttccatcattgaaggcccccatttcctccagcaagagcaggccgagagggtgaactctgagataccgtccttcctggtcaagctttctggcgaggaagcacataattaagttgcaagtctgcgaggaggcgcataactaagtaacgagtaaaagggtagtgtatgagctggttttagatgtgaaagttgtcttttctaaactgaaatataaagctggtgggcctatccactcaaataaatgtcagagataggcttcaataaagtgcactgctgttgtattacaaaaaaaagaagccacccctcaaagtggtacccncgttnaanaaanaaaacaaaaaaaant

SEQ ID NO: 30303 - DNA, 1758 bp, Triticum aestivum
  unsure (1)..(1758): unsure at all n locations
  Clone ID: PAT_TA_30303
cctcgtgccgaattcggcacgaggcacgctnnnnagaagatagttgcagccttatcccaagaacagttctgctatgaatctcagatactaagggacagtgcttttcttcagcgtgcccggccgctcgactcggcacggggattgtggtcagtagacctagttgggggatttaagatgcctttgccatcagaatgccccatggaattttcttgcataccggagcattttcttgatgatgcaatggatttacttgctctaacctctagaattccaaaagctctggagggcttcccactggataattttctcaatttcaacatcatgttcatggcgagctcttcttacattaaaaatccttacctgaaagcaaagatggttgaagttttgaaaagctggatgccacaaagaagcggcttgaaatccacagcctcgttgtttgaggggcaccaactgtgtctcgattatcttgtcaagaatcttctgaagctttatgtggatattgaattcactggctcccatacacagttctttgacaaatttaatattcgacacaacattgctgagcttcttgagtatttatgggatgttcccagtcatcgaaatgcttggagacaaatggctaaagaagaggaaaagggcgtctacttgaattttctgaacttccttatcaatgatagcatctatcttcttgatgaaagtttgaaaaggattctcgagctaaaggaaatagaggctgaaatggctaatactgttgcatgggatagcaggcctgctcaagaaagagaggagcggttgcgcgcgtttcatcagtcagagaatattgctcgatttgatatgaagctcgcaaatgaggatgttgggatgcttgctttcacgtcagaacaaattccagcacctttgcttcttccagaaatggtggaaagggtggcaagcatgttaaattacttcctcttgcagcttgctggtccccagaggaaatcgttgactgtaaaagatccagagaagtatgagttcaaaccaaagcagctattgaaacagattgctaccatctatgtccacattgcaaggggtgataaggaagctgtcttcccagctgcaatctcaaaagacggaaggtcatacagtgagcagttgtttgctagcgcaactaatattttgtggaagattggggtagatccccaaatcatacaggagtttatgcaacttgcaggtaaagcaaaagctgctgctgctgaggccatggatgctgaggctatccttggggacataccagacgaatttcttgatccgatccagtatactctgatgaatgatcctgtgatactaccatcatcgcgggtcacagtagaccgaccagttattgttcggcatttgctcagtgacagtactgatccgttcaaccgctcccagctcactcaagacatgttgataccagatacagatctcaagttgcgcattgaagaatttgtcaggtcccagcagtcgaggaagcggagggctgtcgacactgagaccggggagcctgatggtgctgctgatatggtggagtgaactgctaaaagctgggatagacagtagtttcaggctggatcaattctcggtaaatggtgtaaagtgctccctgcaaatctaagcttgtacactttgtcatgcattgcgttatcatggatcgttaggttatgtcaagttcacttgtataaacattttatcattttgttcagcggtgaattattattggtgtgtgttaaaaaaaaaaaa

SEQ ID NO: 30304 - DNA, 697 bp, Triticum aestivum
  unsure (1)..(697): unsure at all n locations
  Clone ID: PAT_TA_30304
tcgacggggcatgggcaccttattcggaacctatgcgggtggtttccatggcgaggagaggctgggaaagcttggctatctcgttggaagccagctaggcagctgggttgggggaagaatcggactgatggtctatgatgtcatcaacgggttgaactacatgcttgagtttgtccgtccagaggagtatcgatcatcatcttacgcagcagaagagggctcagagtatgcagataactacagaagttcgtcttacgtatcagaagagggctcagagtatgcagataactacagaagtcgcgaaggatatgagccaacatacagtgagacgccagaagaggcgcaggcggaggaggattcggggggtttcagcttgttctgaaactgcaagcttggatatcagccgacttacaccgggatggtagcaggccagcaagcagcacttgtactgaacttgtttttgcatgtctagatggggaagtgattcttctctgtgattcttgtatggccattgtgtataatagaaacgtttgcatgcaaccacggctctggctgcatggtctaaagagctaaacatgaacaaagaacacatctggagtatcctgtagcatacttggggaacacacgtctctacagtgaatttgctgtatacgtgtctgtcagttcgtntataatttaatttaacatacttgggcag

SEQ ID NO: 30305 - DNA, 791 bp, Triticum aestivum
  Clone ID: PAT_TA_30305
tggctgggacttcttcgaggcaatgtactttggcggaagcatgactgaaggatttctacggggcacgggcaccttattcggaacctatgcgggtggtttccatggcgaggagaggctgggaaagcttggctatctcgttggaagccagctaggcagctgggttgggggaagaatcggactgatggtttacgatgtcatcaacgggttgaactacatgcttgagtttgtccgtccagaggagtaccgatcatcatcttattatgactcagaagagggctcagagtatgcagataactacagaagtggcgaagtttatgagccaacatacagtgagacgccagaagaggcgcaggaggaggaatcggggggtttcagcctgttttgaaacttgaagcttggatatcagccgacttacactgggatggcagcaggccagcaagcaagcaccacttatactgaacttgttttttgcatgtctagatggggaagtgattcttgtatggcgattgtgtataatagaaacgtttgcatgctgaacatcaacaaagaacacatctgggagtatcttgtactagcataatcatggttgtggctgcatggtctacagcagaggtactgaacatcaacaaagaagaaacacatctggtctgggagtatctttcttgtagcatacttggggaaacaggtctctagagtgaatttgctgtatatgtgtctgtcagttcgtttataatttaatttaacatagttgggcagatgccccttcatttagcaagaatgtcttcagaatg

SEQ ID NO: 30306 - DNA, 1310 bp, Triticum aestivum
  Clone ID: PAT_TA_30306
tcgcggccccgccgccccctcctcctcccaggacgggggagatccgtggtctgcttcgcctccgagccgcgcgggcgcggccgggaagccgctaaaattccagaagccgcgagtcgaggcgctgctcttcgtcgcctcggtgctcgcccgctggatctcagcttagaagctcagagatcttgtgagataggcggctacgtcaaagagtcagcaagtcagcatcatgaactgtttggatattttggcaaggcagcctggcatgctcggggaaggagggaatgaaggtgtgaagttaacaaccaacaaagcgcacagctggcaaacatgcggcatgcggccccgcgcccaaaacattgggctggctgctgcgatgaaagggccctgaagcccgcctgaggcaacgccaaagccacgctcaaaaggggcgggggaaaagaggcgggcctggccgctcgccaagcgaagaggatattgggtccgataatttcctctggctgggacttcttcgaggcaatgtaccggggcggtggcaggactgttccttttctacggggcacgggcaccttattcggaacctatgcgggtcgtttccatggcgaggcggggctggggaaagcttggctatctcgttggaagccagctaggcagctgggttgggggaagaatcggactgatggtttacgatgtcatcaacgggttgaactacatgcttgagtttgtccgtccatgaggagtaccgatcatcatctgatgagggctcagggtgtgcggtcaactgcaggcggtcgtcttccgtagcggcggagggctcgggccatcctgctgtctgccgccggcgcggacgctaggagccgacacacggggtgacgccccgcgtggcgaattcggcccgggattcggggggtttcagcttgttctgaaactgcaagcttggatatcagccgacttacaccgggatggtagcaggccagcaagcagcacttgtactgaacttgtttttgcatgtctagatggggaagtgattcctttctctgtgattccttgtatggccattgtgtataatagaaacgtttgcatgcaaccacggctctggctgcatggtctaaagagctaaacatgaacaaagaacacatctggagtatcttgtagcatacttggggaacacaggtctctagagtgaatttgctgtatacgtgtctgtcagttcgtttataatttaatttaacataagttgggcaagatgccccttcatttaaaaaaaaaaaaaaaaaaaactccgagggggggcccggtacccaattcgccctata

SEQ ID NO: 30307 - DNA, 700 bp, Triticum aestivum
  unsure (1)..(700): unsure at all n locations
  Clone ID: PAT_TA_30307
gaattcggcacgagcttctcgcccacacgcgcgaaccaaccggcgcgaccgaatcaaaccgtccgaccgtgcgcgcgactccgcacgggggccgggccgccgcgaagcccctggacgccggcggccgcgcgactcctcctcctcctcgggcgggcgggcgcgatgccgtggcggcgctgggggccgtcggtcatgttcatggcgtacgcgaccctggccgtggcggcgctgcgggcgcggctgtcctacaagtggccggcgcacgcggcgcgccggctgtggcggtgggcggacgcgtgggcgcggccgtaccagtgctcttcggtacggcgcttcgccgcgtccggcggcaacgacggggccgagaacccgctcttccctgcgtgctctcctcccgtggcgtcgctgccgtcgcttcgctgcagctacgccccgggcgtgctctcctcgaccagcaagagcaacgacttctcgctgcagctcggcgccggccacaccgcgcacgacgccttcctcggcgcacgcctcgcgtggaccaacccccctgagcgcagcacgttccgcgtgcgcccccatgaccgcacgcgcgtgctgcgcccctacctgcagcacgtcgagtccgtcgccgacgagatggagctgcggcgccgcgagctgcgcctctacgccaacaccgggngccgtcgcttcgcgctgggcg

SEQ ID NO: 30308 - DNA, 799 bp, Triticum aestivum
  unsure (1)..(799): unsure at all n locations
  Clone ID: PAT_TA_30308
aaacccgtcgacccagcgtccganagttctgccatggctgctgcggcgttgctcctggtggccgcgctcgtcgccctcggctccggccatggcggcgaggccttcgaccccaaccctctccaggacttctgcgtcgccgacgccacgtccaaagtgcgcgtgaatgggttatcgtgcaaggacccggccgccgtggtgtccgacgacgtcttcttcgccggcgcagacaagctgcgcgacgaggtgagcgagcgctacgggtactcggcgctgaccgtgcagatcccgggcctgaacacgcagggccagcggtacgcccgcgtcgacctcgcaccgggggccatcttcccgccgcactaccaccccagggcggccgagacggccctggtgctggaaggctccgtctacttcggcttcgtctcctcctacccggacaacaagctctttgccaaggtgctcagcaagggcgacgtcttcgccgtgccgcaggggctcatgcacttcctctacaacaacggcaccgcgccggccacgctctacgcctccctcagcagccagaacccggggctggtgctcctcggcaactcgctcttcgccggggcgctccccgacgacctcgtcgccaagacgctcctcacggaccagcacgggggggagaccatcaaggctaacttccggcggccttgatgcatggccacgccgtgcttttacccatctgtaatctttgtattttctgggggcgggcacggtaatttgcatggcaaccgttgctttgcaataaacatgaaatacttggagc

SEQ ID NO: 30309 - DNA, 827 bp, Triticum aestivum
  Clone ID: PAT_TA_30309
gtcgctccttgccattttgctggtcgagaaggttcgccatggctgctgcgacgttcctcttggcgctcgcggtcgttgccctcggctccggccatgtcgacgcgttcgaccctaaccctctccaggacttctgcgtcaccgaccccacgtccaaagtgcacgagaacgggttggcctgcaaggacccggcggcggtggtggcggaggacttccacttcggcggcctggacaagccgggcggcacgacgagcaagcgcttcgggttcacggcgaaccaggtgcagatcccgggcctgaacacgctgggcgagtcgcacgtccgcctcgacgtcgcgccgggggccgtcttcccggtgcactaccacccgagggcggcggagacggccctggtgctggagggctccgtctacttcggcttcgtctcctcctacccggacaacaagctcttcgccaaggtgctccgcaagggcgacgtgttcgccgtgccgcaggggctcatgcacttcctctacaacaacggcaccgcccccgccgcgctctacgccagcctcagcagccagaaccccgggctggtgctcctcgccaacgcgctcttcgccggggcactccccgacgatctcctcgccaagacgctcctcacggacaagcacaccgtggacaacatccgggcaaactttcggcggtcttgaatccgtgttccaatctcctagtaatttattgcattttctcaggcaaagtaatctttgtgtgtttatttgtgataaacatttgcaatggaattcgaaataagaatactgtgagtgatattccatcgggctcgatcgcgt

SEQ ID NO: 30310 - DNA, 1317 bp, Triticum aestivum
  Clone ID: PAT_TA_30310
agttaacggccagcgcgtgcgcgcgcctggctctgatggttccatgtcgccccgctcgggcagctgcgtgcctcccgctggtgctgatactttgcctcctctcgtgcgccgccgcgaggcctgcgcctgcgccggcgccggtgcacggccggcaccatggccaagggtggcactcgttcaagcggctgctagacgcgctgcgggggacccgcgtgacggggctcggcgacctgaagcgctacctggccatgttcggctacatgcccaagcatgccgggccggagcacggcggcgacccgacggacgccttcgacgagcacctcgaggccgccgtcagacggtaccagtcccggctcagcctgccggtcaccggccagctcgacgtcgtgacgctcgatcagatgatgtccccgcgctgcggcgtccaggacgaccacggcgcgtccgtctcgccagagcacggcggcgcggtcagtcggttcacgttcttcaagggcaagccgcggtggacgcggcggtcggacccggacccggtcgtgctcacgtacgccgtgtcgccgacggccaccgtcggctacctgccagccgacgacgtgagggccgtgttccggcgcgcgttcgagcggtgggcgcgggtcatccccgtggcgttcgtcgagacggacgactacgacgaggccgagatcaaggtggggttctacgggggcagccacggcgactgggtgccctttgacgggccgctcggcgtgctcggccacgccttctctcccaagaacgggcggctccacctcgacgccgccgagcggtgggcggtggacttcgccggcgaaacaaaagcctcggcggccatcgacctggagtccgtggcgactcacgagatcggccacgtcctcgggctcggacactcgacttcgccgcaggccgtcatgtacccgagcatcaaaccgctggagaagaaggccgacctcaccgtcgacgacgtcgaaggcgtgcagctgctgtacgggtccaacccggatttcaggctcagctccctctacgacgcgacggacacctccggctcgccggcggggagcagttgggctgcttcctcggctggggtagttctttgtgcggtcctggtcatactcgtgacgcacttgtagatagacaaagacatcgtttttataggcaaaagatcagaatacagaaaaaacaattgttgggtaccctgattctatctatagatagaagagaaagaaatgtttctcttcttgcatagacagtcaaatgacgacagcatgattgcatgatgtaactgtacataatatattcacc

SEQ ID NO: 30311 - DNA, 705 bp, Triticum aestivum
  Clone ID: PAT_TA_30311
cacgagtccgccgccccgcccgccgaatccgccgccctccctcccctcgccagcgccggagaaggcccccccacacctcctccctctccgcccaccgaacccgccacgcctcccctcccgtccactctccaccgcacaggcgatccgccttggcccccgatctcctcgctggaccccccaaccaccctaaaaacttccagtcttcaagcaaaccagctgcgcaaaagaaataccaggttacataagctgcttctccagcaaaggccatttcaccaaagacaataaagcatattcatccaaaacaattgaccttgagcagggagtcaacaggacaattggcgtcgttttgccaaaacaatagagctctagcaggaatgcagcagatttctaaagcaaaatgtccttttgtatggaattctattcaagcactgcaagttcttggatatcctccatttaggtggattcaaagatgggcaccactcaaatttgtcgtgcaaggcattcagaaattatccactccactgctgttcctatctgtcacatctgcactaggtgatctttcatctaagagcgatgaaactgatgatggacctagtagcactacaggagctcctgaccttcctgctgaatcaaatgaaacatcatcgacttctgatacaagggaggccgctgatggggatggtacaaaggatattgttgtttctg

SEQ ID NO: 30312 - DNA, 666 bp, Triticum aestivum
  unsure (1)..(666): unsure at all n locations
  Clone ID: PAT_TA_30312
tgngcagcattgggtgagaaataagagttagccaatcaggaagtgcaccggccggcctcacgccatggcttgtcacgtgaaggccattgtgtttggcgccgccgtcctggcagcatttgttctcgcgactgagggtcgcgctgcccggaaggacctggggctgggcctcgacctcggcggcggcggcggcctcggggtcggcacgggcggcggtctgggagtcggcaccggtggcggcgtggggatcggctcaggaatcggtgtcggcattggcggtggcggtggcggtggcggctctggctctggctccgggtcagggtccgggtcttactcaggctccggctctgggtctgggtcaggctcaggttccgggtctgggtcttggtctgggtcaggctctgggtcgtcgtcggcagggtcaagtgcaggctcgtacgccgagtcgggcgcgggctcgaacgcagggccaggcgacgcagggtcgtacgccggctcacgggctggctcctacgcgggctccaacgccgggaacggacgctccggcgcgggctcgtacgccggctccgaggccggctcgtacgcaaggtctggtgctggcccgcatggggggtccggagcccgctcgtacgcagggtccagggctggttcctacgctggcagcgggca

SEQ ID NO: 30313 - DNA, 294 bp, Triticum aestivum
  unsure (1)..(294): unsure at all n locations
  Clone ID: PAT_TA_30313
ttcncgagtccacggggagcgtaagcatcaatctcattgaaagaagcaacatcttgttgaatcgtccctctaccactttccttgtcaaccagagtaatggccccagccaagaacattggggcggcatgaatccttgtcattgtcatggtggcaactgcattattaccgtcgtcaagcgccaccctcaccaagtccggcgagaacctgttcaagtttgccttcgtcgcgctcatcgatacggtcctcgacgatgtcatcgccaccaccccaccagccaaaatacccgaagtacaa

SEQ ID NO: 30314 - DNA, 1198 bp, Triticum aestivum
  Clone ID: PAT_TA_30314
cgattcggcacgagctgacgcaagccggcgcgagaggagatcgaggtgcgtaatactccgccggctcgatcgccgggtgcgacgggcgtccgcccaccggcggccccacgcgtgcaggcgctggcgtcctcgctgggcgcgctcccgcccgagttcgtgcggcccgagcacgagcagccgcgcgccaccacgttccgcggggccgcgccgccggaaatccccgtcatcaacatgtcctcgccgggcgcctggcgccgcatggcggaggccgcggcggagtggggcatcttccaggtggtgtgccacggggtgccggctgaggccgtggcggagctgcagcgcgtgggccgcgggttcttcgcgctgccgcaggaggagaagcagcggtacgccatggacccggccgaggggaagaccgagggctacggctccacgctgcggaagggcgacctcgagggcaagaaggcctgggccgacttcctcttccacaacgtcgcgccgccggccgccgtgaaccacgccgtctggccggagagccccgaggggtacagggaggccaacgaggcctactgcggccacatgctgcggctcacgcgggagctgttcgggcgcctctcggcggagctgggcctgcaggagggcgccatggcggaggcgttcggcggcgacgacgtggtgctcctccagaagatcaacttctacccgccgtgcccgcagccggagctcgcgctcggcctcgcgccgcacaccgacatgagcacgctcaccgtcctcctgcccgacgaggtgcagggcctccaggtgttcaaggacggatgctggtacgacgtcaactacgtgcccggcgccctcatcatccacatcggcgaccagatcgagatcatgagcaacgggaggtacaaggccgtgctgcaccggacgacggtgagccgggagaagacgcggatgtcgtggccggtgttcgtggagccgccgccggagcacgtcgtcgggccgcacccgcagctcgtcgccgacgagttcccggccaagtacaaggccaagaagttcaaggactacaagtactgcaagatcaacaagctaccacagtagccaaatccttcagacagagacctttaaccaataatccccttgttcatatgtactgtaatcctacatttcatgcgtgtctgtttggatttttttttttaaaaaaaac

SEQ ID NO: 30315 - DNA, 291 bp, Triticum aestivum
  Clone ID: PAT_TA_30315
gtcatgttcgtgatcgacgcgaacaaggaagagctggcgatcaaggaagccaatacgctgggtatcccggtcgtcgcgattctcgattcgaatgtcgatccggcgggcattgccttcccggttccggccaatgacgacgccagccgcgcgattcgcctctattgcgagtcggctgcccaggccgccaccaagggtggccaggacgcacggggcgctgccggtgtcgatctcggtgcgatggctgagccgccggtcgaggatgtggtcgccgaagtggaggccccgacggcc

SEQ ID NO: 30316 - DNA, 527 bp, Triticum aestivum
  Clone ID: PAT_TA_30316
gccagcatcccgtccctctccgacgcgtcccagagctccaccaccaccgacttggtcgtccacgcccactagcgggagctgggaccccctccatcgtcgagcctgccctcttcttccacctccgggcaccgaaggccgccgccgtcgttccgctgcaccgagcctcccccgagcccgctagtctactctgccaccccgctaccccgagaccgctaccgatgccgctgtgattgactacgtcgacgacgaccccttcttccctttcagtgaaggttccagatggtggatcccttgagccaaatgccaccgccgatggatactactacaaggaggccgccgaagaccaggagtagttaggaggtcccaggcaggaggccttgcctctttgctcgtgttgcttttgtgctagccttcttaaggcatccttgtctaacttatgtccgcactcagatattgttgcttccgctgactcttgtgtatcgagcttgtattcgagccctcgaggcccctggcttgtaaaaaaaaaa

SEQ ID NO: 30317 - DNA, 408 bp, Triticum aestivum
  Clone ID: PAT_TA_30317
tttcactgtaattatcaaactcctcatagacttatagatatctgtacactcacaaacgcattagtcccttaacctataagtcttcaatacaccaaaatcactaaggggcactagatgcacttacaagaataatttgaggtgtcttttccccgcagcaacgggcgcaccgtccttatcgttctttacccgcgagtctcccgcgccgtgtatttcgacccttccagagactacgagaaaaaggactacacccacataatgaatattctagatgatgctctccaaggcttcagcattagaggtggccacatgcagatcaagaaacaaaggaacaagaagatgggtttcgcacataaaactaacttctcctgcatccatgtcccaaaaccaaacaagaaagatggattctac

SEQ ID NO: 30318 - DNA, 545 bp, Triticum aestivum
  Clone ID: PAT_TA_30318
gccttggccgaacctgcatcgccatggcctccgcgtccacgagcccatcgagctccccgcgcccaggcacctcgcccacgagcgtcaccaacatccactctttcgactatgtccaccagttggagccgggagcccctggatcgcagggttcgacgtcgtcttcaacctccggccaccgcgacgccatcgacaaattcggcgccctcgctccacccccggccttctcgagctcgcctaagacatcgctgtgagatgacgtagccgctgagactgctgccaccgtcgacaactactactaccccgagggtgcctactaccacgtgacggacaccgacgactaggagtagttaggaggctcccaggcaggaggccttgccttttcgatcatgttgcttttgtgctcgccttcttaaggcaaacatttaacttatgtctgcactcaaatatgattgcttccgctgactcgtttgtattcaagctgatgtattcgagccctcgaggcccctggcctgtaatataaagcttgtattattttaaaaaaaaaa

SEQ ID NO: 30319 - DNA, 597 bp, Triticum aestivum
  unsure (1)..(597): unsure at all n locations
  Clone ID: PAT_TA_30319
gctcgatcccctcctcccggtgcaccctcacctcaacctgcgcctccggccctcaccaagtcgacgaccgctccttccttgcgccgccttgtcgcgtcgagcctcggagcagctccttccccgcgccccttatcgacctctccgtggtccttggacgtgggctatcgcctgcctctaacgcccgcctcgaccaccatcgctaccctgagactgccggagacccccagtacaactacggtgttgacgacccgtccttcttgccagagcaaccagatgtttgagcccaggagccagacgccaccgtcgacgatgactactactacttgggaggtgcctactactacgtgcagcccgctcacgaccaccaggagtattttaggaggatcccaggcaggaggcatgtgcctgttttgatctgtatcccagtttgtgctagccttcttaaggcaaacttgtttaacttatgtctgtactcaagatattgttgcttctgctgactcgtctaagatcgaactcctgtattcgaagccctcngaaggccctgggcttgtaaatatgatgcctgtaagacntaattttatttgtaaaaaaaaaaaa

SEQ ID NO: 30320 - DNA, 595 bp, Triticum aestivum
  Clone ID: PAT_TA_30320
gcttctccctcacaacacaaaccccgatcgaagccgtcgccgtgccgtcgtggtctccgtggccatggtcatccccgagctacgacaaagatgcctagaggcaccgccgtcctcttctccgtcgactccaaccatcggagcaagctgggagggcctcgcgcgtcaccatcgagctcatctccgcctctgcatctcgccgctcgtcgtcttcgattcggcctcgctggagcctccccgagcccgctctgctcatctacaggctcaacaccccgagactgccggcgaaacccagtacgactacggtgttgacgacccctccttgccaaagcaaccagatgacagaatccaggagccagatgacacctttgacgactgctactaccccgagggtgcctactaccacgtgacggagaccgcggatgactaggagtagttaggaggctcccaggcaggaggccttgccttttcggtcgatgttgcttttgtgctagccttcttaaggcaaacttgtttaacttatgtatgtactcggatattgttgcttccgctgactcatttgcattcgagctgatgtattcgtgttaacactactact

SEQ ID NO: 30321 - DNA, 768 bp, Triticum aestivum
  unsure (1)..(768): unsure at all n locations
  Clone ID: PAT_TA_30321
acgggtctaaccaacaggcccaataaggcccatatacctcccggggggttccggtaacctcccggtactccggtatactcccgatttcacccggaaccattacgatgtccaaacatagggggcgagtatatcgatctttacgtctcggccatttcgagactcctcgtcatgtccgtgatcaaatcctggactccgaactaccttcggtacatcaaaacacataaactcataataccgatcctcagcgaacgttaagcgctgcggatcctacggggtcgagaactatgtagacatgaccgagacacgtctccggtcaataaccaatagcggaacctgggatgctcatattggctcccacatattctacgaagatctttatcgggtcaaaccgcataacaacatacgttgttccctttgtcatccggtatgttacttgcccggagattccattcgtcggtatctcaatacctaattcatctcgttaccggcaagtctcctttactccttcccgttatgcatcatcccgcaactaaccattaatcacattgcttgcaagcttatagtgatgtgcattaccgaagagggccatagatactctccgacaatccggagtgacaaacctaactccatctatgcaactcaacaaacacatcgaagacactgtagacacnttataacactaantacttgtgacttggtacacaaaatgtcctcggaatcggagtgatatccatagcatggacanttnatcanagaagcatanacatc

SEQ ID NO: 30322 - DNA, 657 bp, Triticum aestivum
  unsure (1)..(657): unsure at all n locations
  Clone ID: PAT_TA_30322
tgacggaccgacaaacctagacaaatctcggggaaaatggagcttggagctcgagtttcgagatgagaaagattaactagtgtggctccgacatttcatcgaacagctcatgtgcatangaggtgagctagagcacccaaatgtgccctcccctcgccggccagagaaaacagagcactgtagagtgctctgccgtggcaatggggtatatatagccaactcatttgttccagttcgtggctggaaccgagactaaagccaagccttctgtcccgggtgaagccaagaaacgggaccaatgattgtgggccaggagcgaggaccattggtcccggttcgtgcctcgaaccgggacaaatgggtcaatacgaaccgggaccaatgcccacgaggccccggccggcccctaggctcatgaaccgggacgaattccccatgggtcccggttcgtgactgaaccgggactaatgggctggcgaggcccgaacgaaagccttgttttttactagtgttacatttctagaaataaactataactgtgtcatctgattaagtaaaactacaaaatatttaaaaccaattcatttctcctctctcttatatatagatttaatatgtttttgcaataataagtgcatgtatttgtggattgttgtt

SEQ ID NO: 30323 - DNA, 595 bp, Triticum aestivum
  unsure (1)..(595): unsure at all n locations
  Clone ID: PAT_TA_30323
cgagatccctatcggtgagaccgaagtggctagggtttttggcagtggctatgtcaagtgaactcggtggcgccggataggaaatttcggtgaggccgagtttgacttttggtttgggacatatgtggatatgagaaagtagttgaggatttttggagcatatcactaagcatttgagcaagtaactcattaagcaacacatcatccccttttaatagtattggcttttcctatggactcaatgtgatcttggatcactaaattaaaatgtagagtcntgtgctttgagcttgagccaatcttttgccttagcattttgaggggtccacttccaatccatgccatgccaatcattgagctttcctgaaatattanctccaaatagcattagctcaatgagctaaagttgttaggattacaaaaccacccaagggatanttcacttcatgatttaaacattanagggcctccccncaaaagctccacccctgcagnatgccgattttgctaangcaaccaaggacttggccaacggagtgcacncatanaccngcnctnaacagnactgncgcangagtcctctccctcncgnaca

SEQ ID NO: 30324 - DNA, 996 bp, Triticum aestivum
  unsure (1)..(996): unsure at all n locations
  Clone ID: PAT_TA_30324
ggtccacgggatacaaataagatatattggataaatagatctcgcgagaacacgagataaaataaataacaataaattgcagtaagatatttttgtgtttttggaaatatagatctaaaaataaaagcaaataaaaatagatcgcgaaggcaaatataataaagaagagaccagggcccatagattttactagtggatttctctcgagaaaaatagcatacgatgggtaaacaattactgttgggcaattgatagaacttcaaataatcatgataatatccaggcaatgatcattatataggcatcacgtccaagattagtagaccgactcctgcctgcatctactactattactccacacatcgaccgctatccagcatgcatctagtgtattaagttcatggagaaacagagtaatgcattaagtatgatgacatgatgtagcggaattaactcaagcaatatgatgaaaaccccatctttttatgctcgatggcaacaatacaatacgtgtcggttccccttttgtcactaggatcgagcaccgcaagattgaacccaaagcaaagcacttctcccattgcacgaaaaaccaatctagttggccaaaccaaattgttatttgaagagacttgcaaagatatcaaatcatgcatataagaatcagaggagatccaaataatatccatagataattgatcataaatccacantcacggtntcgggaaacacaccgcaaaaaattatacatagaaaagtntccaagaacaccgaggagaacatggatcagatccaaagagagagaagaancactagatacantacgaccgtnggctgtggnaacacaatgctcacggagagnaaggtgttgatgtaaagcctcgtgatgatcccctcgaaaatgcggnaaggcccaatnggnttggggnaaaaggtcgnggngaatgttctnncctgacatcngaangntagcataggcttanggcacagtngggg

SEQ ID NO: 30325 - DNA, 744 bp, Triticum aestivum
  Clone ID: PAT_TA_30325
atcgggccgcagcgtgatgtcacgctatgaaaaagttgttagcagattagacttgtggaatattgtgttctctatggtggtatgtggaatttgttttgcagagccggacaccattcttgtgttcaagatcttctttggagtatttggagaaggaacccgccttgcaatgctgagacaatctgcgcaccggactcatcgtcattgaagcctggttcaggggatactaagggagtcctggattagggggtcctcagacagccggactatatacttatgtcgggctgttggattatgaagatacaagattgaagacttcgtcccgtgtccgggtgggactctcctttgcgtggaaggcaagcttggcaattcagatatgtagatttccttcttatgtaaccggctctttgtaaaccctagattcccccggtgcctatataaaccggaggggttagtccggaaggcagatattcattaccatagtcatacagacaagacttctagggtttagccattacaatctcgtggtagatcaactcttgtaatactcatattcatcaagatcaatcaagcaggaagtagggtattacctccatagagagggaccgaacctgggtaaacatcgtgtcccccgtctcctgttaccatcgatcctagacgcacagttcgggaccccctacccgagatccatcggttttgacaccgacattggtgctttcattgagagttcgactgtgccgtggtccc

SEQ ID NO: 30326 - DNA, 494 bp, Triticum aestivum
  Clone ID: PAT_TA_30326
tcaggaaaccgtaaccatctattgatcaacgagctagtcaactagaggcttactagggacatggtgttgtctatgtatccacacatgtatctgagtttcctatcaataccattcctagcatggattataaatgattatcatgaacaaggaaatataataataatcaatttattattgcctctagggcatatttccaacaggaaggtcatcattgaattgtgggaagcagggtgccctctctgctctaccgacatggaaaccgcggaccacatgcttttccgatgccctttcgtgtctttcttctgttatagggtgaggggtggaccccaccggtgcgtcggcgtgcgccccttcacctcctcgaagccccatgcgaaggttggcacccccttcttggggactttcgtgatcctcttttgcttgcatctttcggaacatcgggacgcgtggtcttcgaagggatactcctcccccctccctcgcgtgcgccctcc

SEQ ID NO: 30327 - DNA, 966 bp, Triticum aestivum
  Clone ID: PAT_TA_30327
attaacaagggtccttcctaccaataatcaattatctagaataaacaaacgtccttatcctgttttgtgttttacatacctaaaatatgggaatataaaaaattctctgacgtaaccacgctcaactaaaacatggaacgactagaagctggagcctaggattgtttttgcttcattcattccttgaaatcgtccttgtcatctgctggaaggcctctgtttctccagaatactgcaagagcactgcctccgagcgccatgcacacaacactgacagcagaaggaacagcaacaagagggtttgtgaagtgcttttgggcaagtaaaaatccaagcgcagaactctgcatcccacactcaattgagatggttctagaagttgattccccgaaagaagaccatttcgagatccaatagccaagagcgaatgcaacagcatgcagcagagcaacagggagaataagttgagcaccttgagttttcaacacttctgcgacttgcccaatcttgtatgtaaaatttcaattaataatagtgaaagaaagtagcactgtatcacaaacaagagcataacatttacttgaaaaataagaacttcaaaacagtatatgagtactacatgtcggcaatgtcaccatttcatgggataaaagttgcaaactttgtggagagcacacattatttaggttaaagttcaacaaaatgcattctaattaactcaagcaacaactccactcgtcttctcatcaggacacaaagcgtggactatgggctgaaagaaaggcttgaagcattagattgtttgtttacagacttacagggctagcacaaagcaaggtggtgaggatgacccctatcagtggtgttatggagataatccgctcggtaaacttgggaaaatactcatgtgccaacactccaacgatagtcggtactaaaacaacctgaaaagtaccctcgtgccga

SEQ ID NO: 30328 - DNA, 504 bp, Triticum aestivum
  unsure (1)..(504): unsure at all n locations
  Clone ID: PAT_TA_30328
ctctcatccacgtctcccctctcccaggcgttcccctctctagttcagcccaactcccgaacgcctccgtcgccattgttgccgtcgacctcgcgaccatcgtcgcccccactccgagctgggaggtcccgcggaaccgctgtcgtctgcttcgtcttcctcgcccacgagctcaagcccggagccaccgcatcgtgcggatcgagcttcatcttcctcgatcaccgccggcgttcttcttcaagttcgtccaatcctgcgctcctaaccttccaccaggcctacttgtgctccacatcctgagacgatgctgcnattgtgatcgactactcgaacgacgacccccctccttgcaaaagcagccagactaaataaaaatggagggagtaccgattcttctgnatgtaagacaagaaaattattnaagagaacacatnaggacaactaacaagcaaccaatgttaaagggttcaaatccataagttcaagaanattcaatcaagg

SEQ ID NO: 30329 - DNA, 635 bp, Triticum aestivum
  Clone ID: PAT_TA_30329
attcggcacgaggggccatcctacggccgtccccgtcgccccatcgacctacaaggacacccatgccctggttgaaccctagctgccctccagatccccctctctttgcccatctcccacacgcccgagctcgtcggcgctgctgtcgccataccgccgccgtaggcgcggccaccggcctcccggcaccatcggagaatgcccaggagctccaccagcatgccatgcttcccctacgtggatcaactcgatctcggagcaaccacctcgaccggatcgacgccttcttcttcctcgatcgtcgctgctgctcttcatcgatccgtcgcctctgcagctcctaagccaccaacgggcctccgtgtgcctccgcgatgctggagtccaggagccagacgccaccgtcgacgacgactcctactacaccggaggtgcctactactacgtgcagcccgctgacgatgaccaggagtagttaggaggatcccaggcaggaggcctgcgcctctttcgatctgtatcccagtttgtgctagccttcttaagccaaacttgtttaacttatgtctgtactcagatattgttgcttccgctgactcatctatgatcgagcacttgtattcgagcccttgagg

SEQ ID NO: 30330 - DNA, 613 bp, Triticum aestivum
  Clone ID: PAT_TA_30330
aatagtggatccccgggctgacggggagatgcacccgtacgcagcgtcacgccgcctcatcgttgacgcgctccggcaccaccccgtcgcgcccgaaggcacccaggagctgcgcctcgacgtcctctacctccacggcaaccggctcgagctggagtgccccggagccgcagccatggacccctcctcttcgaccagggatgtctgctccgcctcgtcgatctgctacctccggtcctccccgaaccaccccgagctcgccaccgcttcccctcgatgccgcaaccagacgttggagcccaggatccagacgccaccgtcgatgacgactactactctggaggtgcctactactacgtgcaggccgctgacgacgaccaggagtagttaggaggatcccaggcaggaggcctgcgcctctttcaatctgtatcccagtttgtgctagccttcttaaggcaaacttgtttaactaatgtctatactcagatattgttgcttccgttgacttgtttatgtcgagcacttgtattcgagccctcgaggcccctggcttgtaatatgatgcttatatacttgattttatttttaaaaaaaaaaaaaaaaaactcga

SEQ ID NO: 30331 - DNA, 731 bp, Triticum aestivum
  Clone ID: PAT_TA_30331
ggggagaacattgcattgagatccaaaaagagaaaagaagctatctagctactagctatggacccgaaggtctgaagtaaactactcacacttcattggaggggctatggtgatgatgtagaagccctccatggtggatgccccctccggtggacctccggaacaggccccaagatgggatctcgtggatacagaaagttgcagcggtggaattaggtttttggctcctgttctgatcgttcggggatacgtaggtatatataggaggaaggagtacgtcggtggagctctgagggccccacgaggtagggggacgcgccctccaccctcgtgaccgcctctggcgcttcttggagtagggtccaagtctcctgggtcacgttcggttggaaaatcacgatcgcgaaagtttcattccgtttggactccgtttgatattccttttgtgtgaaactctaaaacaaggaaaaacagaaactggcactgggctctaggttaataggttagtcccaaaaatcatataaaatggcatattaatgcatataaaacatccaaaatagataatataatagcatggaaaaataaaaaattatagatctgttggagacgtatcaacatgtgttacctcagctagataatttatgaaattaaatagagcatgcttggattcattcaaaccattcattgtctttggcaaggtgatcccatatctcgattcctattcttgtatg

SEQ ID NO: 30332 - DNA, 419 bp, Triticum aestivum
  Clone ID: PAT_TA_30332
ctatcctcctaggagcatccgcgtagtgcttggtttttgatgacttgtagatttttgcaataagtatgtgggttctttatgactaatgttgagtccatggattatacgcactctcacccttccatcattgctagcctcttcgatgccgtgcattggcctttcccaccttgagagtcggtgcaaacttcgccggtgcatccaaacctcgtgatatgatatgctctgtcacacattaacctccttatatcttcctcaaaacagccaccatacctacctattatggcatttccatagccattccgagatatattgccatgcaactttccaccgtttcatttatgacacgtttcatcgttgtcatattgctttgcatgatcatgtagttgacatcatatttgtggcaaagccaccatgcataa

SEQ ID NO: 30333 - DNA, 684 bp, Triticum aestivum
  Clone ID: PAT_TA_30333
ggctgcaagaagacgacagaagggtttgggtgctagtgtttccacgattccaaaaactttgtgtaatgtgctaggtttccgtcaatttgatgattgttctttgaatttgcatctcgcggattccaccattaagaaacctatgggaaggattaatgatgttcttattgttgcaaataggaattttctgcccatacattttattgtccttgatatagatttcaatccgacatgtcctattattcttggtagacctttccttagaacggttggtgcaattattgatatgaaagaaggaaatattatattacaatttccattaaggaaaggcatggaacactttcctaggaagaaaattaaattaccttatgaatctattatgagagtcacttatggattgcataccaaagatgacaatacctagatctatcctcgcttttatgcctagctagcggctttaaacgatagcgcttgtttggaggcaaccaaaatttatttttattccttgatttttgctcctgtttcctaatatataaattatttagcctcttttttggttgtgttttttgtgtttaattagtgtttgtgccaagtagaaccattgggaagacttggggaaagtcttgttgaacttgctgtagaaaacagaaactttagtgctttcgtgaactgccccgtcggcccgga

SEQ ID NO: 30334 - DNA, 715 bp, Triticum aestivum
  Clone ID: PAT_TA_30334
aaataatataagtgaagcatgagagactagcaatttcttcaaaattaatccaccaccatgctctaaaagatataagtgaagcactagagcaaaaactatcaagctcaaaaggtataagtgaagcacacagagtattctatcaaatcctaagcaaataggcttctcccaaaaggtgtgttacagcaaggatgattgtggtaaactaacaagcaaagaccaatataatacacgacgatccaagcaaaacacatatcatgtggtgaataaaaatatagctccaagtaaagttaccaatgaacgaagatgaaagaggggatgcctttcgggggcatccccaagcttaggcttttggctattcttgaatatcttggggtgccttgggcatccccaagcttaggctcttgccactctttattctatagtccatcaaatctttacccaaaacttgaaaacttcacaacacaaaactcaacaggaaatctcataagctccgttagtgcaagaaagaaaaaccaccacataaggtactgtaatgaactcattctttatttatattggtgttaaacctactgtattccaccttctctatggttcatacctaccggtactagccatagatgcatcaaaataagcaaacaacacacgaaaaacagaatctgtcaaaaacagaacagtctgtagcaatctataactttcgaatacttctggttccgtc

SEQ ID NO: 30335 - DNA, 513 bp, Triticum aestivum
  Clone ID: PAT_TA_30335
atttagtcctaatatgataggcatccaaagaagatataataacaacacttctcatatacagcattgaatacagtgagaagtttgattccttgcatttgttttgagatatgaagatgttgatattagagtcatgctagtagtaaattgtgcagtcaaagaaatagttgcgttaaggtttgtgattcccgtagcatgcacgtatggtcttctagttatgcgacgaagttggagctcaatttattcttgattttcttcctttgcgtgaaagtcgggagcgcatgatggttaactcctaccaacctctcccctaggagcatgcatagtagtactttgctttgagggctaataatttttttgcaataagtatgtgagttctttatgactaatgtcgagtccatggattatatgcactctcacccttccacttatgctagccactctagtaccgcgcatctttcaccgatgcattaaacccaccttatacccttcctcaaaacagccactatacctacc

SEQ ID NO: 30336 - DNA, 436 bp, Triticum aestivum
  Clone ID: PAT_TA_30336
tcgtggtcaccggcctccccggcgcccgggaggacgtccaggagttgcaccgtcctcttccacgtcgattccgtgaaactgttcgacaggagccacattgcggcgccaccagcatgtcttcttcaacctcgggacgccggatgcgttcgtcaaattcctcatcgtcaacccctccccagcctcctcgaccacatccatggttccatgatggtggatccttggagctagatgccacccccgtcgacaactactacatggaggccgctgaagaccaggagtagttaggaggtcccaggcaggaggccttgcctcttcgatcatgttgcttttgtgccagccttcttaaggcatccttgtttaacttatgtctgttcttagatattgttgcttccgctgactcttgtgtatcgagctatgtatttagaccttaagcccc

SEQ ID NO: 30337 - DNA, 650 bp, Triticum aestivum
  Clone ID: PAT_TA_30337
tgggcatccccaagtttcggcttttaggtgtacttatattatcttgggggtgccatgggaatcccaagcttagtctcttgccactccttgttccataatccatcaaatctttacccaaaacttgaaaacttcacaacacaaaacttaaagtagaaaatctcgtgagctccgttagcgaaagaaaacaaaagaccacttcaaggtactgtaatgaactcattatttatttatattggtgttataactactgtattccaacttctctatggtttaaaaactattttactagccatagattcatcaaaataagaaaacaacacacgaaaaacagaatctgtcaaaaacagaacagtctgtagtaatctgtaactagcgcaaacttctggtacctcaaaaattctaaaataaatttctggacgtgaggaatttatatattaatcatctgcaaaagaattaactaaatagcactctccaataaaaaatggcaggaaatctcatgagcgctaaagtttcagttttttacagcatgatcaacaagactttccccaagtcttcccaacggttctacttggcacaaacactaattaaaacataaaaactcaataataacagaggatagataaattatttattactaaacaggaataaac

SEQ ID NO: 30338 - DNA, 611 bp, Triticum aestivum
  Clone ID: PAT_TA_30338
attcggcacgaggaccatcgtcgatttggacgcgcccgagtacccaaccgccatggtcgtcgtcttagccacggccaccgcactccccgccggcttggagcttgtgcagcagctccatcgcggtcgtctgcatcttctactccgccgtatcgaggccgggggccatcaccggcgacgctcgcgccttcttcctccgccatggccgtccgacgccgtcgttcgatccgcaccatcccggcaacctccggcctccccgacctcgccattgagctcgcaacaatggagctccggagccagacaccaccgctgacgacgactcctactacattggaggagcctactactacgagtaggctgctgactacgaccagtactagtttaggaggatcccaggcaggaggcctgtgcctctttcgatctgtatcctagtttgtgctagccttcttaaggcaaacttgtttaacttatgtctgtattcagatattgttgctttcgctgactcgtctatgatcgagctcttgtattcgaaccttcgaggcccctggattgtaatatgaggcttgtatgacttattttatttatagagttgtgttgtgatatcaaaaaaaaaa

SEQ ID NO: 30339 - DNA, 737 bp, Triticum aestivum
  Clone ID: PAT_TA_30339
ggccgcgccttggtcgcgtgtcggccatccaggccccctccgacgcctacttagccatccccgacccccgggacaaagcctagaccatatcccccttcccctcgtccgtcgctctgcctcgcccctccccaccttgcaagagcgccgccatgcccgctgccccatgaagctcgcgaccactctcctcaccgcgcctcgccgacgtgcccccggagctgtgcatcaacgccctcttcctctccatggacgcaggcaagctcggaagcatcggaacaccgcctacatcaccgtcttcaacctcgggagccgaccattgccgccttcgattcgcgaccaccagagcctccccgagcaagctgacctcctcttcgcgatcccaaccccgagactgtcggcgacccacagttcgactacgatgttgacgacccctctctcttgccagagcaaccaggagccagacgccagcgtcgacaatgactactactactcgggaggtgcctactactacgtgctgcccgctgacgacgcccaggagtaatttaggaggatcccaggcaggaggtctgcgctttttcgatctgtatcccagtttgtgctagccttcttaaggcaaacttgtttaacttatgtctgtactcagatattgttgcttccgttgactcgtctatgatcgagctcttgtatctcgagcttcgagcgctcctgtcttgtaatatgatgcttgtatgacttatttt

SEQ ID NO: 30340 - DNA, 673 bp, Triticum aestivum
  Clone ID: PAT_TA_30340
cctcgcccctctcgcccaggaccacctttccccctctgccgatctggaggaagggccggcgcgcccgtctccgacgacctcgcttcaccgtggccaccgtcgtccccgcacccctccgactaatcctggagatcctgcgtcgaccactacgtctccctcgcccacgagaccacgccggaaccactgcatcaccaccatgccgtcttcttcctcctcggacgtcgtcgacctcgccgacgattccgactgcggcaagccctccccgagctcgctttcgcacgactacagggccccacactgagaccgacgttgttgctacccagtacgactacggagttgacgacccctctctcttgccagagcaaccagtcgatggagcccaggagctagacgccaccttcgacgacgactcctattacactggaggtgcctactactacgtgcagcccgctgacgacgaccaggagtagttaggaggatcccaggcaggaggcctgcgcctctttcgattgtatcccagtttgtgctagccttcttaaggcaaacttgtttaacttatgtctgtactctgatattgttgcttccgctgactcgtctatgatcgagcacttgtattcgagccctcgaggcccctggcttgtattatgatgcttgtatgacttatttatgtttt

SEQ ID NO: 30341 - DNA, 683 bp, Triticum aestivum
  Clone ID: PAT_TA_30341
agcgaacagcagctagcacctgtcacgcacgccctcacccttgcgccgcctccgcaaacgccggcgctcgctcctcaagccgccggcgactagaccaacgaacatcagcttgcgccaagccggcacccccaagctgtcctccgacgactaggcctgcacggctgcatcccggtctgaccagccacgactgcaaagtcagcaactgcaaggcagcgtcgcaggtcagtttggagctgtagacaaagttttgggagcagatcggatcaaggctgagtgacatctgggtttttcgtggacgcgttggttgctggtccatggttggcagcatgggaactcccttctgacagccctcaacactgtcagaacaggcagtccgccatcttcttcgtctccggtggtggcgccaccgccggttctgcctctgccaccccaggaaccactgccactacctcccgatcgacctctgccatccctggagggagtagcttttcttgttttttacccatttcttgtccactttgttctgttgcttaacagcctcttactgaaatgtagggaaaggctgcgtacaatagacccaaagtggtcggacccttccccggaccctgcgcaaagcgggagctacctgcaccgggctgcccttttttttgttctgttgctacaacttgcaaactaagcttaat

SEQ ID NO: 30342 - DNA, 717 bp, Triticum aestivum
  Clone ID: PAT_TA_30342
acgcgccgtcgcctccttccttccagagccgcggggagccgccaacgaggaaaacagaaggatgaacttgaaatttaaagcaccgtggaaaaaagagttagttgccctgggcaaagctaacgtcaatggtgaagataaaacaattactataagaaatgattatccggattaccctgtcccttattttcaagttactgagggttttaatttgagaaaggtcaaggagcttatgctagaaaggaatgttaagatcgccaagtccatagcaaatgacataatcatcccagaccctgctccccagtgggtggctgataacttcttggacaaatatgccgaattggagcccatccttgtaaaggacagtgcccggtgcttcctccaactcttccagaactgtagaggccggggcatgtcatcggatcttaccatcaccgcacaaaccttaaccttcattgtcagtttcaatgccctgcgttgtgcaaaagtcgtattggagggcatggcacctgagctctatgggatgcacgccaatcccaactgcataaacaaatatggatacttcccgctccacgaagctgctgaaaggttctctcttgacatgatcaagctgcttttacgccatggtgcattacccaatgtccgcacagttggcaattgatgtcatcaagaatctactcccgctcctgttcgcagtttaaaatacttggctgcataagt

SEQ ID NO: 30343 - DNA, 554 bp, Triticum aestivum
  Clone ID: PAT_TA_30343
ctttgttccgctcgcccaacgcatccgtctcacgccgtcgccgttgtcgtgcactgaagcagccccgggtcactcggaggtgtccagcaggggcgttgtcgccgtctccgtcggctacgtcaacgaaccagaccggagccgccccgcaacgagtggttcgaactcgtcttccacctcgacacccaaatcatgccgacgtcaaattcgtctccgtcgaaccctccccgaccacgctgtctactcctgtccgaccgctactacgagactgacgccgctgctgatgccccgatcgactacattgttgatgacccctcgttgccagagcaaccaggagccagaggatcccgaggatgtttctacatggagttcggcttcgaggagtagttaggaggtcccaggcaggaggccttgccttttcgaccgttgctacatttgtgctagtcttcttaaggcaaacttgtttaagttatgtctgtactcagatattgttgccactcctgactcttgtgtattcgagcttatgtatttgagccctcgaggcctctgacttgtaa

SEQ ID NO: 30344 - DNA, 401 bp, Triticum aestivum
  Clone ID: PAT_TA_30344
cccagcgtccgcttcttcaacctcggtcgccggcgcgccatcgcccaactactctgctccgaccactccggcatttccccgagcacgcctacggctccgcgatggtggaacccaggatccaaacgccacctttgacgacgactgctactacactgagggtgcctactactacgtggagaccgccgacgaccaggagtagttaggaggctcccaggcaggaagccttgccttttcaatcgatgttgcttttttgctagctttcttaaggcaaacttgtctaacttatgtctgtactcagatattgttgcttccactgactcttgtgttttcgagctgatgtattcgatccctcgaggcccctggcttgtaatataaagcttgtattattttaatttgtgttt

SEQ ID NO: 30345 - DNA, 786 bp, Triticum aestivum
  Clone ID: PAT_TA_30345
cccgccacggcaccggccgacgccgtggcgtccatccggccggcgaccccagcctacaagaccccggtgcccctctctaaacctagccagatccccactccccctcctcgcgcccccatctccctaccctcgtcttccccgcggcaacccgacgccgttgcccgaagctgctgtcgccgcgtcgccatcgttgtcgtacatgttgccatcggccaccttcgtcgtccgttggcgtccgggaggttcaccgtcgtcccctacgtcgtctacgcaccaccgttcgagcccggggccactacatcgagcggatcgaactcttcttcaaccttcgtccaccggcgcgcctccgtcgactccgtcgtcgtcctgcgctccgggccctcaccgagcctttagtgcgctccccgactccgagaccgatgctgatgcccctgtggtcgactacgtcaccgacgacccctctctcttgccagagcaaccagaaaatggagccctggagccagacgccaccgtcgacgatgattcctactacactagaggtgcctactactacgtgcaggccgctgacgacgaccaagagtagttaggaggatcccaggcaggaggcctgcgcctctttcgatctgtatcccagtttgtgctagccttcttaaggcaaacttgtttaacttatgtctgtactcagatattgttgcttccgctgactcgtctatgatcgagcacttgtattcgagccctcgaggcccctgacttgtattatgatgcttgtatgacttatttatgttc

SEQ ID NO: 30346 - DNA, 702 bp, Triticum aestivum
  unsure (1)..(702): unsure at all n locations
  Clone ID: PAT_TA_30346
cataacccacctcggtcatatctacgtagtgcttaggcgaagaagccctacgacggtagcttcatcaccgtcatcacgtcgtcatgctgacgaagctctccctcgacactcagctggatcatgagttcgtgggacatcaccaagctgaacgtgtgcagatcgcggaggtgccgtacgttcggtacttggatcggtcgatcgtgaagatgtacgacacatcaaccgcattgtcataacacttccgcttacggtctacgagggtacgtggaagacactctcccctctcgttgctatgcatcaccatgatcttgcgtgtgcgtaggattttttttgaaattactacgttccccaacagtggcatccgagtcaggtttatgcgtagatgttatatgcacgagtagaacacaagtgagttatgggcgatacaagtcataatgctaaccagcatgtcatacttaggttcggcggtattgttggatgaagcggcccggaccaacattacatgtacgcttacgcgagactggttctaccgatgtgctttgcacataggtggctggcgggtgtcagtttccccaactttagttgaactgggtgtggctacgccttgtccttgagaaggttaaaacaacactaacttgatgaaatatcattgtggttttgatgtgtaggtaagaacagtnctgcttagcccgtagcagccac

SEQ ID NO: 30347 - DNA, 788 bp, Triticum aestivum
  Clone ID: PAT_TA_30347
tcgcatctcccctcgattcctagctgcaatgtcgactgaagtggctgctgctgacatcccggtgcctcaggtggaggtagccgccgacgccgccgttgacacgccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggacaagcacaaggcgcacctcccggccaacttccgcaagatcctgctcacccagatcaagaagctcgtcgccgctggcaagctgaccaaggtcaagggctcctacaagctggccaaggcccccgccgccgtcaagcccaagacggccaccaagaagaagccggccgccaagcccaaggccaaggcgccagccaagaagactgccgccaagtccccggccaagaaggccgccgcgaagcccaaggccaaggccggtgaagaaggcggcccccgccaagaagcccgcggccaagaaggccaagaagtagagcccggcatgaccggacctagatggcctggcgggtagtattcagtagcctaattctctgttcggtcttgtcggtcaagagcttcttgaccgtgtcttgggcggtgatgggctcttgtgtcgaggaagagtaatatccatggggatcagttgtacttctagtagcagtacctttgtatttagtctttttattgttcagcaa

SEQ ID NO: 30348 - DNA, 715 bp, Triticum aestivum
  Clone ID: PAT_TA_30348
gaatcacaaactttaacacaagtatttctcaaattcagaactactcaactagcatgattctaatatcaccatcttcatatctcaaaacaattatcaagcatcaaacttctcatagtattcaacacactcataagatttttttttactaatcttggatgcctatcataattaaagaaaattaccatgctgttttgtaggactctcaaaataatataagtgaagcatgagaaaaaaatagtttctataaaacaaatccaccaccgtgctctaaaagatataagtgaagcaatagagcaaaaactatatagctcaaaagatataagtgaagcacatagagtattctaataaatttcaaccaagtaggatcctcccaaaaggtgtgttacagcaaggatgattaggtaaactaaaaagcaaagactaatatcatacacgacgctccaagcaaaacacatatcatgtggcgaataaaaatatagctccaggtaaagttaccaatgaacaaagacgaaagaggggatgccttccgggggcatccccaagcttaggcttttggctattcttgaatatattggggtgccttgggcatccccaagcttaagcttttggcactccttattccatagtccatcaaatctttacccaaaacttgaaaacttcacaacacaaaactcaacaggaaatctcataagctccgttagtgaaagttaacaaa

SEQ ID NO: 30349 - DNA, 1010 bp, Triticum aestivum
  unsure (1)..(1010): unsure at all n locations
  Clone ID: PAT_TA_30349
agaaaaaaccacaatatattacacggtgaaagaacatgccattcttgtacataagtgaacccctaacaaagcaatgtcctagatcatcttcacacacctatgagattccaggttgtagccttaaagataagtgtagacaaaccctgtcaatagtaatacatgggatgcaagagtagagaacattcactgtacacaaagccacaccattctgtcatagaagtagggagacagagcactaaaacaaagaagagtacagtttcctttcaccaacggatgaactttgcaattgacactcaaaaggggatgaaagcaatgggaaattttcttctaagactgccgcaaatcattatgaatcatgggcatgtgtcctgcacatacaccatgatgcattttttattattaccatgcactactgcctactcctttatatatcattaagaacaggtcactaactncctttgtatggttgacacaaagatanaagtcacatgttcaaattctattaacctaataaggcagtaattcaaacagtctgtcgaagcctttccaaagaaggcccctaaaagataatcaaccaaactantatgtactgaacataagaacttattccagagatatgttaacaacacattatgaaagataatacctccacaaagcaaatcagggacggcaaatccacgaatgtccatccccacttccttaaccaggttaccaggctggctgcttatttgggcctaaactgaaacaagcccaaaggcccacccatactccactacaaggtgggggtgaccaagtgcattccagccactccggaggtcttctaagtgaatacaacatagtcctacaggagtgcagaaatgtggtcttgttgtactctatagaatgttgttgtccagttgcggtattcgcagagcctgcatatcccggctcattgaagtatggcttctcattcaaaatgagagcctgaatggacacaagcacctgcagcattgttgaaccggacgcgtggg

SEQ ID NO: 30350 - DNA, 656 bp, Triticum aestivum
  Clone ID: PAT_TA_30350
acgatggctaataattctttgcaataagtatgtgagttctttatgactaatgttgagtccatggatcatacgcactctcacccttccaccattgctagcctgtctagtaccgtgcaacttttgccggtgcattaaacccaccatatactgttcctcaaaacagccaccatagctacctattatggcatttccatagccattccgagatatattgccatgaaacttccaccgttccgtttattatgaaatgcaccatcattgtcatatggctttgcatgatcatgtagttggcatagtatttgtggcttgtccactgttcatatttttatacatgtcacgctagatcattgcacatcccagtacaccgctggaggcattcatatagagtcatatctttgttctagcatcgagttgtaatatggagttgtaagtaaataaaagtgtgatgatcctcattattagagcattgtcccagtgaggaaaggatgatggatactatgattcccccacaagtcgggatgagactccggacgaaaaaaagagaaaggccaaaaaaggagaaggcccaaaaaaatgagagaaaaagagagaaggggcaatgttactatccttttaccacacttgtgcttcaaagtagcaccatgttcttcatatag

SEQ ID NO: 30351 - DNA, 807 bp, Triticum aestivum
  Clone ID: PAT_TA_30351
gactcagatcgagtcgctcgctcccttttccgaataggaaaagagtgagagaaaggagagaactccatggcagccgagggttccagcggcgtcggcgtcggcggccggaaaacatcgttgtctcataacccaagagagcgcggagtggcgaaattcctcaccggcttgccagcgcgaggaaacttctcctcaagttccatctcttccaatctgggaggcctcagggtttatgtctgcgagcacgacacaaatcctccagagggacaagtgatcgagacggatacgacaaatatcttaatcagacatctgcaactaaagaagaaagagagtgaggccaaagacgcaggttctaggactccaggggaaagtggcaagggtaaaagatgtgctgccagaagtttgggtgtgcagaagtcatcaaaaaagcccaacttgggcagttcttccggattgtcttcctctgatgaagcaatatctggcttttcacagcacacactgcagtccttcaccgtagagaggttgcgtgcacttctccgacaaagtggcctcacaaccaaggggaaaaaggacgaactgatcactcgcttaagagaggcgcagagttgatatcaatctcaagtttctgccttgtttgtgattgatcaattgcctactggcactgtaaaacgttgctgagctgaatgaatcatcaggctttacttgttgacattttgtaggtgtatgacttaaggtgatgtagtgatttactcgggctcaggctatcatgaatttgaagacttgtagcgaactttcactatatgcttgcca

SEQ ID NO: 30352 - DNA, 600 bp, Triticum aestivum
  Clone ID: PAT_TA_30352
agaaagtatgtagtagattgagtaagtagatcacaaataaaataaagtgcagcaatatattttggggtttctgaattaatagatctgaaaataaaagcaaaggaaaaatagatcataaaggcaaatatatgagaaagaagaccagagggccgtaggtttcactagtggcttctctcgagaaaaatagcaaacggtgggtaaacaaattactgttgggtaattgatagaactccaaatactcgtgacaatatccaagcaataatcattatataggcatcacgtccaagattagtagaccgactcctgcctgcatctactactatcactccacacatcgaccgctatccaacatgcatctaatgtaataagttcatggagaaatggagtaatgcaataagaacaatgacatgatgtagacaagatctatatatgtagagatagatcccatcgttttatccttagtagcaacgatacatacgtgtcggtttcccttctgtcactaggatcaagcaccgtaagattgaacccactacaaagaaccccttcccattgcaagataaatagatcaagttggccaaacaaaacccaaatatcagtgaa

SEQ ID NO: 30353 - DNA, 786 bp, Triticum aestivum
  Clone ID: PAT_TA_30353
cctgccttccctcctcagatccccctctgcttcccgagctccgccatggacgcgtcgccggcgtagccgtcgccgctaccctccctgctgctggagaccgcgctaggggtaccgtcttcgtcgcctatttcgactacgtgtgcgagctcgggccgaaagccacccgtgtgcccgctgcctccccatcctcaacctccgtccgcccgggatcgtcgccgccttcttcgactccggccaccacccctgcgctcctaagctcccgccggccaccgtgtgcctcaacaccccgaggctgcagctgatgcccctgtgatcgactacgtcgatgacgacccctccttctcgcctgagcaaccagatggtggatccttggagccagatgccaccgccgatggatgctactacgtggcgaccgccgacgaccaggagtagttaggaggtcgcaggcaggaggccttgcctcttcgatcgtgttgctttggtgctagccttcttaaggcggtcttgtttaacttatgtctgtactcagatattgttgcttccgctgactcttgtctatcgaggtttttgtattcgagccctcgaggcccctggcttgtaatatgaagcttttatgtctttcttttgtatttaaagttgtgttgtgatatcttcccgtgagtccctgattttgatcgtacatgtttgcgtgtatgattagtgtacgattgaatcgggggcgtcacatgtgatgaattgagtttcccctttgaagttatcttattggattgagtcttttatgagacc

SEQ ID NO: 30354 - DNA, 398 bp, Triticum aestivum
  Clone ID: PAT_TA_30354
aggtacctcgcagccgaggtgctggagctggccgggaacgccgccaaggacaacaagaagacccgcatcgtgccgaggcacctgctgctggccatccgcaacgaccaggagctcgggaggctgctgtccggcgtcaccatcgcccacggcggcgtgatccccaacatcaacccggtgctgctccccaagaaggccgccgagaaggctgagaaggccggcaccgccgccaagtcgcccaagaaggccaccaagtcccccaagaaggccaccaaggcctagatcctagtagtgtctgcggtgtacaaggagatgctactcaacaagatggtccagatgaaccagcagaggtgattaagaagaaattggttattactgaagaacatttccagagagttaca

SEQ ID NO: 30355 - DNA, 667 bp, Triticum aestivum
  Clone ID: PAT_TA_30355
gctccccacttgcgccccctcgctctctctcttgcccacgcactcgtcacctcctccagatccatcgccgagcacggtcgttgccgctcgcctcactctgccatggccagcaggcacatctcgcctcgccgttgcgtccacaaagaccgccgtcgtctgctgcgtctactacggagacgaaacgagccggaaccccttccatcgttgagccggccctctgcttccacctccggccaccgaaggccgccgccgtcgttctgctgcaccgagcctcccccgagcccgctcatgcacatctgcaggtccgcgaccctgagactgccgctgatgccgctatgttcgagtacatcgacgacgacccctccttgccagagcaaccagatggtggagttcaggagccagatgccacctttgacgacggctgctaccccgagggtgcctactaccacgtgacggtcgccgacgaccaagagtagttaggaggctcccaggcaggaggccttgccttttcgatcgtagatgcttttgtgctagccttcttaaggcaaacttgtttaactcacgtctgtgctcagatattgttgcttccgctgactcgtttgttttcaagctgatgtattcgagccctcgaggcccttggcttgtaatataaagcttgtattatttt

SEQ ID NO: 30356 - DNA, 691 bp, Triticum aestivum
  Clone ID: PAT_TA_30356
ggtcgcgattgtcagtcctcttaatctagacaaatctcgaggaaaatggagctttgaggtcgagcttcgagaggagaaagcttaactagtgtggctcgggcatttcatcgaacacctcatgtgcataggaggtgagatagagcaccacaaacccctcccctcgccggcccagaaaaacagagcactagagtgctctgctctggcgcgagggttatatataggcagcaccactggtcccggttcatggcatgaaccggcactaaatgggagcctttggtcccggttcttgccacgaaccgggaccaatggtggtgggccaagagccaggcccattggtcccggttcgtcccaccaaccgggaccaaaaggtccagacgaaccgggaccaatggcccacgtggcccggccgcccccctgggctcatgaaccgggtccaatgccccattggtcccggttctggactgaaccgggactaatgggctgacccggcctggacctttgcccccttttctactagtgccaataggcatccacgcgtcagctgttcaggggctagggtttttgttttttttctaaaaggggggggggctggatttgggggttttgtatggttaattaaggtgtttcatatattgtgttaggtagccaattaattaatagagagaagtgtcctctcttatttctgtgcttg

SEQ ID NO: 30357 - DNA, 385 bp, Triticum aestivum
  Clone ID: PAT_TA_30357
atagctaaaactctaggtggttaaaccgaatcacacagaacaagggagtccttgctctgataccaattgaaagtgctagttatcgactaggggggggtgaataggcgatttttatgaaagtcttcaaaacatgagagttttgtagaaaaacaatagaaataaacctattgacatgcagcggaaggtagactacactagacaagccatagccaagtactcaatgaactgaaaacacgaagactattagcagctaggtagtatggatcaggatggaagatagtgtgaagccaaactacattagtcatcacacagtgaagtcaaacagataatgcaagcaggcaatgacttcacaaggacaaactgtaagtaaagagaagtaagaggt

SEQ ID NO: 30358 - DNA, 711 bp, Triticum aestivum
  Clone ID: PAT_TA_30358
acggggacccacaatcatccttactctacacaccttttgagagaatcctacattattagaatttgctagaatatgctatgtgcttcacttatatcttttgagcttgatagtttttgctctagtgcttcacttatatcttttagagcacggtggtgacttatttttgtagaaattgctagtctctcatgcttcacttatatatttttgagagtcttttagaacagcatggtatttgctttggttataaaattggccctagaatggtaggcatccaagttgggtataataaaaactatcataggaagtgaattggatgctctggtcaatttgatacttaataattgttttgagatatggaggtagtgatattaaagtcatgctagttgggtgattatgaatttaaagaatgcttgtgttgaatttagcaagtcccatagcatgcacgtatggttaaagttgtgtaacaaatttgaaacatgaggtgttcttaaattgtgcatccttatgaatggcggtcgggacgagcgatggtcttttcctaccaatctatccctctaggagcatgcgcgtagtgcttggtttttgatgacttctaaattttttgcaataagtatatgagttcttttgactaatgttgagtccatggattatacacacttttacctttccatcattgctaacctcttcggtactgtgcattgccctttctca

SEQ ID NO: 30359 - DNA, 740 bp, Triticum aestivum
  Clone ID: PAT_TA_30359
ttgtgttatgaagttttcaagttctgggtaaagatttgatggattatggaacaaggagtggcaagagcctaagcttggggatgcccatggtaccccaaggtaaaattcaaggacaccaaaaagcctaagcttggggatgccccggaaggcatcccctctttcgtcttcgtctatcggtaactttacttggaactatatttttattcaccacatgatatgtgttttgcttgtagcgtattgtatgatttgagtctttgatttttagtttaccacaatcatccttgatgtacacaccttttgagagagactcacataatttgaaatttattagaatactctatgtgcttcacttatatcttttgagctatatagtttttgctctagtgcttcacttatatcttttagagcacggtggtggttttgttttatagaaactatttttctctcataattcacttatatcattttgagagtcccacaaaacaacatggtaattttcttaagttgtgaaattagtcctaatatgataggcatccaagattagtaaaaactttcttataagagcgtttgaatactaagagaagtttgatgcttgatgattgttttgagatatgaagatggtgatattagagaaatgctagttgagtagttgtgaatttgagaaatacttgttctaaagtttgtgattcccgtagcatgcacgtatggtgaaccgttatgtgatgaagtcggagcatgat

SEQ ID NO: 30360 - DNA, 594 bp, Triticum aestivum
  Clone ID: PAT_TA_30360
tccctccttttcccctctggcgccgttctccaccaaatcgagccgcgttcgagagctcccatggctgcgccgtcgacgttggcgcggacaccggcctcccctcgcctatccagcaggtccaggagacgcgcaccttcaccctcttcgtctacgacaagtcgcgcgagcagggacgccctcacgccgccgcaatcgtcgatccccatcgtcgggcggcgcttctacctcgtcgtcgacccgccgctgcctgcgctcccgttcattcgaagagccaccatgtgctccctgatggtggatccttggagccagatgccaccgccgatggatgcaactacatggagaccgccgatgaccaggagtagttaggagggcccaggcgggagggcttggctcttcgatcgtgttgcttttgtgctagccttcttaaggcatccttgtttaacttatttctgtactcaaatattgttgcttccgctgactcttgtgtatcgagctatgtattcgagccctcgaggcccctggcttgtaatataaagcttgtattattttatttgtgtctagagttgtgttgtgataaaaaaaaaaaaaaaaaaa

SEQ ID NO: 30361 - DNA, 709 bp, Triticum aestivum
  unsure (1)..(709): unsure at all n locations
  Clone ID: PAT_TA_30361
aggccatccaatgaaagggatgttgaacggagtttatatcctttgctctttttggcttggagaatgaatcctgggtgtttcggaggctcatcagacttcttcttttttttggtgtcaatgggcgactttttctttgagtccatcttctggtctttatcctttgtttcgttgtcatcctttttctggtcactcttttcgtttgtttcatcaattttcggatctttctgttctataacttcctgctggttaacattatctgtatttgccttttgatcatcagtcattatgtctccctttatctccagctcctgttctttcttctgatttgaggtatcttcagcaggagttttaaatccttcctctttcttctggtttgaaatatcttcagcaggagttttcaatccttctttcttctggtttgaaatatcttcagtggggaattttcaatccttcttccagcttaatctgtgaattcccagcatcaagtgatgccttcancaatcttctctggctgaacatccacatcttgtttacttgcttcancaagtgcagcaagggctgttggctcaatcgcctgaagcangaactttcntttaacaatccttcgaatgaccttcttcttccaatttctaacccangcgttgaacgaaganagtccgccttctcttccaagatccactttccgtcaanggcnttggacggtttgccc

SEQ ID NO: 30362 - DNA, 614 bp, Triticum aestivum
  Clone ID: PAT_TA_30362
acgaggattggatccaagtatgggaagcagatcaggaaaggccccatctcattcttcgtgatttttgtattgtgtgccttgaaaagcttggttgcaaccattcctaattttttgttcttgttcgatttggatttggatgcagcaggtgctctgctcttgcgcatgtttggtggcgtctccggcgtagccgtgcttcttgaggcgagcggcgttatggcgggtgtgtatggcggtgaccacaagctctccggatgtactgttctatgcagaagatctatgagggagtcctggattagggggtggccggatggccggactatagcctttggccagactcctggactatgaagatccaagattgaagacttcgtcccgtgtccggatgggactttccttggcatggaaggcaagcttggcgatacggatatgtcaatctcctaccattgaaaccgactttgtgtaaccctaaccctcttcggtgcctatataaaccggagggttttagtccgtaggacgaacaacaatcataccataggctagcttctagggtttagcctctctgatctcgtggtagatctactcttgtactacccaaaaaaaaaaaaaaaaaaaaa

SEQ ID NO: 30363 - DNA, 637 bp, Triticum aestivum
  Clone ID: PAT_TA_30363
gagaagacgacagaaggggcgtgtagtgcttggtttttgatgacttgtagatttttgcaataagtatgtgtgttctttatgactaatgttgagtccatggattatacgcactctcacctttccatcattgctatcctcttcggtaccgtgcattgccctttctcacattgagagttggtgaaaacttcgccggtgcatccaaaccccgtgatatgatacactctttcacacataaacctccttatatcttcctcaaaacagccaccatacctacctattatggcatttccatagccattccgagatatattgccatgcaactttccaccatctcgtttatcatgacacattcatcattgtcatattgcttagcatgatcatgtagttgacatagtatttgtggcaaagccaccgttcataattctttcatacttgtcactcttgattcattgcatatcccggtacaccgccggaggcatacatatagatttatatctagttctaagtatcgagttgtaatcttgagttgtaaataaataaaagtgtgatgatcttcattattagagcattgttccagtgaggaaaggatgatggagactatgattcccccacaagtcagaatgagacttcggacttc

SEQ ID NO: 30364 - DNA, 383 bp, Triticum aestivum
  Clone ID: PAT_TA_30364
ccgcgcggggagagggcgaacccgcacttggaatcagttcgcccagccccgtctcggcctttagcttgagctctgacccaccaatgctagattcgacccacaagtagcaacgtggtggaggggagtagcaggcagcggcggtgccgagcgaggatgagggaggggctgtggggaacgaagcgtgcacagcacaccggcagtggtatggcgccacgaacggaggcttccttccgccggcgtggttgtagggtagagaggagggaggcagaacggcggcggcggcggctaacgaggatggaggaggaggtagtgtgggatgtaaggctagggtttgtcccgtgggggatggggcctgacgagacgggggattgggtgcggagtgc

SEQ ID NO: 30365 - DNA, 797 bp, Triticum aestivum
  Clone ID: PAT_TA_30365
cgtccgcccacgcgtccgcggacgcgtggggaaaatatgaatacaattactatattaatgcttttatgaagaaagtctccgctgtccaagaagagactaatattttgcaggaagctatggaaaaagaaattgatgaaactgtgagctcataggatgaaaaacatgatgaggagagcgaagaacaaaaggaggaagagcgaattagctacccgtgcccaccttctaaagagagtaaccctccaactcatacattatttaattccccttcgtgcttaccgaaggatgattgctatgatgattgctatgatcccttgaatttgtttgaaatttccctttttgatgatgcttgctatgcttgtggccaagatgccaatatgaattatgcttatggagatgaacttgctatagttccttatgttaaacatgaaattgttgctattgcacccacacatgatagtcctattatctttttgaactctccctactacactatatcggagaagtttgtgcttactaaggcttatattgatgggttgccttttaccattacacatgatgattttgatagatataatatgcacgtgcttgctgctcctacttgcaattattatgagagaggaactatatctccacctctctatgtttccaatatgataaaattgcaataaactgtttatattatgcattggcctttactatgtgtgcatgaattgttcttttatgacatgccgatgcataggaagagagttagacttcgttgttgcatgatatatgttactttgtgctcactactaaat

SEQ ID NO: 30366 - DNA, 738 bp, Triticum aestivum
  Clone ID: PAT_TA_30366
gaaggagattattttgattttgtacttgagcatcttgatgaactgggtggctagccactctactcccccatctttgtaatctccattaagggtccaatgttactatagccaacagtctgtaggaacatcttaagaagttcgatggatgaaaattgtttcctgtagctgtcagttataagtttcaaactgcgcccaagcttagagatgtgcttaactatgatttctgaaaaatcatcaacagaccctgcagttccactttcaaagcctgcaagcgctaagtatcgagcaaccaacttccgtatgataagcaaagcttgctcttgacttaaagattttccttctactttagatacatccttccctctatatttgtttcctgtcttgtagtactcaggcatcattccaaacctttcaagcattgcagtgttgcgactaacaggtgccggtaaattatcaagaacaccatgaacttctattttattgctgatagatatcccactctctctagggattgcactttctggaacacagtcagctggaaatcgaatttccggaatgaaaagatcatctgttaaattactgaattccccattttccaacataatgttgggacccctgattgtccgtaaacacagtcctcttccttttatgcagactgcaaaccttaagatactcagacattccctctggtgttctctttggcatttctttgtcatctgtgcgaaacttgccatgcaa

SEQ ID NO: 30367 - DNA, 783 bp, Triticum aestivum
  Clone ID: PAT_TA_30367
cgggtcgaccggttcctacaacaaatcttatggaaattataataagatgccctctgattttgaatctaatattaaaggatttatttcttcgcaaaagaattttaatgctatgattgaagaaaaattgcttaagattgatgatttggctaggaatgttgatagaattgctcttgatgttgatgctttgaaacttagatctattccacctaagcatgatattaatgagtctctaaaagccatgagaatttcaattgatgagtgtaaagaaagaactgctaggatgcgtgcttccaaagatgcctttattaaatcttgttcttctaattcttatgaaaatcaagatgaagatctaagaattattgatgtgtcccctattaaatctttgttttgcaatattaatattgatgaaactgaatatgatcttcctttacctagaaggcgttctaaaaattcggagtatttagatcttaatgatgaaattgatgaaagtggaattgaaagaaataaaaatctagatgttgctaaacccactatattggatttcaaggaatttaattatgaaagttgctctttaattgattgtatttccttgttgcaatccatgctaaattttccacatgcttatagtcaaaataaagccttcaccgaacatattgttgatgccctgatgtaatcttatgaagaaaaacttgagttgaaagtttctatccctagaaaactctatgatgagtgggaaccaactattaaaattaaaattaaagatcatgagttttatgctttgtg

SEQ ID NO: 30368 - DNA, 554 bp, Triticum aestivum
  Clone ID: PAT_TA_30368
acaaaccaggccgcaaaattcccctccccttgtcttccgacgtggtcctcacaaagaagaactatggagatgatggccggccatgtccgagccagcaagccacaagaatacgaagatgatggacaaggaagaacaaggacatggccatgaggggggatccttgcactctggcaaagaagctcgccttccgacctcatcagtctgctgggagcgcataatggattcgagggacgttatcctcgtccgccatgagatgctggagttcaggagccagatgccaccgtcgacgacgacacctacgacactggaggtgcctactactacgtgcaggccgctgacgacgaccaggagtagttaggaggtcccaggcaggaggccttgccttttcgatcgttgctacttttgtgctagccttcttaaggcaaacttgtttaacttatgtctgtactcagatattgttgcttccgctgactcgtctatgatcgagcatttgtattcgagccctcgaggcccctggcttgtattatgatgcttgtatgacttatttatgttgt

SEQ ID NO: 30369 - DNA, 660 bp, Triticum aestivum
  Clone ID: PAT_TA_30369
gagcgcctggtctgaacaaaccagggccgcaaaacttcccctccccttgtcttccgacgtggtcctcacaaagaagaactatggagatgatggccggccatgtccgagccagcaagccacaagaatacgaagatgatggacaaggaagaacaaggacatggccatgaggggggatccttgcactctggcaaagaagctcgccttccgacctcatcagtctgctgggagcgcataatggattcgagggacgttatcctcgtccgccatgagactacgagaccgacactgctgctgcccagttcgactacggagtcgacgacccctcctacttgccagagcaaccagatgctggagttcaggagccagatgccaccgtcgacgacgacacctacgacactggaggtgcctactactacgtgcaggccgctgacgacgaccaggagtagttaggaggtcccaggcaggaggccttgccttttcgatcgttgctacttttgtgctagccttcttaaggcaaacttgtttaacttatgtctgtactcagatattgttgcttccgctgactcgtctatgatcgagcatttgtattcgagccctcgaggcccctggcttgtattatgatgcttgtatgacttatttatgttgtagagttgggttgtg

SEQ ID NO: 30370 - DNA, 1096 bp, Triticum aestivum
  Clone ID: PAT_TA_30370
gtctgagaaggagcttatttatttaaaagatgaaaaatacattacacgccgaacttaattgcaaagccttgcctatccttcctaccaataatcaattgtctagaataaacaaacgtccttatcctgtttttgtgttttacatacctaaaatatgggaatataaaaaaattctctgacgtaaccacgctcaactaaaacagggtaacgactagaagctggagcctagaattgtttttgcttcattcattccttgaaatcgtccttgtcatctgctggaaggcctctgtttctccagaaaactgcgagagcactgcctccgagcgccatgcacacaacactgacagcagagggaacagcaacaagaggattcgtgaagtgcttttgggcaagtaaaaatccaagcgcagaactcttcctaatatccaggtcaataatacaagaaccatagtgttattaaagctgctgccttgtgaccatgaggtactatagacccaaagtggtcggacccttccccggaccctgcgcaagcgggagctacatgcaccgggctgccctttttttagatattagctgactcgtaggacttcatatgaaaaagggccacaatcaatttgaaaacattgcaacagaagttatagatgaaaaatagaagggggggggggggggataattataatcatggtccagcaagtttattcactcttgattcacaacttgggtgtttgcttcagcacacatgctgggctctgacactcacaaaagagaaaatggttttgtgtctaaaaccatttcaaccatcgcatccgatttcaacacctatctattttagggcctctgtggcctcctggatatctatccccaatggctactagacaattcttgattgtaaccaacttcaagtacatttgctatcgtttcgaacctaccaatattaaattggaacgtgctgatttaacttagacactgctccattgctagctggaacccacccatgacatgagttaacactaaaaggccaccttagcatctcccagccatgctgtcaccactttgaatcctccaaccaaccaagccaagccggtggctcaccctcaag

SEQ ID NO: 30371 - DNA, 830 bp, Triticum aestivum
  unsure (1)..(830): unsure at all n locations
  Clone ID: PAT_TA_30371
ccaaggccaaggcggccaaggccaagaagccctccgccccgaggaagccccgcgccgcccccgcccacccgacctacgctgagatggtgtcggaggccatcaccgccctgaaggagcggacggggtcgagcccgtacgccatcgccaagttcgtcgaggacaagcacaaggcgcacctcccggccaacttccgtaagatcctgtcggtgcagctcaagaagctggtcgcctccggcaagctgaccaaggtcaaggcctcctacaagctgtctgccgccgcggccaagcccaagccggcggccaagaagaagcccgcggccaagaagaaggcgccagccaagaagaccgctaccaagaccaaggccaaggcgccagccaagaagaccgctaccaagaccaaggccaaggcgcccgccaagaagtccgccgccaagcccaaggccaaggccccagccaagaccaaggccgcggcgaagcccaaggcggccgccaagcccaaggccaaggcccccgccaagaccaaggccgcggcgaagcccaaggcagccgccaagcccaaaggccgccccgccaaggctgccaagacctcggncaaggacgcgccagggaaaaaggcgcccgcccgccgggggcccaagaagccccggcgcaggaaagcggcccaccaagaaaccaccgccggtgaaaaaggccgcgcccgccaaaaaagccgccccggcgaaaaaaggcccccgcccccaagaaaggccagaaggaaaatccttggaggaagaacctaaggccttggcggataggttttccagagcagtttttttttggtccgggctggg

SEQ ID NO: 30372 - DNA, 778 bp, Triticum aestivum
  Clone ID: PAT_TA_30372
gggtcgaggcgggaatacaatagatattacaccaatatgaatttataatgagttcacaacagtacctaagtggtggttttattttcttatactaacggagcttacgagttttctgttgagttttgtgttgtgaagttttcaagttttgggtaaagattcgatggactatggaataaggagtggcaagagcctaagcttggggatgaccaaggcaccccaaggtaatattaaaggacaaccaagagcctaagcttggggatagccccggaaggcatcccctgtttcgtcttcattcatcggtaactttacttggagctatatttttattcaccacgtgatatgtgttttgcttggagcatcattttattttcttttgttttgcttgctgtttgaataaaataccaagagctgaaattattaaatgttagagagtcttcacatagttgcataattattcgactattcattgatcttcacttatatcttttggagtagtttgtcatttgctctagtgcttcacttgtatctttttagagcgcgatggtagttttattttgaagaaatagatgaattctcatgcttcacttatattattttgagagtcataaacatcatggtaatttgctttggttatgaatttagtcctaatatgatgggcatcgaagagggatataataaaaactttcatataaagtgaattgaatactatgagaagtttgatacttcataattgttttgagatataaaggtggtaatattagagttgtgttagttgagt

SEQ ID NO: 30373 - DNA, 436 bp, Triticum aestivum
  Clone ID: PAT_TA_30373
aaacggcacgcccaaacccaaagccaagtcgcactcctcctcctcctatcctctccctcgccgaggcggcgaccggccggcgccaccgaccgcgcgtctccgttcaattcggcgaatttggggctcaggaaagaagaggaggagcgacttctctctggtggtcggaaattcaggacaaggttttgagcttttgtctgtttcgctgggatggatgccaagaagttcctgcagatggttgaagacaagaagaagagactccttgagaagaaggaagcccctctgaaatggcagcagaaactggaagcagcaattaaggccactgaagaaaaggagaagaagctcaagtcaaaaaaacacaggaggagaagctattcttcctcagaatctgatagtgaatccgagagcgacagtgatgggaaacacaggaagaggaagg

SEQ ID NO: 30374 - DNA, 670 bp, Triticum aestivum
  Clone ID: PAT_TA_30374
gtatgaaccatagagaagttataatacagtaggtttaacacaaatatgaatttagaatgagttcattacagtacctaagtggtgatttattttcttatactaacggagcttacgagttttgtgtggttgaagttttcatgttttgggtagagattcgatggactatggaataaggagtggaaagagcctaatcttggggatgcccaaggcagccccaaggtaatattcaaggacaaccaagcaactaagcttggggatgctccggaaggcatcccctctttcgtcttcgttcatcggtaactttacttggagctatatttttattcaccacatgatacgtgttttgcttggagagtcattttattttgttagtttttgctttctgttagttagaatagtgtttttcttctttagtttcaataaaaagtcaaggatagcctttgccatgcttattttgctagttcgaatgttgctgttgaaaacagaaagtttaccgctgttgcaacattccctagaaaagtcagagcatggtctaacgttgaatctttttgcataatgagctctggtaaatttattacagtggtaattttagttcataatttttggagtcagggaagtattgatactcttgcattctttacagactgtattgttttgacagattgctgtt

SEQ ID NO: 30375 - DNA, 731 bp, Triticum aestivum
  unsure (1)..(731): unsure at all n locations
  Clone ID: PAT_TA_30375
gagtcttcgaatggttgcataattatttagctactcattgatcttcacgtatatcttgttggagtagtttgtcgtttgctctagtgcttcacttatatcttttagagcacggcagtggttttattttgtagaaattaatgaactctcatgcttaacttatattattttgatagtcttaaacagcatggtattttgaatgaaaactatcataggaagtgaattggatgctatgatcaatttgatacttgataattgttttgagatatggaggtagtgatattaaagtcatgctagttgggtgattatgaatttaaagaatgcttgtgttgaagttaagcaancccatagcatgcacgtatggtaaagtgtgtaacaaatttgaaccatgaagtgtacctgggcttgtgcatccttaatgaagtgngcggtccgaggacgagcgatggcctttccctaccatcctacccccctaaggacnatgcnccntatgcttgatttttggatgactacnaatttttgcaataanatatgatccttttgactaanggtgaacccatggtaaatgcactttactttccacatggcaaccccttcggacgtgcatgcccttccactnganaatggtcaaactcacaatgcaccaanccgtgatcatacgcctacaacataacctcctantctcccaaacagcacatactaccntanggatttcaaccatccnanaatgccag

SEQ ID NO: 30376 - DNA, 673 bp, Triticum aestivum
  Clone ID: PAT_TA_30376
gtcatgaactcatttaaaattaatattggtgtcatatctactgtattccaactaatctatgtttcataccctctgatattactcatagattcatcaaaataagcaaacaacacatagaaaacagaatctgtcaaaaactgaacagtctgtagtaatctgtatcattagaatatttctgtaactccaaaaattctgaaacaaattgttggacctgggtaatttgtctataaatcatatgcaaaaaggatcaacctaaaatcactctccagtaaaatatggtagctaatctcgtgagcgcaaaactttctgctttttacagcaagatcgcatagacttcacccaagtcttcccaaaggttctacttggaacaaacactaattaaaagcataaaaccacatctaagcagaggccatatgaattatttattactaaacaggaacaaaaagcaaggaaccaaaataaaattgggttgcctcccaacaagcgctatcgtttaatgcccctagctaggcatgatgatctcaacgatgctcacataaaagataagaattgtaacataaagagagcatcatgaagaatatgattagcaaatttaagtctaacccacttcctatgcatagggattttgtgagcaaataacttgtaggaacaataatcaactagcataggagag

SEQ ID NO: 30377 - DNA, 599 bp, Triticum aestivum
  Clone ID: PAT_TA_30377
gcccgagccgtcgtccgcaaccaccgtcgtcgttctcgcggccagactcgtccccaagccacgaggagttgtccaggaggcgcgtcgtcgtcggcttcgtcgtctacaccaccggatcggagccgggaggtcgcctcgatgacgccccatcgccttccacctccacggccaccgcgacgccatcgcccgattcgccaccgtcagctcctacccggcctccccgagctgctcttccgcttcgctttcgcctacgatgttgacgacccctctctcttgccagaacaaccagacgttggagcccaggagccagacgccatcatcgacgactactactactactcgggaggtgcctactactacgtgcagcccgctgacgacgaccagtagtaatttaggaggatcccaggcaggaggcctgcgcctctttcaatttgtatcccagtttgtgctagccttcttaaggtaaacttgtttaacttatgtctgtactcagatattgttgcttccgctgactcgtctatgatcgagctcttgtattcgagccctcgaggcccctggcttgtaatatgatgcttgtatgacttattttaaaaaaaaaa

SEQ ID NO: 30378 - DNA, 717 bp, Triticum aestivum
  Clone ID: PAT_TA_30378
gacgggagaaaatagtaatagattgatagatcgaacgccaaataaataaatagaaataaaacacagcaatgtatttttgtatttttggtttaatagatctgaaaataaatgcaaggaaaaagtagatcgcaaaggcaaatatatgagaaagagacctgggggccataggtttcactagtggcttctctcgagaaaaatagcaaatggtgggtgaacaaattactattgggcaattgatagaacttcaaatactcatgatgatatccaggcaatgatcattatataggcatcacgtccaagattaatagaccgactcctgcctgcatctactactgttactccacacatcgaccgctatccagcatgcatctagtgtattaagttaacaagaacggagtaacgccttaaccaagatgacatgatgtagggagatagatccaatcaatattgcaaaaaacccatctttttatccttaatggcaacaatacaaatgcatgcctcgctacccttctgtcattgggtgaggacaccgcaagattgaacctaaaacaaggcacctctctcattctaagaaaaatcaatctaggtggccaaaccaaatcaatagatcagagattagggttggaggtgctccagggggccaataagccctggaggtgcccctcctagggtgcgtcctcctggcttgtggcctcctcgtggctcctatggcctcct

SEQ ID NO: 30379 - DNA, 548 bp, Triticum aestivum
  Clone ID: PAT_TA_30379
gccccatcgcgcccccgtccactcctcgccgtgggcgccccgatcgggagccaccgcgctcgtccccgtcgttgtccgccgtcacctcgacctctgcttcctcctcgaccacgacctcgagtagaagaccgcctcaatgtagagatcgacgccgctcctccacgtcggccatcacctccgtccgctacggtcgccgtcgttttccatggctccggcaccgccctgcagctactaagccgtcgaagggccaccttgtgccccgcgacgatggagcccaggagccagacgccactgtcgatgacgactactactactcgggaggtgcctactactacatgcagcccgctgacggcgaccaggagtagtttaggaggatcccaggtaggaggcctgcgcctctttcgatctgtatccctgtttgtgctagccttcttaaggcaaacttgtttaacttatgtctgtactcagatattgttgcttccgctgacttgtctatgatcgagctcttgtattcgagccctcgaggcccctggcttgtaaaaaaaaaa

SEQ ID NO: 30380 - DNA, 533 bp, Triticum aestivum
  unsure (1)..(533): unsure at all n locations
  Clone ID: PAT_TA_30380
gcctttccgccgcgcggccggctggaggaagtccttctcggaggtggcagcggccgcggcacgccgcgcttcgatgccggcagcggcaagctccggcagcagaagtacagcatgaggttgacgatcggtcgagcaggaatccttgtggcttctacccttctgtgtggggggatttcttccttcaccactctgatccagcagcttcctctcaaaagcagatgttggagcccaggagccagacgccaccctcgacgacgactcctactacaccggaggtgcctactactacgtgatgcccgctgacgacgaccaggagtagttaggaggatcccaggcaggaggcctgcgtctctttcgatctgtatcccagtttgagctagccttcttaaggcaaacttgtttaacttatgtctgtactcagatattgttgcttccgctgacttgtctatgatcgagctcttgtattcgagccttcgaggcccctggcttgtaatatgatgcttgtatgacttattttatttgtnaaaaaaaaa

SEQ ID NO: 30381 - DNA, 602 bp, Triticum aestivum
  Clone ID: PAT_TA_30381
cttcgataggactagctatccccctcttattctggcattctgcagttcaatccatcgacattgcctcttttcacatatacccatgcatatgtagtgtagatcgttgcttgcgagtactttggatgagtactcacggttgctttgctccccctttcccctcttcttcttggatgccgcaaccagatgttggagcccaggagccagacgccaccgtcgacgacgacccctactacaccggaggtgcctactactacgtgcaggctgacgacgaccaggagtagttaggaggatcccaggcaggaggcttgcgcctctttcgatctgtatcccagtttgtgctagccatcttatggtaacttgttaacttatgtttgtactcagatattgttgcttccgctgactcgtcaatgattgagcacttgtattccgagccctcgaggccctggcttgtattatgatgcttgtatgacttatttatttgtagagttgtgttgtgatatcttcccgtgagtccctgatcttgatcgtacacatttgcgtgtatgattagtgtacgattgaatccggggcgttacagttacaaaggtacgtttcgggtttgt

SEQ ID NO: 30382 - DNA, 470 bp, Triticum aestivum
  unsure (1)..(470): unsure at all n locations
  Clone ID: PAT_TA_30382
aagcaatgggcacacacgaagaagagtgaagctggagcatgcatgaggatagagaagcaaaaagagaagagctgcagtttagagagtgtcgagcgagtgctacttcctatataaacccggtgagcagtttagagagtttgcaatcccatctcggtgagaccgagatccctatcggtgagactgaactgattagggtttctagctatggctatgtcaagtgaactcggtggcgccggatgaatcaaatcagtgaggctgagtttgactttaggtttaggacatgtttggaattgagaaagtggctgagggttttggagcatatcactaagcattttgagcaggcaagccattaagcaagacctcatcccgttttaatagtattggctttcctatggactcaatgtgatctgggatcacttaaatgaaaagtagagtcntgagcttttgccaaaaaaaaaaaaaaaaaaaaa

SEQ ID NO: 30383 - DNA, 771 bp, Triticum aestivum
  Clone ID: PAT_TA_30383
gatatgtgatttgcttggagcgtcgtgtattatattagtctttgctttttagtttaccacaatcatcctttctgtacacaccttttgggagaaacccacttgattagaatttattagaatatgctatgtgcttcacttatatcttttgggctagatagtttttgctctagtgcttcacttatatcttttagagcacggcggtggcttaattttgtagaaatttctagtctctcatgcttcacttatattattttgagagtctcttagaatagcatggtatttgctatggttatgaatttggtcctagaatgatgagcatccaagttgggtataataaacactatcatagcaagtgcattaaacactaggatcaatttgatgcttgataattgttttgagatatgaggatggtgatattagagtcatgctagtggagtaatcatgaatttgaggaatacttgtgttgaagtttgtgattcccatagcatgcacgtatggtgaaccgctttgtgatgaagttggagcacgctttatttattgattgtcttccttatgagtggcggtcggggacaagcgatggtcttttcctaccaatctatccccctaggagcatgcgcgtagtactttgtttcaataacttgtagatttttgcaataagcatatgagttctttacgactaatgatgagtccatggatcatacgcactctcacccttccaccattgctagcctctcttgtgccgcgcaactttcgccggtaccattcacccac

SEQ ID NO: 30384 - DNA, 805 bp, Triticum aestivum
  unsure (1)..(805): unsure at all n locations
  Clone ID: PAT_TA_30384
caaaaattctgaaataaattgtcagacatgaggaatttttctattaatcatctgaaaaaatcataaacctaatcgcactctccagtaaaaatggcagcaaatctcatgagtgctaaaatttctgttttttacagcaagatcgcaaagacttcccccaagtcttcccaaaggttctacttggcacaaacactaattaaaagcataaaaccacatataaacagaagctagatgaattatttattactaaacaggaacaaaaacaagaaacaaaaataaaatttggttgcctcccaatgaaagtgcgttatatcgactagaggggggtgaataggcgatttttatgaattcttcactgaggaatttgcaggtgaggaaattccttagcgaagaaatactagcatagtaataagtactcagaagtaaacataacagaatacaagcatggtcatcatgatgaaatgaagacaagcacaagagtacagaaagcgtaatcacaggataacacaagatgaagacaaacagactgaagaaattgaactgaaggatttttgaaatctcaatcaaagtcctcaagcacagtacgaacaacatnaacatagtatgaggaaatgaanggttnaagagatanaccattattggtgaaacatgatttggtaaacaattcaaatgcgtccaatttactccggttgaccggnatattaanccaggggggccgtacaatccccnaanggtccattnccnccaaggctcntttaantctgacggnaacctgggtncaattacccttgnaaacccttcannnggt

SEQ ID NO: 30385 - DNA, 590 bp, Triticum aestivum
  Clone ID: PAT_TA_30385
gccccgacctaaacctaactcaactgcgccccgccccctgatctgcgtgccgccgcccgtcctctggtcccctcgtgccacatcatctccgaccctggcctccctccccgcagggcaccatccgcccgggagcagcagctccgtccgccacgccgaaggagcagcagcgccgtcaaccgccgctgaggatccactgctgatttgtctccacgtgcgacctctgtttcatctgatttccttcgctccgccccgcctacagaattcaagatgtaagcttctggtatgtggtggaggcaagtcaagattttacgccggttctgttacaggaacagaggatagtcctcctaagctgcttaatggtacaatttgtaatgtcattataaacattggatgcattagactgtcataatacctaggttctatcaaaaatggtaataagtaagggcacaatatggtgatagtaaatctgggttatggaagaacattgagtatttggtttctatatttatatttgtatagcagcaccctgattatgcaaatagtatcaaatcctgggccttaatcatggcagctagcagaaaatgtattgt

SEQ ID NO: 30386 - DNA, 779 bp, Triticum aestivum
  unsure (1)..(779): unsure at all n locations
  Clone ID: PAT_TA_30386
ctcgtgccgaattcgcacgaggatccaccttgccgtgcgcccgcatcaccatggccgacctcacccgcacacccacttagctccccgctgtacctgctttctccagaagaacaaccgccgactacctcgtctactggagccacctgttggagttgaagctctctgcatcaaccacgacgatgtcttcttcatcctcgtcaccgaccgctgccctgctgttgattcccctatctccgaacctccccagagccacccgggcctcgtcgagctcgccaccggccctccccatgactacgagactgacgttgctgctgcccagttcgactacggagttgacgacccctccttcttgccaagagcaaccagactacgagaccgacgctgctgctgtccagttcgactacggagttgacgacccctccttcttgccaaagcaaccagtcgttgaagcccaggagacggacgccactgtcgacgaagactcctactaccactagaggtgcctactactacatgcaggccgctgacgatgaccaggagtagttaggaggatcccatgcaggaggcctgcgcctctttcgatctgtatcccagtttgtgctagccatcttaaggcaacttgtttaacttatgtctgtactcaagatattgttgatcccgctgatccgttaaacttcgacacttgtattagacctcaaggccttggctgtaaangatctgtanactattactttaagtttgggggggccggtacaatcgcctaaatgagtctattagcg

SEQ ID NO: 30387 - DNA, 704 bp, Triticum aestivum
  Clone ID: PAT_TA_30387
taccggtccaacattaacgggtccacgggtggtgcgaatattgatatgaaggaagggaacattagattccaatttcctttaaagaaaggcacggagcactttccaagaaagaaattcaaattaccttatgaatctatcatgtgtgctacttatgaatttagtgccaaagacggtactcgttagatctatccttgcttttatgcctagctaggggcgttaaacagtaccgctagttgggaggcaacccaatttttctttatgtgttttgtttttgctcctgtttagtaataaatcttgcatctaccttctgtttagatgtgttttatctgttaattaatgtttgtgccaagtcgaacctatgggataacctacgatgatagttgatttgattctgctgaaaaacagaaactttgcacgcacgaatataattttgttaaatcacaggaacgtaattttgcgttgattcttttttatgctgttcaataaacaaattttccaggacttcctattttggtaggatttttagatttccataagtttgcgttagttacaggttgctacagactgttctgtttttgacagattctgtttttcgtgtgttgtttgcttatttcaatgcatctatggctagtaattcagtatatgaaccataaataagttggagtaggtttaacaccaaaataaataaacaatgagttcattgc

SEQ ID NO: 30388 - DNA, 661 bp, Triticum aestivum
  Clone ID: PAT_TA_30388
gccctctcccaggcattcccctctctagttctgtcccactcccgaacgcctcccgtcaccgctgttgtcgtcgacctcacggccacggttgcccccacgccgaagctgggaggtcccgcggatctgccgtcgtgtgcttcgtcttcctcgcccacgagctcaagcccggagccaccgcatcggccggatcgacaccatcttcttcctcggtcatcgccgttgttcttcgtcgatccgtcgcctctgcagctcctaagacaccaacgggccttcgtgtgcctctgtgactacgagactgatgtcgctgctggtgccccgatcgactatgctgtcgacgacgacccctccttgccagagcaaccagatgacggagcccaggagccagacgacgccaccgatgactactactacccggaggatgcctactactacatgaagaccgccgacgactaggagtagttaggaggctcccaggcaggaggcctcgcctttttcgatcgttgttgcttttgtgctagccttcttaaggcaatcttgtttaactcatgtctgtactcagatattgttgcttccgctgactcttgagttttcgagcttatgtattcgagccctcgaggcccttggcttgtaatataaagcttgtattattttaaaaaaaaaa

SEQ ID NO: 30389 - DNA, 524 bp, Triticum aestivum
  Clone ID: PAT_TA_30389
gcccactccctctggaccctctctctccctcgtcgctctctgcctcacgcgtctgagtgctgccatggaggcgcctcggcgaagctcgcggccaccagccaccccgggccacgagaaggcgtccgggagctcctgagcgcttgccatcggtcgtcttctccgagtccgatcatcgtttccccgccccggatctgcttcctcggcgcttcctcaacctcccgagcatgtcgtcgagaaccgctatgtcggagcccaggagccagctgtcacagccaatgcctactactacatggagaccgccgacgaccaggagtagttaggaggctcccaggcaggaggccttgccttttcgatcgatgttgcttttgtgctggccttcttaaggcaaacttgtctaactcatgtctgtactcagatattgctgcttccgctgacccttgtgttttcgagcttatgtattcgagccctcgaggcccctggcttgtaatataaagcttgtattattttaatttgcaaaaaaaaaa

SEQ ID NO: 30390 - DNA, 989 bp, Triticum aestivum
  unsure (1)..(989): unsure at all n locations
  Clone ID: PAT_TA_30390
aaagatcataagtgctacttatgaattaagtgccaaagatggcactacttagatctatcctcgcttttatgcctagctaggggcattaaacggtagcgctagttgggaggcaacccaattttatttgtgttttttgtttttgtttctgtttagtaataaattttgtatctaccttctgcttagatgtgtttccatgttttatttagtgtttgtgccaagtagaacctataggataacctatggtgatagttaatttgattctgctgaaaaacagaaactttgtgctcacgaaaaaaattcaataaatcacagaaacatgattttgcattgattcattttgctgtagattaatagaaacattttacaggacttcctattttggtaggagttttagagttccagaagtttacgttagttacagatttctacagactgttctgtttttgacatattctgtttttagtgtgttgtttgcttattttgatgcatctatggctagtattaagtggtatgaaccatagagaagttgtaatacagtaggtttaacaccaatataaataaagaatgagttccttacaataccttatgtggtgggtttgttttctttcactaacggagcttatgagatttcctgttcattttggtgttgtgaagtttcaagtttggtgtaaagatttgaatggatatggaataaggagtgggcaaaacctaagattgggatcccatgggcacccaatataagagtaccaaaaccctaacttgggggatcccccgttaggctcccctccttcgtctccgtttancggtaactttactgggagctatattttaatccacacatgatagtgtttgctggagcacatgtagatatagtantgcttttagttacacaatcaccttcttannactttgganaancactnattnaattacagaatacanagtctcctaanctttactnatattttgccatctcctaaccttaagag

SEQ ID NO: 30391 - DNA, 775 bp, Triticum aestivum
  Clone ID: PAT_TA_30391
gggccgaccggatccgtagttaattctcctcatgcttatagtcaaaataaagcttttaccaaacatatcattgatgccttgatgcaatcttatgatgaaaaacttaatttggaagtttctatacctagaaaacttaatgatgagtgggaacctactataaagattagaattaaagatcatgagtgttttgctttgtgtgatttgggtgctagtgtttccacgattccgaaaactttatgtgatattctaggtttccatgattttgatgattgctctttaaatttgcaccttgcggattttccaccattaaaaagccaattggaaggatcaatgatgttctcattgttgcaaatagaaatttggtgcccgtagattttatcgttcttgatatagattgcaatccttcatgtcctattattcttgatagacctttccatagaacaattggtgcaattattgatatggaggaagggaatattagattccaatttcccttaaagaagggcatggaacacttccctagaaagaaaataaaattaccatatgaatctatcatgaaagccacttatggattgcgtaccaaagatggcaatacctagatctatccttgcttttatgcctagctaggggcgttaaacgatagcgcttgttgggaggcaacccaattttattttgtgttttctgtttttgcttgtgtttaggaataaataatccatctagcctctgtttggatgtggttttgtcttttagttagtgtttgtgccaagtagaacct

SEQ ID NO: 30392 - DNA, 1114 bp, Triticum aestivum
  Clone ID: PAT_TA_30392
tgcaatgtcgactgacgtggtcgccgatgtcccggcccctgaggtggcggcggccgccgaccccgtcgtggagaccacggcagagcccgccgccggcgacgcgaacgcggccaaggagaccaaggccaaggcggccaaggccaagaagccctccgccccgaggaagccccgcgccgcccccgcccacccgacctacgctgagatggtttcggaggccatcaccgccctgaaggagcgaacggggtcgagcccgtacgccatcgccaagttcgtcgaggacaagcacaaggcgcacctcccggccaacttccgtaagatcctgtcggtgcagctcaagaagctggtcgcctccggcaagctgaccaaggtcaaggcctcctacaagctgtctgccgccgcggccaagcccaagccggcggccaagaagaagcccgcggccaagaagaaggcgccagccaagaagaccgctaccaagaccaaggccaaggcgcccgccaagaagtccgccgccaagcccaaggccaaggccccagccaagaccaaggccgcggcgaagcccaaggcggccgccaagcccaaggccaaggcccccgccaagaccaaggccgcggcgaagcccaaggcagccgccaagcccaaggggccgcccgccaaggctgccaagacctcggccaaggacgcgccagggaagaacgccggcgccgcggcgcccaagaagcccgccgccaggaagccgcccaccaagagatccacgccggtgaagaaggccgcgcccgccaagaaggccgcgccggcgaagaaggcccccgccgccaagaaggccaagaagtagatccttggaggaagatcctagggcttggcgatagttttccagtagcagttttttctgttctgtgctgttagtcggaatgtccggctgtgtcgacggtgctagactgtaaatttgaatctgggtttgggtgcagcggatcaccggtgcacaccttggtgtgtgttgtgagcaaacggtgacgacgatcgcgctgtagtaagcttattatgtatttgtgtaactgaattgggtaattgaatcttaattttagcccacaaaaaaaaaaaaaaaaaaaaaaaaaaa

SEQ ID NO: 30393 - DNA, 514 bp, Triticum aestivum
  Clone ID: PAT_TA_30393
gctccccgccaagcgcctccccgtcctcgacctcctccccaatgccgccccgtgacgccgccccgagccctccttcctcctctgcttcgccggccgccgacgccaaatccggcgaccttgagccctctccgagcccactcgtgcacacctgcaggagcatgaccccgagaccgctgctgatgccgttgagatcgactacatcgacgacgcccctccttcttgtctgagcaaccagatggtggatccctggagccagatgccaccgccgacggatactgctacgtggagaccgtcgacgtccaggagtagttcggaggtcccaggttggaggccttgcctcttcgatcattgatgtttgtgctagccttcttaaggcatcttggtttaacttatgtctgtactcaaattttgttgcttccgctaactcttgtgtatcaagctatgtattcgagccctcaaggccctggcgtgtaatataaagcttgtattattttatttgtgtctaaaaaaaaaa

SEQ ID NO: 30394 - DNA, 564 bp, Triticum aestivum
  Clone ID: PAT_TA_30394
gttgatcataagtttttgcttcttcacatgatgtttgccattcttagaatgccattttattttgctttgcttgctgtttgaataaaataccaagatctgaaattattaaatgttagagattcttcgcatagttgcataattattcgactactcattgatcttcacttatatctttcggagtagtttgtcatttgctctagtgcttcacttatatcttttagagcatggtggtagttttattttgaagaaatagatgaactctcatgcttcacttagattattttgagagtcttaatagcatggtaatttgcttaaaatcctaatatgctaggtattcaagaataacaaaactttcttatgagtgtgttgaatactaagagaagtttgatgcttgatgattgttttgagatatgggggtaataatatcaaagtcgtgctagttgattagtgtgaaattgagaaatgcttgtgctgaagtttgcaagtcccgtagcatgcacatatgataaatgttgtgtaacaaatttgaaacatgaggtgttatttgattgtcctccttatgag

SEQ ID NO: 30395 - DNA, 710 bp, Triticum aestivum
  Clone ID: PAT_TA_30395
gtccacaatcatccttgctgtacacaccttttgagagatacacacatgattcagaaattgttagaacactctatgtgcttcacttatatctattgagttatatagtttttgatctagtgcttcacttatatattttagggcacggtggtggatttgttttatagaaactattcttctctcatgcttcacttagattcttttgagagtcctacaaaacagcgtggtaatttgctttaattatgttaggcattcaagattaataaaaaaattcttatgagtgtgttgaatactatgagaagttttatacttgataattgttttgagatatggagatggtgatattagagtcatgctagttgaggtgattatgaaaatacctgtgttaagggttgtgattcccgtagcatgcacgtatagtgaactgctttgtgatgaagttggagcacaattttatttattgattgtcttccttatgagtggcggtcggggatgagcgatggtcttttcctaccaatctatccccctaggagcatgcgcgcagtgctttggtttttgatgacttctagatttttgcaacaagtatatgagttcttttgactaatgttgagtccatggattatacgcacctcatccttccattattgctagcctctcttgtgccacgcaacttccactggtaccatacacccaccatttaccttcctcaaaac

SEQ ID NO: 30396 - DNA, 747 bp, Triticum aestivum
  Clone ID: PAT_TA_30396
atatgtttgattccttgcaatagttttgcgatataaagatggtgatattagtgtcatgctagtgggtagttgtggattatagaaatacttgtgttgaagtttgtgattcccgtagcatgcacgtatggtgaactgttatgtgatgaagtcggagcatgatttatttatttattgtcttccttatgagtggcggtcggggacgagcgatggtcttttcctaccaatctatccccctaggagaatgtgtgtagtactttgtttcgatgactaatagatttttgcaataagtatgtgagttatttatgactaatgttgagtccatggattatacgcactctcacccttccatcattgctagcctcttcggtaccgtgcattgccctttctcacctcgagagttggtgcaaacttcgctggtgcatctaaaccccgtgatacgatacgctctatcacacataagcctccttatatcttcctcaaaacagccaccatacctacctatcatggcatttccgtagccattccgagatatattgccatgcgacttccatcatcatcatatacatgacttgagcatttattgtcatattgctttgcatgatcgcaatatagctagcatgatgttttcacggcttgtcctttttttatgtcattgctatgctggatcatcgcacatcccggtacaccgtcggaggcattcatatagagtcatatctttgttctagtatcgagttgtaatattgagtt

SEQ ID NO: 30397 - DNA, 421 bp, Triticum aestivum
  Clone ID: PAT_TA_30397
taggatttagaccagcatgctgacctatctattgtgcctaggtagggctgcgacgtgttgatctcccaaggccggacatgacctaggaaggtgtgtccggccaaaggggatcgagcgtgttgggaaatgtggtgcacccctgcagggaagtttatctattcgaatagccgtgtccctctgtaacaggatgacccggagttgtaccttcaccttttgacaattagaactggatacttaataaaacacacccttccaagtgccagatacaaccggtgatcactctctcacagggtgatgaggggaggatcatcgggtaggattatgctatgcgatgatacttggtgaacttaccatctactctcttctacatgctgcaagatgtaggttgctagaagcatagtcttcaatacgactagctatc

SEQ ID NO: 30398 - DNA, 692 bp, Triticum aestivum
  Clone ID: PAT_TA_30398
ggacgaaaacgagctgcagacaacgaatggcaatgtgctccctggcacggtcgtcgacacagtcgtggtcgacgggtcgcacgatgacttcttcctctgcagccacgacgggctgcacgggacgagccggccgacgcactactacatgctgaagaacgggcacgccttcaagcccgtggacctgcagaagctggtgtacagcatgtgcttcatgttcgctcgctgcaccaagccagtgtcgctgacggcgcccatcaagtacgccgacaccgcggcctaccgcggcagggactactacgacagcaggatggtgtcccagcagttccaggtccaggagcccgggccatcatcgtcggcctccgtccccgcgggtgctcccctgttccgggatatgcccgaggtgcacgctgatctcaaggacagcatgttcttcatctgatgccgcctgtttttcagcatggggagctccaaccctgcattctgcttcttgtgtgcgccttcttgctgtgtatggtgaaggcctttggctggcgcttctgttacatatttgctgtgttctgtacatgctcgtcaaactgacttacagctttgctgtgttctgtacatgctcgccaaattggctcttacagctctgctgtgttctgtacatgctcgccaaatggcttgtttcaaacttgttctgcacacattct

SEQ ID NO: 30399 - DNA, 729 bp, Triticum aestivum
  Clone ID: PAT_TA_30399
ggttcctctcctccctcgctccccacgcgccgccacacactcacgcacgcgtagggcagcgcccagccccgtgcgcctcctgcctcccgccccgtcacccgcgtctgacgaccagcggcgcccctcctggcctccttcctctctctttcctgaactgcgcccttcatccccaagctctgcgcgctccatccatggtcgccctgacctcctgccacaacgtcgccgtcccccctcgccccggcgagtcgggaaccatgcacccacctcgccggagcacctcgccgcctcgaccacgacgccgccgtcctctccgtcatcgccctgtcgtccccgtcctcctccccgaacgacctccacgcacctcgacgcccccctgctcaccaacaccgacatcgagaccgacgccgcctgccacccagtacgactacggtgttgacgacccctccttcttgccagagcaatcagatgccggagcccaggatccatacgccaccgttgacgacgactcctactacaccggaggtgcctactattacgtgcagcccgctggcgacgaccaggagtagttaggaggatcccaggcaggaggcctgcgcctattttgatctgtatcccagtttgtgctagccttcttaaggcaaacttgtttaacttatgtccgtactcagatattgttgcttccgctgactcgtctatgatcgagctcttgtattcgagccttcgaggccc

SEQ ID NO: 30400 - DNA, 639 bp, Triticum aestivum
  unsure (1)..(639): unsure at all n locations
  Clone ID: PAT_TA_30400
gcgataaggatgccgcccccctgcggcgcctcggtcccctcccccacttgccacctcgctccccactccgtcctccactctccctctccccagatccctttctcccctgcgcccacccgacgcggccgctgctgccgcctcgccgtgaccatggccgacgacctccccgagccaagcgaagacatccaggagcatcatcggcatctcctgcgtctactacagccagcagtgcgagctgggaggcgttgcttccccggatcctcgtcgtcttccaccttcggcaccgccgccgtcatcgcctcatcgtctccgtggccagcgtcgtccctttcgtccgagcttgcgcctcccggcctcgccgagctcgtccacggcttccctgggatgacggagtccaggagccagatgccacctttgacgactgctactaccacgagggcgcctactacctcatgaagaccacgacgaccaggagtagttaggaggctcccaggcaggaggccttgccttttcgatcaaggttgcttttgtgctagccttcttaaggcaaacttgtttaactcatgtctatacacagatattgttgcttccgctgactcttgtgtattcgagcttatgtattcgagcccncgagggccc

SEQ ID NO: 30401 - DNA, 685 bp, Triticum aestivum
  Clone ID: PAT_TA_30401
ggtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggtgaagaaggccgcgccggccaagaagcccgcggccaagaaggccaagaagtagagccccgcatgacggacctagatgccctggcggtagtattgagtagcctaattctctgttcggtgttgtcagtcaagagcttcttgactgtgtcttgggcggcggtgggctgtaaatctgatctatctgtgccgggggtgtaccctttgtgtcgaggaagagtgatatccatgggaatcagttgtactagtagcagtaatctgtgtaatttagtcttttttattattgcagcaatgtccatgagctatttgtcagaaaaaaaaaa

SEQ ID NO: 30402 - DNA, 405 bp, Triticum aestivum
  Clone ID: PAT_TA_30402
gcggccaccggcctcctatcatcacgccaagaagtccagaagctccaccatcgccgtctccttcaccctctccgaagggttcgagctgggaggccccgtacgctcgccatcaccgtcgtcttcgcccacggctgttgcatctcgtcgtcgagctcgtcgcatctggacatccccgggctctctaaccgcgcccacgagctttgtgacattggaaccctggagccatacgccaccgtcgacgacgactcctactacactggaggtgcctactactacgtgcagcccgctggcgacgaccaggagtagtttaggaggatcccaggcaggaggcatgtgcctctttctatctatatcccagtttgtgctagcatttttaaggcaaacttgtttaacttaaaaaaaaaa

SEQ ID NO: 30403 - DNA, 144 bp, Triticum aestivum
  Clone ID: PAT_TA_30403
gcggcagtggaagcccgcgcggagaggactacgagggttcactggttcggctgtggtgtgaggctgccatcgtcgcagggcctggccagcggtgggaatagtagggggcggcgaggcctctgcggcagcacagccggccacggc

SEQ ID NO: 30404 - DNA, 584 bp, Triticum aestivum
  Clone ID: PAT_TA_30404
gcacacacgctgtttcctctctgctcacctcgccgagcgcctccatggccgcgtcgtcaacatgcacgcgggccaccgggccaccgtcctccacaccgacgggtccaggaggtccaccgtggacgagttcgtcgcctgcgccctcgagaccaagccggagagcccgcggcaccgccatcgccttgttctgcaccgcctcggccgccgtcgatccgcggcggacaccaccgcttcggcgccaccccgtcctccccgagtcttctgtgagcatcgctatgctggagtccaggagccagacgccaccgtcgacgacgacccctactacactggaggtgcctactactacgtgctgcccgctgatgacgaccaggagtagtttaggaggatcccaggaaggaggcctacgcctctttcgatctgtaccccagtttgtgctagccttcttaaggcaaacttgtttaacttatgtctgtacttagatattgttgcttccgctgactcgtctatgatcgagcacttgtattcgagccctcgaggcccctggcttgtattatgatgcttgtatgacttatttaaaaaaaaaa

SEQ ID NO: 30405 - DNA, 415 bp, Triticum aestivum
  Clone ID: PAT_TA_30405
ccctcctaattgcaagagcaaccaggcaagccccccccttgatcaccagatatcgcctactctcctctatactgcttgcattagagtagtgtagcatgttactgcttttcgatatcctattctgatgcatagcctatccttgctactactgttgatacctttacctgcaatcctacatgcttagtataggatgctagatttccatcagtggccctacattcttgtccgtctgctgtgttatactatcgggccgtgatcacctgggcggtgatcacgggcatatacttatatactatatacatgacacatgtgatgactaaagtcgggtcggctcgtaggagtacccgcaagtggatctttgtggcggagcgacagggcaggttgagaccgcctacgtaagaggtgggcctggccc

SEQ ID NO: 30406 - DNA, 649 bp, Triticum aestivum
  unsure (1)..(649): unsure at all n locations
  Clone ID: PAT_TA_30406
gcgcctcgctctctctccctcatagtaccccctccccatcgcgccgcagccgccatgaccatcaccatcgttgcgccgacgacctcctcggcgcctgagaatacatccaggggctccatcgtcgtcatcttcttcacccttgaccaaggggtcgacctaggaggccccgttcgcccgccatcgccgtcgtctccctcgcgtacaccgtcgtccgtcaccagatgccgctcctcccgaccatccccgacctcctcgagctcgcccaccgcctcaacaccccgagactgccggcgacccccagttcgactacggtgttgacggcccctccttgccagagcaaccagatgttggagcccaggagccagacgccaccatcaacgatgactcctactacaccggaggtgcctactattacgtggaggccgctgacgacgaccaggagtagtttaggaggatcccaggcaggaggcatgcccctctttcgatctgtatcccagtttgtgctcgccttcttaaggcaaacttgtttaacttatgtctgtacttagatattgttgcttccgctgactcgtctatgatcgagcacttgtattcgagccctcgaggcccctggcttgtattatgatgcttgtatgacttanaaaaaaaa

SEQ ID NO: 30407 - DNA, 543 bp, Triticum aestivum
  Clone ID: PAT_TA_30407
gcatcctcctcgctcgctctcttccctcctctgtcacccgaccgcaatcgtcgtgccgtcgtcgtgctcgtggccgatagcctccccggtgctcaggaggaagtcgaggagcatcgccgtccgcttctgcactgtctgcaagcgccaggtcgagccggagcaactggagccatcgccatcggccttcttccccaaccacggtcgccgtcgtccacctcgtcgacccgctcgccttcggccgtcctcgtgcgtccccaaccccctcgagctcgtccacgacctccccgtaaccccgagaccgatgctgcccatgtgaccgactacgtctccgacaacccctccttgccagagcaaccagatgacggagcccaggagccagatgccaccgccgatgcttactactacgtggaggccgccgatgaccaggagtagttaggaggctcccaggcaggaggccttgccttttcgatcgatgttgcttttgtgctagccttcttaaggcaaacttgtctaacttaagtctgtgctcagataaaaaaaaaa

SEQ ID NO: 30408 - DNA, 599 bp, Triticum aestivum
  Clone ID: PAT_TA_30408
tccacgggctctatccacctaggagcatgcgcgtagtactttctttcgataactaatagatttttgcaataagtatgtgagttctttatgactaatgtttagtccatggattatacgcaccatcacccttccaccattgctagcctctctagtactgcgcaactttcaccggtaccataaacccaccatataccttcctcaaaacagccaccatacctacctattacggcatttccatatccattccgagatatattgccatgcaaatttccaccgttccgtttgttatgacatgcttcatcattgtcatattgccatggatgatcatgtagttgacatcatatttgtggcaaagccaccgttcataattttttcatacatgtcactcttgattcattgcatatcccggtacaccgccggaggcattcacataaagtcatattttgttctaagtattgagttgtaattgttgagttgtaagtaaataaaagtgtgatgatcatcatttttagagcattgtcccaagtgaggaaaggatgatggagactatgattcccccataagtcgagatgagactccggacgaaaaaaagtggccat

SEQ ID NO: 30409 - DNA, 559 bp, Triticum aestivum
  Clone ID: PAT_TA_30409
cggcacgaggcccctctctctctcgcccttccccatctggatcggggtggcgttcgaccgcgccgccgccgcccggggaaccccatcgcccacgccgtcgctgtcctcggctcctcctcgccagctccaccaaccctcaccgcctcgccggaacgtcgtccccgtcaccctcctcgacccccgctgcctaacccctacggccactacaccgagaccgacgccgctgctggtgccccgaccgactacgccattgacgacccctcctacttgccagagcaatcagatgctggagtccaggagctagagataccgaggatgattctacgtggagttcggcttcgaggagtagttaggaggtcccaggcaggaggccttgccttttcgatcgttgctacttttgtgctagccttcttaaggcaaacttgtttaacttatgtctgtactaagatattgttgcttccgccgactcgtctgtgatcgagcacttgtattcgagccctcgaggcccctggcttgtattatgatgcttgcatgacttatttatgttttaaaaaaaaaa

SEQ ID NO: 30410 - DNA, 415 bp, Triticum aestivum
  Clone ID: PAT_TA_30410
gtggcagtcggggacgagcgacagtcttttcctaccaatctatccccctacgagcatgcgcgtagtgctttggtttttgatgacttctaaatttttccaacaagtatatgagttcttttgactaatgttgagtccatggattatacgcaccctttcacccctccattattgctagcctctcttgtatcgtgcaactttcgccggtaccatacacccaccatataccttcctcaaaacagccaccatacctacctattatggcatttccatatccattctgagatatattgccatgcaactttccatcgttccatttattatgacacctttcatcattgtcatattgctctttgcatgatcatgtagttgtcatcgtatttgtggcaaagcaccatcataatcttcatacatttcg

SEQ ID NO: 30411 - DNA, 614 bp, Triticum aestivum
  Clone ID: PAT_TA_30411
ccacgcgtccgctccctctctcgcgccgttgtcgtcgtttttgttcgcgcccgagcgctgccctccatggccttcgtcatcctcacccccgctatcgtccccgtgcggtgaggccatgctcggccgctccttcgccttccagtacgtcttcctcgaggagcagatcgagcaggggagccccaagttgacggatcgagccgatcccctcctctgctgtcgccggcgttcgtcgacgatcccggcgccctctgccgctcctaaccttccaacgagccaccgtgcgctcctacacgatggagcccaggagccagatgccagtgtcgatgacgactactactactactcgggaggtgcctactactacatgcagcacgctgacaatgaacgaagtagtttaggaggatcccaggcaggaggcctgcgcctctttcgatctgtatcccagtttgtgctagccttctttaggcaaacttgtttaacttatgtctgtactcagatattgttgcttccgctgactcgtctatgatcgagctcttgtattcgagccctcgaggcccctggcttgtaatatgatgcttgtatgacttattttatttgtaccgctgtgttgtgat

SEQ ID NO: 30412 - DNA, 692 bp, Triticum aestivum
  Clone ID: PAT_TA_30412
ctcatagtgcttcacttatatatttttagcttgatactattgctcattgtgcctcacttatatcttttgagcttgatagttttgctcatagtgcttcacttatatcttttgagcataataatttttgctctagtacttcacttagatcttttagagcacggtggtggatttgttttaaagaaactattgatccctcatgcttcacttagattattttgagagtatttaatagcattgtaatttgcttaaagataatatacttggtattcaagatatgtgaaactttcttttgagtgcattgaatagtaagataagtttgatgcttgataattgttttgagatatggaggtgataatatcaaagcaatgctagttggggtgattatgaatttaaagaatgcttgtgttgaagtttgtgattcccgtagcatgcacaaatggtgaaccgctttgtgatgaagttggagcacaattttatttattgtttgtcttccttatgagtggcagtcggggacgagccatggtcttttcctaccaatctatccccctaggagcatgcgtgtagtgttttgatttttgatgacttctaaattttcgcaacaagtgtatgagttcttttgattaatgttgagtccatggattataagcaccctttcacccttccaccattgttagcctctcttatactgcgca

SEQ ID NO: 30413 - DNA, 583 bp, Triticum aestivum
  Clone ID: PAT_TA_30413
ttcggcacgagccccttcgctctcctccccgatctggagaggcacccgtacgcagtcgtcaacgccgcctcgtcgttgacacgctccggcaccaccccgtcccgcccgaaggcacccaggagatgcgcctcgacgtcctctacctccacggcaaccggctcgagctagagcgccccggagccgccgccatggacccctcctcttcgaccagggacgtctgctctgcctcgtcgatctgctacctccggtcctccccgaaccaccccgagctcgccaccgccttaccctcgatgccggagcctaggagccagacgccaccgccgacgacgactcctactacactggaggtgcctactactacgtgtaggccgctgatgacgaccaggagtagtttaggaggatcccaggtaggaggcctgcgcctctttcgatctgtatcctagtttgtgctagccatcttatggcaacttgtttaacttatgtctgtactcagatattattgcttctgctgacttgtctatgatcgagcacttgtattcgagccctcgaggcccctggcttgtattatgatgcttgcatgact

SEQ ID NO: 30414 - DNA, 660 bp, Triticum aestivum
  Clone ID: PAT_TA_30414
gccctttcgccgagccgccgcccgtgcgttgccgtcgtcgcgtcttcgtcgtcaccacggtctccgactgccccgcgctgcaccaccacctgcaggagctccgtcatgttcgtctacgtcatctacggccatccgttcaagctgggcacctctacatcaccgggatcgactgcttcgtccccgcggccgtcggtgcctctccggcgaatttcggcgctctctgctgctcccggcaaccaacgagcctccgtgagctcccttgactacgagacggacgtcgctgctgcctcgatcgactacggtgttggcgacccctccttcttgcgagagcaaccagatgttggagcccaggagccagacgccaccgccaccgacgacccctactacaccgagggtgcctactactacgtgcaggccgctgacgacgaccaggagtagtttaggaggatcccaggcaagaggcctgcgcctctttcgatctgtatcccagtttgtgctagccattttatggcaacttatttaacttatgtctgtactcagatattgttgcttccgctaacttgtttatgtcgagcacttgtattcgagccctcgaggcccctggcttgtaatatgatgcttatatgacttattttacttttaaaaaaaaaaaaaaaaaaa

SEQ ID NO: 30415 - DNA, 761 bp, Triticum aestivum
  Clone ID: PAT_TA_30415
gggtcgaccggagtaatgattatatttataaaacttgtcatgattatgattaccctttttctgaacattactcttttaatgtggaaacaatttatagattcgagtttcttatgacactcccactattccgaatgagaagaattttgcttatgtggagagtagtaaattttctatgcttgtagatcatgaaaagaatgctttatgtgatggttatattgttgaatttattcatgatgctactgaaaattattatgagggaggaatatatgcttgtaggagttgcaataatatcaagtttcctctctatgtgttgaaaatcttgaagttatgcttgttttgccttcctatgctagttgattattgttcccataagttgtttgctcacaaaatccctatgcataggaagtgggttagacttaaatgtgctagtcatattcttcatgatgctctctttatgtttcaattcttatcttttatgtgagtatcattgaaatcatcatgcctagctaggggcgtcaaacgatagcgcttgttgggaggcagcccaactttatttttgttccttgatttttgctcctgtttagtagtaaatattttacctagcctctgtttagatgtggttttatacttttaattagtgtctgtgccaagtagaacctttgggaagacttgggaaaagtctttgcgatcatgctgtaaaaaaatagaaactttagcgctctcgagaattgctgccattttttattggagagtgctattta

SEQ ID NO: 30416 - DNA, 614 bp, Triticum aestivum
  Clone ID: PAT_TA_30416
ctccgtcgccatggccgtcgccaacctcgcgcccatcgtcatccacgccacctaggtctgcaccaggggctccgacgacctcgtccaagtcaactgcaagcgccagttcgagatcatcgcccctctgtggattggatcgacctcgtcttcttccacgggctccgccggcgatcttctacggttccctctgctctgctgctactaagccaccgccggacccccgtgtgccttcccgaccccgaggccaatgttgatgccgctgtgatcgactacgtcgacgacgacccttcttccctatcagcggagcttccagatgatggatcccaggagccagatgtcacccccgccgacaactactaccccgagggtgcgtactactacgtggaggctgccgacgaccaggagtagttaggaggtcccaggcaggaggccttgcctcttcgatcgtttttttgtgtgtttgccttcttatggcatccttgtttagcctatgtctgtactcagatattgttgcttttgttgactcttgtgtattgagctatgtattcaagccctcgaggcccctagcttgtaatataaagctagtattattttatttgtgtctaaaaaaaaaa

SEQ ID NO: 30417 - DNA, 725 bp, Triticum aestivum
  Clone ID: PAT_TA_30417
taccttagtattcaattcactcaaaagaaagtttcacatatcttgaacaccaagtatattaacattaagcaaattaccatgttattaaagactctcaaaataatctaagtgaagcatgagagatcaagtttctttaaaacaaatccaccaccgtgctctaaaagatctaagtgaagtactagggcagaaattatcacgctcaaaaagatataagtgaagcactatgagcaaattagcaagctcaaaagatataaggaagcacatagagtattctatcaaatttcaaatcatgtatggctctctcaaaaagttgtgtacagcaaggatgattgtggtaaactaacaagcaaagacacaaataatacaagacgctccaagcaaaacacatatcatgtggtgaataaaaatatagctccaagtaaattaccgatggaagtagacgaaagaggggatgccttccggggcatccccaagctttgaatttttggtgtccttggattatcttgtgggtgacatgggcatccccaagcttaggctctttccactccttgttccataatccatcaaaagaattcacccaaaacttgaaaactccacaacacaaaactcgatagaaatctcgtgagctccgttagagaaagaaaacaaaagactactttaatgtactgtaatgaactcattctttatttatattggtgttaaactactgtattccaatttctcta

SEQ ID NO: 30418 - DNA, 649 bp, Triticum aestivum
  Clone ID: PAT_TA_30418
gcctctccctcgcgccgtagctcttgctcccgcacacgcctgaccccgcgccgccgcacacgtcgtcgatctcgtgctccggagccgtcccgcgccgcgtccaagagcctcaccgtcgacgtctccttcgcctgggtactccgaatcgagcagggacgcatcgcatcatcgccttgttcgccgtcttctctgccacagtcgccactgcctccgcgtcgattcgcccgaccacgacctcccccggcttccccaagactgcctcgaccaccactaccccgtggcggctgccgatgccgctgtgagcgactacgtcaccgacgacccctccttcttgtctgagcaaccagatgctggagcccaggagccagacgccatcgtcgacgacgactcctactacaccggaggtgcctactactacgtggaggccgccgccgacgaccaggagtagtttaggaagatcccaggcaggaggcctgtgcctctttcgatctgtatcccagtttgtgctagccatcttatggcaacttgtttaacttatgtatatactcagatattgttgcttccgctgactcgtctatgattgagcacttgtattcgagccctcgatgcccctggcttgtattatgatgattgtatgacttattttaaa

SEQ ID NO: 30419 - DNA, 860 bp, Triticum aestivum
  unsure (1)..(860): unsure at all n locations
  Clone ID: PAT_TA_30419
cacggggctctatatacttcacttatatcttttgagcttgatagtttttgctctagtgctccacttatatcttttagagcacggtggtctcttaattttgaagaaattgctagtctctcatgcttcacttatatatttttagagtcttttagaatagcatggtacttgctgtggttacaaagttggtcctagaatgatgagcatccaagttgggtataataaaaactatcatagaaaaagaattggatgttatgatcaatatgatgcttgataattgttttgagatatggaggtagtgatattaaattcatgctagttgaggtgattatgaaaagtacttgtgttgagggttgtgattcccgtagcatgcacgtatggtgaaccgctttgtgacgaagtaggagcacaattttatttattgattgtcttccatatgagtggaggtcggggacgagcgatggtcttttcctaccaatctatccccctaggagcatgcacgtaatactttgtttttgatgacttgtagatttttgcaataagtatatgagttcttttgactaatgttgagtccgtggattatacgcgccctcacccttctaccattgctagcctctcttgtgtcgcgcaactttcgccggtaccatacacccaccatgtaccttcctcaaaatagccancatacctacccattaaggcaatttcatagccaattccgagatatatggncaagcaactttccacggttccgttcatatgacatgcattactttgtcaatattgctccttccatnatnatgtanttgacatanganttgtngcaagncaacctcaaaatcctcanaaagtcgncctgatnattg

SEQ ID NO: 30420 - DNA, 731 bp, Triticum aestivum
  Clone ID: PAT_TA_30420
cgggtcgaccggattttgatgaatataatatgcatgtgcttgctgctcctacttgcaattattatgagagaggaactacatctccgcctctttatgtttccaacacgataaaattgaaagaaactatttatactatgcattggcctttactttgtgagcatgaattgttctttcatgacatgccgatgcataggaagagagttagacttcgttattgcttgatttatgttactttgtgctcactactaaattacaaatcattgtttattaaaattggctttgatataccttgggatccaggtggatccattacttgagcactatatgcctagcttaatggctttaaagaaagcgctgctagggagacaacccggaagttttagagagtcatttatttctgttgtgtgctttcatattgtttaaaaacaaaaaaataaagaggggaacctaaaacttttcaaaagggaaagtgaaagtgagaaagacaagcattgttgaagtgggagctagctttgaactttgttcatggtcacgtaaactttgtgaatcttgattacagaaacttttcatcaaaaaaaattatccccttgtacaattccattgtattataaaaataatgtgctaaggtttgcctttaggatgtttacaatgcttgttggtttgtacggtgcaggacagaaactttggctgtagtgcgcgattttaagttttatatggaacgtcaaatggtt

SEQ ID NO: 30421 - DNA, 661 bp, Triticum aestivum
  Clone ID: PAT_TA_30421
tttttttttttttttttttttttttttttttttttttagatctccaagaagatcgaggagaactttgttttgtgattcaaagaagagaagaatcatctagctaataactatggacccgaaggtctgtggtaaactactcacaactcatcggaagggccttaaaaatgatgtagaggccctccgtgatcgattccccctccggtggagcgctggcgaaggctccaagatgggatctcgcggatacagaaggttatggcggtgaaaatagtttttcgtggtgctcctcgaagtttttagggtatatgggtatatataggaggaagaagtacgtcggtggatctccgggctgtccacgaggcagggggcgcgcgcagggggcgtgagcacgcccccaccatcgtgggcagcctgggactcttctggtccatctccgatactccgtgggcttcttctggtccaaaaataagttccgtggagtttcaggtcaactagactccacttaattttccttttctgcgatactctaaaacaaggaaaaaacagaaactggcactgggctctaggttaataggttagtccccaaaaatcatataaaatagcatataaatgcatataaaacatccaaagttgatacgactcactcttgggacacccatcgacc

SEQ ID NO: 30422 - DNA, 564 bp, Triticum aestivum
  Clone ID: PAT_TA_30422
atgtagctgccatggccattgtcgtcgtcgcggccatcggcctcccgtctcctgagagcatgccctggagcttcagcgcctccgactccaccgactacgtgcatcggttcgagctcggacgccctgctgcctcgccatcgcgtcgtcttctccgccaccgccgccgcatctcgtcgtcgagctcgtcgcgtccgggccacccccgcgctccccgacctcgccatcggacttgcacgttggagcccaggagccagacgccaccgttgacgacgactactactactcgggaggtgcctactactacgtgcagcccgttggcgacgaccaggagtagtttaggaggatcccaggcaggtggtctgcgcctctttcgatctgtatcccagtttgtgctagccttcttaaggcaaacttgtttaacttatgtctgtactcagatattgttgcttccgctgactcgtctatgatcgagctcttgtattcgagccctcgaggccccttggcttgtaaaatgatggttgtatgacttattttatttgtagagttgtgttgtgaaaaaaaaaa

SEQ ID NO: 30423 - DNA, 750 bp, Triticum aestivum
  unsure (1)..(750): unsure at all n locations
  Clone ID: PAT_TA_30423
attccgaggtcgacgggccccaagtaaatattcaaggagactcaaacgtctaagcttggggatgccccggaaggcatcccctctttcttcaacaaatatcggtatgtttttggattcgttttgttcatgcgatatgtgcaaatcttggagcgtcttttgcatttagttttcatttttcttttatgcaccatgctggtatgagatagtccttggttgatttatagaattctctatgcacttcacttatatcttttgagtatggctttatagaatgcttcatgtgcttcacttatatcatttgaagtttggattgcctgtttctcttcacatagaaaaccgccatttgtagaatgctcttttgcttcacttatatttattagagcatgggcatatcttttgtagaaagaattaaactctcttgcttcacttatatctatttagagtgttgacaggaattggtcattcagatggttagtcataaaatcctacataaacttgtagatctctaaatataatatgtttgattccttgcaatagttttgcgatatagagatgctaatatgtgggaggtactaagtgaatgattgtggtttagtaaaaatattggtgttaaggtttgtgattcctgaagcatgcacgtatggtctcctaactatgtaaccaaattggcgcgcattgtantttgatggttanccttgcgtgaaggccggggcgcccgatggtaactccnacaaactccccctagagcag

SEQ ID NO: 30424 - DNA, 610 bp, Triticum aestivum
  Clone ID: PAT_TA_30424
gcccactcccgcgctcgccatcgtcatcttgcttgcgcctgagtacgtcgtcgccatggccgagctcaaccgcaatggctatcgtgctcccaggcgcgtgatacactgtcaagaagcctcctcgtcatcgtctccttcatcctcgttgctggatcgaggccaacatgctgcatcgccgtcgctgcgtcggtcgtcttcaacctcggtgccgcggcgtccgccgccatcgatctgcgtcacctcgtccatcccggcctcgcagagcacgccaccgacctccactactccgagaccgctgctggtacccctgatcgactatgttgttgacgaccccttcttgccagagcaaccaggagctagaggatcccgaggatgattctgcgtggagtttgacttcgaggagtagttaggaggtcccaggcaggagggctcgcctttttgatcgttgctacttttgtgctagccttcttaaggcaatcttgtttaacttatgtctgtacttagatattgttgctttcgctgactcttgtctcttcgagaatttgtattcgagccctctggcttgtaatataaagcttgtattattttaatttcgtgtctaaaaaaaaaa

SEQ ID NO: 30425 - DNA, 345 bp, Triticum aestivum
  Clone ID: PAT_TA_30425
ggtcgcctcgtcttcgtcctcctccccatcggacgcccccacgcctcgacgcccccctgctctccaacgccgatggtggatccttggagccagatgccaccgccgacggatactgctacgtggagaccgccgatgaccaggagtagttaggaggtcccaggcaggaggccttgcctcttcaatcgtgttgcttttgtgctagccttcttaaggaaaactttgtttaacttatgtctgtactcagatattgttgcttccgttgatctcttgtgtatcgagctatgtattcgagccctcgaggcccctggcttgtaatataaaacttgtattatttcaaaaaaaaaa

SEQ ID NO: 30426 - DNA, 604 bp, Triticum aestivum
  Clone ID: PAT_TA_30426
acgaggctccctcgcgccgtagctcttgctcccgcacacgcctgaccccgcgccgccgcacacgtcgtcgatctcgtgctccggagccgtcccgcgccgcgtccaagagcctcaccgtcgacgtctccttcgcctgggtactccgaatcgagcagggacgcatcgcatcatcgccttgttcgccgtcttctctgccacagtcgccactgcctccgcgtcgattcgcccgaccacgacctcccccggcttccccaagactgcctcgaccaccactatgctggagcccaggagccagacgccatcgtcgacgacgactcctactacaccggaggtgcctactactacgtggaggccgccgccgacgaccaggagtagtttaggaagatcccaggcaggaggcctgtgcctctttcgatctgtatcccagtttgtcctagccatcttatggcaacttgtttaacttatgtatatactcagatattgttgcttccgctgactcgtctatgattgagcacttgtattcgagccctcgatgcccctggcttgtattatgatgattgtatgacttattttattttagagttgtgttgtgataaaaaaaaaa

SEQ ID NO: 30427 - DNA, 797 bp, Triticum aestivum
  Clone ID: PAT_TA_30427
cacccacacatgatagtcctattatctttttgaattctcccgactacactatatcggagaagtttgcgcttagtaaggattatattgatgggttgccttttaccattgcacatgatgatgaatgtaatatgcatgtgcttgctactcctactttcaattattatgagagaggaactatatctccacctctctatgtttccaatacgatagaattgcaagaaactgttatactatgcattggcctttacttggtgtgcatgaattgttcttttatgacatgccaatgcataggaagagagttaaacttcgttgttgcatgatatatgttactttgtgctcactactaaattacaaatcattgttaattaaaattggctttgatataccttgggatccgggtggatccattacttgagcactatatgcttagcttaatggctttaaagaaagcgctgccagggagacaacccggaagttttagagagtcatttatttctgttgtgtgcttttgtaaagtttaaaaacaataataacgtgccaaggtttgcctttaggatgtttagattgcttgttggtttgtgcggtgcggaaacagaaactttggctgtagtgcgtgattttacattttttactgaaacgtcaaacggttttaaatttctttgcactgtctttatatacaaattgtttatctttcctaattgtttcataatttttggagtaccagaagtatggtgaatgtttagattactatagactgtcctgtttaagacagattctgtttttaatgcatagtttgc

SEQ ID NO: 30428 - DNA, 891 bp, Triticum aestivum
  unsure (1)..(891): unsure at all n locations
  Clone ID: PAT_TA_30428
cggtcccgtttcgagtcaccaactggggccaatggtggtgggccaggagcgagggacattggtcccggtttgtcccaccaaccgggaccaataggtccagacgaaccgggaccaatggcccacgtggcccggccggcccctggggctcacgaaccgggtccaatgcccccattggtcccggttctggattgaaccgggactaatgggctggatcggcctggaccattggccccttttctactagtgttatagaatgcttcatgtgcttcacttatatcatttgaagtttggatttcttgtttctcttcacatagaaaactgatgttcgtagaatgctcttttgcttcacttatatttgttagagcatggtcttttgtagaaagaattaaactctcatgcttcacttagatctatttatagtcaacaggaattggtcaattgcatggttactcataaaatcctacataaaacttatggatcactgaatatgatatgtttgattccttgtgatagtttgcgatatagagatggaatatgtgggaggtactaagtaaacggttgtgttaagtcaagaatatgggtgttaaggttggtgatccctggaacatgcacatatagccctcgttaagctangatgttggagcatgattattatgatgctcccttaagatggnggcngggaccangatggctttccctacancctacccccctaaagggnagcgtagganacttggttttgagggctaataacttttggcaataagtatatgatcctttangactaatgnganccaatggntttaccatcctactttccgaaattgncnacncctaagggaccgtanatgccttcnaaaaccaganngggnaactccaagggancaaacc

SEQ ID NO: 30429 - DNA, 407 bp, Triticum aestivum
  Clone ID: PAT_TA_30429
gaagacgcggcattggaagcccgcgcggagaggagtacgagggttcactggttcggctgcggtgtgaggctgccgtcgccgcagggcctggccagcggtgggaatagtaggggcggtgaggcctccgcggcagcacagccggccatgggaggcaggagcatgcgacacgaccggcgctgctttgggtggctggagcaagaagaccagaggttgaagaagcactacggccgttggatggacatcgtacggtcactggagctagaatcattcatattgactaagttgataaagcccttcatccccatcaacttagtaggcccactagtcagcctcccaccaaggtgggtcccagctagccgggggagtattcatttttttgtgcgtaataaggaggcacttccgatggg

SEQ ID NO: 30430 - DNA, 772 bp, Triticum aestivum
  Clone ID: PAT_TA_30430
ggtctagaactcgcgggtcgacgggtatctgaagctagagtcttattcaccacatgatatgtgttttgcctggagcatcttgtatgatttgagtctttgatttttagtttaccacaatcatccttgctgtacaccccttttggagagacacacatgaatcggaatttattagaatactctatgtgcttgacttatatcttttgagctagataatttttctctagtgcttcacttatatctttttagagcacgatggtggtttattatagaaatcattgatttctcatgcttcacttatattactttgagagtcttttagaacagcatggtaatttgctttggctacaaaattagtcttaatatgataggcatccaagatgggtataataggaactatcataaaaagtgcgttgaatactatgagaagttggatgcttgataatttttttgagatatgaggatggtgatattaaatttgtgctagttgagtagttgtgaatttgagtacttgtgctgaagtttgcaagtcccatagcatgcacatatggtaaccattgtgtaacaaatttgaaacctgaggtgttctttgattgtcttccttatgagtggcggttggggatgagcgatggtcttatcctaccaatctatccccctaggagcatgcgtgtagtgcttggtttttgatgacttctagatttttgcaataagtgtatgagttctttatgactaatgttgagtccatggattattcgaactctcacccttccatcat

SEQ ID NO: 30431 - DNA, 691 bp, Triticum aestivum
  Clone ID: PAT_TA_30431
ctgcgccataggatttagaccggcgtgctgaccaatctattgtgcctatatagggctgcgacgtgttgatcttccgaggccgggcatgacccagaaaagtgtgtccggacaaaggggatcgagcgtgttgggaaatatggtgcacccatgcagggaagttaaactattcgaatagccgtgatcttcggtaacaagacgacttggagttgtaccttgaccttatgacaactagaaccggatacttaataaaacacacccttccaagtgccagatataacccggtgatcgctctctaacagggcgacgaggggaggatcatcggataggattatgctacgtgatgatacttggaggacttcagtctactctcttctacatgctgcaagacggaggctgccagaagcgtagtcttcgaaaggactagctatccctctcttattccggcattctgcagttcagtccacatatgatagctttattccagttgataccaatgcatgcatatgtagtgtagctccttgcttgcgagtactttggatgagtactcacggttgctttctccctcttttccccctatcccttctacctggttgtcgcaaccagatgttggagcccaggagccagacaccaccttcgacgatgacttctactacaccggaggtgccttctactacgtgttggccgtcgaccc

SEQ ID NO: 30432 - DNA, 644 bp, Triticum aestivum
  unsure (1)..(644): unsure at all n locations
  Clone ID: PAT_TA_30432
ctccttggattacttttggtacctcccctgctaggactttatagcaaggcacacatcaggtntggtacacaacattgcatacatgatagagcctatggcttgaagcataggaaacatctttcaatattttctctatcttctgcagtggtcgggcattgagtcttactcaacttcacaccttgtaacacaggcaagaaccctttctttgcttgatccattttgaacttcttcaaaactttgtcaaggtatgtgctttgtgaaagtccaattaagcgtcttgatctatctctatagatcttgatgcctaatatgtaagcagcttctccaaggtccttcattgaaaaacatttgttcaagtaggccttaatgttgtccaaaagttctatatcatttcccatcaagagtatgtcatctacatagaatatgagaaatgctacagagctcccactcactttcttgtaaacgcgggcttctccataagtctgcataaacccaaatgctttgatcatctcatcaaagcgaatgttccaactccgagatgcttgcaccagcccataaatggatcgctggagcttgcatactttgtcagcattcttaggatcgacaaaaccctccggctgcatcatatacagtcccgtcgaccc

SEQ ID NO: 30433 - DNA, 439 bp, Triticum aestivum
  unsure (1)..(439): unsure at all n locations
  Clone ID: PAT_TA_30433
gctagtctttgataggctaggctttccccttctcttctggcattctgcagtttagtccacaaatacagcccatttcctttgatacagatgcacacttagtttaaatctgatgtaagtcttgcgagtactttggatgagtactcacggttgctttgctacctctttttcccccatacccgattgttgcgaccagatgacagatcccaggagccagacgacaccactgatgattactactaccccgagggtgcctactactacgtggagaccgtcgacgaccaggagtagttaggaggctcccaggcaggaggccttgccttttcgatcgttgctacttttgtgctagccttcttaaggaaaacttatttaactcatgtatgtactcagatattgttgcttccgccgactcttgtgtaatcgggcttatgtnaaaaaaaaa

SEQ ID NO: 30434 - DNA, 676 bp, Triticum aestivum
  Clone ID: PAT_TA_30434
tttttttttttttttttttttttttttacctttccgtctaatctattttgcaatatcataacacaagtcattacaaacaacacttgccttgtcccctcaggtattctcaaggttttagcgtaatgtcaattgagctttgttcgacaaaagtactattgaactagctaagaacttatattttacctaagtgctactgcgatctatacatcaaagcataatcagcctacacatattcctacatcaaaaaaattatttcttctttgagatactcactcggtcccataatataggatttggtgctgcttgcaagatgccctcttacgccgatttcactcgctgcatgttgcgtcaaagacaggtgcataatgcatttgctgcttcatgttgtttacacagtttacaataatagttgttgaagtgtaccccctgcatcactgattgtgttatggctgagcttgaaaagctaggacaaaaataccgtgtcgcgttgagaattgctaaggaccctaggttccagagattagcgtgcacacacaagggaacttatgctgatgactgtattgttgagagaattactcagcacaaatgctacattgttgccacctgcgatagagatttaaagaggagaataagaaaggttcctggtgttccaatcatgtacctcggccgcgaccac

SEQ ID NO: 30435 - DNA, 448 bp, Triticum aestivum
  unsure (1)..(448): unsure at all n locations
  Clone ID: PAT_TA_30435
aatacccctctccctcgtaagtatttgacgacctggaagaggccgacctcgcggtcgtcgtcatcgtcgtcgatcccgtggccaccggcctcccttcgtcgcgccaagacgtccaggagctccgccatcgtcgtctccgtcgccatcgactatcggttggagctcggacggcctgctgcctcgccatcgcgcggtcttctcctgtcggccgcccccaccatcgccgtcgatctccaccaccggcgcctcccggcctcgccaagctcgtccacggcctccccgggaccccgagattgatgctgccattgtgatcagctacgtcgacgacgaccctccttgccagagcaaccagatgtcggagcccaggagccagatgccaacgccgatgcatactactacgtggagaacgcccgggatnaggagtagttangagntccaagcaagaggc

SEQ ID NO: 30436 - DNA, 690 bp, Triticum aestivum
  Clone ID: PAT_TA_30436
tacttggagctatatttttattcgccacatgatatgtgtttttcttggagcatcttgtatgatttgagtcttttctttttagtataccacaatcatccttgatgtacacaccttttgagagagacacacatgaattagaatttattagaatactctatgtgcttcacttatatcttttgagctatatagtttttgctctagtgcttcacttatatcttttagagcacgtcagtggttctattttatataaataattgatctctcatgattcacttatattatttttagagtcctttagaacaacatggaaatttgcttttaggcattataaaaactttcatataagtgcattgaatactaagagaagtttgatacttgataattgttttgagatatggagatggtgatattagagtcatgctagttgagtagttgtgaatttgagaaatacttgtgttgaagtttgtgattcccgtagcatgcacgtatggtgaactgttatgtgatgaagtcggagcatgatttatttattgattgccttccttatgagtggcggtcggggatgagcgattgtcttttcctaccaatctatccccctaggagcatgatgcacgtagtactttctttcaataactaatagatttttgcaataagtatgtgaattctttatgactaatgttgagtcaatgg

SEQ ID NO: 30437 - DNA, 802 bp, Triticum aestivum
  unsure (1)..(802): unsure at all n locations
  Clone ID: PAT_TA_30437
ggcaccccagttatatccagcactaagcttggggtgccttggaggcatccctcttgtctccaacattccggtacctcacttggatcatgttttcattcgtcacatgtatgtgttttgcttggagcattaattattttgttagtattttcttgctgttatttagaataatgttttgcatcttttatttcaataaaagtggcattgatagcctttactatgcttattttacaagtctacatgttgctgtttgaaaacagaaagtttaccgctgttgcaaaaattcccgaggaaagtcagaatgtgataaaatgttgaaactttttgcataataagctctgataaattttatacagggtggtagaatttcataatgtttggagttagggaagtatcaatactcttgcattctttacagactgtactgttttggcagattgctggtatgtttgcgttgtttgcatatgttcgcttatttaatgattctatttgaggataggagtattaaatatgcagaggcatttagtattcaatgttgaataataattttggtgatttgttacagtagaatatgataaggttttgcattggtttatactaacctatctcacgagttcttgttgagtttgttgtgaatgaagtttttgataaaaagaaagaccatgatatgagaggaattaaggagacgcaaaagttcaagcttggggatgcccaaggcaccccaagatattatttcaagaagtctcaagcatctaagattggggatgccccggtaggcatcncacctttcttcttcaacaactat

SEQ ID NO: 30438 - DNA, 714 bp, Triticum aestivum
  Clone ID: PAT_TA_30438
acacggcccgcggaggtgttcttcctgcggtttgaccatatctttgagatgtttctgacaaagcggctcgattttacaatcgtccacctttttacactacatatgagcttcgtcatgaagagagaagaagtctcgcaaatctgtgtggcggatccgtactacatgcacgagtctttcttgagtctcggtgactttgagcgtgaaactgctagggactacctccaaaacttcatggtacagaataaggaccaggaaattggcctcctgccttatcatccaaagtaagtcaattccggacaaccctttcgtacatttcaatcattccttctcgctcatatggggaataatttgaggtgtcttttccccgcagcaacgggcgcgccgtccttatcgttctttacccgcaagtctcccacgccgtgtattttgacccttccagagactacgagaaaaaagactacacccacataatgaatattctagatgatgctctccaaggcttcagctttagaggtggccatgtgcagatcaagaaacaaaggaacaagaagatgggtttcgcgcataaaactaacttctcctgcatccatgtcccaaaaccaagcacgaaggatggattctacatcgtccatctcatgattcagttcaacacggatcaccaaaagcttcgcattaacagcagaaatgatgatcgtaaccacaagtggctagaat

SEQ ID NO: 30439 - DNA, 655 bp, Triticum aestivum
  Clone ID: PAT_TA_30439
tcgctctctcccgaacacaaccgccgccatgcgccgctcgatcccgcggccaccggcgcccctacgcccgagaaccttgcctgggaggcgtgccggccgtcgcctcttcttcctcaaccattggttaaagccggggcgatctacagcgaaggaatcgggtccttcttcgtcctcggccgcggcttcttccccgacgaaccccggcgccgtcggtcctcctcgaggccgctgccctcccctactgaaccacaaccccgaggtcgttgctgagggcccggtgatcgactacgtcgacgacgacccctcctttccagagcaaccagatgtcggagcccaggagccagatgccaccgcgatgcttactactacgtggaggccgccgacgactaggagtagttaggaggctcccaggcaggaggccttgccttttcgatcgatgttgcttttgtgctagccttcttaaggcaaacttgtctaacttatgtctctactcagatattgttgcttccgttgactcttatgttttcgagcttatgtattcgagccctcgaggcccctggcttgtaataataaagcttgcattattttcaatttggggcctacaaaagacaaggaaaattaataaaaaaaggcccctagggccctccgagggccg

SEQ ID NO: 30440 - DNA, 1038 bp, Triticum aestivum
  Clone ID: PAT_TA_30440
ttgcacccacgcatgatagtcctattatctttttgaattctcccaactacactatatcggagaagtttgcacttattaaggattatattgatgggcttccttttaccgttgtacatgatgattctgatagatataatatgcatgtgcttgctgctcctacttacaattattatgagagaggaactatacctccacctctctatgtttccaatacgataaaattgcaagaaactgtttatactatgcattagcctttactacgtgtgcatgaattgttcttttatgacatgccgatgcataggaagagagttagactttgtcattgctttatatatgtctctttgtgctcactactaaatgctaaatcattgttaattaaaattggctttgatataccttgggatccgggtggattcattacttgagcactatatgcctagcttaatggctttaaagaaagcgctgccagcgagacaacccggaacttttagagagtcatttatttctgttgagtgctttcatatagtttaaaaacaacaaaaataaagaggggaacccaaaactttttctaaaagaaaagtgaaagtgagagagacgagcattgtgaaagtgggggacgtccttgaactttgttcatgcccatgggaactttgtgaatcttgattacagaaacttttcaacaaaaataattatcctcttgtataattccattgaattataaaaataatgtgccaaggtttgcctttaggatgtttacaatgcttgttggtttgtacggtgcaggacagaaactttggctgtagtgcgcaattttatattttttactggaacgtcaaacggttctgattctttttgcactgcctttctgtcaaattgtttattttcctaatttttgtagaatttttggggcacaaaaagtatggtgaatgttcagattgctacagactgttctgtttttgacagattccgtttttgatgcatagtttgcttgttttgatgaaactatcaatttctatcagtggattaagccatggaaaa

SEQ ID NO: 30441 - DNA, 1028 bp, Triticum aestivum
  Clone ID: PAT_TA_30441
tcgacgggacgtgctacacttataacttttgagcgttataattttgctctatgtgcttcacttagatcttttagagcacggtggcggattcatgttaaagaaactattgatctctcatgcttcacttaaattattttgagagtctcttaatagcatggtaatttgcttaataataatatgcttggtattcaagatttgtgaaactttcttttgagtgtgttgcatactaagaaaagattgaagcatgataattgttttgagatatggaggtgataatattaaagtcatgctagttgagtagttgtgaatttgagagatacttgtgttaaagtttgtgattcccgtagcatgcacgtatggtgaaccgttatgtgatgaagtcggagcatgatttattgattgattgtcctccttatgagtggcggtcggggacaaacggtggtcttttcctaccaatttatccccctaggagcatgcgcgtaatactttgtttcgataactaatagatttttgcaacaagtatatgagttctttatgactaatgttgagtccgtggattatacgcactctcatccttccaccattgctagcctctcttataccgcacacctttcgccggtatcagacacccaccatataccttcctcaaaacagccaccatacctatgtattatggcatttccatagccattccgagatatattgccatgcaactttccaccgttccgtttattatgacacactccatcattgtcatattgcttagcatgatcatgtagtcgacatcgtatttgtggcaaagccaccattcataattctttcatacatgtcactcatgagtcattgcatatcccggtacaccgccgaaggcattcatatagagtcatattttgttctaagtatcgagttgtaattgttgagttgtaagaaaaataaaagtgtgatgatcatcattattagagcattgtcccagtgaggaaaggatgatggagactatgattcccccacaagtcgggacgagactccag

SEQ ID NO: 30442 - DNA, 598 bp, Triticum aestivum
  Clone ID: PAT_TA_30442
gaactcccctttccctttggtcacaacttggagttcgcctgatgtcatggtcgccatgccggcgtcgtagccgcggccaccgtgcgcttcttcgctgggggagacgtccagcagaaccatcgtcgtccacttcttcatctccacccacgagatcgagcccggagccaccgcatcgaccggacgaggtcttcttcaagctctgccccgccgctcgtcatcttcgatttcgacctcattgaagcctccccgagcccgctgactttctctacagctgcgatacattggagcccaggagccagacgccaccgtcgacgatgactcctactacactggaggtgcctactgctacgtgcaggacgctgacaacgaccaggagtagtttaggaggatcccaggcaggaggcctgcccctcttttgatctgtatcccagtttgtgctagccttcttaaggcaatcttgtttaacttatgtctgtactcagatattgttgcttccgctgactcatctatgatcgagctcttgtattcgagccctcgaggcccctggcttgtaatatgatgcttgtatgacttatttttatttgtagagttgtgttgc

SEQ ID NO: 30443 - DNA, 1045 bp, Triticum aestivum
  unsure (1)..(1045): unsure at all n locations
  Clone ID: PAT_TA_30443
tttctgatgaagttttgtgtggatgaagtgttcgatgatcgagaaggtctcgatgtgagaagaaggaagagatgcaagagctcagtcttggggatgcccgaggcaccccaagtaaatatttaaggatactcaagcgtctaagcttgggtatgccccggaaggcatcccctctttcttcaacaagtatcagtatgttttcggattcgtttcgttcatgcgatatgtgcaatcttggagcgtcttttgcatttagttttcatttttattttatgcaccatgctggtatgggatagtccttggttgatttatagaattctctatgtacttcacttatatcttttgagtatgaccttgtagaatgcttcatgtgcttcacttatatcatttgaagtttggattgcatgtttctcttcacatagaaaaccgttctttatagaatgctcttttgcttcacttatatttattagagcatggtcttatgtagaaataattaaactctcctgcttcacctatatctatttagagagtcancaggaattantcatttgcatggttagtcataaaatcctacataaaacttgtggatcactgaatatgatatgtttgattccttgcaatagttttgcgatatagagatgataatatgtggaaggtactagtaaatgattgtggttagtaagaatatttgtgttaaggtttgtgattcccgaagcatgcaagtatagtctctcgttatgctaagaagttggagcatgatttattattgattgtcttccttatgagtggcggtcggggatgagtgatggtcttttcctaccaatctatccccctaggggcatgcgtagtagtactttgcttcgagggctaataaacttttgcaataagtatatgagttctttatgactaatgtgagtccatggattatacgcattcttacctctttccgcaatttgctagcctctatggtaccgtgcattgtcctttctcacctcgagatgtggtgcaaactacaccggtgcatccaaaccccttgacatgattcacg

SEQ ID NO: 30444 - DNA, 816 bp, Triticum aestivum
  Clone ID: PAT_TA_30444
acggtcgtagcttccgggtgcacgggttgatacaaattactatagactattctgtttttgacagattctgtttttcgtgtgttgtttgcttattttgatgaatctatggctagtaatggagtttataaaccatagagaagttggaatacagtaggtttaacaccaatataaataaataatgagttcattacagtaccttaaagtggtgctttgttttctttcgctaacggagctcacgagattttctgttaagttttgtgttgtgaagttttcaagttttgggtaaagatttgatggattatggaacaaggagtggcaagagcctaagcttggggatgcccaaggcaccccaaggtaaaatccaaggataaccaaaagcctaagcttggggattccccggatggcatcccctctttcgtcttcgttcatcggtaactttacttggagctatatttttattcgccacatgatggcatcccctgttttgcttggagcattattttattttgctagtttttgcttgctgtcagttagcataatgttttgcatctttagtttcaataaaaaaagtcaaggatagcctttgccatgcttattttgctagtttgcatgttgctgtttgaaaacagaaagttcaccgttgttgcaaaaattccctagaaaagtcatagaatggtataacgttgaatctttttgcatattaagctctgataaatttattacagtaggaattttagttcataatttgtggattcagggaagtatttttactcttgcattctttacatactgtactgttttcgcagattgctgtta

SEQ ID NO: 30445 - DNA, 691 bp, Triticum aestivum
  unsure (1)..(691): unsure at all n locations
  Clone ID: PAT_TA_30445
gcctctctccccactcctcctctgtccctctccccagatccctttctcttccccaccgaacacgttcgccgtcggccacctcgccccgccgtggccaccgtccttcctgcatcaagccgatgtgaccacgagctccgcctcgtcctctgctccttctccgtcgaaccacgagacccggagcgctccacaacgccggcgccggcatcgtcttccacctccggatgcgccgggagctcgccgtcgatccgcgccgccccgagcacctcgagccgtccccggaccttctctgcaacggccaccccgagaccgatgctgatgtccctgtgatcgactacgtcgacgacgaccctccttcttgtgtgagcaaccagatggtggatcccaggtgccaagatgatgccacccccgcagactactactactacccaaagggtgccttctactacgtggagcccgccgacgaccaaggagtagtttgggaggtcccaggcaggaggccttgcctcttcgattgtgttgcttttgtgctagccttcttaaggcatccttgtttaacttaatgtctgtactcaagatattgttgcctccgctgactgttgtgtaatgagcttgtatcgaacccttggagccctgggcttgtaatataaagctngtataatttaattgggtccnaaaaaaanaaaaaaaaacc

SEQ ID NO: 30446 - DNA, 650 bp, Triticum aestivum
  Clone ID: PAT_TA_30446
ggcgccgttttctcccccgtgacggtcggccgtcgccttgccgtcgtcgatgccgcggcccatgaccacctcaagccacccggaggtgtccaggagcttcaccataatcacctccttcgcctacgctattgggctggactggggaggccttgtacgctcgccatagccgtcgtcttcgtcacgtacatcgccgatcgcgccgtcgattcacaccgctccggtctaccctcggcctcctcgaccacgcccccgagctcgctactacgagactgacgccgctgctggtgccccgatcgactacgctgttgacgacccttctttcttgccagagcaaccaggcaatggagtccaggagccagacgccaccgttgatgacgactcctactacactggaggtgcctactactacgtgcaggccgccgacgacgaccaagagtagtttaggaggatcccaggcaagaggcatgcgcctctttcaatatgtatccttgtttgtactagccttcttaaggaaaacttgtttaatttatgtatgtactcagatattgttgcttccgctgactcgtctattatcgagctcttgtattcgagccctcgaggcccctggcttgtaatatgatgcttgtagtcttaaaaaaaaaaaaaaaaaa

SEQ ID NO: 30447 - DNA, 1028 bp, Triticum aestivum
  Clone ID: PAT_TA_30447
ccgggccgacgggcaacatgatatgtattttgcttggagcgtcattttattttgttagtatttgcttgattttatttataatagtgttttgtatctttagtttcaattaaaatgtcaaggatagcctttaccatgcttattttgctagtatacatgttgctgtttgaaaacagaaagtttaccgttgttgcaaaaattccctagaaaagtcagagaatggtataatgttgaatctttttcatattgagctctgataaatcttctacagcatagtatttttcttataatttttcgagttagggaagtatgatgaatcttgcattctttacagactatactgttttggcagattgctgttatgtttgcattgtttgcatatgtttgcttgtttaatgattctatttgaggataggagtattaaatatgcagagacatttagtattaaatgttgaataataatgttagtgatttgttacagtataatatgataaggttttgcattggtttatactaacctatctcacgagttcttgttgagtttgttgtgaatgaagcttttgataaaaagagaaaccatgatatgagaggaattaaggagacataaaagttcaagcttggggatgcccaaggcaccccaagataatatttcaagaagtatcaagcatctaagattggggatgccccggtaggcatcccacctttcttcttcaacaactatcggttagtatcggttgagcctaagtttttgcttcttcacatgagttgtgctatccttgcaatgtagttttatttagctttgcttgctgtttgaataaagtatcaagatcagaaattattaaatgagagagagtcttcgcatagttgcataattatttagctactcattgatcctcacttatatctttcagagtagtttgtcatttgctctagtgcatcacttatatcttttagagcatggtggtagttttattttgaagaaatagatgaactctcatatttcacttagattattttgagagtcgttaata

SEQ ID NO: 30448 - DNA, 744 bp, Triticum aestivum
  Clone ID: PAT_TA_30448
gccacgcgccggccatcgcccggccaccccccttcttaaccaagcggcgccaccaaaccctagcccctcacatatctccccctcgcgccccctcctccctctgcgctcgtcgacatcgtggcgccccgacccgtccgcctctgccctgctgacctcgccgtcaaccgcggccaccgtcgtctccggcgtgcaggagcacgtccgggaggttcgccgcggccggatccgtccgttccggggaccagctcaagccgggacggtccatgtgctcgcaatcgagcccttctccgtcgcggacgtcatcaactcgtcgtcgttcccactgctctgggccgcttcccgaccttctaacctcgtccacgagaaccgggaccccgagactgccggcgacccccagttcgactacggagttggtgacccctccttgccagagcaaccagatgctggagtccaggagccagacaccaccgtcgacgatgactcctactacaccggacgtgcctactactacgtgcagcccgctgacgatgaccaggagtagttaggaggatcccaggcaggaggcatgcgtctctttcgatctgtatcccagtttgtgctagccttcttaaggcaaacttgtttaacttatgtctgtactcagatattgttgcttccgctgactcgtctatgatcgagcacttgtatttgagccctcgaggcccctggcttgtattatgatgcttgtatgacttaaaaaaaaaa

SEQ ID NO: 30449 - DNA, 878 bp, Triticum aestivum
  Clone ID: PAT_TA_30449
tctttaaaagattgtatttccttgttgcaatccgtgctaaattctcctcatgcttatagtcaaaataaggcttttaccaaacatatcgttgatgatttaatgtaatcttatgaagaaaagcttgaattggaagtatctatccctagaaaactttatgatgagttggaacctactattaaaattaaaattaaagatcatgaatgctatgctttgtgtgatttgggtgctagtgtttccacgattccaaaaactttgtgtgatatgttaggtttccgtgaatttgatgattgttctttaaacttgcaccttgcggattccattattaagaaacctatgggaagaattaatgatgttcttatttttgcaaatatgaactatgtgcccgtaaatttcaatgttcttgatatagattgcaatccttcatgtcctattattcttagtagacctttccttagaacgattggtgcaattattgatatgaaggaagggaatattagattccaatttccgttaaggacagacatggaaaacttccctagaaaaaaattaaattaccttataaatctactatgagtgccacttatggattacctaccaaagatggtaatacctagatctatccttgcctttatgcctagctaggggcgttaaacgatagcgcttgttgggaggcaacccaattttattttagtttcttgctttttggttctgtttaggaataaataatccatctagattctgtttagatgtggttttatgttttaattagtgtttgtgccaagtagaacctttgggaagacttggggaaagtctttgcgatcttgctgtaaaaagcagaaactttagcgctcactagattagctacaactttttactgg

SEQ ID NO: 30450 - DNA, 632 bp, Triticum aestivum
  Clone ID: PAT_TA_30450
gtccatagttgatttttacaatgctcttttgcttcactaatatttgttagagcgtgggcatatcttttgtaaaaagaattaaactatcttgcttcacttatatctattcagagagatgacaggatttggtcattcacatggttagtcataaaatcctacataaaacttgtaaatcgctgaatatgatatgtttgattccctgcaacagttttgcgatataaagatggtgatattagagtcgtgctactggttagttgtgcgttgtagaaatacttgtgttgaagtttgtgattcccgtagcatgcacgtatggtgaaccgttctgtaatgatgttggagcatgaggtatttattgattgtcttccttatgagtggtggcctgggacgagcgatggtcttttcctaccaatctatccccctaggagcatgcgcgtagtactttgtttcaatgactaatagatttttgcaataagtatgtcagttctttatgactaatgttgagtccatggattatacgcactctcacccttccatcattgctagcctctctagtaccgggcaactttcgccggtaccataaacccaccatataccttcctcaaaacagccactatacctacctatcacggaat

SEQ ID NO: 30451 - DNA, 758 bp, Triticum aestivum
  unsure (1)..(758): unsure at all n locations
  Clone ID: PAT_TA_30451
aggaattcggacgaggcaatccccctccccctctctctacccgattgcaccgttgcccccgacctaaacctaactcaactgcgccaccgcccctgatctgcgtgccgccgcccgtcctctggtcccctcgtgccacatcatctccgaccctggcctccctccccgcagggcaccatccgcccgggagcagcagctccgtccggccacgccgaggagcagcagcgccgtcaaccgccgctgaggatccactgctgatttgtctccacgtgcgacctctgtttcatctgatttccttcgctccgccccgcctacagaattcaagatgtggtggaggcaagtcaagattttacgccggttctgttacaggaacagaggatagtcctcctaagctgcttaatggtagagttggaatccctctagtccagctccaggcaggaggtcggatggaactggatcagtatcgagattaggaatcaaccaagtcgcccttttgatcaactacaacagcaggacaaacaatggtgggaaaatggtagaaagtagcaagtccactagttgatcgaagatgttcttgtgattgcttttcttgataatatggatgacacattttgttcatatggaagttgatttggcttggcgattgaagatttggtcccttggtctcttttgaactttggccattatgtttgtaacatgcctctcttgtatatccgacttgtgtatttccataaggttgagctaactnagtaagaaaacta

SEQ ID NO: 30452 - DNA, 575 bp, Triticum aestivum
  Clone ID: PAT_TA_30452
gaggccctctcccacgcccacttgctcccctctccctctggcctccccctcctccagatctcctcctcccgagcgtggtcgccgccgttccccgcgctccaccgcggccatcaacgcccccgcatccatctgtcaagtccgcaagctccgctcgccctctcccccaactccgaccacgcgcggtggccgggagcgaccggagcgcccgcaccgccgtcttcttcctcctctgtctcgccggacttcgttgactactccgactccggcaggcctccccgagcccgctgccctccacgaccggctcctcgttgatgcaaccagatggtggatccctggagccagatgccactgccgatggatgctgctacgtgaagaccgccgatgaccaggagtagttaggaggtcccaggtaggaggccttgcctcttcgatcgtgttgcttttgtgctagccttcttaaggcatccttgtttaacttatgtctgtacttagatattgttgcttccgctgactcttgtgctttcgagcttctatattcgagccctcgaggcccctggcttgtaatataaagcgtg

SEQ ID NO: 30453 - DNA, 615 bp, Triticum aestivum
  unsure (1)..(615): unsure at all n locations
  Clone ID: PAT_TA_30453
gcttctcaccccctcttcccgttctggatgtgcccaactccgtcgtcgccatggccctcgtcgatcccgtggccactgccctccccaccacctaggattgcgccaggagatcctcccgcctccgctgcttcctctacgctgaagaacacgagccgagtgcctctgcttcgaccggatcgagtcgttccccttctctgcaccgccaacgccattgccggaattcatcgcctccgcgccttccccgagcacgctatgcacacctacaggctcaccacaccgagatcgatgttgcccctgtgatcgactacgtcgacgacgacccctccttgccagagcaaccagatgtcggagcccaggagccagatgccaccgccggtgcctactactacgtggaggccgctgacaaccaggagtagttaggaggctcccaggcaggaggccttgccttttcgatcgtagatgcttttgtgttggccttcttaaggcaaacttatttaacttatgtctgtactcagatattattgcttccgctgactcttgtatattcgagcttatgtattcgagccctcgaggcccctagcttgtaatataaagcttgtattaacaaannanaaa

SEQ ID NO: 30454 - DNA, 568 bp, Triticum aestivum
  Clone ID: PAT_TA_30454
gagcatgcacgtagtgctttatttttgatgacttataaatttttgcaataagtatatgagttctttttactaatgttgagtccatggattatacgcacttttaccttcccatcattgctagcctcttcggaaccgtgcattgccctttctcaccttgagagttggtgcaaacttcgccggtgcatccaaaccccgtgatacaatacgctctatcacacataaacctccttatatcttcctcaaaacagccaccatacctacctattatggcatttccatagccattccgagatatatttccatgcaactttccaccattccattcatcatcatcatgacatactttacttttgtcatattgccattgcatgatcatgtagttgacatcgtatttgtggcaaagccaccatgcattatttttcatacatgtcactcttgattcattgcaccatcccggtgcaccgccggaggcattcatatagagtcatatcttgttctagtttcgagttgtaattcatatgttgtaatcaatgaaagtgtgatgatcatcattattagagcattgccc

SEQ ID NO: 30455 - DNA, 593 bp, Triticum aestivum
  Clone ID: PAT_TA_30455
gctcatcatccgcatgctctctgtcggccccgtaggctgggacctttccagaagcgccttcgctgtccgcagcgtcgactacgccgccggatcgaggccgggaggccacatcatcgaccggatcgacgcatcttcttcctcggtcgtcgccgctgcccttcatcgatccatcgcctctgcagctcctaagccaccaacgggcctccgtgtgcctccgcgactacgagaccgacactgctgctgcccagttcgactacggagctgacgacctctctctcttgccagagcaaccagatgctggagttcaggagccagacgccaccgtcaacgacgacccctactacaccggaggtgcccctactacgtgcagcctgctgacgacgaccaggagtagtttaggaggatcccaggcaggaggcctgcgcctctttcgatctgtatcccagtttgtgctagccttcttaaggcaaacttgtttaacttatgtctgtactcagatattgttgcttccgctgactcgtctatgatcgagctcttgtattcgagccctcgaggcccctggcttgtaatatgatgcttgtatgacttatttt

SEQ ID NO: 30456 - DNA, 657 bp, Triticum aestivum
  Clone ID: PAT_TA_30456
gctcatctgctaaaatacgagctgctaaactcatgcggtgaccgcgaacgccgccaccattaccgcgaccatcatcgtcccgacgccctgcagtcgtgtccagaaaatccgccgtcgttcgcttcttcaccttcgtcaattggatccagccggactcgaccgtgccgtcgggatcgagcttcttcttcaacttcggccgccgtcatccaccgcgtcgatccgctcgtcaccgactgtcccccgcctcgtcgagccctcctcgagctgcgctacctcgagaccgctgccggtacccccgatcgactacggtgttgacgacccctacttgccagagcaaccagatgttggagcccaggagccagacgccaccgtcgacgacgactcctactacaccggaggtgcctactactatgtgctgcccactgacgacgaccaggagtagtttaggaggatcccaggaaggaggcctgcacctctttcgatctgtattccagtttgtgctagccttcttaaggcaaacttgtttaacttatatctgtactcagatattgttgcttccgctgactcgtctatgatcgagctcttgtattcgagccctcgaggcccctggcttgtaatatgatgcttgtatgacttattttatttgtaaaaaaaaaa

SEQ ID NO: 30457 - DNA, 1083 bp, Triticum aestivum
  unsure (1)..(1083): unsure at all n locations
  Clone ID: PAT_TA_30457
ggaattcggcagaggctcggccgatgatgatagttcggctatccggacaccccctagtccaggactccctcacccaccattcaaaatatacacgtatccggtttgtgacttagagtcatccagatctgtgtcgaagctagcatcgacgtaaccctttacgatgagctctttgtcacctccataaatgagaaacatatccttagtccttttcaggtgctttaggatgttcttgactgttgtccagtgttccttgccgggattactttggtaccttcctaccaaacttacggcaaggtttacatcaggtctggtacacagcatggcatacataatagaccctatggctgaggcataggggatgacactcatctcttctttatctcctgccgtggtcgggcattgagccgagctcaatctcacatcttgcaatacaggcaagaaccctttcttggactgatccatattgaacttcttcaatatcttatcaaggtatgtgctttgtgaaagacctatgaggcgtctcgatctatacctatagatcttgatgcctaatatgtaagcagcttctccaaggtccttcattgaaaaacacttattcaagtaggccttaatgctgtccaaaagttctatatcatttcccatcaaaagtatgtcatctacatataatatgagaaatgctacagagctcccactcactttcttgtaaatacaggcttctccataagtctgcataaacccanaccagttaanntctcattaaagcgaatgttccaactctgagatgcttgcaccagtccataaatggatcgctggagcttgcacacttggttagcattcttagggtcgatgaaaccttcaggttgcatcatacacaactcttcttccagaaatccattcaggaatgcagtctttacgtccattggccaaatttcataatcataaaatgcggcaatagctaacatgattcggacagacttaagcatcgctacgggtgagaaggtctcatcgtagtcaactccttgaacttgtcgaaaacctttcgcaacaagtcgagctttgtagatagtaacattcccgtggacc

SEQ ID NO: 30458 - DNA, 908 bp, Triticum aestivum
  Clone ID: PAT_TA_30458
cgtgggcatatcttttgtagaaagaattaaaatctcttgcttaacttatatctatttagagagatggcaggaattggtcattcacatggttagtcataaaatcctacataaacttgtagatcgctgaatatgatatgtttgattccttgcaatagttttgcgatataaagatggtgatattagagtcatgctagtgggtggttgtggattgtagagacacttgcgttgaggtttgcaagtcccgtagcatgcacgtatggtaaccattgtgtgacaaatttgaagcatggggtgtttctttgattgtcttccttatgagtggcggtcggggacgagcgatggtcttttcctaccaatctatccccctaggggcatgcgtagtagtactttgcttcgagggctaataaacttttgcaataagtatatgagttctttatgactaatgtgagtccatggattatacgcactttcacctttccatcattgctagcctcttcggtaccgtgcattgccctttctcacctcgagaattggcgcaaacttcgccggtgcatccaaaccccgtgataggatatgctctatcacacataagcctcattatatcttcctcaaaacagccaccatatctacctattatggcatttccatagccattccgagatatattgccatgcaacttccatcatcatcatattcatgacttgagcattcattgtcatattgctttgcatgatcgtaagatagctagcatgatgtatgatgtcattgctacgctagatcattgcacatcccggtacaccgccagaagcattcatatagagtcatatctttgttccagtatcgagttgtaatatcgagttgtaagtaaataaaagtgtgatgatcatcattattagagcattgtcccc

SEQ ID NO: 30459 - DNA, 590 bp, Triticum aestivum
  Clone ID: PAT_TA_30459
gtttcccctcgatccactgcccctccctcctccccgcttgtcaccagggcctcggcatcgcctactcctcctccaccaccattgcttattccccacctcaacttccctctctccgttgtttatccggtcatcggcggtgcctggatccagatctggcgcaagtaaggcctggtggtggggcgaaggggcactggaggcaggcggacatgacaagcagttgtcggcccgtcgcgggtgaggctccaagagggaagaggcggggataggaggctcaatggaagagggaagatggatgaggcggggacaggtgaagcagcaggctggtcctcgtggaggcggcgctgccggccagggggccattcgcggtttttatctgctgtcttcttactccggggcatgcccaaggaagaactcacgcacaccagccaaggaggagccatgatgtgtgtgaggtagaggtggatcattggaggtgaagcaggtctcctggatgcgtgcttcatctgagatgctcagattataagaaagaggaattttgtaagtcagacatcgattgctcacctttgaaggttacaaattcaagtgctagg

SEQ ID NO: 30460 - DNA, 625 bp, Triticum aestivum
  unsure (1)..(625): unsure at all n locations
  Clone ID: PAT_TA_30460
tttttttttttttattttttttttttttttaaaaacatactcttgatttgtccaataccaataccaataagatgcagtacaaacgcccacccaacgctcatttagagctacacatagagcagtggtgcaaacatacaaataacaatacaatagagtacagacatccagccaggggggggggctcatttagagctacaaatagagatgtggtgcaaatatacaaatactatagtagatacaaataataatagggagttgggcacttcatggtgcaccatcttgatttttctccaacatgtgagcccaccttacagccacttgcacataaaccatgtcgtacatcatatcaacgaactggaagaaggcagccctccaggttctcttcatcaacatggtgcagaaaactgtccacagaccaaccacaaatccaatgctcatggcaagataaacagatggcatatgatctatatcttcaaggccaatttgctctgcgtcatgtgttgagcagttcctaccaacaggatctccacaaagaccagggttaccgatgtagatatacatctggttatcaagagcttgtanctgttggccggatggtatcggaccggacagattgttgtatgac

SEQ ID NO: 30461 - DNA, 768 bp, Triticum aestivum
  unsure (1)..(768): unsure at all n locations
  Clone ID: PAT_TA_30461
ggcgggcggaaaacaccgttgccccataacccaagagagcgcggagcggcgaaattcctcaccggcttgccatcgcgaggaaacttctcctcaagttccatctcttccaatctgggaggcctcanggtttatgtctgcgagcanganacaaatcctccagnnggacaantgatncacgacngatacgacaaatatcttaatcagacatctgcaactaaagaagaaagatagtgaggccaaagacgcagggttctaggactccaggggaaagtggcaagggtaaaagatgtgctgccagaagtttgggtgtgcaaaagtcgtcaaaaaagcccaacctgggcagttcttccggattgccttcctctgatgaagcaatatctggcttttcacagcacacactgcagtccttcaccgtagagaggttgcgtgcacttctccgacaaagaggcctcacaaccaaggggaaaaaggacgaactgatcactcgcttaagagaggcgcagagttgatatcaatctcaagtttctgccttgtttgtgattgatcaattgcctactggcactgtaaaacgttgctgagttgaatgaatcatcaggctttacttgttgacattttgtcactattgcatattgtaggtgtataacttaaggtgatgtagtgatttactcaggctcaggctatcatgaatttgacgtcttgtagcgaactttcactatatgcttgtcagaattcttgtttcatcttgaattttggattagaaaaaaaaaa

SEQ ID NO: 30462 - DNA, 546 bp, Triticum aestivum
  Clone ID: PAT_TA_30462
acgagggcgcaacagtcgccgagcctcgtcgttgatgtggctaccggagccaccccgagccgtcccaggtgttctgcagctacaccaagatcgtctccgtcgcctaccgcactggatcgagctctgggagcaacgttgacgccgccctcattgtttgtcttcgccgcggcctcgccgttgatccgcatcacctcgtccaccccggcccagtacgagctcaccaccgacctcctctcgacgatggattccaggagctagacgccaccgtcgacgacgactcctactacactggaggtgcctactactatgtgtagctcgctgacgacccaggagtagtttaggaggatcccaggcaggaggcatgcgcctcttttcgatctgtatcccaatttgtgctagcctttttaaggcaaacttgtttaacttatgtctgtactcagatattgttgcttccactgactcgtctatgatcgagctcttgtattcgagccctcgagacccctggcttgtaatataatgcttgtatgacttattttaaaaaaaaaa

SEQ ID NO: 30463 - DNA, 914 bp, Triticum aestivum
  Clone ID: PAT_TA_30463
gattcggcaccaggcgccactcattgactttggcggaaaaattgtgggaatggtcaatggcaatacaagcgggtcttttataccgtcttccattttagtgaagtgcttgcatttgtggagaaaattccagcgcatccctcggccccagcttggaatgaaattttggtcgatcaagtttgtggacattgctcttgctgagaatatattgtgcaagtgtaatattgatgatggccttattgtaaaaagggtgtcatatggatctcctgctgagaaacttggaatactggtgggtgacgtcattagttgtttcaatggagaacacatctctacaacagttgagttagagaatatgatgctgagcaaatgtgaggatgaaaataatagccttaattctgaactgaatgtcaaacttgatgtgtttcacatacgcaagtctcgctggagtgacagaacattaactgtaaaagtgtctgatgacagtgaagtagttgcaacaggagttacttatcctttcgtagaagggacaccatgattaataccatgccaattgaccaaacgggccgaggaacaggaagataggtttgggagttcaggacagatacgtgcttcggtgaatgcaagcgtggaacctgcaagtttctgcctaatgcatttgatttcttaggcggtgtaactccttggcatatccttgtaccaaaagtactggtgcaggcaagcgactctgctgtttcctttctgcatgaaaacgggaaccgtcatgtgagctgactgtacatttctggatgcttgttgagtccctacacttcatgtaagtcttggttcgatgaacaaacaagtatcctggtccactgaatgaacagaagttgaggatcctgaaagtgtatacttacaattcaaaagcggaaccactttga

SEQ ID NO: 30464 - DNA, 577 bp, Triticum aestivum
  Clone ID: PAT_TA_30464
gcccgaaacaccatggacgcgccgccgtcgctcacacggccaccgcctcccccgcgctgcaccaccatgtcccgggggaccaacgtcatctcctacgccgtctacaacaccaactcgacgccggggagcctcacaacgatgggatcgaggtcgtcttcaacctcggtgccgccaccgtccgtcgttcgatccgcgaccgatgatgcatccccggcctccacgagacctcctcgagctccgcaacccgagaccgcggttgaaccactgatcgactacttcaccttcgagggtccgtttctgtctacagagcaaccaggagccagaggatctcgaggatgtttctacgtggagttcggcttcgaggagtagttaggaggctcccaggcaggaggcctcgccttttcgatcgttgttacttttgtgctagccttcttaaggcaaacttgtttaacttatgtctgtacttagatattgttgcttccgctgactctttgtattcaagctatgtattcgagccctcgaggcccctggcttgtaatataaagcttgtattatttttaaaaaaaaaaaaaaaaaa

SEQ ID NO: 30465 - DNA, 653 bp, Triticum aestivum
  Clone ID: PAT_TA_30465
agcacacatctaatattaccacctttatatctcaaaacaactatcaagtatcaaacttctcttactattcaatgcactttataaactaccatgccgttctaagggactctcaaaatgatataagtgaagcatgagagatcaataatttcaataaaatataaccaccaccgtgctctaaaagatataagtgaagcactagagcaaaattgtttagctcaaaagatataagtgaagcacatagagtattctcataaattccgattaatgtgtgtctctctcaaaaggtgtgtacagcaaggatgattgtggtgaaactaaaaatcaaagactctaatcatacaagacgctccaagaaaaacacatatcatgtggtgaataaaaatatagcctcaagtaaagttaccgatggacgaagacgaaagaggggatgcctcccggggcatacccaagcttaggcttttcgttgtcctttaattttaccttggggtgccttgggcatctccaagcttaggctcttgccactccttattccataatccatcaaatctttacccaaaacttgaaaacttcacaacacaaaactcaacagaaaatctcatgagctccattagtataagaaaacaaaccaccacttaaggtactgttatgaactc

SEQ ID NO: 30466 - DNA, 1026 bp, Triticum aestivum
  Clone ID: PAT_TA_30466
agggaaccctaaaatgagtcgtaataaagctcaaaagatataagtgaagcacgtggagtattcttagcaaactctaatcatgtaggcttatcccaaaaggtgtgtacagaaagtatgattgtggtaaactaaaaatcaaagactaatataatacactacgctccaagcaaaacacatatcatgtggcgaataaaaatatagctccaagtaaagttaccaatgaacgaagacgaaagaggggatgccttcccggggcatccccaagcttaggcttttcgctattcttgaatatcttggggttccatgggcatccccaagcttaggctctttccactccttattccatagtccatcaaagctttacccaaaatatgaaaacttcacagcacaaaactcaacaggaaatcttataagctccgttagtgaaagaaaacaaaaccaccacataaggtactgtaatgaactcattctttatttatatttgtgttaaaggtactttattccaacttctctatggtttataaactattttactagccatagatgcatcaaaataagcaaacaacacacgaaaaacagaatatgtcaaaaacaaaatagtctgtagcaatctctaactaacgcaaacttatgtaactctaaaaatcctaccaaaataggaagtcatggacaatttgtctattgaacagcagaaaaaagaatcaactcaaaagcacgttcctgtgatttaacaaaattatattcgtgcgcgcaaagtttctatttttcagcagaatcaaatcaactatcatcgtaggttatcctataggttctacttggcacaaacactaattaaaagataaaaacacatctaaatagagagtagatgcaagatttattcctaaacaggagaaaaaaaactagaaacataaagaaaatttgggttgcctcccaactagcactatcgtttaacgcccctagctaggcataaaaagcgaagatagatttaacgagtgccgtaataataagatagatcttgtaggctca

SEQ ID NO: 30467 - DNA, 1006 bp, Triticum aestivum
  Clone ID: PAT_TA_30467
tcctttagagtacgaggtagttttattttgaataaataggtgaactctcatgcttcacttatattattttgagagtcttaaacagcatggtaatttgctttggttatgaatttagtcctaatatgataggcatccaagagggatataataaaaactttcatataagtgcattgaatactatgagaagtttgatgcttgatgattgttttgagatatgaagatggtgatattagagtcatgcttgttgagtaattttgaatttgagaaatacttgtgttgaggtttgcatgtcccgtagcatgcacgtacggtaaccgttgtgtgacaaatttgaagcatgaggtgttctttgattgccttccttatgagtggcggtcggggacgagcgatggtcttttcctaccaatctatccccctaggagcatgcgcatagtactttgtttcaataactaatagatttttgcaataagtatgtgagttctttatgactaatgttgagtccatggattatacacactctcacccatccacctttgctagcctctctagtaccacgcaactttcgccggtaccataaacccaccatataccttcctcaaaacagccaccatacctacctattatggtatttccatagccattccgagatatattgccatgcagctttccaccgttccatttattatgacacgttttttcattgtcatattgcttagcatgatcatgtagttgacattgtatttgttgcaaagccaccgttcataattctttcatacatgtcactcatgagtcattgcatatcccggtacaccgctagaggcattcatatagagttatattttgttctaagtatcgagttgtaattgttgagttgtaagaaaaataaaagtgtgatgatcatcattattagagcattgtcccagtgaggaaaggatgatggagactatgattcccccacaagtcaggatgagactccggacaaaaaaaacaaaagacaacaaacaaa

SEQ ID NO: 30468 - DNA, 586 bp, Triticum aestivum
  Clone ID: PAT_TA_30468
gtgtggccgccaccgtcgaccactgcggcgaccggcatcgccgtccgtctccgaggcgtccatggaccccatcgtccatgactgcgtcgactacgccgagctacgagccggggagcagccaccaagccgtctgcttcttcttctccgccggccaccacgaactcgccgtcgaccttcctcacctccggccacccctgcagctactaatctgacgccggcctccgtgagccgcccgaccccgagacggctgtcgatgccgctgtgatcgactacgtcaccgacgacccctccttctcttctgagcaaccagatggtggatccttggagccagatgccaccgccgacggatactactacatggaggccgccgaagaccaggagtagttaggaggtcccaggcaggaggccttgcctcttcgatcgttgatgtttgtgctagccttcttaagacaaaaacttgtttaacttatgtctgtactcagatattgttgcttccgctgactcgcttgtgtatcgagcttttgtattcgagccctcgaggcccctggcttgtaatatgaagcttgtatgtcttaaaaaaaaaaaa

SEQ ID NO: 30469 - DNA, 611 bp, Triticum aestivum
  Clone ID: PAT_TA_30469
gaattcggcacgagcacacacgatagcttgagcggaaccatggccgtgtcatcatcaacctcgagcgtcgaagcctccccgagcctctagaggaggtccggaggatgctgctccttcgtcttcttcgaccacgaacatgggttcgtctggagatgcaacacaccgacggatcggtcgtcatcttccccgtcggccgccgcacaacctcgcctcgattcgtcgcctccggagcttccccggccgtctcgcgctcgccaatcacctcctgaccccgagaccgctgttgatgtccctgtgatcgactacgtcaccgacgaccccttcttccctttcatcggagcttccagatgtcggagcccaagagctagatgccaccgtcaatgcctactgctacgtggagaccgctgacgaccaggagtagttaggaggctcccaggcaggaggccttgccttttcgatcgtagatgcttttgtactagccttcttaaggcaaacttgtctaacttatgtctgtactcagatattgttgcttccgctgacttttgtgtattcgagcttatgtattcgagccctcgaggccctggcttgtaatataaagcttgtattatttt

SEQ ID NO: 30470 - DNA, 561 bp, Triticum aestivum
  Clone ID: PAT_TA_30470
gttcagacatcacacacaactcatgcaaccaattaaagtgacagcagctcacagtagaataactactaacttaatatccaacaattcagcaattcagcaaggatacatgagggttcagcaaaggtgcacaggtaacagagtaaatttcagacccaacagtgcatatactcagagaacaggaacaagagaagagagaagttcagagcctatgggtcttgatgatcttcgattcgaagctgtagatgttgcaggcgaagaagagtagaagcagaagcacgctggagacgatcttgcgtggagaaccagaaggcccgacgcccctggcctctggtcgatcctctccctctcagcagcgatgaagaggagagaaggagtggcagagatcgtcggtgcgggaggttgcagcagcaggagttggagctgagtagcggcagtcgatcttgaggttggagacgaggaagtgcagcaggtcagcgtcgtcattggagaggagcggtggatcgccggtaagatcggggcagcttcgtggtggatcgggcaccaccgccagtctcccggcac

SEQ ID NO: 30471 - DNA, 551 bp, Triticum aestivum
  unsure (1)..(551): unsure at all n locations
  Clone ID: PAT_TA_30471
gcgacgccgagaccgacgtagccgcagccaccaccgtccctgaacccctccgatgcgtccatgtcccctacgacatctacatgggcgggctcgagctgggcgtccctgcatcgagcggatcgacgccatcctcctcctcgagcaccaccgccttcttcttcaacttcgtcgtcgtcctatgctttgacccctccccgagcatgctcttgcacaactacaggtccgatgacggatcccaggagccagaagacgccactgatgactactagtacccggaggatgcctactactacgtgaagaccgcagacgactaggagcagttaggaggctcccaggcaggaggccttaccttttcgatcattgttgcttttgtgctagacttcttaaggcaatcttgtctaacttatgtctgtactcaagatattgttgcttcccgctgactcttgtgtattcgaacttaagtattccaacctccaaggcccctggggttgtaanataaacttggtacaatttnatttgtgtccaaaattgnnttggtaanacttccncgc

SEQ ID NO: 30472 - DNA, 695 bp, Triticum aestivum
  Clone ID: PAT_TA_30472
cgtccgcggacgcgtgggaacggcacggccaaatccaaagccaagtcgcactcctcctctcctatcctggtcctcgccgaggcggcgaccgcagccccggacgctgccaccgccaccccccgcgcgtctccgattcggcgaatttggggctcaggaaagaggaggagcgacttctctctggtggtcggaaattcaggacaaggttttgagcttttgtctgtttcgctgggatggatgccaagaagttcctgcagatggtcgaagacaagaagaagagactcctcgagaagaaggaagccccactgaaatggcagcagaaactggaagcggcaattaaggccactgaagagaaggagaagaagctcaagtcaaaaaagcacaggaggcgaagctattcttcctcagaatctgacagtgaatccgagagcgacagcgatcggaaacacaggaagaggaaggaccgcagaaggcacaggaaacatggccactctgactctgatggtgccaggaggcgcaagcacaggtcaaagaggaggagctcagactctagcgatgagagcgacagtgatgaatatgatagcgaatctgaagaagagcgccgaaggaagaagcactcgcacaggaggaagcatcgccgtcactcttcaaggtcagagtctgatgcttcagattacagcagcgatgatgatgagcga

SEQ ID NO: 30473 - DNA, 657 bp, Triticum aestivum
  Clone ID: PAT_TA_30473
cggacgcgtgggcggacgcgtgggcgccgccgccgcccaaaggaccctccctcgccggacgcctcaccttcctccactccttcccctctctctactggatccgggtgatccacgtcgcccctgaccttgcctccccgacaaccaccacgatgacactcgcctctgccccgacggcaaccggtgcccccgtcgctcgacgccgttcgccgtcgtctcctcaccctcgcgtcggactgccccgtccccgcctctccatcgccggccgaccccgagcctcgccgcccccccgcttccctccatcgctgaccccgagaccgatgctgctcttgtgatcgactacgtcgactacgacccccctccttgccagagcaaccagatgacggatcccaggagccagacgacgccagtcatgactactactatccggaggatgcctactactacgtgaagaccgcagacgactaggagtagttaggaggctcccaggcaggaggccttgccttttcgatcgatgttgtttttatgctagccttcttaaggcaaacttgtctaacctatgtctgtactcagatatggttgcttccgctgactcttgtgttttcgagcttatgtattcgagccctcgagggccctggcttgtaatataaagcttgtatt

SEQ ID NO: 30474 - DNA, 667 bp, Triticum aestivum
  Clone ID: PAT_TA_30474
cccctctcacctcgctcgctccgcctgcctcacctcgccgagtgcagtcagggcctcgccgccgtaggagccgccgccatcgtcctccgcacgcctcgagaccctgctcagaagacgcgccgccgtacgctacttcctctacgcccaggaacgcgagctggggagccctccatcgccgggtcgccttcaacttcctccccgacaccgacgaactccgtcgccccgattcgccgccctcctgcgctcctaagcccatcgccggccaccgtgtgcctcactacctcgagactgccggcgacccccagttcgactacggagttgatgacccctccttgccagagcaaccagatgctggagtccaggagccagacgccaccttcgacgacgactcctactacgctggaggtgcctactactacgtgcagcccgctgatgacgaccatgagtagttaggaggatcccaggcaggaggcctgcgcctctttcgatctgtatcccagtttgtgctagccttcttaaggaaaacttgtttaacttatgtctgtactcagatattgttgcttccgctgactcgtctatgatcgagcatttgtattcgagccctcgaggcccctggcttgtattatgatgcttgtatgacttatttatgttttagagttgtgttgtg

SEQ ID NO: 30475 - DNA, 1022 bp, Triticum aestivum
  Clone ID: PAT_TA_30475
caaaattacgtagctcaaaagatataagtgaagcacatagagcaaaaatacatagctcaaaagatataagtgaagcacatagagcaaaactacatagctcaaaagatataagtgaagcacatagagtattctatcaaattttaattcatgtatggctctctcaaaaggtgtgtacagcaaggatgattgtgtcttactaaaacacaaagacacaaataatacaagacgctccaagcaaaacacatatcatgttggtgaataaaaatatagctccaagtaaattaccgatggaagtgaacgaaagaggggatgccttccggggcatccccaagctttgactttttggcgtccttggattatcttgggggtgccatgggcatccccaagcttaggctcttgccactccttgtttcataatccatcaaaagaattcacccaaaacttgaaaacttcacaacacaaaactcaatagaaatctcgtgagctccgttagagaaagaaaacaaaatactactttaaggtaccgcaatgaactcattctttatttttattggtgttaaacctactgtactccaacttctctatggtttataaactattttactagccatagattcatcaaaataagcaaacaacacacgcaaaacagaatctgtcaaaaacagaacagtctgtagcaatctgtaactaacacaaacttctggaactttaaaaatcctaccaaaataggaagtcctggaaaatttgtctattgatcagaagcaagaataatcaacgcaaaagcacgttcctgtgatttaacaaaactaatttcatgcgtgcaaagtttctgtttttcagcagaatcaaattaactatcaccataggttatcccatagattctacttggcacaaacactaattaaaacataaaaacacatctaaacagaagttagatgcaagatttattcctaaacataagcaaaaaaaaacacaaataaaattgggttgcctcccaactagcgctatcgtttaacgcccct

SEQ ID NO: 30476 - DNA, 610 bp, Triticum aestivum
  Clone ID: PAT_TA_30476
ccgacctcgagagctatcatcccacggaccagccgccgccgccgccgtcgagcactcgagcgccgcggagaccacaactggtcctagggtttcgattcaagcaggatggggaagtcgaagagcaagggcgccaagttcgccgccgtcaagaagatcatcagcaagaagaccatcaagaagtacaaggaggaggtgctggacccccggaagaaggacaccgagaaggagaagctcggccggaatgtgccgcaggtgtcgtcggcgctcttcttcagctacaacatggcgctcgggccgccctaccgggttattgttgacaccaacttcatcaatttctccatccagaacaagttggatttggagaaaggaatgatggactgcctttatgcaaaatgtaccccctgcatcactgattgtgttatggccgagcttgaaaagttaggacaaaaatatcgtgtggcttttgagaattgctaaggatcctaggttccagaggctggcgtgcacacacaaaggaacttatgctgatgactgtatcgttgagagaattactcagcacaaatgctacattgttgccacttgcgatagagatttaaagaggagaataaga

SEQ ID NO: 30477 - DNA, 441 bp, Triticum aestivum
  Clone ID: PAT_TA_30477
gaagaactggcaccgtctgctacatcgtctacgcccactaggttgagttgggatccccaacgacgagcgcgtcatcgtcatcttcttcctctgcccgtcggcgatctcctccgactccggctgccctgctgctactaagcttccgccaggcccccttgtgcctcctacatgttggagcccaggatccagacgccaccgtcgacgatgactcctactgcaccggaggtgcctactactacgtgctgcccgctgacgacgaccaggagtacttaggaggatcccaggcaggaggcctgcgcctctttcgatctgtatcccagtttatgctagccttcttaaggcaaacttgtttaacttatgtctgtactcagatattgttgcttccgttgactcgtctatgatcgagctcttgtattcgagccctcgaggcccctggcttgt

SEQ ID NO: 30478 - DNA, 979 bp, Triticum aestivum
  Clone ID: PAT_TA_30478
accaagatctgaaattcttgaatgagagagagtcttcacatagttacacaattatttagatactcattgatcttcacttatatcttttggagtagtttgtcgtttgctctagtgcttcacttatatctttttagagcacgacggtggttttattttgtagaaattattgaactctcatgcttcaattatattattttgagagtcctaaaaagcatggtaatttgaatgaaaactatcataggaggtgaattggatgccatgatcaatttgatacttgataattgttttgagatatggaggtagtgatattaaagtcatgctagttgggtgattatgaatttaaagaatgcttgtgttgaagttagcaagctagctagcatgcacgtatggttaaagttgtgtaacaaatttgaaacatgaggtgttcttagattgtgcatccttatgagtggtggtcggggatgagcgatggtattttcctaccaacctatccctctaggagcatgcgcgtagttcttggtttttgatgacttgtagatttttgcaataagtatatgagttcttttgactaatgttgagtccatggattatacgcacttttacctttccatcattgctagcctcttcggtatcgtgcattgccctttctcaccttgagagttggtgcaaacttcgctggtgcatccaaaccccgtgatatgttatgctctatcacacataaacctccttatatcttcctcaaaaaagccaccatacctacctatttatggcatttccatagccattccgagatatgttgccatgcaactttccaccgttctgttcatcatgatcatgacatacattacttttgccacattgtcattgcatggtcatgtacttgacatcgtatttgtggtaaagccaccatgcataatttttttaaacatgtcactcctgattcaatgcgccatccccgtacgtcgccgtgggcattcat

SEQ ID NO: 30479 - DNA, 1042 bp, Triticum aestivum
  Clone ID: PAT_TA_30479
tacctccatatctcaaaacaatcatcaagcatcaaacttctcttagtattcaacacactcataagaaagtttttactagtcttcaatacctagcatattaggattatttaagaaaattaccttgctgttttaagactctcaaaataatctaagtgaagcatgagagaataatagtttctataaaacaaaaccaccaccgtgctctaaaagatataagtgaagtactagagcaaaaactatataactcaaaagatataagtgaagcacatagagtattccaataatttccgaatcatgtgtctctctcaaaatgtgtgtacagcaaggatgattgtggtaaactaaaaagaaaagactcaaatcatacaagacgctccaagcaaaacacatatcatgtggtgaataaaaatatagctccaagtaaagttaccgatggatgaggacgaaagaggggatgtcttccggggcatccccaagctttggctttttagtgtccttagattatcttggggtgccatgggcatccccaagcttaggttcttgccactccttgttccataatccatcaaatctttacccaaaatttgaaaacttcacaacacaaaactcaacagaaaatctcgtgagctccgttagcgaaagaaaacaaaacaccacttcaaggtaatgtattgtactcattatttatttatattggttttaaacccactgtattccaacttctctatggtttataaactcttttactagccatagattcatcaaaataagcatacaacacacgaaaaacagaatctgtcaaaaacagaacagtctgtagtaatctgcaactaacgcaaacttctggaactccaaaaaaatcagccaaaatacgacgacctagccaatttgtttattgatcagcagcaattggaatcaatattttatcacgttctggtgttttttaacaattattttcatgaacagaaagtttctgggaattacagcaagatcaaataactatcatccaagaagatcctataagtttaacttgggaaaaaca

SEQ ID NO: 30480 - DNA, 1121 bp, Triticum aestivum
  Clone ID: PAT_TA_30480
aatgccaatacaaccaaattcattacaatagatggatttcagtcctaacactggaatgtaaataagcataacagaagtgaatcatataacgtggtttatacaaagcacgatagtcttcctgtgagtacaacttctaccacacatagcctagctagaacgaatcagcccatagcatttttcagactcatttcgtgtcctcggtttctcatgtacttataataaaggggagccttggcgcagtggtataaacagcctcttacagaaatgtagggaaaggctgcgtacaatagacccaaagtggtcggacccttccccagaccctgcgcaagcgagagctacatgcactggggctgccctttatttcgtgtcctcggtttctcaatgctgctctaactgtagcatcttatctctgttttcaccgcgggtatcatgaatccttttgcttacatagcagcagggtcttccgacatggtctcatgtaacagccgtacggctgttttatctccaaaagatgatattgctgtatgcaaataaacagtcaagcacatcatgcaactgtcacattttgcttcgatactcagccactggtaggccagaagtttgtagaagaatatccaacatcatcatgtgaggtattttcaccatcggtggagcaccctgtaggttttaatgacatgccgtaaatttgcagaatttacagggaaacctaagacattttagaaattacttcatacctaagacatagaacaattggcatgccgtcctcaaacgatattctttgtagtcacaataaaagctatccagtgtggagaaataggtatgctgatttataagacgctcgccacaaaatttgattagtagatgatccaggacccagggaaagctgattacacatttgttgactgtctattgacctgtgttgtgatgatagcatagaatgacaatcagagtaattgcttagcactattattaggtctcaggcttctcctaggtgtgtacctatttctgaaacgtacataggctagagagggaatccatgatagaacgaatataaaaagttatagtctcctttgtccgaacatcaaaagtaaattagttaaagaaggattcggagagcccgc

SEQ ID NO: 30481 - DNA, 762 bp, Triticum aestivum
  Clone ID: PAT_TA_30481
taacattgtatacatgatagaacctatgaatgaagcatagggaacttctttcattttctctctatcttctacagtggtcgggcatttagtccgactaaatttcacaccttgtattacaggcaagaaccctttctttgcatgatccattttgaaccttttcaaaactttatcaaggtatgtactttgtgaaagtccaattaagcgtcttgatctatctctatagatcttgatgcccaatatgtaatcagcttcaccgaggtccttcattgaaaaacttttattcaagtacccttttatgctatccagaaattctatatcatttccaatcaataatatgtcatccacatataatattagaaacgctacagagctcccactcactttcttgtaaatacaggcttctccaaaagtctgtataaaaccatatgctttgatcacactatcaaaacgtttattccaactccgagatgcttgcaccagttcgtaaatggatcgctggagcttgcacactttgttagcatcctttgtatcgataaaattttcaggttgcatcatatacaactcttcttctagaaatcaattcaggaatgcagtctttacatccatttgcaaaattttataatctaaaatgcggcaattgctaacatgattcagacggacttaagcatcactactggtgagaaggtctcatcgtagtcaactccttgaacttgtcgaaaacctcttgcaacaagtcgagctttgtagatattaacattcccg

SEQ ID NO: 30482 - DNA, 560 bp, Triticum aestivum
  Clone ID: PAT_TA_30482
tccctcttcccgttctggatgtgcccaactccgtcgtcgccatggccctcgtcgatcccgtggccactgccctccccaccacctaggattgcgccaggagctcctcccgcctccgctgcttcctctacgctgaagaacacgagccgagtgcctctgcttcgaccggatcgagtcgttccccttctctgcaccgccaacgccattgctggaattcatcgcctccgcgccttccccgagcatgctatgcacacctacaggctcaccgagccagatgacacctttaaagattgctactaccccgagggtgcctactaccacgtgacggacgccgacgaccaggagtagttaggaggctcccaggcaggaggccttgccttttcgatcgtagatgcttttgtgctagccttcttaaggcaaacttgtctaacttatgtctgtactcagatattgttgcttccgctgactcttgtgttttcgagcttatgtattcgagccctcgaggcccctggcttgtaatataaagctggtattattttaaaaaaaaaaaaaaaaaaaaaaaa

SEQ ID NO: 30483 - DNA, 1085 bp, Triticum aestivum
  Clone ID: PAT_TA_30483
atatacatgacagttttaggtcatacaagcagcgggttacaagaaaaacaatcgatatgtgatgaaccaagcctaagtcaaataggtaatgccaatacaaccaaattcattacaatagatggatttcagtcctaacactggaatgtaaataagcataacagaagtgaatcatagaacgtggtttatacaaagcacgatagtcttcctgtgagtacaacttctaccacacatagcctagctagaacgaatcagcccatagcatttttcagactcatttcgtgtccttggtttctcaatgctgctctaactgtagcatgttatctctgttttcaccgtgggtatcatgaatccttttgcttacatagcagcagggtcttccgacatggtctcatctaacagccatacggctgtattatctccaaaagatgatattgctgttagtcgctggacagccgccgaggttgtatcatggggtctgagcaagaaaggaggcaaaggatccatgtatgggtttcgtccatgtcgcgccaccccgcggctgaccttcatgttcaaataaccaagtatatcacatcatttctggttcatataccccttgttctccaggaccagcagcatggtggggtcggatgcactcatcatcacttcatgtgtgcggagctccccaagccacacccgtggtcacctctcttgccgcctatccaactcgctgcaccatgctccgtacttaccggcactatccgtcgacccgctttggtcgaggcacaaccaggatgctcgatttcgcacgggtttccgtttcctggtctaaatcccgtccagaagcttccccaacaacacaaccggagcatagactgggccctatcaccctgcattcccggagccaccgctagcacgctcgttttcgccggggtctcctagtctccctccaaatctcaatcgccggttgagcaccacgtaaggacgagccctcccttgcgctgagggaggggctgtggggaacgaagcgtgcacagcacaccggcagtggtatggcgccacgaacggagcttccttgccgccggcgtggttgtaggtagagagga

SEQ ID NO: 30484 - DNA, 500 bp, Triticum aestivum
  Clone ID: PAT_TA_30484
cccaacccgaacgccacgcccaaacccaaagccaagtcgcactcctcctcctcctcctcctatcctcttcctcgccgaggcggcgaccggccaagcgccgccaccgccaccgcccgcgcatctccgttcaattcggtgactcgctacgctccccctgcgttcttctggcaaattcagcgaatttggggctgaggaaagaggaggaacgacttttcgctggtggcctgaaattcaggacaaggttttgagcttttgtctgtttcgctgggatggatgccaagaagttcctgcagatggtcgaagacaagaagaagagactcctcgagaagaaggaagcccctctgaaatggcagcagaaactggaagcagcaatcaaggccactgaagaaaaggagaagaagctcaagtcgaaaaagcacaggagacgaagctattcttcctcagaatctgacagtgaatccgagagcgacagtgatcggaaacacaggaagaggaaggac

SEQ ID NO: 30485 - DNA, 386 bp, Triticum aestivum
  Clone ID: PAT_TA_30485
tcgagcggccgcccgggcaggtacagggtgaaggtgaccacaatgccaaacttggtatcaccattcttggtgaagccgttgatgttgaagatgaagtagttgtaactaacagtatcgtgctcccaaataaaactctcaatgccagtgtgcaagatgagatcatcctataatattccttgcacaacacatatctttatttaatcctgaataaggtcttcaaaccaaatatgtaattttctttccttttcttctttaccccccttatgtatgcttgcattacattggggtcattaatctgtacaaggcattggatgtgatattggtgtaattttgtttagcatcctggcatcaagttgactggtgtagaaattgtacaaccagattac

SEQ ID NO: 30486 - DNA, 773 bp, Triticum aestivum
  Clone ID: PAT_TA_30486
atggaccaccgggacccttccggtggtcccggtacaatacctgtgacccctgaaactttctcgatggccgaaacctgacttcctatatataattctttacctccggaccattccggaactcctcgtgacgttcgggatctcatccgggactccgaacaactttcgggttactgcatactaatatctctacaaccctagcgtcaccgaaccttaagtgtgtagactctaggggttcgggagacacgcagacatgaccgagacgactctccggtcaataaccaacagagtaatctggatacccatgttggctcccacatgctcctcgatgatctcatcgaatgaaccacgatgtcgaggattcaatcaaccccgtatacaattccctttgtcaatcgatacgttacttgcccgggatctgatcgttggtatcccaattgtcacagccccagatcagcccttgtttgtttttgctttagcatccatgcaacatgtttaaattttatgaaatttgaaatggggattgctcaaaccctagcattaaaggaattcactaggttcacctaaaatactttcaagtaagtccaaatggctttcaaaaatgttcatgatttttgacaaaggtgaaaaacctctaccaaaaatgatgccaatatttttgggccattatggatttttgaataatccatattgtatttgtattggggcatttaaatactattaatatttttaaatgctccaacaattctgaaaatagttaagggcctctgtaataa

SEQ ID NO: 30487 - DNA, 607 bp, Triticum aestivum
  Clone ID: PAT_TA_30487
tcggcacgaggcacctcgctcgctccgcctgcctcacctcgccgagtgcagtcagggcctcgccgccgtaggagccgcggccaccgtcctccgcaggcctcgagaccctgctcagaagacgcgtcgccgtccgctacttcctctacgcccaggaacgcgagctggggagccctccgtcgctggatcgcttttgacttcctccccgacaccgacgaactccgtcgccccgattcgccgccctcctgcgctcctaagcccatcgccggccaccgtgtgcctcactatgctggagccctggagccagacgccaccgtcgatgatgactcctactacaccggaggtgcctactactacgtgcagcccgctgacgacgaccaggagtagttaggaggatcccaggcaggaggcctgcgcctctttcgatctgtatcccagtttgtgctagccttcttaaggcaaacttgtttaacttatgtctgtactcagatattgttgcttccgctgactcgtctatgatcgagcacttgtattcgagccctcgaggccgctggcttgtactatgatgcttgtatgacttattttatttgtaaaaaaaaaaaaaaaaaaa

SEQ ID NO: 30488 - DNA, 642 bp, Triticum aestivum
  Clone ID: PAT_TA_30488
gctcgttcgcccctcttcctctccgtcttgttcgcccgagcacggtcgtcgatgcgctgccgtcgatcccgcggccaccggccaccccgacctgcgccacggcgtctaggcggcccaccgtcctcgtctccttcctctacgcccttcggttcgtcaccaggccgccaccaagatcgccatcgcgggtcttctccgccacggccgtcatcacctcgccgctcgacccgctcgtctccgaccagccccgatctccccgacctcgccatcgagctcgcgaccccgagaccgatgctgcccctgtgatcgactacatcgccgatgacacttcttccttttcagcagatcttccagatgacagatcccaggagccagacgacaccaccgatgactactactaccccgagggtgcctacttctacgtgatggccactgacgacctggagtagttaggaggctccccggtaggaggccttgccttttcaatcaatgttgcttttgtgctagccttcttaaggtaaaacttgcttaacctatgtttgtactcagatgttgttgcttccgctgactcttgtgtattcgagcttatgtattcgagccctcgaggcccctggcttgtaatataaagcttgtattattttaaaa

SEQ ID NO: 30489 - DNA, 619 bp, Triticum aestivum
  Clone ID: PAT_TA_30489
gccgctctccctctcccgttacagaagccgcccgacgccaccatcgccaccacctcgtcgatccggtggccaccggcctcccctcgtcgcgccaaggcgtccaggagcttctccatcgtcgtctccttcgcctacgtgctctgaatcgagccgggacgcccgtacgctcgccatcgagctcatctccgtcgcgtacatcgccgatgttcgtcgtcgttgccgcggctccggttcacctccggcctccccgacctcgccatcgcgcttgcgaccccgagatcggcgctgatgccactgagtacgactacgtcaccgtcgacccgtccttctctgccgagcttccaggagccagaggatcccgaggatgattctacgtggagttcgacttcaaggtgtagttaggaggtcccaggcaggaggccttgccttttcgatcgttgctacttttgtgctagccttcttaaggaaaacttgtttaacttatgtctgtactcagatattattgcttccactaactcttgtgtcttcgagcatttgtattcgagccttcgaggccccttgcttgtaatataaagcttgtattattttatttgtgtctagagttgtgttaaaaaaaaaa

SEQ ID NO: 30490 - DNA, 560 bp, Triticum aestivum
  Clone ID: PAT_TA_30490
gcacgaggcctcgtgccgaattcggcacgaggctttttcacaattgttcatgagcgccattggatagtcgtttgcgcaaacttgattcacaagcaatggaatgtatttgactcaatcaatgcaaaagggaaagcatctcctttgaagaagcaggccaataacctgacaccgagaccgacgccgctgctacccagtacgactacggtgttgacgacccctccttctcggctgagcttccagatgatggagcccaggatccagacgccaccgtcgacgacgactcctactacaccggaggtgcctactactacgtgctgcccgctgacgacgaccaggagtagtttaggaggatcccaggcaggaggcctgcgcctctttcgatctgtgtcccagtttgtgctagccttcttaaggcaaacttgtttaacttatgtctgtactcagatattgttgcttccgctgactcgtctatgatcgagctcttgtattcgagccctcgaggcccctggcttgtaatatgatgcttgtatgacttattttatttgtagagttgtgttgtg

SEQ ID NO: 30491 - DNA, 625 bp, Triticum aestivum
  Clone ID: PAT_TA_30491
agttgcatcagggaggctcttgcgccgcatctttcataatagtcgcgcccgagcggctgcccgccatggccatcgtcgtagccgcggtcagcacgctcgctgtcgcctgagaagaggtgcaggaggacggacgtactcctctacttcgtctacaccaccggatcgacgccgtagaactccaacgccgctgcccgcttcatcttcatcctcggacgccgtcggacctcctcgtcaaattcgccgccgtctgcagctcctaaccttccaccggcctttcttgtgccccgcgatgttggagcccaggatccagacgccaccgtcgacgacgactcctactaccccggaggtgcctactactacgtgcagcccgccgacgacgaccaggagtagttaggaggatcccaggcaggaggcctgcgcctcgttcgatctgtatcccagtttgtgctagtcttcttaaggcaaacttgtttagcatatgtctgtactcagatattgttgcttccgctgactcgtctatgatcgagcacttgtattcgagccctcgaggcccctggcttgtattatgatgcttgtatgacttattttatttgtaaagttgtgttgtaaaaaaaaaaaacaaaaa

SEQ ID NO: 30492 - DNA, 730 bp, Triticum aestivum
  Clone ID: PAT_TA_30492
ttctttctcgcgaaaatgtcgactgaagtggctgccgctgacatcccggtgcctcaggtggaggtagccgccgacgccgccgttgacacaccggcggcgaagccggccaaggcggccaaggtggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggataagcacaaggcgcacctcccggccaacttccgcaagatcctgctgacccagatcaagaagctcgtcgccgccggcaagctgaccaaggtcaagggctcctacaagctcgccaaggcccccgccgccgtcaagcccaagacggcgaccaagaagaagcccgccgccaagcccaaggccaaggcgccagccaagaagacggccgccaagtcccgcggccaagaaggccaagaagtagaggccgcttgacggacctagatgccctggcggtagtattgagtagcctaattctctgttcggtgttgtcggtcaagagcttcttgactgtcttgggcggcggtgggctgtaaatctgatctatctgtgccgggggtgtacccttgtcgaggaagagtggtatccatgggaatcagttgtactagtagtagtaaccagtgtaattgagtctttttattatcgcagc

SEQ ID NO: 30493 - DNA, 800 bp, Triticum aestivum
  Clone ID: PAT_TA_30493
atccacggctgccatggccatggatggcctccacgtcgttcccctcggcctataaacatgcccaaccgcaaccctagctccccctcatccgtttcccccttgatcccccatcaccccccttctcatctgctcgaattcgaggtcggaacctcgcgcgacgattgtgctcgtcatcaccgtcgtctccggcatgcgggagcacgtccaggaggtccggcgcggccggatccgtctgtccagggaccagcacaagccgggacgtcccgtacattcgccatcgacgtcgtcctctccgtgtacatcgtcgccgtccgccatcgtttgccactgctccgagccgtcccctgcctcccccgcctcgccgtcgcgctcgtgatgatggatctcaggagccagacgacaccactgatgactactgttaccccgagggtgcctactactacgtgacgaccgctgacgacttggagtagttaggaggctcccaggcaggaggccttgccttttcgatcgttgttgtttttgtgctaagccttcttaaggcaaacttgtctaacttatgtctgtactcagatattgttgcttccgctgactcttgtgtagtcgagcttatgtatttgagccctcgaggcccctggcttgtaatataaagcttgtattattttaatttgtgtctagagttgtgttgtgatatcttcccacgagtccttgatcttgatcgtacacatttgcgtgtatgattagtgtacgattgaatcgagggcgtcacaacgttgttcaaagaaaatcttatctatttcatt

SEQ ID NO: 30494 - DNA, 687 bp, Triticum aestivum
  unsure (1)..(687): unsure at all n locations
  Clone ID: PAT_TA_30494
gccctacgtctagttgtgatgggattattggggtctcgctaaccagggagctaaacaagctatgcctggctatcgggttgtttttcttgtccctgaaccacggccgggtcatccccttatatacacgggttgatgcctggccggtctacaaagtcccgaggccgactcatacaagtgttcggctcggtctctcctttccttatcttacaacacaagttacatgactatggcggtttaccactatgggccctaatcctcctttgggctccgggcctctaagttgcatagtaaagcgccatcttctgagtcttcgtgggcttcaatatagttgagggtgaaccggcccctcctgcgcggtttatactcagtagttatatccccaacacccatgatacgatacgctctatcacatataaaatctccttatatcttcctaaaaacagccaccatacctacctattatggcctttccatagccattccgagatatatttccatgaaactttccaccgtttcttttattatgacacgtttcatcattgtcatattgccttgcatgatcatgtagttgacatcgtatttgtggcaaagccaccatgcataatttttcatacatgtcactcttgattcattgcccatcccagtacaccgnncgagacactcgtatagagtcataatttgttctaa

SEQ ID NO: 30495 - DNA, 614 bp, Triticum aestivum
  Clone ID: PAT_TA_30495
tcctctccctcgctctctctcgataaaatcgcccgagtagccgccatggccatcgttgtcgtcgcggccactggcctccccgcggccggagctcgtgtccaggaggacctccggcatcgtctccttcgccacgtgcaccggttcgagctaggaccactccaagcctcgccatcgagctcttctctgccgtggacgtcaccatctcgccgtcgattcgcctctccgacaccactccaaccgccccgagctctccaccgccctcctcccaaccccgagaccgatgctgcccctgtgatcgactacgtcgacgatgacccctccttgccagagcaaccagatgtcggagcccaagagccaagatgccaacgccgatgcctgctactacgtggagaccgccggcgaccaggagtagttaggaggctcccaggcaggaggccttgccttttcgatcatcgttgcttttgtgctagccttcttaaggcaaacttgtctaactcatgtctatactcagatattgttgcttccgctgactcttgtgtattcgagccctcgaggcccctggcttgtaatataaagcttgtatttttttaaaaaaaaaaaaaaaaaaaaaaaaa

SEQ ID NO: 30496 - DNA, 554 bp, Triticum aestivum
  Clone ID: PAT_TA_30496
cttcctcgcccctctctcgctcgatcccatctccacccgagcgtcaccgtcgtcatgccgcctccatagccgcggccaccgtcgtcccctcgcccactgagcgcgtccttccgctccatcgtcgaccactgcctcaaccacaaccaccagatgtaccagggagcccctacatcgaccggatcgaggtcatcttcaacctccgcaccgccgctcaccgtcttcgattcggcctcaccggagcctcctcgagcccgctttgctcacctacaggatcgataccccaagactgccggcgacccccagttcgactactgtgttgacgacccctgtcttttgccagagcaaccagacgatggagtccaggatccaaacgccaccatcgacgatgactcctactacgccggaggtgcctactactatgtgtagcccgctgacgatgaccaggagtagttaggaggatcccaggcaggaggcgctgcgcctctttcgatctgtagcctaatttgtgctagccttcttaaggcaaacttgtttaacttatgggctgkacgctg

SEQ ID NO: 30497 - DNA, 869 bp, Triticum aestivum
  Clone ID: PAT_TA_30497
ttttttttttttttttttacttaaatcacatcaattagtaagtagtataaacctcttgcatctggtgaaagcagatgagacggtagaattgcaagaacagtgaacgtacgtcccttttgtacattacagagttacagtgtacattttcatcggcacaaggatgtatcatctacttgggagatgtgagtttgctggtgtcgctggacgagtccccgctcaccagttcgtggaacgcctccaccttcacgggcggcacccgcatgccgtaagagttcatcgattgtggcacttgtttgaactgctgggctagctgggcttgggcgctctggtttccagacatgcccagctgctgctgctgctgctgctgctgctgcgctagctgggcttgggcgctctggtttccggacatgcccagctgctgctgaaactgttgctgctgctggtggtgctgctgctggaggagctgctgctgctggtggtgctgctgctgctgctgcttggagttgctgctgctgctgcggcttggattgttgcttgatgttgctgctgctgcggttggagctgctgttgctgctgttgcttggtgctgctgttgaagctgcagtagctgctgttgctggacctgcttttgttgctgctgctgcagtagctgatggtgcctcagctgctgcatctgctgttgttgtctggtgagagatccgtacgggctatctatttgtgaatccatggtgttctcgagcttcacgtttaccagggcctgggctttgtccgacatcgtaagagcaccacggggacccgtcatttggttccgcctcatccactgttgctgctgcagcagctggtgttgctgctgtgctgtcagattctgg

SEQ ID NO: 30498 - DNA, 1029 bp, Triticum aestivum
  unsure (1)..(1029): unsure at all n locations
  Clone ID: PAT_TA_30498
cctcgatccactgcccctccctcctccccgctcgtcaccagggcctcgccgccacctactcctcctccgccaccgttgctgcttccccacctcgacttccctctctccgttgtttatccggtcgtcggcggcgcctggttccagatctggcgcaagttaggcgagcccggtggtggggcgaaaggggcagtggaggcgggcgaccaaggacaagcagctgtcggcccgtcgcgggtgaggctccagagggaagaggcggggacaggaggctcgagggaagagggaagagggatgaggcggggacaggaggctcgagggagtagttcgctaacattgataatgattgggtaattccattctgtaaattgctctgccgttgaaagctgtgatgtggaaattatagcttggttcatatagttgctctcattatgcttttcttcatttgaactcttcgacagatgctcagattataagaaagaggaattttataattcaggcatcgattgctcacctttgaaggttgcagattcaagtgctaggctttaaggatgaagcaaatcccaatctagaaacatgtgtcgtgcaccatatatttgtcaccagaaacgaatgtgcaggcgacggccatttgattagtgttatatccaactaaggctagttgactgctgtttgattatcgattcatctacggcagcacagacaggtaaaaatgttttttttcttgttttacagttttaggtcaaagttctcttttaccttaacttttcaattgtactctgctttgtangttctgatcataccgatttagtgacttactacagtttgattgccgattcatatttattctttatattatgcagcttcctctgtgtactgttgggataaattcatgaactatgtatcctgtttaaatggctaggatttgagattgtttgaatccatcatgacacaatgttctgaccatcaactagggtgctcaatgcacaataaatagcttttggttgtcacattaggacacaaaactactag

SEQ ID NO: 30499 - DNA, 663 bp, Triticum aestivum
  unsure (1)..(663): unsure at all n locations
  Clone ID: PAT_TA_30499
ccacgacccgctctccttcccccacgtctctctccccctcgtcccgatctagatcggggtcgcgcccgatcccgacgcaggcgaccgtccccgactccgcccttgcccccgaccaccccgccgcctggaacgacgccgccccggtccgccagcgcccgtcgacgacacgacctcgccggactgctcctctccgtcgacctcgtccccggcatcctccccgcaccaccacaactccgtcgccacccgtcgtccccatcccccaccccgagcctccccgagcacgctgccccgtccctactccccgctacaccgagaccgacgccgctgctacccggttcgactacaagtgttgacgaccactctctcttgccaagagcaaccaagatgttggagcccaagagccaaacgccaacttcgacgacaactcctactacaccggtggtgcctactacttcgtgctgcccgctgacgacgaccaggagtagtttaggaggatcccaggcaggaggcctgcgcctctttcgatctgtatcccagttttgtgctagccttcttaaggcaaacttgtttaacttatgtctgtacttagatattgtttgcttccactgactcgtctatgatcgagctcntgnaatcgatcctggcaaagtcctgcgcttgtac

SEQ ID NO: 30500 - DNA, 613 bp, Triticum aestivum
  Clone ID: PAT_TA_30500
actcgcccccatctccctcgcccgctctctctttccttttctccatcgcccgaccacaaccatagccatggccgccccattgttgtggccactgatgctccccgcgccacctggggacgtccaggaggtccgccatcctccgatgcctcgactaccgcatgagctcaaaccgggaacccctgcatcgacgggatcgaggccttcttcttcctcgggcaccaccgcctccgccgtcgatccgccgcctctgctgctcctaagccatcgtcgagccacccttgtgctccccgacgatggagcccaggagccagacgccactgtcgatgacgactactactactcgggaggtgcctactactgcgtgcagcccgctgacgacgaccaggagtagtttagaaggatcccaaggaggcatgcgcctctttcaatctgtatccagtttgtgctagccttcttaaggcaaacttgtttaacttatgtctgtactcagatattgttgcttccgctgactcgtctatgatcgagctcttggtatccgagccctcgaaggcccctgggcttgtaatatgatgcttgtatgacttgttttatttgtaaaaaaaaaaaaaaaaaa

SEQ ID NO: 30501 - DNA, 649 bp, Triticum aestivum
  unsure (1)..(649): unsure at all n locations
  Clone ID: PAT_TA_30501
gccctttccctcgctctctctcttctcctcgcgtgaaaccgctgctgccgtcgccatggccgcgaccaccgtgctccccgcgccgcgagaagacgcccagaaggactgccacggtccacttcgtccatcccgaggaccgaatcgagcggggaaggcccgtacactcgccatcgccaccatcttcatcttgtacatcgccgcggcctcgacgtcgatccgcatcacctcgtccatcccggcctcgtacgagctcaccaccgacctcctctcgaccccgtgacgatgctgatgcccctgtgatcgactacgtcaccgatgacccctccttctcgcctgagcaaccagatgacggagtccaggagccagatgagacctttgactactgctactacaccgagggcgtctactaccacgtgacgaagaccgccgatgaccaggagtagttaggaggctcccaggcaggaggccttgccttttcgatcgtagatgcttttgtgctagccttcttaaggcaaacttgtttaacttatgtctgtactcagatattgttgcttccgctgactcgtttgtattcaagctgatgtattcgagccctcgaggccccnggcttgtaatataaagcttgtattattttaatttgtgtctagag

SEQ ID NO: 30502 - DNA, 704 bp, Triticum aestivum
  unsure (1)..(704): unsure at all n locations
  Clone ID: PAT_TA_30502
cccacttcccccagatccgccttcccttctcgttcctcactcctccttcctcccttccgctcgggactcaccttgccgggcgtgtccgtcaccggccacctcgcccggtcgcgcccaccaaggtccccagcgcttgaggatgtgtcgagcagccgcgtcgtcgtcgactacgtcggctacatggacgggatccaccccgggagcgcctgcatcgccgccacgcctcgtcttcttcttcctcggctccgacgcactccgcgacggttccggagccagcgagccttccccgagcttccttttgcacacctacaggctcccgacaccgagaccgacgccgctgctacccagtacgactacggtgttgacgacccctctctcttgccagagcaaccagacgttggagtccaggagccagacgccaccgttgatgatgactcctactactcgggaggtgcctactactacgtgcagcccgctgacgacgacaaggagtagtttaggaggacccaagcaggaggatgcgcctctttcaatttgtatcccggtttgtgctaccttcttaaaggcaaattgtttaacctatgtctgtactcaagtattgttgcttcccgctgactcctctatgattngactcttgtattccgaccttncgangccctggttgtnatatgatgcttggtatgactatttttaaaaaaaaaaaa

SEQ ID NO: 30503 - DNA, 581 bp, Triticum aestivum
  Clone ID: PAT_TA_30503
cggcacgaggcaagcattggtaagaaactaattaacaaagtacatgacagttcagtttggactgttccaaatttgttgatagcgcaaaataaggaacttactcgagcacattcattaataggtcagcgcaaaataataaggaactgacttgagcacattcattcataggtcagcaaagtgaaactaattcgtttttgcatccataattgcatcactttggaccacatcactgtcaccgtcgttaaccttgagactcttattctgccggtcacattcagcctcctcctggcaactcctcttggaactgaacacttgtggcacctcaaccaacatctcttcagactcccgaggctcccgcaagactgctgctttagcatcgcaaagaagaatcttgagcttgtgcagcgttgaaaacttaagttttattaagttgtacacttcgaaatatatactacctctgtttctaaatatatggcattttttgcagtcagttgaactacaaaaacgtctaatatttaagaacaaggtagtatatgttaatgttgtttctagttatgaactgttgacccaaagatttatgt

SEQ ID NO: 30504 - DNA, 835 bp, Triticum aestivum
  Clone ID: PAT_TA_30504
ttttttttttttgaaacattgccaataacttgcctcatatacatgatagttttaggtcatacaagcaatggggaaaagaaaagcagtctatatgtgatgaagcaagcttaagtcaaataggtaatgcccatacaaccaaattcattacaatggatggatttcagtcctaaaactgaaaagtaaatatgcataacagaagtgaatcgtagaacgtggtttatacacagcacgatagtcttcctgtgagtacatcttctaccacacatcgcctgtaaacaaaagaaaagataaccatgagttatttgtacttataatagagcaacatcacaacagttctagttatccgcgctgttacgttgcatatatataagagaagccatgcatgtacctagctagaacgaatcagcccatagcatttttcagactcatttcgtgtcctcggtttctcaatgctgctctaactgtagcatcttatctctgttttcaccgcgggtatcatgaatccttttgcttacatagcagcagggtcttccgacatggtctcatgtaacagccgtacagctgttttatctccaaaagatgatattgctgtatgcaaataaacagtcaagcacatcatgcaactgtcacattttgcttcgatactcagccactggtaggccagaagtttgtagaagaatatccaacatcatcatgtgaggtattttcaccatcggtggagcaccctgtaggttttaatgacatgccataaatttgcagaatttacagggaaacctaagacattttagaaattacttcatacctaagacatagaacaattggcatgccgtctcaa

SEQ ID NO: 30505 - DNA, 584 bp, Triticum aestivum
  unsure (1)..(584): unsure at all n locations
  Clone ID: PAT_TA_30505
cttgatcttgcttaagtaaaagactaaagtaaaagataggacttcgtcgagcgaagcagaggttgtcatgctcttttatggttggatgcacaaaatcttaatgcgaaagaacgtcactttatattaccacttgtgatatagacctttattatgcagtccatcgcttttatttcttccacatcacaagatcgtataaatcttattttctcccacactaataagtcatacatatttagagagcaatttttattgcttacaccgatgacaacttacttgaaggatcttactcaatccataggtaggtatggtggactctcatggcaaaaactgggtttaaggatatttggaagcacaagtagtatctctacttggtgcaaggaatttggctagcatgagggggaaaggcaagctcaacatgcttgaatgatccatgacaatatactttaactgagatgtgagaaaacataaccattacgttgtctccctgtccaacgtcaacacttagcatatcagattttatgaggctcacatcataaagatgtcaagatagatattaaatgtgaagactcncttccttatactcc

SEQ ID NO: 30506 - DNA, 602 bp, Triticum aestivum
  Clone ID: PAT_TA_30506
gccggccgggccgggatactcctatatcaaacacaacgaaggcaggaactgtagtacgtacgtaagtgtagctagcctcctcctgtactgcacaccatggcgataccgaggaagaactggagctccttgagcttcgtcgtggccgccctcatggtgatcatggctgccacccttctcctctccacatgcgacgcccgcaaagtgaaggataagcccaccgctttcccagtgccggggaagtgctacgcgaggtttttcccgaactgcaccgagcagcggtgcaagatgttctgcgtccagccgctccccggagccgtctgcctcgacaaaaagacctgttgctgccctgttgcttaattataagtgccgctgaagtgatcgggctaagaaacagtgaaagatgacaacaagcaatcttggtaaacctccaaatatgtagtccttgtttgttaacgttgtccctatttatgacccgtcaaccaaagatttgtgtattgtattaatgtgtgtattatatcaccacaacaatgtgctcgctattagcattaatgagttccgtatatcttgagacacaacaaaaaaaaaaaaaaaaaaggccccta

SEQ ID NO: 30507 - DNA, 831 bp, Triticum aestivum
  unsure (1)..(831): unsure at all n locations
  Clone ID: PAT_TA_30507
tagcgtggtcgcggccgaggtacatctttactagtaggacttctgctattactacatctctgtggatctttactactaggacttcagtttttacgcatgatttggacagagaagtcaggaatgcggggagttgttgttctgatcgagcgtgcactgtggctgcatgcatgtttgtattgctcatttctagatttatgttagctcacttgagtgtttatgttatctgcatattgagtggttattgtgactcttatgtgtcatatggatctcctgctgagaaacttggaatactggtcggtgacgtcattaattgtttcaatggagaacgcatctctacaacagtcgagttggagaatatgttgctaagcaaatgcgaggatgaaaataatagccttaattctgaagtcaatgtcaaagtaagtttcttctatgattttctttatacttattattcatgctatgattttctttatagacccaaagtggtcggacccttccctggaccctgcgcaagcgggagctacatgcaccagcttgatgtgtttcacatacgcaagtctcgctggagtgacagaacattaactgtaaaagtgtctgatgatggtgaagttgttgcaacaggagttacttatcctttcggagaagggacaccatgattaataccatgccaattgaccaaacgggcccaggaagataggtttgggagttcaggacagatacatgcgtcggtgaatgcatgcgtggaactgcaagtttctgctaaatgcatttgatttcttnngcggtataactccttggcatatccttgtacctgcccgggcggccgctcga

SEQ ID NO: 30508 - DNA, 677 bp, Triticum aestivum
  Clone ID: PAT_TA_30508
acgtgacggatcgctaaacctagacaaatattaaggaaaatggagcttggaggtcgagcttggagaggagaaagcttaagtagtgtggctcgggcattccatcgaacacctcatgtgcataggatgtgagctagagcaccacaaagctctcccctcgccggcgacgaaaaacagagcactgtgagtgctctgctcgcgggcgaggggtatatatagtcaactaattggtcccggttcgtgccacgaaccgggactaaagggcaacctttggtcccggttcacgccaccaactgggaccaatggtggtgggccaggagcgagacgcattggtaccggttcatcccaccagccggaaccaaaaggtccagacgaaccgggaccaatggcccacgtggcccggccggcccccggggctcacgaaccgggtccaatgcccccattggtcccggttctggattgaaccgggactaatgggctgacccggcctggaccaatacccccttttctactagtgatgtctaacaacgaaatgtctgtgtcctcctcaatgtggaacaagctttatctttagagtccttcagaaagagatgtagtatattgtaaagaaaggtagactaagggcatttctaaccgatcccctaaaaatagtgaagtttccagtggagtaaactcttagt

SEQ ID NO: 30509 - DNA, 1036 bp, Triticum aestivum
  Clone ID: PAT_TA_30509
ttcgcgggtcgacaggttgctagaatactgtatgtgcttcacttatatcttttcagattgatagtttttgctctagtgcttcacttatattttttagagcacggcggtggcttgattttatagaaattattagtctctcatgcttcacttatattattttgagagtctcatagaacagcatggtattttctatggttaataatttggtcctagaatgatgagcatccaagttgggtataataaaaactatcataggaattgaataggatgttatgatcagtttgttgcttgataattgttttgagatatggaggtagtgatattaaagttgtgctagttgagtagttgtgaatttgagaaatacttgtgttgaagtttgtaagtcccgtagcatgcacgtatggtaaacgttatgtaacaaatttgaaacatgaggtgttctttgattgtcctccttatgagtggcggtcggggacgagcaatggtattttcctaccaatctatccccctaggagcatgcgcgtagtgcttggtttttgatgacttgtagatttttgcaataagtatgcgagttctttatgactaatgttgagtccatggattatacgctctctcacctttccatcattgctagccctttctcacattgagagtttgcgcaaactttgccggtgcatccaaaccccgtgatatgatacgctctttcacacataaacctccttatatcttcctcaaaacagccaccatacctacctattatggaatttccatagccattccaagatatattgccatgcaactttccatcattccattcatcatgacacattcattattgtcatattgcttagcatgatcatgtagttgacatagtatttgtggcaaagccaccgttcataattctttcatacatgtcactcttggtccattgcatatcccggtacaccgccggaggcattcatatagagtcatctttgtcctagtatcgagttgtaatcagtgagttgtaaataaatagaagtgtgatgatcatcat

SEQ ID NO: 30510 - DNA, 1010 bp, Triticum aestivum
  Clone ID: PAT_TA_30510
atacccaaagcattcttacggtatccgggagtaacacgatctcatggtctaaggaaaagatacttagacatgggaaaactctagcaaacgaactatacgatcttgtgctatgttaaggattgggtcttgtccatcacatcattctcccaatgatgtgatctcgttatcaatgacatccagtgtccatagtcaggaaaccatgactatctgttgatcaacgagctagttaactagaggctcacaagggacatgttggtgtctgttattcacacatgtattacgatttccggataacacaattatagcatgaacaatagacaattatcatgaacaaggaaatataataatacccattttattattgcctctagggcatatttccaacagcagctccattgcagctccgccgcctgtgtcaagcagctccattgcagctccgccgcctgcgccagcagctccgtcgtcggcgtcgagcgctccattgcagctccgtcgcctgcgccgcgcagctccattgcagctccgtcgtcggcgtcgagcgctccattgcagctccgtcgcctgcgccgcgcagctccattgcagctccgtcgtcggcgtcgagcgctccattgtagctccgtcacctgcgccgagcagctccattgcagctgcgccacccgcaccgagcagctccattgcagctccgccgtcggcgtcgagcgctccattgcagcttcgtcgcctgcgccgagcagctccccccgctgtcgctcgagtatggcggccgtcgacgcgttcgtgcgttgcagcaccagcgttcgtcgacgagcgccgtttcttatcgccggcagcacctcccggttcccccgctgttgtggtggtgctcaccatgactcccttccatgggcgctgctttgcagctatgccgcatccagctatgcaacggaagagctccggttgttggtgccgacatgcggcgtcaaagctcttccatcttcctagctgttgtggtggtgctcggccggacg

SEQ ID NO: 30511 - DNA, 554 bp, Triticum aestivum
  unsure (1)..(554): unsure at all n locations
  Clone ID: PAT_TA_30511
cggacgcgtgggcggacgcgtgggctcgactctcttcctgtcagttctctctgacggagcgccgtcagcgccattgccatggccaccgaccctcccccgccacgccgacgagccctggaggaccgccgtcgtctacctcaccctttgcgccaccggattggagccgggagtccccatctccgtcacccacatcgtctttgtctcgggtcgtcttcgatccgctccaccccgagcctctccggcatccccgagctcgcttttgcacgactacaggcccccatggtggatccctagagccagatgccaccgccgatggatgctactacatggaggccaccgaagaccaggagtagttagaaggtcccaggcaggaggccttgcctcttcgatcgtgttgcttttatgctagccttcttaaggcagtcttgtttaacttatgtatgtactcagatattgttgcttccgctgactcttgtgtatcgagcttgttttcgacgccctcgagcgcccctagccttgtaatatgaagcttgtattantttctttttgtgtct

SEQ ID NO: 30512 - DNA, 1316 bp, Triticum aestivum
  Clone ID: PAT_TA_30512
ggccgacgggtatgtgtatttatcttttaattagtgtttgtgcaaagtagaacctataggataacctacgatgatagttgatttgattctgctgaaaaacagaaactttgcacgcacgaatataattttgttaaatcacaggaatgtgcttttgcgatgattctttttgatgctgttccataaaaaaattgtcccggacttcctattttggtaggatgtttagagttccagaagtttgcgttagttacagattgctacagactgttctgtttttgacagattctgtttttcgtgtgttgtttgcttatttcaatgcatctatggctagtaaattagtttataaaccataaataagttggaatacagtagttttaacaccaatataaataaagaatgagttcattaagtaccttatgtggtgggttttctttcttgcactaacggagcttatgagatttcctgttgagttttgtgttgtgaagttttcaagttttgggtaaagatttgatggtctatggaataaggagtggcaagatcctaaacttggggatgcccatggcaccccaggatattcaagaatagccaaaagcctaacattggggatgccccggaaggcatcccctctttcgtcttcgttcattggtaactttacttggagcaatatttttatttgccacatgatatgtgttttgcttggagcgtcgtgtattatattggtctttgcttgttagtttaccacaatcatccttgctgtaacacaccttttgggagaagcctatttgattagaatttgctagaatactctacgtgcttcacttatatcttttgagcttgatagtttttgctctagtgcttcacttatatctttaagagaacgacggcggtgtcttaattttgaagaaattgctagtctctcatgcttcacttatatcattttgagagtcctacaaaacagcatggtaattttcttaaattgtgaaattagtcctaaatatgataggcatccaagatttgtaaaaactttcttataagtgcgttgaatactaagaaaagtttgatgcttgatgattgttttgagatatggaggtagtaaattaaagttgtgctagttgagtaattgtgaattcgagaaatacttgtgttgaagtttgcaagtcccgtagcatgcacgtatggtaaacgttgtgtaacaaatttgaaacatgaggtgttctttgattgtcctccttatgagtggcggtcggggacgagcgatggtcttttcctaccaatctatccccctaggagcatgcgcgtagtgcttagtttttgacgac

SEQ ID NO: 30513 - DNA, 1260 bp, Triticum aestivum
  Clone ID: PAT_TA_30513
gggggccgccttttttttttttttttttttttttttttaggaataaataatccatctactttctgtttagatgtggttttatgttttaattagtgtttgtgccaagtagaacctgtaggatgagctatgatgatagttgatttgattctgctgaaaaacagaaactttgctctcacgagaaaaaattcaataaatcacaggaacgtgcttatgcattgattcgttttgatgctgatcaataaacaaaatttcgagtacgtcctaatttggtagaatttttagagttccagaagtttgtgttagttacatattgctacagactattctgtttttgacatattctgtttttcgtgtgttgtttgcgtatttcaatgcatctatggctaataaattagtttataaaccttaaggaagttggaatacagtaggtttaacacaaaaataaataaataaagaatgagttcattgcagtaccttatgtggtggtcttgttttctttcattaacggagcttataagattacttgttgagttttgtgttgtgaagttttaaagttttggttaaaccttttttggattatggaataaagggtggcaagagcctaagcttggggatgcccatggcaccccaagatattcaagagtagccaaaagcctaagcttggggatgccccgagaaggcatcccctctttcgtcttcgttcattggtaactttacttgaagctatatttttatttgccacatgatatgtgttttgcttggagcgtcttgtatgatttgagtctttgcttttagtttaccacaatcatccttgccgtacacaccttttgggagagacacacatgaatcggaatttattagaatgctctatgtgcttcacttatatattttgagctagataattttgctctagtgcttcacctatatatttttagagcacggtggtggttttattttatagaaattattgatatctcatgcttcacttatataattttgagagtcttatagaacagcatggtaattttctttggctataaaattagtcctaatatgataggcatccaagatgggtataataaaaactttcataaaaagtgcatcaaatactatgagaagtttggtacatgatgattgttttgagatatgaagatggtgatattagagtcatgctagttgagtagttgggaattttagaaatacttgtgttgaagttggtgattcccgtagcatgcacgtatggtgaaccgttatgtgatg

SEQ ID NO: 30514 - DNA, 1256 bp, Triticum aestivum
  unsure (1)..(1256): unsure at all n locations
  Clone ID: PAT_TA_30514
agtgtgaattttctatcataacttttggatttagggaagtatgatgaatcttacattctttacagactatactgttttggcagattgctgttatgtttgcattgtttgcatatgtttgcttgtttaatgattctatttgaggatangagtgttaaatatgcagatacatttagtattcaatgttgaacaataatttatgtgattttttacaatataaaatgataagtttttgcattggtttatactaacctatctcacgagtttttgttgagtttggtgtggatgaagcttttgataaaaagagaaaccgtgacatgaaaggaattaaggagacacaaaggttcaagcttggggatgcccaaggcaccccaaaataatatttcaagaagtttcaatcatctaagcttggggatgccccgttaggcatcccacctttcttcttcaacaactatcggttagtatcggttgagcctaagtttttgcttcttcacatgagttgtgctatccttgcattgttattttattttgctttgcttgatgtttgaataagataccaagatctgaaattctttaatgagatagagtctttgcatagttgcataattatttagctaccctttgatcttcacttaaatctttcggagtagtttgtcatttgctctagtgcttcacttatatcctttagagcatggtggtagttttattttgaagaaatagatgaactctcatgattcacttagattattttgagagtcttaaatagcatggtagttttcttaaaatcctaatatgctaggtattcaagaataataaaattctcttatgagtgtgttgaatactatgagaagtttgatacttgataattgttttgagatatgaagatggtgatattagagtcatgctagttgagtagttgtgaatttgagaaatacttgttctgaggtttgtgattcccgtagcatgcacgtatggtgaaccgttatgtgatgaagtcggagcatgatttatttattgattgtcttccttatgagtggcgatcggggacgagcgatggtcttttcctaccaatctatccccctaggagcatgcgcgtagtactttgttttgataactaatagatttttgcaataagtatgtgagttctttatgactaatgttgagtccatggattatacgcactctcacccttccaccattgctagcctctctaatactgcgcgcctttcgccggtatcatacacccaccatataccttc

SEQ ID NO: 30515 - DNA, 1258 bp, Triticum aestivum
  Clone ID: PAT_TA_30515
gtaccgtactagaattcgcgggccgacgggctaacatatgagtgtttaatttttttttgtttgccacaatcatccttgctgtacacacctttcgagtgggacacgcatgaattgtgaattattagaatactctatgtgcttcacttgtatcttttgagctaggcaattttgctctagcgcttcgcttatatcttttagagcacaatagtggttttagtttgttgaaattattgaactctcatgcttcacttatatcattttgagaatctttttaaacaacacagtaatttgctttggttataaatttagtcctattatgatagacatccaagagggatataagaaaaactttcatataacgtgcattgaattccatgagaactttgattcattgcaatagttttgctatataaagatggtgatattagagtcatgctagtgggtggttgtggattgtagagacacttgtgttgaggtttgcaagtcccgcagcatgcacgtatggtaaccgttgtgtgacaaatttgaagcatggggtgtttctttgattgtcttccttatgagtggcagtcggggacgagcgatggtattttcctaccaatctatccccttaggggcatgcgtagtagtactttgctttgagggctaataaacttttgcaataactatatgagttctttatgactaatgtgagtccatggattatacacacttttacctttccatcattgctagcctctacggtaccgtgcattgcactttctcacaccaagacgtggtgcaaacttcgcaggtgcatccaaaccccgtgatatgatacgctctatcacacataagccttattatatcttcctcaaaacagccaccatacctacctattatggcttttctatggccattccgagatatattgccatgcaacttccaccgcttccgtttgatgacttgagcattcattgtcatattgctttgcatcatcatatagctgacatagtagttgtggctcagccaccgttcatcatttttcatacatgttacgctagatcattgcacatcctggtacatgccagaggcattcatatagagtcatactttgtcataggtatcgagttgtattttttatttcttttgagttataagtaaattgaagtgtgatgatcatcattattcatttttagagcagtgccccagtgaggaaaggatgatggagactatgattcccccacaagtcgggatgagactccagacaatgagagag

SEQ ID NO: 30516 - DNA, 452 bp, Triticum aestivum
  Clone ID: PAT_TA_30516
ggcacgagccgcagcgccaccgtcgattccggcaccctctgctgctcccgtccctcgccgagcctttcttgtgctccccgaccccgaggctgtcggcgacccccagtttgactacgatgttgacgacccgtccttcttgcccgagcaaccagatgtcagagcctaggagccagacgccaccgtcgacggacggctcctactacactggaggtgcctactactacgtgcagcccgctgacaacgaccaggagtagttaggaggatcccaggcaggaggcctgcgcctctttcgatctgtatcccagtttgtgctagccttcttaaggcaaacttgtttaacttatgtctgtactcagatattgttgcttccgctgactcgtctatgatcgagcacttgtattcgagccctcgaggcccctggcttgtattatgatgcttgtacgacttatttt

SEQ ID NO: 30517 - DNA, 1367 bp, Triticum aestivum
  unsure (1)..(1367): unsure at all n locations
  Clone ID: PAT_TA_30517
gggtcgagcgggatattacagtagaaacaacgcaaaaacaaaatatgaattggtttgcaacagttcttagagtagtgatttgctttattatactaacggatcttaccgagttctctgttgaagttttgtgtggatgaagtgttcgatgatcgagaaggtctcgatgtgagaagaaggaagagaggcaagagctcaagcttgggatgcccgaggcaccccaagtaaatattcaaggatactcaagcgtctaagcttggggatgccccggaaggcatcccctctttcttcaacaagtatcagtatgtttttggatttgtttcgttcatgcgatatgtgcaatcttggagcgtattttgcgtttagttttcatttttattttatgcaccatgacggtatgagatagtccttggttgatttatagaatgctcattgcacttcacttatatcttttgagtatggctttatagaatgcttcatatgcttcacttatatcatttgaagtttggattgcctctttctcttcacatagaaaaccgccatttatagaatgctcttttgcttcacttatatttgttagagaatgggcatatcttttgtagaaagaattaaactctcttgcttcacttatatctatttagagagatgacaggaattggtcattcacatggttagtcataaaatcctacataaacttgtagatcgctgaatatgatatgtttgattccttgaaatagttttgcgatataaaggtggtgatattagagtcatgctagttgagtaattgtgaaattgagaaatacttgtgttaaggtttgcaagtcccgtagcatgcacgtatggtaaccgttgtgtgacaaatttgaagcatggggtgtttctttgattgtcttccttatgagcggcagtcggggacgagcgatggtatttcctaccaatctatccccctaggggcatgcgtagtaatactttgcttcnaagggctaataaacttttgcaataagtataanaattccttaatgactaaaggtancccatggnttatacacacccccaaccttccancaattgctancccctaagnaacctgcatgcccttntacccccaagggggggcccggtaccaattngcccnaaaanagtcntattagccccncanangcctccntttaaaactcctgacngggaaacctgggnntaccaacttaacgcttgcanaaatccccttcccaactgggtaatacaaaangcccacgatngcctccaacattcnaacctaatgcaatggaccnccttacggncataacccgngtgtgngtaccactacgnaaatncagccaagccgnccttcntttccnntttccaancgg

SEQ ID NO: 30518 - DNA, 778 bp, Triticum aestivum
  unsure (1)..(778): unsure at all n locations
  Clone ID: PAT_TA_30518
tattcggaatttggagaagaacccgccttgcaatgccgaagacaatctgcgcgcaggactcatcgtcattgaatcctggttcgggggctactgagggagtcctggattaggcggtccttggacagccggactatatcctttggccggactgttggactatgaagatacaagattgaagattttgtcccgtgtccgggtgggactctcctttgcatggaaggcaagcttggcaattcggatatatagatcacctcccttgtaaccgactttgtgtaaccctagccccctccagtgtctatataaaccggagggtttagtccgtaggacaacgaaaatcataatcataggctggcttctagggtttagcctctacgatctcgtggtagatccactcttgtaatactcatattcatcaatatcaatcaagaaggacgtggggtattacctccatagagagggcccaaacctgggtaaaacattgtgtcccttgcctcctattaccatcagccttagacgcatagatcggggaccccctaccccgagatccgccggttttgacaccgacattgggtgcttttggagantcctctatgtccgtccgctgcgaggtccgatggtcccttcaatccgtcaaacaacaacatggtccaaggtgagcctttctccccgttacagntttcaatgttccggcggttcacactatgggcaattcnctgggcatcctggacggtttgacantaccccttgccaacagncaaggtnaaaaanctntaataca

SEQ ID NO: 30519 - DNA, 730 bp, Triticum aestivum
  unsure (1)..(730): unsure at all n locations
  Clone ID: PAT_TA_30519
ccgggtcgacgcgggatatgtattttgcttggagcgtcttgtatgatattagtattttctttttagtttaccacaatcaacctttctgtacacacctttcgagagaagccccacttgattggaatttattagaatactctatgtgcttcacttatatcttttgagctagatagttattgctctagtgctcacttatatcttttagagcacggctgtggcttaatttttgtagaaattgctagtctctcattcttcacttatattattttgagagtctcttagaacagcatggtatttgctatggttataaaattggtcctataatggtaggcatccaagtttggtataataaaaactatcataggaagtgaattggatgctatgatcaatttgatgcttgataattgttttgagatagggaggtagtgatactaaagtaatgctagttgggtgattatgaatttaaagaatgcttgtgttaaagttagcaagtcacgtagcatgcacgtatggttaaagttgtgtaacaaatttgaaacatgaagtgtacctggcttgtgcatccttatgagtgggcggtcaaggacgagtgatggcctttcctaacaatcctatcccgctangagcatgcgcgtaatgcttggttttgatgactggagatttttgcaataagtatatgagtctttttgactaagttgatccaaggattataccaccccaccttcaaggg

SEQ ID NO: 30520 - DNA, 1277 bp, Triticum aestivum
  Clone ID: PAT_TA_30520
gacttgcaaacttcaacacaagtatttctcaaattcacaactactcaactagcacaactttaatatcactacctccagatctcaaaacaatcatcaagcatcaaacttctcttagtattcaacacactcataagaaagtttttactagtcttgaatacctagcatattaggattaagtaaattaccatgctgtttaagactctcaaaataatataagtgaagcatgagagaacaatagtttctataaaacaaatccaccaccgtgctctaaaagatataagtgaagcactagagcaaaaactatatagctcaaaagatataagtgaagcacatagagtattataataaattccgaatcatgtgtgtctctctcaaaaggtgtgtacagcaaggatgattgtggtaaactaaaaagcaaagactcaaatcatacacgacgctccaagcaaaacacatatcatgtggtgaataaaaatatagccccaagtaaagttaccgatagacgaagacgaaagaggggatgccttccggggcatccccaagcttaagattttggttgtccttgaattttaccttggggtgccttgggcatccccaagcttaggctcttgctactccatgttccataatccatcaaaagaattcacccaaaacttgaaaactccacaacacaaaactcaacagaaaactcgtaggctccgttagtataataaagtaaaaccaccacttaggtactataataaactcattctaagctcatatgggtgtaatatctactatattccaacttatctatgatgcataccctccgatactactcatagattcatcaaaataagcaaacaacacatagaaaacagaatctgtcaaaaacagaacagtctgtagtaatctgtagctagcgcaagatctggaaccccaaaaattataaaataaatttccggacgtgaggaatttatctattaatcatcttcaaaaagaattaactaaatatcactttccaaataaaaatgacagcagttctcgtgagcgctaaagtttctgttttttacagcaagttcaacaagactttccccaagtcttcccaacggttctacttggcacaaacactaattaaacacaaaaaaacacaaccaaaacagaggctagataatttatttattactaagcaggagcaaaaaacaaggaataaaaataaaattgggttgcctcccaacaggcgctatcgtttaacgcccctagctaggcataacaagcaatgatagatgcccgtggac

SEQ ID NO: 30521 - DNA, 1310 bp, Triticum aestivum
  Clone ID: PAT_TA_30521
gggtcgacgggtcatcggtaactttacttggagctatatttttatttaccacatgatatgtgttttgcttggagcgtcaatttattttgttaggatttgcttgctgttatttagaacaatgtttttcatcttttatttcaataaaagtggcattgatagcctctactatgcctatgttacaagtatacatgttgctgtttgaacacagaaagtttaccgctgttgcaataattccctagaaaagtcagaatgtgataaaatgttgaaaccttttgcatattaagatatgataaatttaatacagtggaaattttctttcataatttttggatctagggaagtatggatgttgcagcattctttacagactgtactattttggcagattgatgttatgtttgcattgtttgcatatgtttgcttgtttaatgattctattttaggataggagtattaaatatgcagaggcattttagtatgcaattttgaataataattttagtgatttgttacagtagataatgataaggttattgcgttgatttatactaacttatctcacgagttcttgttgagttttgtgtggatgaagtttttaagatgtagggaagccgtaatataaaaggaattaaggagacacaaaagctcaagcttggggattcccaaggcaccccaagataatatttcaataagtctcaagcatccaagcttggggatgccccggtaggcatcccacctttcttcttcaacaattatcggttagtatcggttgagcctaagtttttgcttcttcacatgatgagtgctatccttgaaatgtacttttattttgttttgcttgttgtttgaataatatcccaagatctaaaattcttaaatgttacagagtcttcacatagttacataattattcgactactcattgatcttcacttatatcttttgtagtagtttgtcatttgctctagtgcttcacttatatcttcctagagcatggcggtagttttattttgtagaaattattgatctctcatgctccacttatattattttgagagtcctaaacagcatggtaattttctttagttatgaaactagtcctaatatgatagacatccaagatggttataataaaaactttcatatagagtgcattaaatactatgagaagtttgatacttgatagttgttttgagatataaatatggtaatattagagtcgtgctagttgagtaatagtggaattgagaaatacttgtgttgaagtttgcaagtcccgtagcatgcacgtatggtaaacgttgtgtgac

SEQ ID NO: 30522 - DNA, 1036 bp, Triticum aestivum
  Clone ID: PAT_TA_30522
ggtcgatgggtctcgctatagagagtcattatatgttagagaatcttcacatagttgcataattattcgactactcattgatcttcacttatatctttcggagtagtttgtcttttgctctagtgcttcacttataacttttagagcacggtcgtagttttattttgaagaaatagatgaactctcatgcttcacttaggttattttgagagtcttaaatagcatggtaattttcttaaaatcataatatgctaggtattcaagaataataaaattctcttatgagtgtgttgaatactatgagaagtttgatacttgatgaatgttttgagatatgaggatggtaatattagagtcatgctagttgagtagttatgaatttaaagaatacttaaagtttgtgattcccgtagcatgcacgtatggtgaaccgttatgtaacgaagacggagcatgatttgtttattgattgtcttccttatgagtggcggtcggggacgagcgatggtcttttcctaccaatctatccccctaggagcatgcgcgtaatactttgttttgataacttctatatttttgcagtaagtatatgagttttttatgactaatgttgagtccatggattatacgcactctcacccttccacctttgctagcctctctaataccgcgcacttttcgccagtatcatacacctaccatataccttcctcaaaacatccaccatacctacctattatggcatttccatagccattctgagatatattgccatgcaactttccaccatctagttcatcatgacacactcgtcattgtcatattgcatatcctggtacaccgccgaatgcattcacatagagtcatattttgttctaagtatcgagttgtaattgttgagttgtacgaataataacagtgtgatgatcatcactattagagcattgtcctagtgaggaaagaatgatggagactatgattcccccacaagtcaggatgagactccaaacgaatgaagagaggccaaagtagccca

SEQ ID NO: 30523 - DNA, 1632 bp, Triticum aestivum
  unsure (1)..(1632): unsure at all n locations
  Clone ID: PAT_TA_30523
gggaaatcatggagcgtcttttgtgtttagttttcatttctcttttatgcaccatgatggtatgagatagtccatggttgatttatagaatgctcattgcacttcacttatatcttttgagtatggatttgtagtttcacttatatcatttgaagtttggattgcttgttcctcttcacatagaaaactgttgtttgtaaaatgctcttttgcttcacttatatttattagagcttgctcttttgtagaaagaattaaactctctttcttcacttatatctatttagggagatgacagaaattggtcattcacatggttagtcataaaatactacataaacttgtagatcgctgaatatgatatgtttgattccttgcaatagttttgcgatataaaggtggtgatattagagttatgctaatgggtgaatgtggattagtagaaacacttgtgtcgaggtttgtgattcccgtagcatgcacgcatggtgaactgctttgtgatgaagttggagcacaattttatttattgattgtcttctttatgagtggcggtcggggacgagcgatggtcttttcctaccaatctattcccctaggagcatgcgcgtagtactttgttttcaatggcttgtagatttttgcaataagtatatgagttctttatgactaatgttgagtccatggattatacacactctcacccttccatccttgttagcctcttcggtaccgtgcattgccctttctcacattgagagttggcgccaacttcgccggtgcatccaaaccccgtgatatgatacgctctttcacacataaacctccttatatcttcctcaaaacagccaccatacctacctattatggcatttccatagccattccgagatatattgccatgcaactttccaccattccgttcatcatgacacattcatcattgtcatattgctagcatgatcatgtagttgacatcgtatttgtggcaaagccaccattcgtaattctttcatacatgtcactcttgattcattgcctatcccggtacaccgccagaggcattcatatagagtcatattttgttctagtcttgagttgtaaatcaataaaaatgtgatgatcttcattattagagaattgtcccggtgaggaaaggatgatagagactatgattcccccacaagtcgggatgagacttcggactttacaaaagaaaaaaaagagaaaggccaaaaataaaaaaaaggccaaagaaaaaaagaaaaagaaaaaganaaaaataaaagaaaaaaaggaaaaaaagaaaaaaatgagagaaaaagagagaagggacaatgctactgtccttttaccacacttgtgttcaaagtagcaccatgtcttcatgtagangctcctatgttgcacttcatatctagtaggatttcatttagacttggttgttttcatgtggttctcaaatgcctngctcgtagcagcggttgatccaccactngtctttgtggcttnncattatgcccngtcatcgttcatgcatccnctcccacatgttcttatggantcangccgtcncgctgtntgggcactcctttgctccaacacatcntcacaaggatnatgcngnagatc

SEQ ID NO: 30524 - DNA, 434 bp, Triticum aestivum
  Clone ID: PAT_TA_30524
cgggtcgacgggataaaaatatgatagattggataaatagatctcgaataaaagcaaattaaaataaagtgcagcaaggtatttttgtatttttggattaatatatccgaaaataaaagaaaataaaaatagatcgcaaagacaaatataataaagaagagaccccaggcccgtagatttcactagtggcttctctcgagaaaaatatcaaacggtgggtaaatgaattactgttgggcaattgatagaacttcaaataatcatgacgatatccaggcaatcatcattatataggcatcacgtccaagattagtagaccgactcctgcctacatctacttctattactccacacatcgccagctatccagcatgcatttagtgtattaagttcatggagaaacagagtgatgcaaaaagaacaatgacatgatg

SEQ ID NO: 30525 - DNA, 1009 bp, Triticum aestivum
  Clone ID: PAT_TA_30525
cgggcccaaagcacccaagataatatttcaataagtctcaagcatctaagcttggggatgcccggttggcatcccacctttcgtcttcaacaactatcggttagtatcggccgatcctaagtttttgcttattcacatgatgtttaccattcttagaatgtcattttcttttgctttgattgatgtttgaataatataccaagatatgaaattattaaatgttagagagtcttcacatagctaaataattatttaactactcattgatcttcacttatatctttcggagtagtttgtcattgctctagtgcttcacttatatctttttagagcacggtggtggttttattttatagaaataattgatctctcatgcttcacttatattattttgagagtcctttagaacaacatggcaatttacttttaggcataataaaaacttccatataagtgcattgaatactatgagaagtttggtacttgataattgttttgagatatggagatggtgatattaaagtcatgctagttgagtagttgtgaatttgagaaatacttgtgttgaagtttgtgattcccgtagcatgcacgtatggtgaaccattatgtgatgaagtcggagcatgatttatttattgatggccttccttatgagtggcggtcggggacgagcgatggtcttttgctaccattccatccccctaggagcatgcgcgtagtactttgtttcgataactaataaatttttgcaataagtatgtgagttctttatgaataatgctgagcccatggattatacgcaccctcacccttccacattttctagcctctctagtaccacgcaactttcgccggtaccataaacccaccatataccctcctcaaaacagccaccatacctacctattatggcatttccatagccattccaagatatatttccatgcaactttccaccgttccgttgttaataacacacttcaccattgtcatatttccatgcatg

SEQ ID NO: 30526 - DNA, 606 bp, Triticum aestivum
  Clone ID: PAT_TA_30526
cgggtcgacggggtaccaatctacccaccctagggtcatgcgtagtagtactttgcttcgagggctaatgaactttcacaataagtatgtgaattctttatgactactatgagtccatggattatacgcactctcatctttctgccatttgctagcctctccagtaccgtgcattaccctttctcacctcgagagttggtgcaaacttctccgatgcatcgaaaccccatgatatgatatgctctatcacacataagcctccttatatcttcctcaaaacaaccaccatacctacctatcatggtatttccatagccattttgagatatattgccatgcaacttccaccactccgtttttatgacatacacattcattgtcatattgctttgcatgatcataagaaagctagcatgatatttccatggcttgtctgttttttgatatcgttgttacgctagatcattgcacatcctgggtacactgccaagaggcattcatatagcattttttggttataggtatccgattgtaattttgagttgtaagtaaatagaagtgtgatgatcatcattattcattattagaagattgtcccaagtgagg

SEQ ID NO: 30527 - DNA, 1345 bp, Triticum aestivum
  Clone ID: PAT_TA_30527
ttgcccacgcgtccgcggacgcgtgggtctcgcgccgtttctccctcacaacacaaaccccgagcgaagccgtcgacgtgccgtcgtggtctccgtggccatggtcattcccgagctacgacaagatgcctagaggcaccgccgtcctcttctacgtcgacttcaaccatcggagcaagctgggagggcctcgcgcgtcaccatcgagctcatctgcgcctctgcatctagacgctcgccgtcttggattcggtctcaccggagcctccccaagcccgctttgctcatctacaggctcaacatgctggagtccaggagccagacgccactgtcgacgacgactcctactacacctgaggtgcctactactacgtgcagcccgctgacgacgaccaagagtagttaggaggatcccatgcaggaggcctgcgcctcgttcgatctgtatcccagtttgtgctagccttcttaaggcagacttgtttaacttatgtctgtactcagatattgttgcttccgctgacttgtctatgatcgagcacttgtattcgagccctcgaggcccctggcttgtattatgatgcttgtatggcttatttatgttgtagagttgtgttgtgatatcttaccgtgagtccctgatcttgatcgtacacgtttgcgtgcatgattagtgtacgattgaaccggaggcatcacagtcatatcgttgcagagtttaggcgaagccctgcgccggtagaacatcatcatcgtcaccatgccctcgtgctgacggaactcatccccgacaccctgctggattagagtccggggatcgtcatcgagctgaacgtgtgctgaactcggaggtgccgtacgttcggtacttggatcggtcagatcgtgaagacgtatgactacatcaaccgcgttgtcataacgcttccgcttacggtctacaagggtacgtggacaatactctcccctctcgttgctatgtcatcaccatgatattgcgtgtgcgtaggaattttttttgaaattactacgttccccaatattgaggccctgcccctcctccttctcttcctcagaggaacttcttcttcatcagccggaagttcaatgacgtcccgcggagcagctttggaagtggttgcgtcatcggcctcctcatcacctcggaccttgtcaacgtccatggaagtcgtagaagttgcagcgccagaggtaacaggaacgtccatcttgatcttgggcaaggtcttctgaggcttcgaaggggccaccttgggttgcttggcgaccttctccgttggctccggagtcgaagtccgagtgcgcttttgtgcttgggtactcg

SEQ ID NO: 30528 - DNA, 865 bp, Triticum aestivum
  Clone ID: PAT_TA_30528
gcagcggtgtaatctctctgtttcccgcggtaatttctacttaaacatggtgctcaacgctatatattatttcccaatgatgtatgactatcctatgatgtttgagtagattcattttttcctatgggctatttgatgatcaagattggtttgagttgcatgttttattattggtgttgtcctatggtgctctccgtgtcgcacaagcgtgagggatccctgctgtagggtgttgcaatatgttcatgattcgcttatagtgggttgcgtgagtgactgaaacacaaacccgagtaagggagttgttgcgtatgggataaagaggacttgatactttaatgctatggttgggttttaccttaatgatctttagtagttgcggatgcttgctagagttccaatcataagtgcatatgatccaagtagagaaagtttgttagcttatgcctctccctcaaataaaattgcaataatgattaccggtctagttattgattgcctagggacaaataactttctcgtaacaaaaagctctctactaaaactaattgagttgtgtctttatctaaacagcccctagtttatgtttacgtgctctttattatcttgcaaatctgtcctatcacacctacaaagtacttctagtttcatacttgttctaggtaaagcgaacgtcaagcgtgcgtagagttgtatcggtggtcgatagaacttgagggaatatttattctacctttagctcctcgttgggttcgacactcttacttttcgaaaactgttgcgatcccgtatacttgcgggttatcactccaacacaaagtgcttgccaaaggaaaaagtgtaaaaaggaaagttgatgatccct

SEQ ID NO: 30529 - DNA, 598 bp, Triticum aestivum
  Clone ID: PAT_TA_30529
gtcttgtaatatttgtgtctttgtgtcttagtattccacaatcatccttgctgtacacaccttttgagagagccatacatgaattaaaatttgatagaatactctatgtgcttcacttacatcttttgagctaagtagttttgctctatgtgcttcacttatatcttttgagctagataattttgctccatgtgcttcacttatatcttttgagcattataattttgctctatgttcttcacttagatcttttagagcacagtggtggatttgttttaaggaaactattgatctctcatgcttcacttaaattattttgagagtctcttaatagcatggtaatttgcttaataataatatgcttggtattcaagatttgtgaaactttcttttgagtgtgttgaatactaagaaaagattgaagcatgataattgttttgagatatggaggtgataatattaaagtcatgctagttaagtagttgtgaatttaaagaatacttgtgttgaagttagtgattcccgtagcatgcacgtatggtgaaccgttatgtgatgaagtcggagcatgatttatttattgattgtcttccttatg

SEQ ID NO: 30530 - DNA, 1247 bp, Triticum aestivum
  unsure (1)..(1247): unsure at all n locations
  Clone ID: PAT_TA_30530
gcatgatatatttattgattgtcttccttatgtgtggaggtcgggatcacgcgatggttaactcctaccaacccttcccctaggagcatgtgtgtagtactttgttttgatgacttgtagatttttgcaataagtatgtgagttctttatgaataatgttgagtccatggattatacgcactctcacccttccaccattgccagcctctctagtaccgcgcaactttcgctggtgcattacacccaccatataccttcctcaaaatagccaccatacctacctattatggcatttccatagccattccgagatatattgccatgcaactttccaccgcttcatttatgacacgctccatcattgtcatattgctttgcatgatcatgtagttgacatcgtatttgtggccaagccatccttcataatttttcatacacgtcactcttgattcatcgcaatcccggtacaccgtcggaggcattcatatagagtcatatcttgttctagtatcgagttgttatctttgagttgtaaataaacagaagtgtgatgatcatcattaatagagcattgtcccaaaaaaagaaaaaggccaaaaaaaggccaaaaaaagaaaggccaaataaaaaagggacaatgctactatccttttttccacacttgtgcttcaaagtagcaccatgatcttcatgatatagagtctcttgttttgtcactttcatatactagtgggaaattttcattatagaacttggcttgtatattccaacaatgggcctcctcaagtgccctaggtcttcgtgagcaagcaagttggatgcacacccacttagtttcttttgttgagctttcatacatttatagctctaagtgcatccgttgcatgggcaatccctactccttgcattaacatcaatcggtgggcatctccatagctcattggattagcctcgttgatgtgagattttctccctttttgtcttctccacataaccccatcattaatattctatccaccataatgctatatccatggctcaagctcatgtatggcgtgaaattgaaaagtttgagattactaaagtagaaacatgctggcttgtcatcggttgtcatnatgggacatctgtgtgatgaaatggncatgacaaacaaatatttgtnggataantcttggcatgtatttngaaaaanaattgctatngagcnganatatatttaggncatatgacttactgaccttcgg

SEQ ID NO: 30531 - DNA, 782 bp, Triticum aestivum
  Clone ID: PAT_TA_30531
taatatatatgcctaacttgaatactgtaccgtcagaatcggcactcggttgattcaggtcattcctccggtgaataagttcgagttccaacaattactgaaagtcgctactatctacaaaaccttccctgcacttaggaaagcaaactactaccaccaccttgttacctatttctagttacggagcctgcagctatcacccccattaccaggcaaattatctcctacccgcgcacgcagtcttcaggctgcgggcaggttcttcttcaccttgtcttccaggaacttcctagtgtcagcgcccttcacgttgaactccatcagaagatcttcaaacagcgtcttgaggttgtcaatgaactgagtgcgcctacccagtggatccaccctcatcacttcttgcttctttggtacactgctgctgctgctgctgctagatgctccagtgccgtcgtattccacttcttcctcttcggggacctccgatccaaccatgttaccctctaggtagtgtttgcatgctgccagaatggtgcgtccacgttcccggaagtggccggcgacaaggtctccaaagtgctccggaggccttctaagtgaatacagcatagtcctacaggagtgcagaaatgtgttcttgttatactctacagaatgctgttgtccagttgcggtattcgcagagcctgcatatcccggttcattgaagtatggcttctcattcaaaatgagagcctgaatggacacaagcacctgcagcatggttgagtgagctgagttcc

SEQ ID NO: 30532 - DNA, 936 bp, Triticum aestivum
  Clone ID: PAT_TA_30532
tgccatcaccaatactgctgcttgatagatgtgaagagttatcatacaacgaatcggggttctgctggaagctctcctgcacaaaatccacaagattcatctgttcatcatctgcagaactcgaatccaaccttggagacttatcatcttcaggttcttccttgtgagttgatagagtagatcgaggtataaataaggagcctttattgctgtcatcttgggagaccactctccattctttaaccttgccaacacggttcatgaagcggcggctctcccttgagattagtggaggaggaagccttgggttcaaattcaccttggaaccataatagtcaaagtatgcaggatcagcacgtaactgctcctcagccgtggaactgccagtcacattgtccaagttacctaaactggtgtcaaagtttccactccgctgacctataagattaccaagagcagccagagatccctccatgctaggaggtgcgcttccacttcgatttgggacagattccccccagcccccataaatcccactgccattctccacaaaccccagcccttctcctggaagatttcccagtggagagtcgaatgctccgaaatccttagtccagccaccagcccctgcccctccaattaaccgaacagcactctgtgtggccattacacttgacgcctccgagccagccgaagcttccaaaccctaggcgagcaccagcgccagcacgagcccggcctcctccgtctcctcaccctcctcggccccaagccgcggcagctggccaggcctcgcttccctctccctctacctccccggagaacaaccagctcgagcccccccttctccctctcgtcgccgccgatcttctccttctggaagccttccttctcctctctcggtcctcccctctttctcttttgccggacgcgtgg

SEQ ID NO: 30533 - DNA, 816 bp, Triticum aestivum
  Clone ID: PAT_TA_30533
tcgcctcgctctctctccctcacagtaccccctccccatcgggccgcagccgccatgaccatcaccgtcgtcgcggccgacgacctcctcggcgcctgagaatacatccaggggctccatcgtcgtcatcttcttcacccttgaccaaggggtcgagctaggaggccccgttcgcccgccatcgccgtcgtctccctagcgtacacctcgtccgtcgccagatgccgctgctcccgaccatccccgacctcctcgagctcgcccaccgcctcaacacttcgagaccgctgccgatgttcgtgtgttcgactacatcgaagacgacccctctctcttgccagagcaaccagatgctggagccctggagccagacaccaccgtcgacgacgactcctactacactggaggtgcctactactacgtgcagcccgctgacaacgaccaggagtagtttaggaggatcccaggcaggaggcctgcgcctctttcgatttgtatcccagtttgtgctagccttcttaaggcaaacttgtttaacttatgtctgtactcagatattgttgcttccgctgactcgtctatgatcgagcacttgtattcgagccctcgaggccctggcttgtattatgatgcttgtatgacttattttatttgtagagttgtgttgtgatatcttccagtgagtccctgatcttgatcgtacacatttgcgtgcatgattagtgtacaattgaatcgggggcgtcacactatctatacagtatattatgaacctatcatctgctagctatccttacttctggagcctattttttg

SEQ ID NO: 30534 - DNA, 693 bp, Triticum aestivum
  Clone ID: PAT_TA_30534
cagacactatccttgtattcaaatttttccgtggtgtattcggaggaggaacctgccttgcaatgccgaagacaacactgcgcgccggactcatcgtcattgaagcctggttcaggggctactgagggggtcctggattagggggtatccggacagccggattatatcctttcgccggactgttggactatgaagatacaagattgaagacttcgtcccgtgtccggataggactctacctggcgtggaaggtaagctaggcaatacggatatgtatatctcctccttgtaaccgaccttgtgtaacccttgccccctccggtgtctatataaaccggagggttttagtccataggacaacatacaatcataccataggctagcttctagggtttagcctctccgatctcgtggtagatcaactcttgtaacatccacatcatcaatatcaatcaagcaggatgtagggttttacctccatcaagagggcccgaacctgggtaaaacatcgtgtcccttgtctcctgttaccatccgcctagacgcacagttcgggaccccctacccgagatccgccggttttgacaccgacatggagcatcacgaagagatcacatgcttgaatcttgccatccattgtggtgtcaatggacttgtgaagatgtgcctaagagtggctcacccatagtggac

SEQ ID NO: 30535 - DNA, 1260 bp, Triticum aestivum
  unsure (1)..(1260): unsure at all n locations
  Clone ID: PAT_TA_30535
aagggagaagacccggataacgaactgaaatcacacgacactggagcggaaatcaatctgaaagaagaggaggttgaggagatcggaatcaccatggatgacgaggaaatcgccaagaactgcctccctctctcatctttaactctcgcgaagaaatgagaaagggcaagaataaaaaaagacagagagccaggggataggcagtaacgggttggctgggaaacgaaagcgcgcccggtaacagacgcatagaaaaacgtccaaaaaagccagcacccagcgcggacctcggcacgagatcaaacggccaaaaaaattgaatgcaaaccaattgtaaatcactcgactgtaaattagcaaaaccgtagtcatacgctagtggtattttgtcatgtaaactgaactgactacactttggttttcactagtggtatgtttgaacctctgatttttgacttgtggtattttggccattttctcaatcctgcaagaaaagccgcacgaatcccgcctcatccatctctttccgccgcaggtaagttgatggagcccaacgccgacaagctacgcggtcttcgcatcacctccctcgacgatgaagatgatgatgagatagaactgcccgcgaccgtggctgcggcggcctcgggctatgatgacgatgacgaggacgaagatgaagaagcggaagtgatgcttggtttcctggagaagccgaagcatccaggcctcctccgccacctctttcctagcaaggccggaggcatcccggcgtggttggatcccgtgaacttgccctcggggaactccagctgctgtggcttctgcggcgagcccctgcactttgtcctccaggttattgctttgtgcctagaagcaattgtacctgttgttttctttccggaacttgtacttgttaaatggatgctccggctgtgtagatttatgctcctattgagagcaatgcagcagcattccaccgcactctcttcatgttcatgtgcccgtcgatggcatgcttgcaccgagacagcacgaacagtggacacgcaaccaagcaacctcgtagaagcgtgagggttccggtgccagctgcctcgtacaactgtctaccaagtaaactccagtcacaataactctgacagcacattgccggactgccctgtatggtgtggacatgaaagggataaatattgtggtgaagaacacntacgtcgaaanacagcatcactgcgccggcaaaaatatgcaaatacattc

SEQ ID NO: 30536 - DNA, 598 bp, Triticum aestivum
  Clone ID: PAT_TA_30536
attcggcacgaggctctcttgcccacgcactcgtcacctcctccagatccatcgccgagcacggtcgttgccgctcgcctcactctgccatggccagcaggcacatctcgcctcgccgttgcgtccacaaagaccgccgtcgtccgctgcgtctactacggagacgaaacgatccggaaccccttccatcgtcgagccggccctctgcttccacctccggccaccgaaggccgccgccgtcattctgctgcaccgagcctcccacgagcccgctcatgcacatctgcaggtccgcgatggtggagtccaggagccagatgccacctttgacgactgctactacatcgagggcgtctactaccacgtgacggagaccgccgatgaccaggagtagttaggaggctcccaggcaggaggccttgccttttcgatcatagatgcttttgtgctagccttcttaaggcaaacttgtctaacttatgtctgtactcagatattgttgctttcgctgactcttgtgttttcgagcttatgtattcgagccctcgaggcccctgggcttgtaatataaagcttgtatttttttaaaaaggggggg

SEQ ID NO: 30537 - DNA, 1100 bp, Triticum aestivum
  unsure (1)..(1100): unsure at all n locations
  Clone ID: PAT_TA_30537
tcaccacaggctaatgtgttttgcttggagcgtctttattatttgtgtctttgcttgttagtttgccacaatcatccttgctgtacacacattttgagagagtcatacatgatttagaatttgctagaatactcattgtgcttcacttatatcttttgagcttgatagttttgctcattgtgcttcacttatatctttaagcttggtagttttgctcacagtgcttcacttatatcttttgagcgtgataatttttgctctagtgcttcatttagatcttttagagcatggtggtggatttgttttaaagaaactattgatctctcatgcttcacttagattgttttgagagtcattaatagcatggtaatttgcttaaatattaatatacttggtattcaagatatgtgaaactttcttttgagtgaattgaatactaagataagtttgatgcttgataattgttttgagatatggaggtgataatatcaaagtcatgctagttgggtgattatgaattcaaagaatgcttgtgttgaagtttgcaagtctcgtggcatgcatgtatggttaaagttgtgtaacaaatttgaaacatggagtgtacctggcttgtgcatccttatgagtggcggtcggggacgagcgatggtcttttcctaccaatctatccctctaggagcatgcgcgtagtgcttgatttttcatgacttctaaatttttgcaataagtatatgagttcttttgactaatgttgagtccatggattatacgcacttttacctttccaccattgctagcctcttcggtaccatgcattgccctttctcaccttgagagttggtgcaaaacttcgccagtgcatccacaccctgtggatacgatacgctctgtcacacataaacctccttatatcttcctcaaaacagcaccataccaacctattatggatttcatagccattccgagatatattgccatgcaactttcacgtccgtcacatcatcatgacatacttacttgtcaattgcattgcagatatgtagtgaatntatttgtggaaagcacatcataattttaacatgcaccctgatcatgac

SEQ ID NO: 30538 - DNA, 1252 bp, Triticum aestivum
  unsure (1)..(1252): unsure at all n locations
  Clone ID: PAT_TA_30538
tctacgtatatcggtaactttacttggagctatatttttattcgccacatgatatttgtattgcttggagcatcttgtatgatactagtctttgcttattagtttaccacaatcatccttgctgtaaacaccttttgggagaaacccacttgattggaatttattagaatactctatgtgcttcacttatatcttttgagctagataatttttgctctagtgcttcacttatatcttttagagcacggcggtggcttaattttgtagaaattgatagtctatcatgcttcacttatattattttgagagtctcttagaacaacatggtatttgctatggttataaaattggtcctagaatgatgggcatccaagttaggtataataaaaactatcagaggaagtgaattggatgctatgatcaatttgatacttgataattgttttgagatatggaggcagtgatattagagtcatgatagttgggtgattatgaatttaaagaatgcttgtgttgaagttggcaagtcatgtagcatgcacgtatggtaaacgttatgtaacaaatttgaaacatgaggtgttctttgattgtcctccttatgagtggcggtcggggacgagcgatggtcttttcctaccaatctatccccctaggatcatgcacgtagtgcttggtttttgatggcttgtagatttttgcaataagtatgtgagttctttatgactaatgttgagtccatggattatacgcactctcacctttccatcaccgctagcctcttcggtaccgtgcattgccctttctcacattgagagttggtgcaaacttcaccggtgcatccaaaccccgtgatatgatacgctctttcacacataaacctccttatatcttcctcaaaacagccaccatacctacctattatggcatttccatagccattccgagatatattgccatgcaactttccaccattccatttatcatgacacattcattattgtcatattgcttagcatgatcatgtagttgacatagtatttgtggcaaagccaccgttcataattctttcatacatgtcactcttggtccattgcatatcccggtacaccgccggaggcattcatatagagtcatcttttgttctagtatcgagttgtaatcattgagttgtaaataaatagaagtgtgatgattatcattttctagagcattgtcccaagtgaggaataaattaanaaaaagagagaaa

SEQ ID NO: 30539 - DNA, 1244 bp, Triticum aestivum
  Clone ID: PAT_TA_30539
gcatctatggctaataaattagttaataaaccataaggaagttggaatacagtaggtttaacaccaaaataaataaataatgagtttgttacagtaccttatgtggtggttttgctttctttcactaacgaagcttatgagatttcctgctgagttttgtgttgtgaagttttcaagttttgggtaaagatttgatggactacggaataaggagtggcaaaagcataagcttggggattaccatggcatcccaagatattcaagaatagccaaaagcctaagcttggggatgccccgggaaggcatcccctctttcgtcttcattcattggtaactttacttggagctatatttttattcgccacatgatatgtgttctgcttggagcgtcgtgtatgatattagtctttgctttttagtttaccacaatcatccttgctgtacacaccttttggggagaagctatttgattagaatttattaagaatatgctatgtgcttcgcttatatcttttgagttatataattttgctctagtgcttcacttatatcttttagagcatggtggtggatttgttttatagaaactattgttctctcatgcttcacttatattattttgagagtcctttagaacaatatggcaataataaaaactttcatacaagtgcattgaatattatgagaagtttgatacttgataatcgttttgagatatggagacggtgatattagagtcatgctagttgagtagttgtgaatttgagaaatacttgtgttgaagtttgtgattcctgtagcatgcacgtatggtgaaccgttatgtgatgaagtcagagcatgctttatttattgattgtcttccttatgagtggcggtcggggacgagcgatggtcttttcctaccaatctatccccctaggagcatgtgcgtagtactttgtttcgataactaatagatttttgcaataagtatgtgagttctttatgactaatgttgagtccatggattatacgcactcacacccttccaccattgctagcctctctagtgccgcgcaactttcgctagtaccttaaacccatcatataccttcctcaaaacagccaccatacctacctattatggcgtttgcatagccatttcgagatatattgccatgcaactttccaccattctgcttattatgacacactccatcattgtcatactactttgcatgatcatgtagttgacatcgtat

SEQ ID NO: 30540 - DNA, 1124 bp, Triticum aestivum
  Clone ID: PAT_TA_30540
cgggccgaccggttgttagagcatgggcataccttttgtagaaagaattaaactctcttgcttcacttatatctatttagagagtgacaggaactggtcattcacatggttagtcataaaatcctacataaacttgtagatcgctgaatatgatatgtttgattccttgcaatagttttgcgatataaagatggtgatattagagttatgctagtgggtggttgtggattgtagagacacttgtgttgaggtttgcaagtcccgtagcatgcacgtatggtaaccgttgtgtgacaaatttgaagcatggggtgtttctttgattgtcttccttatgagtggcagttggggacgagcgatggtcttttcctaccaatctatccccctaggggcatgcgtagtagtactttgcttcaagggctaataaacttttgcaataagtatatgagttctttatgactaatgtgagtccatggattatacgcacttttacctttccatcattgctagcctcttcggtaccgtgcattgccctttctcacctcgagagttggtgcaaacttcgccagtgcatccaaaccccgtgatacgatatgctctatcacacataagcctcattatatcttcctcaaaacagccaccatacctacctatcatggcatttccatagccattccgagatatattgccatgcaacttccatcatcataatattcatgacttgagcattcattgtcatattgctttgcatgattgtaagatagctagcatgatgttttcatggcttgtccagttttttatgtcatggctacgctagatcattgcacatccaggtacacttcttgaggcattcatatggagtcatattttgttctagtatcgagttgtaattcttgagttgtaagtaaataaaagtgtgatgatcatcattattggagaattgtcccatgtgagcaaaagatgccaaagaagcccaaataaaaaaagaggccaaagaatcccaaacaaaaaaaatgaaaaattgaaaaaatgaaaaaaatgggagaaaaagagagaagggacaatgttactatcccttttccacgcttgtgctttgaaatagcaccatgttcttcatgataccg

SEQ ID NO: 30541 - DNA, 1239 bp, Triticum aestivum
  unsure (1)..(1239): unsure at all n locations
  Clone ID: PAT_TA_30541
cccttggtctctttataagaggttgaataccaagggccctccccgtgaccgtttgggactcgcctttgatcgagaaaacataccaacaggtacggttgggttacccacacccgtattgatgagaatcccggaataaggtgacatgatatctactttaacatgacgtgccaaggaaaccgcctcgataaacgcgctgaggtggtgattcgaataaagacttggccgtagtgtgatgtcacgctatggaatacatcagcagattagatctgtgtaaatattattctctatatggcaatatctggaaacttattttgcagagccggacactacctttgtgttcaaaatcttctatgaagtacttggaggaggaacccgccttgcaatgccgaagacaatctgcgcgccagactcatcatcattgaagcctggtttaggggctactgagggagtcctggattagggggtatccggacagccggactatatcctttggccggactgttggactatgaagatacaaaattgaagactccgtcccgtgtccggatgggactctccttggcgtggaaggcaagcttagcaatacggatatgtagatctccttccttgtaaccgactctgtgtaaccctagccccctccggtgtctatataaaccggagggtttagtccgtaggaccaacaacacacaatcataccataggttagcttctagggtttagcctcttcgatctcgtggtagatcaactcttgtnatactcatatcatcaatatcaatcaagcaggagtagggttttacctccatcaagagggcccgaacctgggtaaaacatcgtgtcccttgtctcctgttaccattgatcctaagacgcactgcttgggaacccctacccgagatccgccggttttgacaccgacagacattttaattacccatgatgcattttctttttgttaacttatttcattgttctcatctgccaacaaaattctctattacggtgcaattataaagcttatacttcagtcatttctgtttttttgtatcacaacagttttgagattggccttgttatcattgtacaagacatcttaggtaagatcccatgtgctgatgggttagtttctcatgtaaactcatcttttatggtgttctgtgataatcatggcagactaaagatatgttatctatgcggtataatagggccattaaaaatcaagctccgtttggcattgtaaca

SEQ ID NO: 30542 - DNA, 754 bp, Triticum aestivum
  Clone ID: PAT_TA_30542
aggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagcaccgacctactcgacccttcggccggcatcgcgctcctagccttaattggccgggtcgtgtttccggcatcgttactttgaagaaattagagtgctcaaagcaagcctgcaactcctaagcctcccaccggcctctgtgtgcctctgtgtttcttccccctcttctctcccgtagaccccgagactgatgccgatgccgttctgatcgactacgtcgacgacgaccccttcttccctttcagcggagcttccagatgtcggagcctaggagccagatgccaccgccgatgcctactactacgtggaggccaccgatgaccaggagtagttaggaggctcccaggcaggaggcctcgccttttcgatcgttgttgcttttgtgctagccttcttaaggcaaacttgtctaactcatgtccgtactcagatattgttgcttccgctgactcttatgttttcgagcttatgtattcgagccctcgaggcccctggcttgtaatataaagcttgtattattttaatttgtgtctaaaaaaaaaa

SEQ ID NO: 30543 - DNA, 951 bp, Triticum aestivum
  unsure (1)..(951): unsure at all n locations
  Clone ID: PAT_TA_30543
ctcgtgccgaattcggcacgagacacactctctcatcttgctcccggacaagcagcgcctccgccctccccactgcatcccgccgccggcacagggaccctcccttgctgcgcgctgcttcggcagggactgcccctctgcctccccactccccatggctgctgagacggccgcccttctcttgcctctccacctccgtccgcggaggcgcagacttcctctccaccagatcctcggtcgtggactcgacatgagagctggagggctcccctacgcctacctcctcctcccgcgggacaagacgcagaatcggagcgagcgccgaggatcgccggctaggacgccttgctccgatgggttgggcgtgtcgcgagcctcaccgtggccaagtaccacatgctccagagtggatggtcgacgccctccccacctggccacctcacccatgactggtacagtatgcagttgggttctagtgtttagctacagtgcagggaagcaagcttggattcactggatgatgtatacacaccaagtgcacctcgctttcataatagcaagcaacctcatattgagattcttctaattacggtactcctaataattgaatatgtggggagagtcagtgttccatgaaaccagattgctttccttgctacagagtatgagccacctaggtttgtttcccgtcagctaacttcctacaccaagccggcggcttgatgttgaggtaaagtcttaaagaaaattctgatcgaagcttgtacctgatcaaagtttgctggcttggtggcgagggcgtcaacatggcgacggcggcagcccgcgctcgcatccgttggtcagcagaggagagcagcaggcggccacggcgccccgcgctcacttccatgggccagcagaggtgaagccgacggtggcgccggagactctcgctncgtcgctcgcatc

SEQ ID NO: 30544 - DNA, 1312 bp, Triticum aestivum
  Clone ID: PAT_TA_30544
gggtcgacgggtaaggtaaagattcgatggactatggaataaggagtggcaagagcctaagcttggggattcccaaggcaccccaaggtaatattcaaggacaaccaagagcctaagctttgggatgccctggatggcatcccctctttcgtcttcgttcatcggtaactttacttggagctatatttttattcaccacatgatatgtgttttgcttggagcgtcatgtcattttattttgttttgcttgatgtttgaataaagtaccaatatctgaagttcttaaatgttagagagtctttacatagttgcataattatgactactcattgatcttcacttatatctttcggagtagtttgtcacttgctctagtgcttcacttttatccttttagagcacggcggtcgttttattttatagaaatagatgaactctcatgcttcattatatcattttgagagtcatttagaacaacatggtaatttgctttggttataaaattagtcctaatatgatgggcatccaagatgggtataataaaaactttcatataaagtgcattgaatactatgagaagtttggttctttatgattgttttgagatatgaagatggtgatatcagagtcatgctagtagagtagttgtgaattttagagatacttgtgttaaagtttgtgattcccgtagcatgcacgtatggtgaaccgttatgtgatgaagttggagcttgatttatttattgatatcttccttatgagtggcagtcggggacgagcgatggtcttttcctaccaatctatccccctaggagcatgcgcgtaatactttgctttgataacttctagatttttgcaataagtatatgagttctttatgactaatgttgagtccatggattatacgcactctcacccttccacctttgctagcctctctaataccgcgcacttttcgccggtatcatacacctaccatataccttcctcaaaacagccaccatacctacctattatagcatttccatagccattccgagatatattgccatgcaactttccaccatctagttcatcatgacacattcatcattgtcatattgcttagcatgatcatgtagttgacatagtatttgtggcaaagccaccgttcataattttttcatacttgtcactcttgattcattgcatatcccgatacaccgctggaggcatccatatagagtcatactttgttctattatcgagttgtaatcattgagttgtaaataaatagaagtgtgatgatcatcattcaatagagcattgtccc

SEQ ID NO: 30545 - DNA, 1278 bp, Triticum aestivum
  unsure (1)..(1278): unsure at all n locations
  Clone ID: PAT_TA_30545
ttatatcattttgagcttgatagtttttgctctagtgcttcacttatatcttttagagcacggtggtgtcttaattttgaagaaattgctagtatctcatgcttcagttatatatttttgagagtcttttataacagcatggtatttgctatggttacaaagttggtcctagaatgatgaacatccaagttgggtataataaaaactatcatagaaaaagaattggatgctatgatcaatatgatgcttgataattgttttgagatatggaggtagtgatattagagtcatgctagttgaggtgattatgaaaaatacttgtgttaagggttgtgattcccgtagcatgcacgtatggtgaaccgctttgtgatgaagttggagcacaattttatttattgattgtcttccttatgagtggcggtcggggacgagcgatggtcttttcctaccaatctatccccctaggagcatgcgcgtagtgcttggtttttgatgacttctagatttttgcaataagtatatgagttcttttgactaatgttgagtccacggattatgcgcacttccaccattgctagcatctcttgtgccgcacaactttcgccggtaccatacacccaccatataccttcctcaaaacagccaccatacctaccaattatggcatttccatagccattccgagatatattgccatgcaactttccaccgttccgttcatatgacacgcattacttttgtcatattgcttttttgcatgatcatgtagttgacatcggtatttgtggcaaaggccaccctcataattttcatacatgtcactcttgattcattgcataaccccggtacatcgccggagggcattcatatagagcatacttgttcttctttgattgtaaatccataaaagtgtgatgatcttcattaattaagacatgtcccaagtggangaaaggatgatgnaagactatgatccccccataatcaaggatgaacttccggactttntcaaaaagaaaaanaagaaaaatangaaaaaaaataagaaaggcaanaagaaaaaaaagagaaggccaangaaaaaaaaagaaanaagggaaaggaaaaaatgagagaaaaagagagaatgacaagctacnacncttttcacactgggctcaaatacacatgtctcatgttaagatccataatgnnctcantcaanggaattctataaactggtgaaataananggctcccaaatgcnggctcagacacattgtgcccactattttt

SEQ ID NO: 30546 - DNA, 658 bp, Triticum aestivum
  Clone ID: PAT_TA_30546
gcgcgatgtgctcccctctgatctccatggggacctatgccgcccaaattcgcctcacatgcatgtgattccggtgtgctggcggcgcgacccagcgctgttgggctacttttcgtctccgccaacatccgcggtgccggcaagccggccctgttctgtctcctcctctgtgaaggcccgtgtccgacagttgcaggctcgtccgactccccccctgctgtcaacgctggatgtgccaaacctccaccatcaggtcagatctaatctttctttttccattctttccgttctacggtaattggtcgataggtcccctcgagctgattctcctttaataattccttcccttgattgattttgaggcggcttgttgatttcagatcgcccacacgtatctataatttttgattgcttcatgttatattctactgttttggacattattgggctttattatacacttttatattatttttgggactaacctattaactagaggcccagccagaattgctgttttttgcctgttttagggtttcgaagaaaaggaatatcaaacggagtccaaacggaatgaaaccttcgagaacgtgattttctcaacgaacaagacccaggagacttggaccctatgtcaagacacaaaagaggaggccat

SEQ ID NO: 30547 - DNA, 1167 bp, Triticum aestivum
  unsure (1)..(1167): unsure at all n locations
  Clone ID: PAT_TA_30547
atcatccatgctgtacacaccttttgagagagactcacacaattgggaatttattagaatactctatgtgcttcacttatatcttttgagttatatagtttttgctctagtgcttcacttatatcttttagagcatggtggtggttttgttttatagaaactattgttctctcatgcttcgcttatattattttgagagtcttttagaacaacatggcaataataaaaactttcatacaagtgcattgaatactatgagaagtttgatacttgataattgttttgagatatggagatggtaatatcagagtcatgctagttgagtagttgtgaatttgagaaatacttgtgttaaagtttgtgattcccgtagcatgcacgtatggtgaaccgttatgtgatgaagtcggagcatgatttatttattgattgtcttccttatgagtggcggtcggggactagcgatggtcttttcctaccaatctatccccctaggagcatgcgcatagtacctcgtttcgatgacttgtagatttttgcaataagtatctgagttctttatgactaatgttgagttcatggattatacgcactctcacccttccaccattgctagcctctctaataccgcacaactttcgccggtaccataaacccatcatttatcttcctcaaaacagccaccatacctacctattatggcatttccatagccattccgagatatattgccatgcaactttccaccgttccgtttatcatcatcatgacatacattacttttgtcatattgccattgcataatcatgtagttgacatcgtatttgtggcaaagccaccattcataattctttcatacatgtcactcttgattcattgcacatcccgatacaccgccgaaggcattcatatagagtcatactttgttctaatatcgagttgtaatcattgagttgtaaataaatagaagtgtgatgatcatcaataatagagcattgtcccaaaaaagaaaaaaaaggaaaaaagaaagaaaggcaaaaaaagaaagccaaaaaaantaagnaaaaaaggcaaattaaaatanaaataaattaaangganatgcacancctttttcaaactgtgctcaagtacacatgattcagataaaatcctgnttgtacttca

SEQ ID NO: 30548 - DNA, 1124 bp, Triticum aestivum
  Clone ID: PAT_TA_30548
atgatgatagttgatttgattctgctgaaaaacagaaactttgtgcgtgcgaatttagttttgttaaatcacagaactttttcattgattcgtttttcttctgatcaatatacaaattttacaggacttcctattttggtaggatttttagagttccagaagtttgcgttagttatagatttctacagattgttctgtttttgacagattctgtttttcgtgtgttgtttgcttatcttgatgcatctatggctagtaaaatagtttataaaccatagagaaattgggatacagttggtttaacaccaaaataaataaagaatgagttcattacagtaccatatgtggtggttttgttttctttcactaacggagcttataagatttcctgttgagttttgtgttgtgaagttttcaagttttgggtagagattttttggactatggaataaggagtggcacgagcataagcttggtgatgcccatggaaccccaagatattcaaggatagccaaaagcctaagcttggggatgccccgggcatcccctctttcgtcttcgttcattggtaactttacttggagctatatttttattcgccacatgatatgtgttttgcttggagcgtcgtgtattatattagtctttgctttttagtttaccacaatcatccttgctgtacacacctttttagagaagcctatttgattagaatttgctagaatactctttgtgcttcacttatatcttttgagcttgatagtttctgctctagtgcttcacttatatcttttagagcacggtggtggcttatttttgtagaaattgctagtatctcatgcttcacttatattattttgagagtcttttagaacagcatggtatttgctatggttataaaattggtcctagaaaggtaggcatctaaattgggtataataaaaactatcataggaagtgaattggatgctatgatcaatttgatacttgataattgttttgagatagggaggtagtgatattaaagtcatgctagttaggtgattatgaatttaaagaatgcttgtgttgaagttagcaaatcccgtagcatgcacgtatggttaaagttgtgttacaaattt

SEQ ID NO: 30549 - DNA, 1124 bp, Triticum aestivum
  unsure (1)..(1124): unsure at all n locations
  Clone ID: PAT_TA_30549
agataaccaatcatacataaaagaattcagaggagattcaaatatttctcatagataaacttgatcataaacccacaattcatcggatctcgacaaacacactgcaaaaagagttacatcgaatagatctccaagaagatcgaggagaactttgtattgagaatcaaagagagataagaagccatctagctaataactatggacccgaaggtctgtggtaaactactcacaactcattggaagggccttggagatgatgtagaggctctccatggtcgattccccctccagcggagcgctggtaaaggctccaagatgggatctcgcggatacagaaggttgcagcggtggaattaggttttcggtggtgctcctagatgttttcggggtacgtggatatatataggcgaaggaggtaggccagaggagccatgaggggcccacgagggtggggggtggcctacccccatagggcgcgccctcctgcctcgtgtccgcctcggctgcttcttgacgtccactccaagtctcatggattgcgtttgttccaaaaagatcgctcccaaaggtttcattccgtttggactccatttgatattccttttcttcgaaacactgaaataggcaaaaaaaacagcaattcaggctgggtctccggttagtaggttagtcccaaaaatgatataaaagtgtaaagtaaagcctataaagcatccaagaatgataatatagcagcatgaatacttcataaattatcgatacgttggagacgtatcagcatccccaagcttaattcctactcgtcctcgagtaggtaaatgataaaagaaataatttatgaagtgtgaatgctagcaaagtgcataagtttgatcaatgacaatttcaatcacttttcctagcttcataacaacaattctttcctataaaatttcacatgttaaagtagcaaccaattcacatgttaaggttcanacaacaaattctcttaaaaacccacaacctatgttatcagttcacaagcaattgtaattcaatttattcaacggaatttaactaagagctccacatactcaaccatcatatagttttctaggattgctaacactcaccgcatacacatg

SEQ ID NO: 30550 - DNA, 986 bp, Triticum aestivum
  Clone ID: PAT_TA_30550
agctaacacgtcgcgatggctccacgaataagtcctttctctaggacatctgccgtgacaaacccacaacatatggctagtaaaagagtttataaaccatagagaagttggaatacagtaggtttaacaccaatataaataaataatgagttcattacagtaccttgaagtggttttttgttttctttcgctaacggagctcacgagattttatgttaagttttgtgttgtgaagttttcaagttttgggtaaagatttgatggattatggaacaaggattggcaagagcctaagcttggggattcccaaggcaccccaaggtaatattcaaggacaaccaagagcctaagcttggggatgccccggatggcatcccctctttcgtcttcgttcatcggtaactttacttggagctatatttttattcaccacatgatatgtgttttgcttggagcgtcattttattttattttgttttgcttgctgtttgaataatataccaagatctgaaattcttaaatgttagagagtcttcacatagttgcataattattcgactactcattgatcttcacttatatctttcagagtagtttgtcatttgctctagtgcttcacttatatccttttagagcacggaggtggttttattttgaagaaatagatgaactctcatgctttacttatattattttgagagtcataaacagcatggtaatttgctttggttatgaaactagtcctaatatgataggcatccaagatgggtataataaaaactttcatatagagtgcattgaatactatgagaagtttgatacttgataattagtttgagatatacagatggtgataatagagtcatgctagttgagtaattgtgaaatttagaaatacttgtgttgaagtttgcaagtctcgtagcatgcatgtatggtaacagttgtgtgaccaatttgaagcatgaggtgttctttgattgcct

SEQ ID NO: 30551 - DNA, 1728 bp, Triticum aestivum
  unsure (1)..(1728): unsure at all n locations
  Clone ID: PAT_TA_30551
gtattgttttcttttactaacggagcttataagatttcctgttgagttttgtgttgtgaagttttcaagttttgagtaaagtttttatggactatggaataaggagtcgcaagagcctaggcttggggatgcccaaggaaccccaagatattcaaggatagccaaaagcctaagcttggggatgccccgggaaggcatcccctctttcgtctttgttcattggtaactttacttggagctatatttttatttgccacatcatatgtgttttgcttggagcgtcgtgtactatattagtatttgatttttagtttaccacaatcacccttgttgtacacaccttttgggagaagcctattttattaggatttgctagaatactctatgtgcttcacttatatcttttgagcttgatagtttttgctctagtgcttcacttatatcttttagagcgcggcggtggcttaattttgaagaaatttctagtctctcatgcttcacttatattattttgagagtcttttagaacagcatggtatttgctatggttatgaatttggtcccagaatgatgagcatccaacttgggtataataaaaactatcatagaaagtgcattaaacactaggatcaatttggttcttgataattgttttgagatataaaggtagtaatgttaagatccatgctagtgggtaattatgaaattgataaatacttgtgttgaagttggcaagtcccgttgcatgcacgtatggtaaaagttgtgtgacaaatttgttgcttgaggtgctcttttgattgtcttccttatgagtggcactcggggacgagcgatggtcttttcctaccaatctatccctctaggggcatgcgtagtagtactttgcttcgagggctaagtaaatttttgcaataagtatatgagttctttatgactaatgtgagtccatggatatacgcacacttacccttccactttgctagcctctattatgccgcgcaactttcaccgatatcttgaacccattatttaccttgctcaaaacagccaccatacctacctattatggcatttccatagccattccgagatatattgccatgcaactttccaccattccgtttattatgacacactccatcattgacatattgctctttgcatgatcatgtagttgacatcgtatttgtggcaaggccaccttcataattttcatacatgtcgctcttgattcattgcatatcccggtacaccgctggggcattcatatagagtcatatcttgttctagctttgagttgtaatcttggagttgtaaatccataaaagtgtgatgatattcattattaagagcattgtcctaagtgaggaaaggatgatgaaggctatgatccccccaacaagtcaaggatgagacttccnaacttttacnaaaagaaaagaaaaagagaaagaagaaaaaatttagaaaggccaaaaaagaaaaaagaaaaagaggccaaagaagaagaaaaagagaaaaggaaaaangaaaagaaaattanaaaattaaatgagagaaaaagagaaaggacaaggtacnacnctttcccaacttggctnaaatacacatgtntcaagatanaatcccnagtgcattcanaacaantggaatttcatanaantggttgtaatcaagaggggtcctaaagccngtctctacaanattggtgaanccntttttttt

SEQ ID NO: 30552 - DNA, 703 bp, Triticum aestivum
  Clone ID: PAT_TA_30552
ccctagctgccctccagatccccctctctttgcccctctcccacacgcccgagctcgtcggcgctgccgtcgccataccgccgccgtaggcgcggccaccggcctcccggcaccatcggagaatgcccaggagctccaccagcatgccctgcttcacctacgcggatcaactcgagctcggagcaaccacctcgaccggatcgaccccttcttcttcctcggtcgtcgccgctgctcttcatcgatccgtcgcctctgcagctcctaagccaccaacgggcctccgtgtgcctccgcgattacgaggctgatgctgctgctggtaccccgatcgactacggtgttgacgacccctccttcttgtctgagcaaccagatgctggagtccaggagctagacgccaccgtcgacgacgactcctactacaccggaggtgcctactactacgtgcatcccgctgacgacgaccatgagtagttaggaggttcccaggcaggaggcctgcgcctctttcgatatatatcccagtttgtgctagccatcttatggcaacttgtttaacttatgtctgtactcagatattgttgcttccgctgactcgtctataatcaagcacttgtattcgagccctcgaggcccctggcttgtattatgatgcttgtatgacttatttatgttttagagttgtgttgtgatatctttc

SEQ ID NO: 30553 - DNA, 1064 bp, Triticum aestivum
  Clone ID: PAT_TA_30553
tctaatataagaacacctaaaagccaaagcttggggatgccccagaaggcatcccctctttcgtctacttctatcggtaactttacttggagcaatatttttatttaccacatgatatgtgttttgcttggagcgtcttgtatgatttgagtctttgcttgttagtttaccacaatcatcctttctgtacacactttttgagagagccatacatgatttggaatttttagaatactctatgtgcttcgcttatatcttttgagttatataattttgctctagtgcttcacttatatcttttagagcatggtggtggatttgttttatagaaactattgatctctcatgcttcacttatattattttgagagtcttaaatagcatggtaattttcttagaatcctaatatgcttggtatgcaagattaataataaaaatcctcttatgagtgtgttcaatactatgataagtttgatacttgataattgttttgagacatggagatggtgatattaaagtcatgctagttgagtagttgtaatttgagaaatacttgtgttgaagcttgtgattcccgtagcatgcacgtatggtgaaccgttatgtgatgaagtcggagcatgatttatttattgattgtcttccttatgagtggcggtcggggacgagcgatggtcttttcctaccaatctatccccctaggagcatgcgtgtagtactttgtttttgatggcttgtatatttttgcaataagtatatgagttcttttgactaatgttgagtccatggattatacgcaccctcacccttccaccattgctagcccctcttgtgccgcgcaactttcaccggtaccatacacccaccatataccttcctcaaaacagccaccatacctacctattatgggcctttccatagccattccgagatatattgccatgcaaatttccactgttccgttcatgtgacaacgcattacttttgtcaaattgctctttgcatgatcatggtaggtgacaaacgtaattggtgggcaagggcaccttcataattttcaatac

SEQ ID NO: 30554 - DNA, 1846 bp, Triticum aestivum
  Clone ID: PAT_TA_30554
cggacgcgttggttaaaatttaaaaaatcatagaaaataaaccgcaagtcagatgaaaatactttgtacatgaaagttgctcagaaggacgagacgaatccgaatacgcagtccgttcgtccgccacgcgtccctagcatagtgaacctgcaacatttcccctccggttcatctgtccgaaaacacggaacaccggggatactttcccggatgtttccccccttcaccggtatcacctcataccgcgttagaacacgtctagctctgcttgttgtcctgttatgcacttgcttgctatgtatttactgtttcttcccccccgcctcttctgttcggtagaccccgtgacgatgctgatgccctgtggtcgactacggcactgacgacccctccttgttgtctgagcaaccaggcaagcccacccctgatcaccagatatcgcttatgtcttctctatactgcttgcattacagtagcgtagcatgttactgttttcggataatcctattctgctgcatagcctgtccttgctactactgttgttacctttacctgctatcctactgcttagtataggatgctagtattccatcagtggccctacactctagtccgtctgccatgctatactactgggccgtgatcacttcgggaggtgatcacgggcatatactatatactttacactgttacattaccggtgatactgtttggagatgggggctgaaggggcaggtgactccatccaggtagtggtgggcctgagttcccgacgacccccgactattactttgtggcggagcggcagggcaggttgagaccacctaggagagaggtgggcctggccctggtcggcattcgcgaatacttaaacacgcttaacgagatcttggtatttgatctgagtctggccactggcttatacgcactaaccatctacgcggggacagttatgggcactcgacgtcatggtattagccgaagccttcgtgacgtcagcgactgagtggcgcacgccggattggaccgtaagcctgctcttgtattaagggggctagttctgcttccggtcgcgtacgcaacgtgcaggtgtgcaatgggcgatgggcccagacccctgtgcgcttaggtttagaccggcgtgctggcctctctgttttgcctaggtggggctgcgacgtgttgatcttccgcggccgggcatgacccaggaaagtgtgtccggccaaatgggatcaagcgtgttgggctatgtggtcacccctgcagggaagttaatctattcgaatagccgtgatcttcggtaacaggacgacttggagttgtaccttgaccttatgacaactagaaccggatacttaataaaacacacccttccaagttccacagacaacccagtgatcgcttttccgcagggcgacgaggagaggatcgccgggtagaattatgctatgcgatgcgactggagatgcgcttggagatgctacctggatatgctacttggagacgctacttggaggacttcaatctactctcttctacatgctgcaagatggaggtggccagaagcgtagtcttcgacaggattagctatccccctcttattctggcattctgcagttcagtccaccgatatgcccctttacacatatacccatgcatatgtagtgtagctccttgcttgcgagtactttggatgagtactcacggttgctttcctccctcttttccccctttcctttctacctggttgtcgcaactagatgctggagcccaggagccagacgccaccatcgacgacgactcctactacaccggaggtgcctactactacgtgcagcccgct

SEQ ID NO: 30555 - DNA, 1895 bp, Triticum aestivum
  unsure (1)..(1895): unsure at all n locations
  Clone ID: PAT_TA_30555
ccgggccgacgggtatttgaatttcatatgatactcccactattccgaatgagaagaattttccttatgtggagagtaataaaatttctatgcttgtagatcatgaaaacaatgctttatgtgatggttatattgttgaattcattcatgatgctactgaaaattattatgagggaggaatatatgcttgtaggagttgcaataatatcaagtttcctctctacatgttgaaaatcttgaagtgttgcttgctttacctcctatgcaagttgattcttgttcacataagttgtttgctcacaaaatccctattcataggaagtggattagacttaaatgtgctagtcatattcttcatgatgctctctttatgttacaattcttatcctttatgtgagcatcattgaaatcatcatgcctagctaggggcgttaaacgatagcgcttgttgggaggcaacccaattttattttagctccttgatttttgttcctgtttaataataaaaaatccatctagactctgtttagatgtggttttatgtgtttaattagtgtttgtgccaagtagaaccgttgggaagacttggggaaagtcttgttgatcatgatgtaaaanacanaaaactttagcgctcacaagaattactgccatttttatttgaagagttctatttagttaattcttttttcagatgattaatagataaattactcacgtccagcaatttattttagaatttttggggttccagatcttgcgctagctacagattactacagactgttctgtttttgacagattctgtttctcgtgtgttgtttgcttattttgatgaatctatggctagtaaaatagtttataatccatagagaagttggaatacagtaggtttaacaccaatataaataaagaatgagttcattacagtaccttgaagtggtcttttggtttctttcgctaacggagctcacgagttttctattttgagttttgtgttgtgaagttttcaagttttgggtgaattcttttgatggattatggaacaaggagtggcaagagcctaagcttggggatgcccatggcacccccaagataatctaaggacaccaaaaagccaaagtttggggatgccccagaaggcatcccctcgttcgtctacttccatcggtaactttacttggagctatatttttattcaccacatgatatgtgttttgcttggagcgtcttgtatgatttgagtctttgctttttagtttaccacaatcatccttgcagtacacaccttttgagagagccatacatgatttggaatttgttagaatactctatgtgcttcgcttatatcttttgagctatatagttttgctttagtacttcacttatatcttttagagcacggtggtggatttgttttatagaaactattgatctctcatgcttcacttagattattttgagagtcataaatagcatggtaattttcttaaataatcctaatatgctaggtattcaatattagtaaaaaaattcctatgaatgttttgaatactaagagaagtttgatgcttgatgattgttttgagatatggaggtaataatatcaaagtcgtgctagttgagtggttgtgaatttgagaagtgattgtgttgaagtttgcaagcccatagcatgcacgtatggtaaacattangtaacaaatttgaaacatgagggttttttggattgtctccctaatgaatgggcggtccgggacgaacgatggcctttcgtacaatctacccccctaagagcangcgcgtaatgcnangttttggatgaccggtngatttttccaanaagtaggggagtcctaagacaaaggttgtccatggttaaaccaccccaccta

SEQ ID NO: 30556 - DNA, 759 bp, Triticum aestivum
  Clone ID: PAT_TA_30556
ctgcaggattcggcacgaggccgggaacgaggtgccttcccgccgcgcgcgccacacgcgcaccgcccttccttctcttctcgtttgctatctgatctgaaaacaaaaggatggaattgaaatttgatgcactgtggaaaagggacttacttgccctgagcaaatacaacgttaatggtaaagttaaagcaattacagtaagaaatgattatccggactaccctgtcccttattttcaagttactgagggttttgatttgaaaaaggttaagaagcttatgctagaaagggatgttgagatcgccaagtccatagcaaacgacataatcatcccagaccctgctccccaatgggtggctgataacttcttggacaaatatgccgaattggagcccatccttgtaaaggatagtgcctggtgcttcctccgactcttccaaaactgtagaggccggggcatgtcatcggatcttaccatcaccgcacaaaccttaaccttcatggtcagtttcaatgccctgcgatgtgcaaaagttgtattggagggcatggcacctgagctctatgggatgcacgccaatcccaactgcataaacaaatttggatactttgcgctccacgaagctgctgaaaggttctctgtggacatgatcaagctgcttttacgccatggtgcatcgcccaatgtgcgcacagttcgcaatgatgtcatttttgatgtcattgagaatctactcccgctccatgtcgcagttgaga

SEQ ID NO: 30557 - DNA, 656 bp, Triticum aestivum
  Clone ID: PAT_TA_30557
cttttgttcgtcgcccgaagctcatggtcgtcgttgccgcgtcgatcccgcggccaccggcatccccgtcacctcagagcatgccctggagcttcagcgcctccgactccaccgactacgtgcatcggtttgagctcggacgccctgctgcctcgccatcgcgttgtcttctccgcccccgtcgtcgcatctcgtcgtcgagcccgtcgcgtccggccacccccgtgctccccgacctcgccatcggacttgcaccccgagactgccggcgacccccagttcgactacggtgttgacgacccttccttcttgccagagcaaccagatgctggagtccaggagctagagatcccgaggatgattctacgtggagttcggcttcgaggagtagttaggaggtcccaggcaggaggccttgccttttcgatcgttgctacttttgtgctagccttcttaaggcaatcttgttgaacttatgtctgtactcagatattattgcttccgctgactcttgtgttttcgagcttatgtattcgagccatcgaggcccttggcttgtaatataaaggttgtattatttttatttgtgtcatagagttgtgttgtgatatcaaaaaaaaaaaaaaaaaaaaaaaaaaaaaaaaaaaaaactcgag

SEQ ID NO: 30558 - DNA, 993 bp, Triticum aestivum
  unsure (1)..(993): unsure at all n locations
  Clone ID: PAT_TA_30558
ccgggtcgaccggcccttcacataaacaaccgccatttgtagaatgctcttttgcttcacttatatttgttagagcgtgggcatatcttttgtagaaagaattaaactctcttgcttcacttatatctatttagagagatgacaggaactggtcattcacatggttagtcataaaatcctacataaacttgtagatcgctgaatatgatatgtttgattccttgcaatagttttgcgatataaagatagtgatattagagtcatgctagtgggtagttatggattagtataaatacttgtgttgaggtttgtgattcncgtagcatgcacgtatggtgaaccgttatgtgatgaactcggagcctgatttattcattgattgtcttatttatgagtggcggtcggggacgagcgatggtcttttcctaccaatctatccccctaggagcatgtgtgtagtactttgtttcgataactaatagatttttgcaataagtatgtgagttctttatgactaatgttgagtccatggattatacgcactctcacccttcgaccattgctaacctctctagtatcgtgcacctttcgccggtaccatacacccaccatatagcttcctcaaaacaatgaccatacttacctattatggcatttccatagccattccgagatatattgccatgcaacttccatcatcgtcatatacatgacttgagcattcattgtcatattgctttgcatgattgtaagatatttagcatgatgttttcatggcttgtccgttttttgatgtcattgctatgctagatcattgcacatcccggtacaccgccgaaagcattcatatagagtcatatctttgttctaagtgtcgagttgtaattttgggttgtaagtaaataaaagtgtgatgatcatcattatagagcattgccccatgaaaaaaaagaaaaagaaaaaaaagaaaaaaaggaaagggcaaagaagcca

SEQ ID NO: 30559 - DNA, 817 bp, Triticum aestivum
  Clone ID: PAT_TA_30559
aggggctctcgcccctcccattccatggaggccaaggaccagaggggaaacccttctcccatctagggaggaggtcaaggaagaagaggaagaaggggggccctctcccccctcctccggtggcgccggaacgccgccgtggccatcatcatcatcatcaccgcgatcttcaccaacacctcccgccatcttcacccaacatctcccatcaccttcccccctctatctacagcgatccactctcccgcaacccactgtaccctctacttgaacatggtgctttatgcttcatatttttatccaatggtgtgttgccatcctatgatgtctgagtagattttcgttgtcctatcggtggttgatgaattgctatgattgattaatttgcttgtggttatgttgctgtcctttggtgcccatcatatgattgcgcgcatggatcacaccatagggttagttgtatgttgataggactatgtattggagggcaagtgtaacagaagcttcaacctagcatagaaattgatgcatacgggattgaagggggaccaatatatcttaatgctatggttgggttttaccttaatgaacattagtagttgcggatgcttgctaatagttccaatcataagtgcatagaattcctagtcacggatgacatgctagcagtgacctctcccacattatacttgctatcggtctagtaaagtagtccatttcttaggggcaatttcgcaactcctaccaccacttctccacactcgctatatttactttattgtttctttatcttaagagcccctactttttatttacg

SEQ ID NO: 30560 - DNA, 1259 bp, Triticum aestivum
  Clone ID: PAT_TA_30560
gcgtattgaattatttgagtctttatttgttagttttccacaatcatccttgctgcacacccctttttgagagagacacacacgattcggaaattattagaatactctatgtgcttcacttatatcttttgagttatatagtttttgctctagtgcttcacttatatcttttagaacacatcggtggatttgttttatagaaaccattgttctctcatgcttcacttagattattttgagagtcctacaaacagtatggtaatttgctttaattatttgaggcattcaagattaaataaataaatttttcttatgagtgtgttgaatactatgagaagtttgaaacttgataattgttttgagatatggatatggtgatattagagtcgtgctagttgagtaattgtgaaattgagaaatacttttgttgaggtttgcaagtcccgtagcatgcacgtatggtgaaccgttatgtaacgaagtcggagcatcaggtgtttattgattgtcttccttatgagtggcggtcggggacgagcgatggtcttttcctaccaatctatccccctaggagcatgcgtgtagtactttgttttgatgactaatagatttttgcaataagtatgtgagttctttatgactaatgttgagtccatggattatacgcactctcacccttccatcattgctatcctcttcggtaccgtgcattgccctttctcaccttgagagttggtgcaaacttcgccggtgcatccaaaccctgtgatatgatacgctctatcacacataagcctccttatatcttcctcaaaacagccaccatacctacctattatggcacttccatagctattccgagatgtattgccatgcaactttccaccgttccatttattatgacacgcatcatcattgtcatattcctttgcatgatcatgtagttgacatcgtatttgtggcaaagccaccattcataattttttcatacatggcactcttgattcatcgcaatccatgtacaccgccggaggcattcacatagagtcatattttgttctaagtatcgagttgtaattcttgagttgtaagtaaataaaagtgtgatgatcatcatttttagagcattgtcccaagtaaggaaaggatgatggagactatgattcccccacaagccgggatgagactccggacgaataataaaataaaataaaaaaagagaggccaaagaagcccaaataaataaaaaaagaggccat

SEQ ID NO: 30561 - DNA, 463 bp, Triticum aestivum
  Clone ID: PAT_TA_30561
tggaagtcaacagtagggaaatggtcacgtgtacagggtgaaggtgaccacaatgccaaactttggtatcacccattcttggtgaagccgttgatgttgaagatgaagtagttgtaactaacagtatcgtgctcccaaataaaactctcaatgccagtgtgcaagatgagatcatcctataatattccttgcacaacacatatctttatttaatcccgaataaggtcttcaaaccaaacatgtaattttctttccttttcttcttcaccccccttatgtatgcttgcattagattggggtcgttagtctgtacaagtcatgtgatgtgatatggtgtaattttctttagcattctggtatcaagttcactggtgtagagattgtacaaacagattacaacatttctattgagaactgacattttgacctgcccgggcggccgctcgaaatcactagtgaattc

SEQ ID NO: 30562 - DNA, 930 bp, Triticum aestivum
  unsure (1)..(930): unsure at all n locations
  Clone ID: PAT_TA_30562
tgttaccggcagtcactttatcgaccgtaatgatatccgtgccaaccacttggtcatttgagctcgttatgatgatgcattaccggtgggcccagagatactttccatcatacggagtgacaaatccccgtctcgatccgtgtcaacccaacagacactttcggagatacctgtagtgcacctttatagtcacccagttacgttgtgacgtttgatacacccaaagcactcctacggtatccaggagttacacgctctcatggtcaaaggaagagatacttgacattggcaaagctctagcaaacgaactacacgatctttgtgctaggcttaggattgggtcttgtccatcacatcattctcctaatgatgtgatcccgttatcaacgacatccaatgtccatagccaggaaaccatgactatctgttgatcacaacgagctagtcaactaagaggctcactagggacatattgtggtctatgtattcacacatgtattacggtttcccgggataatacaattatagcatgaacaatagacaattatcacgaactagaaaatataataataaccattttattattgcctctagggcatatttccaacacgaatttcatcaggaacatttattctgctgatgttggttttacatgcctaaacctccaaactttttgggtttgcatacattttttccaggcaattaagcattgtgcaccaagtgcaagtttcctctacggctcaaaagaaggctcgctgaattgagtctagggtttttaggacacttttcgggatgaggaagacaggcataaagtggaccaagatggagtcaatggcatctgatagtaggatgagcctgtctcccttagagaaattttttcctgccaacctgtcaaaaaaaaatccagcatcgttcgatgattggnagaaa

SEQ ID NO: 30563 - DNA, 1179 bp, Triticum aestivum
  Clone ID: PAT_TA_30563
cgggtcgatgggtgaccctatatcgatgcgtcttaacatgagttgtgctatccttgaaatgtcattttgttttgctttgctttgcttgctgtatgaataaaataccaagatctgaacttcttaaatgttatagagtcttcacatagttgcataattattcaactactcattgatcttcacttatatcttttggagtagtttgtcatttgctctagtgcttcacttatatctttttagagcacgacggtggttttattttgaagaaatagatgaactctcatgcttcattatattattttgagagtcttaaacaacatggtaatttgcttgggttataaaatttagtcctaatatgataggcatccaagatgggtataataaaaactttcatataaagtgcattgaatactatgagaagtttgattccttatgattgttttgagatatgaagatggtgatattagagtcatgctagttgagtaattatgaatttgaggaatacttgtgtggaagtttgtgattcccgtagcatgcacgtatggtgaaccgctttgtgatgaagttggagcataatttatttattgattgtcttccttatgagtggcggtcggggacgagcgatggtcttttcctaccaatctatccccctatgagcatgcgcgtagtactttgttttcaatggcttgtagatttttgcaataagtatatgacttctttatgactactgttgagtcgctggagtatacgcacgctcacccttccaccattgctagcctctcttgtgccgcgcaactttcgccgggtacatacacccaccatatatcttcctcaaaacagccaccgtacctacctattatgacatttccatagccattctgagatatattgccatgtaactttccaccagtccgtttattatgacacgcatcatcattgtcatattgctttgcatgatcatgtagttgacatcatatttgtggcaaagccaccgttcataatttttcatacatgtcgctcttgattcatcgcaatcccggtacaccgtcggaggcattcatatagagtcatattttgttctaactatcgagttgtaattcttgagttataaataaatagaactgtgatgatcatcattaatagagcatttgtcccaaaaatagaaaaaaatagaggccagag

SEQ ID NO: 30564 - DNA, 583 bp, Triticum aestivum
  Clone ID: PAT_TA_30564
tttttttttttaaaaaatacaacaccaggaaatgttattattattaggccattatgtttgctgtgtgaaaaaaatctaatgaaattttcctagtaggtcaacatacaaacgatatcagttcattaacaaatattcattcaaagaaacaaaaactagctcccagctacatggaagtacactactcgggtgactttccattgatcatcgattcactgtcaagaatctccaacaaacaagttccataactcaactagctgctagggccaaaaccaggtccagatcagaggtcagctttcttgacaagctttgtatagataatgcgaccatcccttgcagaattgctctcagcaagagcaatttgaaccatgtccttcacatccctgttggataaaaatttccccaagttgtgaaggatgcaccttaaatcatccacctttatataaccaactctgttttggtcgaagtacctaaaagcctgcaacaggtccttatcaaccacatcatgtttcgctgaatctcctttttgtgaaccagatatctttccctccttaccaacagatttctcttcaaccctcgtgccgaa

SEQ ID NO: 30565 - DNA, 944 bp, Triticum aestivum
  Clone ID: PAT_TA_30565
gccccgccgccgccgccgtcgagcactcgagcgcagcggagcggaccgcagccggtggtagggcgtcgagtcgagggaggatggggaagtcgaagagcaagggcgccaagttcgccgccgtcaagaagatcatcagcaagaagaccatccagaagtacaaggaagatgtgctggacccgcggaagaaggacaccgagaaggagaagctcggccggaatgtgccgcaggtgtcgtcggcgctcttcttcagctacaacatggcgctcgggccgccctaccgggtcatcgtcgacaccaacttcatcaatttctccatccagaacaagttggatttggagaaaggaatgatggattgcctttatgcaaaatgtaccccttgcatcactgattgtgttatggctgagcttgaaaagttagggcaaaaatatcgtgtggctttgagaattgctaaggaccctaggttccagagattagcgtgcacacacaagggaacttatgctgatgactgtattgttgagagaattactcagcacaaatgctacattgttgccacctgcgatagagatttaaagaggagaataagaaaggttcctggtgtgccaatcatgtatatcacccaacacaggtactcgatagaacgactccctgaagctacaattggtggagcaccaagaatttgattagcccttagatggtaccaaacaccatcacacttgcccaggttccttgatttaggatggatacgagtactgccgtgctgaatcgaactgattgtaaccacttcaaaattgtgtaccagcctcctcagggcgtcgttttcataaattttgaaagaaactttagaagaaagtgtatggttgtcctttgttctgaactgaactatagccaacttcccagcttgctttgtgttgttaatgatgcagagtcaagaatatattttatgt

SEQ ID NO: 30566 - DNA, 649 bp, Triticum aestivum
  Clone ID: PAT_TA_30566
aagcatctacgcgtggaggcgtggagcccacgcacctccttcctccgttccccaatccccctggaggcgcggcgcatatcagcggcgacattgggcggcgatggcctcggttaggccccctctccgccgcctcgcgctgctgcttaacagccgcatccgcgccaacaaccgcttcctcgcctccgcctccgcctccacctcctcctaccccaccgccgccgcagccggcaccgccaccaccgagacgccggcgccggaggagccggaggtcgtcagcatgacgggataactgcgtccgtagactcaaagagttgcatactaaagaaccatctggctaaagggcaacatgttgcgcttgagcgttgaaagctggtgggctgttctggattccaagtacaccttctcactggatagcaaggaaaatgctgatgatagggtcttcgagaagaatggtgttaagttggttgtcgacaatgtctcatacgacttcgtgaaaggttcaacaatcgattatgtagaggrattgataagctcagcatttgtggtttcaaaccaatccaagtgctgttggaggctgcagctgcaagagttccttcatggttaaataattcgaacattagtaactttaagagttaaatagcgcattggt

SEQ ID NO: 30567 - DNA, 1891 bp, Triticum aestivum
  unsure (1)..(1891): unsure at all n locations
  Clone ID: PAT_TA_30567
accatacagaagttagaatacagtatatattacaccaatatgaatttataattatttcacaatagtaaataagtggtgatttattttcttatactaacggagcttacaagttttctgttaagttttgtgttgtgaagttttcaagttttgggtaaagattcgatggactatggaataaggagtggaaagagcctaaccttggggattgccaaggcaccccaaggtaatattcaagtacaaccaagagcctaagcttggggatgccccggaagtcatcccctctttcgtcttcgttcatcggtaactttacttggagctatatttttattcaccacatgatatgtgttttgcttggagcgtcttgtattatttgagtctttgcttgttagtataccacaatcatccttgttgtacacaccttttgagagagccatacatgatttagaatttgttagaatactctatgtgcttcgcttatatcttttgagttatataattttctctagtacttcacttatatcttttagagcatggtggtggatttgttttatagaaactattgatctctcatgcttcacttagattatttttgagtcttaaatagcatggtaaattgcttaaataatcctaatatgctaggtattcaagactagtaaaaactttcttatgagtgtgttgaatactaagagaagtttgatgcttgatgattgttttgagacatggaggtagtgatatcaaagttgtgctagttgagtagttgtgaatttgagaaatacttgtgtcgaagtttgcaagtcccgtagcatgcacgtatggtaaacgttatgtaacaaatttgaaacatgaggtgttctttgattgtcctccttatgagtgacggtcggngacgagcgatggtcttttcctaccaatctatcccccaggagcatgcgcgtagtgcttggtttttgatgacttgtagattttttcaataagtatgtgagttctttatgactaatgttgattccatggattatacgcactctcacccttccatcattgctagcctcttcggtaccatgcttgccatttatcaccttgagagttggtcaaaacttcgtcggtgcatccaaaccccgtgatatgatacactctgtcacacataaacctccttatatcttcctcaaaacagccaccatacctacctattatggaattttcatagccatttcgagatatattgccatgcaactttccatcgttccatttatcatgacacacatcatcattgtcatattgccttgcatgatcatgtagttgacatcgtatttgtggcaaagccaccatgcataatttatcatacatgtcactcttgattcattgcccatcccggtacaccgccggaggcactcatatagagtcatactttgttatagtatcgagttgtaatctttgagttgtaaataaatagaagtgtgatgatcatcagtaatagagcgttgtcccaaataaaataaagataaaggccaaaaaaagaagaaaaaagaaaggccaaataaaaaataaaaaaagggacaatgctactatccttttttccacacttgtgcttcaaagtagcaccatgatctttatgatagagagtctcttgttttgtcactttcgtatactagtgggaatattatagaacttggcttatatattccaacaatgggcttcctcaaataccctaggtatccatgatcaagcaagttggatgcacacccacttagtttcttttgagctttcatacacttatagctttaagtgcatccgttgcatggcaaccctactgactcacattgacatctaatgggtgggatctccatancntgttgntaacccantgatgtaaaacatctcccnctttttgcct

SEQ ID NO: 30568 - DNA, 1208 bp, Triticum aestivum
  Clone ID: PAT_TA_30568
ttcggcacgagggcaaagcccaaacacgccaccagaaataaggagcggcccaattcagattccccaagatcgtctcgtctcgtctcgaatcgcatccatgggttggcgttggcacgacgacgtcgagggcgacggtggccgcggcgggctcggcgacatccccgacctcgccggccgaggcggcggcgagggcgcgcacgtcggcacgcgccgggtggtgcagtcccgctgccacacggaggaggtggagcccggccgcttcgtccgcaagtgcgagaagaccgagcagctcctccgcgactgcgtcggcaggccctccgagctggtggaatcaaaaactgagaacaccgaagaagatgtcacggatgaaatgaccggtggtgcctcgcgttctcttggcttcccgacaaaagagccctttgcatttccaggacttcgcagtgacatagaagctattgagaaaggcttcggtagctttctggatgaagctgagcggatgaccaacgagttcttcaaatcttttggatttccaaccattcatgacggggactcgagaccgtttcctaggcaacctgcagagaggcatgttggagaaggtaccgtgaagaagcccaatgagaatgagtactcagaattcggtagccagataactgatgtgtaacaagctacagtcgtataacatgccttgttggagctgaagcctgagaagtgtgtttcgctgggtatctagggtactaaagtggtttctcttttggactcatcattatggttgtaatagtcgatgaagaatcatattttactaattttatctgcagaacgttttttgcgcgaaatacaatggccgtccgttgggtccctgatacgtctccaacgtatctataatttatgaagcattcatgctattttattatctgttttgaatgattatgggctttattatacacttttatattacttttggactaacctattaaccggaggcccaaccatattgctgttttattgcatgtttcagtatttcgaagaaaaggaatatcaaacggagtccaaacggaatgaaaccttcagcaacgtgatttttttggaagattatcatcctggagacttggagtccatgtcagaagatactcgaggagcccgggatataggggggcgccccccctccccctactaggcgcgccccctgtctcgtggacctctcgagcacc

SEQ ID NO: 30569 - DNA, 749 bp, Triticum aestivum
  Clone ID: PAT_TA_30569
ctccccacaccccgctcctccctctgccccccgattggatcggggggatcgaccccatcgatcgatcgccgtcgccgcccggatcggtcgccgccccgtcgtcctcgactccacctcgccggaccgcctcctcatctccggcaacgcacgcgtccccgtcctcctcctcgacaaccgctgccattgccctacgcgccgtcaccccgagactgccggggaccccagttcgactacggtgttgacgactcatccttcttgccagaacaaccagacgttggagcccaggagccagacgccactgtcgatgatgactactacacttgaggtgcctactactacgtgcaggctgacgacgacgaccaggagtagttaggaggatcccaggcaggaggcctgcgcctctttcgatctgtatcccagtttgtgctagccatcttatggcaacttgtttaacttatgtctgtactcagatattgttgcttctgctgactcgtctatgatcgagcacttgtattcgagccctcgaggcccctggcttgtattatgatgcttgtatgacttattttatttgtagagttgtgttgtgatatcttcccgtgagtccctgatcttgatcgtacacatttgcgtgcatgattagtgtacgattgaatcgggggcgtcacaaatttgttgcttgataattgttttgagatataaaggtaataatgttagggtcatgccagtgggtaattatgaaattgagaaat

SEQ ID NO: 30570 - DNA, 1591 bp, Triticum aestivum
  unsure (1)..(1591): unsure at all n locations
  Clone ID: PAT_TA_30570
tagtctattgttttctttctctaacggagctcacgagatttctgttgagttttgtgttgtgaagttttcaagttttgggtgaattcttttgatggattatggaacaaggagtggcaagagcctaagcttggggatgcccatggcaccgccaagataatacaagtacaccaaaaagtcaaagcttggggatgccccagaaggcatcccctctttcgtccacttccatcggtaatttacttggagctatatttttattcaccaacatgatatgtgttttgcttggagcgtcttgtattatttgtgtctttgcttgttagtttaccacaatcatcctttctgtacacacatcttgagagagccatacattaattaaaatttgatagaatactctatgtgcttcacttatatcttttgagctaagtagttttgctctatgtgcttcacttatatcttttgagcgttataattttgctctatgtgcttcacttagatcttttcgtgcacggtggtggatttgttttaaataaactattgatctctcatgcttcacttaaattattttgagagtcttaatagcatggtaatttgcttaataatgacatgcttggtattcaagatttgtgaaactttcttttgagtgtgttgaatactaagaaaatttggatgcttgataattgttttgagatatggaggtgataatatcaaagtcatgcttgtagagtaattgtgaatttgagaagtgcttgagttgaagtttgcaagtcccgtagcatgcacgtatggtaaacgtcatgtaacaaatttgaaacatgaggtgttatttgattgtcctccttatgagtggcggtcggggacgagcgatggtcttttcctaccaatctatcccctaggagcatgcgcgtaatgctttggtttttgatggcttgtagatttttgcaataagtatatgagttctttatgactaatgttgagtccatggattatacgcactctcacccttccatcattgctagcctcttcggtaccgtgcattgccctttctcacattgagagttggtgcaaacttcgccggtgcatccaaaccccgtgatatgatacgctctatcacacataagcctcattatatcttcctcaaaacagccaccatacctacctatcatggcatttccatggccattccgagatacattgccatgtaacttacatcatcatcatatacatgacttgagcattcattgccatattgctttgcatgatcgcaagatagctagcatgatgttttcatggcttgtccattttttgatgtcattgctatgctaagatnattgcatatctcggtacaccgtcggaagcatcatatagagcatatccttggtccaaatattgantgtaagtaaataaaagtgtgatgatatcattattagagcatgcctaatgaggaaagatgatggagactagatccccacaatcagatgagatcggacttacaaaaataaagaggcaaagaagccaataaaaaggcaaagaancacaaaagaaaaagaaatttacaaagaaagaaaangaaaaaaggggaagggatangngcatt

SEQ ID NO: 30571 - DNA, 726 bp, Triticum aestivum
  unsure (1)..(726): unsure at all n locations
  Clone ID: PAT_TA_30571
cccttccctctcctccccgatctggagaggcacccgtacgcagccgtcaacgccgcctcatcgttgacgcgctccggcaccaccccgtcgcgcccgaaggcacccaggagctgcgcctcgacgtcctctacctccacggcaaccggctcgagctggagtgccccggagccgcagccatggacccctcctcttcgaccagggatgtctgctccgcctcgtcgatctgctacctccggtcctccccgaaccaccccgagctcgccaccgccttcccctcgactctgagaccggtgccgatgtccgtgtgttcgactacaccgaagatgacccctccttgccagagcaaccagatgccgcaaccagacgttggagcccaggatccagacgccaccgtcgatgacgactactactactcgggaggtacctagtgatacgtctccaatgtatctataatttttgattgctccatgctatattatctactgttttgggcaatattgggctttattatccacttttatattatttttgggactaacctattaacctgaggcccagcccagatttgctgttttatgcctatttcagtgttttgaagaaaaggaatatcaaacggagttgaaacggaacgaaattaactagagaagttatctttggaaggaaacacacctgatggacttggaccccacgtcggaagatacgggagctannnnnnnnnnnnggggg

SEQ ID NO: 30572 - DNA, 1259 bp, Triticum aestivum
  Clone ID: PAT_TA_30572
cacgaggcccggccgacgcgagcactagcgacgcacagctatctctggagaccgaagaggacgacttggtacaccgccgctccattcttccacttatccccttaagatttttcaaaggagcccaggaacaaatttgttgcttgaattgcatcaattgtaagatgactgggggagtcctggactagggggtgtccggacagccggactatcatcgtcagccggactccaagactatgaagatacaagattgaagacttcgtcctgtgtccggatgggactttccttggcgtggaagacaagcttggcgatacggatatgtagatctcctatcattgtaaccgactctgtgtaaccctagtcctctctggtgtctatataaatcggagggttttagtccgtaggacacataaccattacaacaatcataccataggctagcttctagggtttagcctcctaggtctcgtggtagatccactcttgtactacccatataatcaatatcaatcaagcaggagtagggttttacctccatcgagagggcccgaacctgggtaaaaacatcgtgtcccttgtctcctgttaccatccgcctagacgcacagttcgggacccctacccgagatccgccggttttcacaccgacaaagatctaaaacttattgatgtgtcccctattaaatctttgttttgcaatatgaatcttgatgaaactgaatatgatcttcctttacctagaaggcattctaagaattcggagtttctagatcttgatgatgaaattgatgaaagtgggattgaaaaacaataaaaacctagatgttgctaaacccactattttggatctcaaggaatttaattatgaaaattgctctttgattggttgtatttccttgttgcaatccgtgctaaattctcctcatgcttatagtcaaaataaagcttttaccaaacatattattgatgctttaatacaatcttatgaagaaaagcttgaattagaagtttctatccctagaaaactttatgatgagtgggaacctactattaaaattaaaattaaaattaaatatgattaatgctatgatttatgtgatttgggtgctagtgtttccacgattccaaaaactttgcgtgatgtgttaggtttccgtgaatttgatgattgctctttaaatttgcaccttgcggattccaccattaagaaacctatggtaaggattaatgatgttattattattgcaaatacgaattatgtg

SEQ ID NO: 30573 - DNA, 1861 bp, Triticum aestivum
  Clone ID: PAT_TA_30573
tggaatacagtaaatattacaccaatatgaatttagaatgagttcacaacagtaccaaaagtggtgatttattttcttatactaacgtaccttacgagttttctgttgagttttgtgttgtgaagttttcaagttttgggtaaagattcgatggactatggaataaggagtggcaagagcctaagattggggaagaccaaggcaccccatggtaatatacaaggacaaccaagagcctaagcttggggatgcaccggatggcatcccatctttcgtcatcgttcatcggtaactttacgtggagctatatttttattcaccacatgatatgtgttttgcttggagcgtcattttattttcttttgtcttgcttgctgtttgaataaaataccaagatctgaaattcttaaatgttatagagtcttcacatagttgcataactattcaactactcattgatcttcacttatatcttttggagtagtttgtcatttgctctagtgcttcacttatatccttttagagcacgacagtggttttattttatagaaattattgatctctagttcttcacttatattattttcagagtctttagaacagaatggtaatttgctttggttatgaaattagtcctaatatgatgggcatccaagagggatataataaaaactttcatataaagtgcattgaatactatgagaagtttgatccttgatgattgttttgagatatgaagatggtgatattagagtcatgctagttgattagttgtgaatttgagaaatacttgtgttgaaatttgtgattcccatagcatgcacgtatggtgaaccgttatgtgacgaagtcggagcatgatttatttattgagtgtcttccttatgagtggcggtcggggatgagcgatggtattttcctaccaatttatatccctaggagcatgcgcgtagtactttgtttcgataactaatagatttttgcaataagtatgtgagttctttatgcctaatgttgagtccatggattatacgcactctcacccttctaccattgctagcctctctaataccgtgcacctttcaccggtatcatacacccaccatatatcttcctcaaaacagcctccatacctacctactatggcatttccatagccattccgagatatattgccatgcaactctccactgttccgtttattatgacacgctccatcattatcatattgctttgcatgatcatgtagttgacatcatatttgtggcaaagccaccgttcataattctttcatacatgtcactcatgaatcattgcacatcccggtacaccgccgaaggcattcatatagagtcatatctttttctaagtatcgagttgtaattcgtgagttgtaagaaaataaaagtgtgatgatcattattattagagcattgtcccagtaaggaaaaaaataaatgaggccaaagaagccaacaaaaaaagaggccaaagaagccaaacaaaaaaagagagaaaagagagaagggtcaatgttactatcccttttccacacttgtgcttcaaagtagcaccatgatcttcatgatagagagtcttctatgttgtcactttcatatactagtgggaatttttcattatagaacttgggcttgtatattccaatgatgggcttcatcaaattgccctagctcttcgtgagcaagaaagttggacgcacacccactcagttttgtttttgagctctcataaacttatagctctagtgcatccgttcatggaatccctactcactcacattgatactattgatgggcatcccatgatgtctactaccaactttatcctgtaacactgttgg

SEQ ID NO: 30574 - DNA, 1718 bp, Triticum aestivum
  Clone ID: PAT_TA_30574
gaggtggcccagaggccacacatccatgcacgccaccggattaatcatcactctcaggatttttggagttacagaataattgaaacctacaaagtactacagactgttctgtttttgacagattctgtttttcgtgtgttgtttacttattttgatgaatctatggctagtatgggggggtatgaaatatagagaagttggaatacagtaggtttaaaaccaatataaataaagaatgagttcattacagtaccttaaagtggtggtttgttttcttatactaacgtggctcatgaggtttctattttgagttttgtgttgtgaagttttcaagttttggatgaattcttttgatggattatggaacaaagagtggcaagagcctaagcttggggatgcccatggcacccccaagataatccaaggacaccaaaaagtcaaagcttggggaagccccggaaggcatcccctctttcgtctacttccatcggtaatttacttggagttgtatttttattcactacatgtcatgtgttttgcttggagcgtcttgtattattcgcgtctttgcttgttcgttttccacaatcatccttgctgtacacacctttttagagagccatacatgatttggaatttgctagaatactctatgtgcttcacttatatcttttgagctatatagtttttgctgtagtgcttcacttatatattttagagcacggtggtggatttattttatagaaattattgttctctcaagcttcacttatattattttgagagtcctacaaaatagcatggtaattttcttaaatagtgaaattagtcctaatatgataggcatccaagattagtaaaaactttcttataagtgcgttgaatactaggagaagtttgatacttgataattgttttgagatatgaagatggtgatattagagtcatgctaatttagtagttgtgaatttgagaaatgcttgtgttgaagtttgtgattcccgtagcatgcacgtatggtgaaccgctttgtgatgaagtcggagcacaattttatttattgattgtcttccttatgagtggcggtcggggacgaacgatggtcttttcttaccaatctatccccctaggagcatgcacgtagtgctttggtttttgatgacttctaaatttttgcaacaagtatatgagttcttttgattaatgttgagtccatagattatatgcactctttcacccttccaccattgctagcctctcttgtacggcgcaactttcgccggtaccatacacccaccatttaccttcctcaaaacagccaccatacctacctattatggcatttccatagccattccgagatatattgccatgcaacttccatcatcatcatatacatgacttgagaattcattgtcttattgatttgcatgatcataagatagctagcatgatgttttcatggcttgtccgttttgtcattgctatgctaaatcattgcatatcccggtacaccaccggaagcattcatatagagtcatatctttgttctagtatcgagttgtaatatcgagttgtaagtaaataaaagtgtgacgatcatcattatagagcattgccccatggaaaaaagaaaaagagaagaaagaaaaaaagggaaaggccaaagaagcctaaataaaaaaggggccaaagaagcccacccaacgagatgcaac

SEQ ID NO: 30575 - DNA, 1290 bp, Triticum aestivum
  Clone ID: PAT_TA_30575
cgggccgacgggcatcacacttaaaaacgatattatgaattttaaacaatttgatcatgagcatgttgcccaatcttgggaaagaatgaaattgatgcttcgcaattgccctactcatggtttgaatttatggatgatcatacaaaatgtttatgcccgtttgaactttgcttctagaaatctcttagatttggccgccgggggcacgtttatggaaatcactttaggagaagctactaaactccatgataacattatggctaattattctcaatggcacaccgaaagatctactagtaaaaaagtgcatgctatagaagaaattaatgttttgagtggaaagatggatgaacttatgaaattgtttgctactaagagtgctcctattgatcccaatgatatgcctttgtcttctttgattgagaataataatgaatctatggacgtgaattttgttggtaggaatagttttggaaacaatgcttatagaggaaactttaatgctagaccgttccctagtaattcctctaataattatggaaattcctacaataattcttatggtaattttaataagatgccctctgattttgagaatagtgtgaaacaatttatgatttctcaaaagaattttaatgccttgcttgaagaaaaattgctcaaagttgatgatttggctaggaacgttgatagaatttcgcttgattttgattctcttaaacttagatcttctcctcctaagcatgatatcaatgagtctctcaaagtaatgagaatttcctttgacgagtgcaaggaaagaaccgctagattgcgtgctaaaaaagatagctttataaaagcgtgttctagtttccacgaaaataatgatgaagatctaaaagttattgatgtgtcccctattaaatctttgttttgtaatatgaatcttgataatgatgggactggagatgactcaactttagttaaaaggcgtcctaacgattcagagtttttagatcttgatactaaatttggtaaaagtgggactggagaggtcaaaactttacatagcattgaacccactattatggatttcaaggaatttaattatgataattgttctttaatagattgtatttcatttttgcaatctgtgatgaattctcctcatgcttatagtcaaaataaagcttttaccaaacatactggtgatgccttgatgcaatcttatgaagaaaaacttgaatcgaaagtttctatacctagaaaactttatgatgagtgggaacctactatcaaaattaaaat

SEQ ID NO: 30576 - DNA, 1156 bp, Triticum aestivum
  unsure (1)..(1156): unsure at all n locations
  Clone ID: PAT_TA_30576
tcacatagatgcataattattcaactactcattgatcttcacttatatctttcggagtagtttgtcatttgctctagtgcttcacttatatcttttagagcacggcggtggttttattttgaagaaatagatgaactctcatgcttcacttatatcatttttagagtcctttagaacagcatggtaatttgctttggctataaaattagtcctaatatgataggcatccaagatggaaataataaaaactttcatataagtgcattgaatactaagagaagtttgatacttgatgattgttgagatatggagatagtgatattaaagttgtgctagttgagtaattgtgaatttgagaaatgcttgtgttgaagtttgcaagtcccgtagcatgcacgtatggttaaagttgtgtaacaaattagaaacaagaagtgtacctggcttgtgcacccttatgagtggcggtcggggacgagcgatggtcttttcctaccaatctatcccctaagagcatgcgtgtagtacttgatttttgatgacttctaattttttgcaataagtatatgagttcttttgactaatgttgagtccatggattatacgcactctcatcttttcgcctttgctagcctcttcggtaccgtgcattgccctttctcaccttgagagttggtgcaaacttcgccggtgcatcctaaccccgtgatacgatacgctctatcacacatcaacctccttatatcttcctcaaaatagccaccatacttacctattatggcatttccatagccattccgagatatatttccatgcaactttccaccgttccgtttattatgacacgctccatcattgtcatattgcttttgcatgatcatgtagttgacatcgtatttgtggcaaagccacctttataattctttcatacatgtcgctcttgattcgcatatcccggtacaccgcaggaggcattcacatagagcatattttgtcctaagtattgagtgtaattcttgagttgtaagtaaaagtggtgatgatcttcaataatagattatcgtcccaagtgagggaaagggatgatgggagactatgaattcccccacaaagtccggggatggagactccagacnttatgaaaaataaaaagagg

SEQ ID NO: 30577 - DNA, 1053 bp, Triticum aestivum
  Clone ID: PAT_TA_30577
cggtcgagatattccgggtcgacgggtacttgaatattgttatgataattatgcttctaatgcctatgttaaaccatatattgagaaattcaacgctgacgaagaagagactaatattttgcaggacgctatggaagaagaaattgatgaaactgtgagctcattggatgaaagagatgatgaggagagcgaagaacaaaggaggaagagcggattagctacccgtgtccaccttctaatgagagtaaccctccaactcatacattatttaattccccttcgttcttaccgaaggatgattgctatgatgattgttatgatcccttgaatttgtttgaaatatccctttttgatgatgcttgctatgcttgtggctaagatgccaataggaattattcttatggacatgaacttgctatagttccttatgttaaacatgaaattgttgctattgcacccacgcatgatagtcctattatctttttgaattctccaaactacactatatcggagaagtttgcgcttagtaaggattatattgatgggttgccttttaccattgcacatgatgattttgatgaacataatatgcatgtgcttgctgctcctacttgcaattattatgagagaggaactacatctccgcctctttatgtttccaacacgataaaattgcaagaaactgtttatactatgcattggcctttacttgatgtgcattaattgttcttttatgacatgccgatgcatagaaagagagttagacattcgtcattgcatgctatatgttgctttgttctcattactaaatgccaaaccaatgctaattaaaataggctttgatataccttaggatataggtggatccattacttaagcactttatgcctcgtttaatggcgttaaagaaagtgctgccagggagacaacccggaagttttagagagtcatttatttctgttgagtgcttttataaaggttagaaacataaaatatagatgggaacctaaaaactttttcaaaagggaagcgattggaagttatgcattggag

SEQ ID NO: 30578 - DNA, 997 bp, Triticum aestivum
  Clone ID: PAT_TA_30578
gattcggacgaggctcgcgctcccgatgctgcgccgacacctcctccccttctctcacggcctccacaagcatccgcaaatcctccctctcccataatctccttccttttgcctctcaatcacgaatcaggatccatggaggtgtccgacaagtgctactcgatctgctatacggcagcggcggggaacaccggccgtcggtctgcctctcgatgctcatcctccgggaggctgcgcgcggagcctgccgctgaacttcgcctccacatcgccatgaaggtggttcttcttcttcgctgacctgttcatccatcgctcgtcttgttcgtctctctgttgtccggtcctcgtcgtcgtcaagggattggcatcatcggttcataatcaagtttgactcgttatctaatctgctgggcatatcgactctgcggctaagtgatggtgaaagacttgaagtagatcatgctagcattttcccaatgtgatgactatgaccaatagttagcctgcacatcttactttcaatgccttcgatcacaccgtcgccacctaaaagtttcagatctccctgagttattccagaatctattatgctcttttacattgaattccttgggttgaaactgtgagctgtgcctatttttaattctaaaatatatctgctttgtctagagaaggtagaacgacaaggttattcagatgttttacagtatctgatatgccccttaattagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcggttttgtcaactctgacattgctttgggttttccttctccatttatctttcttgtttgttcctaagaatatgtgtatgtccatgttcatgtacctcggccgcgaccacgcta

SEQ ID NO: 30579 - DNA, 1279 bp, Triticum aestivum
  Clone ID: PAT_TA_30579
catcatataagtttccgatctattttattttgcaatctttacttttcaatctatatcataaaaataccaaaaatatttatcttattatctctatcagatctcacttttgcaagtggtcgtgatgggattgataacccctttatcatgttggttgcaaggttcctatttgtttgtgtaggtacaatggatttgtgtgtagactcctactggattgataccttggttctcaaaaactgagggaaatacttacgctactttgctgcatcacgctttatcttcaagggaaaaccaacacagtgctcaagtggtagcaagaaggatttctggcgccgttgccggggaggtctacgcacaagtcaagacataccaagtacccatcacaaactcatctccctcgcatttacattatttcccatttgcctctcgttttcctctcccccacttcacctttgccgttttatttgccctctctttcccaatctcctctcttttgcttgtctttttgtttgctcgtgtctccatatgccttctatgtgctttcatctttgcttgctaaaaatctattgatatggatccacttaaagtgttctacttggatcttcttcgatccttatgcgctcgtgctgaaaccccaactagcctagttgatgggaaatctttagatgagcatgctcattttgtgcgtcatcgtttgtctgaaaaggggagactcttatgggatcaaataaacatattgctatgttatgcttggaatctttgtgaaatttatgattttacttgttgctctaagaaccctaaaaaacaccttccctacctatgtgagtttaatgataatgaaatcttatcttcttatgctaagggtgtttataattactatgatgttcaacaaattgaagaatttgttgcttttaagggtgcttatgaaattgcttctttgattgaaaagtatgatgctactctttacaagtatgaaaattttgccatagttaaatattgctatgataattatgcttctaatgcctatgttaaaccttatatcaaggtctactccgctgtccaagaagagactaatattttgcaggagtctatggaagaagaaattgatgaaactgtgagctcattggatgaaaaagatgaggaggagagcgaagaaaaaaaggaggaagagcggattagctacccgtgcccaccttctaatgagagtaactcttcaactcatacattgtttaaattcccttcgtgcttaacgaaggatgattgttatgatccggtcgacccg

SEQ ID NO: 30580 - DNA, 783 bp, Triticum aestivum
  unsure (1)..(783): unsure at all n locations
  Clone ID: PAT_TA_30580
ctcactctagcatggccagcaagcacatctcgcctcgccgttgtgtccacaaagaccgccgtcatccgttgcatctactatggagacgaaatgagccggaaccccttccatcgttgagccggccctcttcttccacctccggccaccgaaggccgccgccgtcgttctgctgcaccgagcctcccccgagcccgctcatgcacatctacaggtccgcgaccccgtggtggctgctgatgccgctgtaatcgactacgtcaccgacgacccctccatcttgtctgagcaaccagatggtggagtccaggagccagatgccacctttgacgactggtactacaccgagggcgtctactaccacgtgacggagaccgccggatgaccaggagtagttaggaggctcccaggcaggaggccttgccttttcgatcatagatgcttttgtgctagccttcttaaggcaaacttgtctaacttatgtctgtactcagatattgttgctttcgctgactcttgtgttttcgaagcttatgtattcgagccctcgaggcccctggcttgtaatataaagcttgtatttttttaaaaaaaaaaaaaaaaaaaaaanaaanaanaaaaaaacccncgtgccganttcgggnacgaggatcaancaanancaanttccagnccttctcngagantcaattcaaacaggangctcacaganntccaaaatttacagttataattcatctgtcacccttgaccccaagtctgatcanccatgtttanaaaaattaa

SEQ ID NO: 30581 - DNA, 1379 bp, Triticum aestivum
  unsure (1)..(1379): unsure at all n locations
  Clone ID: PAT_TA_30581
acacccaatagtccaggactccctcagtgggcatatcttttgtagaaagaattaaactctcttgcttcacttatatctatttagagagatgacaggaattggtcattcacgtggttagtcataaaatcctacataaacttatagatcgctgaatatgatatgtttgattccttgcaatagttttgcgatataaaggtggtaatattagagtcatgctagtgggtggttgtggattgtagagacacttgtgttgaggtttgcaagttccgtagcatgcacgtatggtaaccgttgtgtgacaaatttgaagcatggggtgtttctttgattgtcttccttatgagtggcggtcggggacaagcgatggtcttttcctaccaatctatccccctaggggcatgcgtagtagtactttgcttcgagggataataaacttttgcaataagtatgtgagttctttattactaatgttgagtccatggattatacgcactctcacccttccatcattgctagcctctctagtatcgcgcaactttcggcgttaccacaaacccatcatataccttcctcaaaacagccaccatgcctacctatcatggcatttccatagccatactgagatatattgccatgcaacttccatcatcatcatatacatgacttgagcattcattgtcatattgctttgcatgatcgtaagatagctagcatgatgttttcatggcttgtccatttttttatgtcattgctatgctagatcattgcacatcccggtacaccgccggaagcattcatatagagtcatatctttgttctagatattgagttgtaagtaaataaaagtgtgctgatcatcattattagagcattcccccagtgaggaaaggatgacggagactatgattcccccacaagtcgggatgagactccggactttatgaaaaataaaagaggccaaagaagcccaaatanaaaaacagaggctaaagaagcccaccaaaaagaaaaaaaagaaaaanataaggaaaaaagagaaaataaaaaaataaggaaaaaagagaaataaaaaaaatgagagaaaaagagagaagggaaaatgttactatccttttaccacacttgcgcttcaaagtagcaccaagatctccatgatagagagctctccgttatgtcactttcatatactagtgggaattttcattatagaacttggcgtgcgtagtgttctatcggtagtcgatagaacttgagggaatatttattatacctttagctcctcattgggttcaacactcttacttatcaaaagaggctacaactatcccctatacttgtgggttatcattcccccataagtcgggatgagactccggacg

SEQ ID NO: 30582 - DNA, 930 bp, Triticum aestivum
  Clone ID: PAT_TA_30582
atgacaactggaaccggatacttaataagacacacccagacaagttccacagacaactcggtgatcgcttttccacagggcgacgaggggaggatcgccgggtaggattatgctatgcgatgctacttggaggacttcaatctactctcttctacatgctgcatgatggaggtagccagaagcgtagtcttcgacaagattagctatccccctcttattctggcattatgcagttcagtccaccgatatggccctttacacatatacccatgcatatgtagtgcagctccttgcttgcgagtactttggatgagtactcacggttgcttttctccctctttttcccccttacctttctacctggttgtcgcaaccagatgttggagcccaggagacagacgccactgtcgatgacgagtcctactacaccggaggtgcctactactacatgcaggccgctgacgacgaccaggagtagtttaggaggatcccaggcaggaggcctgcgcctctttcgatctgtaccccagtttctgctagccttcttaaggcaaacttgtttacttatgtctgtactcagatatggttgcttccgctgactcgtctatgatcgagcacttgtattcgagccctcgaggcccctgacttgtattatgatgcttgtatgacttatttattttttagagttgtattgtgatatcttcccgtgagtccctgatcttgatcgtacacgtttgcgtgtatgattagtgtacgattgaatcgagggtgtcacaagttggtatcagagccgactgcctgtaagaatcccccttccacactccttggccgaagtcgagtctagacattgcaaaaactttactaacatggctgtgtggcttacaggcccacgtcgctattggatggtattaggatcttttaaaaaaaaaa

SEQ ID NO: 30583 - DNA, 1359 bp, Triticum aestivum
  unsure (1)..(1359): unsure at all n locations
  Clone ID: PAT_TA_30583
ctactgatacaataaacaaattttctagatcgtcctattttggctgattttttggagttccataagtttgcgttagttacagattactacagactgttctgtttttgacagattctgtttttcgtgtgttgtttgcttattttgatgaatctatggctagtaaaatagtttataaaccatagagaagttggaatagagtatgtttaacacgaatatatatagaaaatgagttcattacagtaccttaaagtggtgttttgttttctttcgcaaacggagctcacgagattttctgttaagttttgtgttgtgaagttttcaagttttgggtgaaagatttgatggattatggaatcaggagtggcaagagcctaagcttggggatgcccatggcaccccaatataatattaaaggacaaccaaaagcctaagcttggggatgcccaagaangcatcccctctttcgtctccgttcatcggtaactttacatggagctataattttattcaccacatgatatgtgttttgcttggagcgtcattttttgcttgttgtttgaataatatcccaaaatctgaaattcttaaatgttagagagtcttcgcaaagttacataattatttagctactcattggtcttcacttatatctttcggagtagtttgttgtttgctctagtgcttcacttatatatttttagagcacggcggtggttttattttgaagaaattgttgaactatcgtgcttcacttatattattttgagagtctttaaacaacatggtaatttgcttatgttatgaatttagtcctaatatgatgggcatccaagagggatataataaaaactttcatctaaagagcattgaatactatgataagtttgatacttgcatttgttttgagatatggagatggtgatattaaagccatgctggtgagtaattgtggattggtataaatacttgtgttaaagtttgtgattcccgtagcatgcacgtatggtgaaccgttatgtgatgaagtcggagcatgatttatttattgattgtcttccttatgagtggcggtcggggacgagtgatggtcttttcctaccaatctattcccctaggagcatgcgtgttatactttgctttgataacttctagatttttgcaataagtatatgagttctttatgactaatgttgagtccatggattatatgcacttttccccatccttccaccattgctagccactctaataccgcgcactttttgccggtatcatacacctaccatataccttcctcaaaacagccaccatacctacctatcatggcattcccatagccattccgagatatattgccat

SEQ ID NO: 30584 - DNA, 1379 bp, Triticum aestivum
  Clone ID: PAT_TA_30584
cgtgcgcccgaacgccacgcccaaacccaaagccaagtcgcactcctcctcctcctatcctcttcctcgccgaggcggcgaccggccagcgccgcccacccgccaccgcccgcgcatctccgttcaattcggtgactcgctacgctccccctgcgttcttctggcaaattcagcgaatttggggctgaggaaagaggaggaacgacttttcgctggtggcctgaaattcaggacaagatgcacttccttgcatcatttcacggccctgcaggttttgagcttttgtctgtttcgctgggatggatgccaagaagttcctgcagatggtcgaagacaagaagaagagactcctcgagaagaaggaagcccctctgaaatggcagcagaaactggaagcagcaatcaaggccactgaagaaaaggagaagaagctcaagtcgaaaaagcacaggagacgaagctattcttcctcagaatctgacagtgaatccgagagcgacagtgatcggaaacacaggaagaggaaggaccgcaaaaggcacaaaagacatggccattctgactctgatggtgccaggaggcgcaagcacaggtcaaagaggaggagctcgggctctagcgacgagagcgacagtgatgaatatgatggcgaatctgaagaagagcgccgaaggaagaagcactcgcacaggaggaagcatcgccgacactcttcaaggtcagagtctgacgcctcagattacagcagtgatgatgatgagcgaaggtcaaccaggaaggaccattctaggagccggaggcgtcgccaccggtcctcagacgatgaatctgaggagaagatcaggtcgaggcataggaagcgtcatcacagatcaagtgacgaggacaagccgtcagattctgacaaccataagcgccacaggagccgctctatgtccttggatgatggtgctgctggtgagccagacaagatgaatgatggcaaggggtctcacaaaagccggcatcaccgccgccaccaccaccatcatgatcatcgtgtgaactctgctgaacccagtgacgggaagcaacttcgtgtaagttgttaaaatgcctcagaacctgattggcattttcactggactctgtgacggcaatgtttgcttgccccagttggctagttgctgaatggaagcgatgtatctttcataatgttactgtctccggctctgctgcggattctgaagcctttacttgttctactgaaacgtttggcgacactagatgttatttccagcgtttcctctgttgacatatgtttgcttgctgatttggtggttaaacatgcctgtttcatttgctgcaagttcactattgcaaaaaaaaaaaaaaaaaaa

SEQ ID NO: 30585 - DNA, 891 bp, Triticum aestivum
  Clone ID: PAT_TA_30585
tgtgggctggcttgcctccctcctatggcccatgtggcccatatcttcccccagggggttctggtaactccccggtactccgatacgtaccccatacatttcgaaacacttccggtgtccgaatactatcgtccaatatatcaatatttacctctcaaccatttcaagactcctcgtcatgtctgtgatctcatcaggaactccgaacaatcttcggtcaccaagaacacgtaactcataatacaaatcatcatcaaacgttaagcgtgcggaccctacgggttcgagaactatgtagacatgactgagacacctctccggtcaataaccaataccagaacctgggatggtcatattggctcctacatattctacgaagatctttatcggtcaaactgcataacaacatacgtcattccctttgtcatcggtatgttacttgcccgagattcgatcgtcggtaatcttcatacctagttcaatctcgttatcggcaagtctctttgctcgttccgtaacgcatcatcccgcaactaactcattagtcacattgcttgcaaggcttcttatgatgtgtattaccgagagggcttagagatacctctccgatactcggagtgacaaatcctaatctcgatttatgccaacccaacaaacaccttcggagatgcctatagagcatctttataatcacccagttacattgtgacgtttgatagcacacaaggtattcctccggtatccgggagttgcataatctcatagtcgaaggaatatgtatttgacatgaagaaagcaatagcaatataactgaacgatcaatatgctaagctaacggatgggtcatgtccatcacatcattctcctaatgatgtgatcccgttatcgaat

SEQ ID NO: 30586 - DNA, 1807 bp, Triticum aestivum
  unsure (1)..(1807): unsure at all n locations
  Clone ID: PAT_TA_30586
gctagggacgttaaacgatagcgctagttgggaggcaacccaattttgtttgtgttttttttcctgtttagtaataaatcttgcatctaccttctgtttagatgtgtttttatcttttaattagtgtttgtgccaagtagaacctataggataacctatgatgatagttgatttgattctgctgaaaaacagaaactttgcacgcacgaatttaattttgtcaaatcacagagacgtgattttgcgttgattctttttgctgatgatcaatagacagattttccaggacttactattttggtagggtttttagagttctagaagtttgcgttagttacagattgctacagactgttctgtttttgacagattccgtttttcgtgtgttgtttgcttattttaatgcatctatggctagtattaagtggtatgaaccatagagaacttgaaatacagtatgtttaacaccaatataaataaagaatgagttcattatagtactttatgtgtttatttttctttctttcactaacggagcttatgagatttcctattgagttttgtgttgtgaagttttcaagttttgggtaaagatttgatggactatggaataaggagtggcaagagcctaagcttggggatgcccatggcaccccaagatattcaataatggccaaaagcctacgcttggggatgcctcgggaaggcatcccctctttcgtcttcgttcattggtaactttacttggagctatatttttattcgccacatgatatgtgtttcgcttggagcatcttgcatgatattagtatttgctttttagttttccacaatcatcctcgctgtacacaccttttgggagaagcccacttgattagaatttattagaattctctatgtgcttcacttatatcttttgagctagatagtttttgctctatgcttcacttatatctttcagagcacggcggtggcttaattttgtagaaattgctagtctctcatgcttcacttatatttttttgagagtcttaaacaacatggtaatttgaatgaaaactatcataggaagtgaattggatgctatgatcaatttgatacttgataattgttttgagatatggaggtagtgatattaaagtcatgctagttgggtgattatgaatttaaagaatgcttgtgttgaagttagcaagtcccgtagcatgcatgtatggttaaagttgtgtaacaaatttgaaacatgaagtgtacctagcttgtgcatccttatgagtggcggtcggggacgaacgatggtcttttcctaccaatctatccccctaggagcatgcgcgtagtgcttggtttttgatgacttctaaatttttgcaataagtatatgagttcttttgactaatgttgagtccatggattatacgtacttttacctttccatcattgccagcctcttcggtaccgtgcattgccctttctcaccttgagagttggtgcaaacttcgccagtgcatccaaaccccgcgatatgatacactctatcacacataaacctccttatatcttcctcaaaacagccaccatacctacctatttatggcatttccatagccattccgagatatattgccatgcaactttccaacgttccgttcatcatcatcatgacatacattactttgtcatatgccattgcatgataagtagttgacatcgtactgtggcaaagccacaatcataantttaaacatgtcacnctgatcatgcacatcccggtacacgccgagnatcatatagagcatactgtcaa

SEQ ID NO: 30587 - DNA, 1608 bp, Triticum aestivum
  unsure (1)..(1608): unsure at all n locations
  Clone ID: PAT_TA_30587
ctccgaaaatacctgaatcactcggaacctttctgatgtctaaatatagtcgttcaatatatcgatctttacgtctcaaccattttgagactcctcatcatgtccccgatctcatccgggactccgaactacattcggtacatcaaaacacataaactcataatataaatcgtcatcgaactttaagcgtgcggaccgtgcgggttcgagaactatgtagacatgaccgagacacatctccggtcaataaccaatagtggaacctggatgctcatattggttcccacatattctacgaagatctttatcggtcaaaccgcataacaacatacattgttccctttgtcatcggtatgttacttgcctgagattcgatcgtcggtatcatcatacctatttcaatctcgttaccggcaagtctctttactcgttccgtaatgcttcatccttcaactaactcattagtcacattggttgcagggcttatagtgatgagcattactgagagggcccagagatacctctctgatacatggagtgacaaatcctagtctcgatctatgccaacccaacaaacaacttcagagacacctatagagcatctttataatcacccagttaccttgtgacgtttgatagaacacaaggtgttcctccggtattcgagagttgcataatctcatagtctgaggaacatgcataagtcacgaagaaagcaatagcagaaaaactaaacgatcattatgctaagctaacggataggtcttgtccatcacatcattatctaatgatgtgatctcattcataaaatgacaacacatgtctatggctaggaaacttaaccatctttgattaacgagctagtcaagtagaggcatactagggacactatgtttgtctatgtattcacacatgtactaagtttccggttaatacaattctagcatgaataataaacatttatcatgatatgtaaggaaataaataataactttattattgcctctagggcatatttccttcacaaataacaatacagtgcagtacaaaccgtccagagaaggctaatttagaggctacaaatagagatatggtcaaacatataaataatattcaagatacaaacaattcgcttgctgcaaagttgggcgcttcatggggcaccgtcttgagttttctccatcatgtgagcccaccttacagccacttgcacataaaccatgtcatacatcatatcaacaaactgggaagaaggcagcctccatgttctcttcatcaacatggtgcagaaaacgtccacagacccaccacaatccaatgctccatggcaagataaacagatggcatatgatctanacctccnagncactttgctccngatcangttntngagaaggcccngcaacagntttcccacaaagactaggttacgagttaataaanccggtgtcnanacttgtactgttnccngatgnatgcacaaacaatgttgtanacattcaatggccaaatattaaagtgacaatgatggatgcacanaaacatgaagtagtcatgatcacgctaatacaattttggatcgcgtantntattcagttaattgancat

SEQ ID NO: 30588 - DNA, 1193 bp, Triticum aestivum
  Clone ID: PAT_TA_30588
attttattcaccacatgatatgtgttttgcttggagcgtcttgtatgatttgagtctttgctttttagtttaccacaatcatcctttctgtacacaccttttgagagagactcacatgatttgaaatttattagaatactctatgtgcttcacttatatcttttgagctatatagtttttgctctaatgctttacttatatcttttagagcacggtggtggttttattttatagaaataattgatctctcattcttcacttatattattttgggagtcctttagaacaacatggcaatttgcttttaggcataataaaaactttcatataagtgcattgaatactaagagaagtttgataattgatgattgttttgagatatggagatagtgatattaaagttgtgctagttgagtaattgtgaatttgagaaatattgtgttgaagtttgcaaatcctgtagcatgcacatatggtaaacgttgtgtgacaaatttgacgcatgaggtgtttctttgattgtcctccttatgagtggcggtcggggacaagctatggtcttttcctaccaatcgatccccctaggagcatgcgcgtagtgcttggtttttgatgacttgtagatttttgcaataagtatgtgagttctttatgactaatgttgagtccatggattatacgcactctcacccttccatccttgctagcctcttcggtaccgtgcattgccctttctcacattgagagttggcgcaaacttcaccggtgcatccaaaccccgtgatatgatacgctctttcacacataaacctccttatatcttcctcaaaacagccaccatacctacctattatggcatttccatagccattctgagatatattgccatgcaactttccaccattccgtttatcatgacacattcatcattatcatatttcttagcatgatcatgtagttgacatagtatttgtggcaaagccaccattcataattttcatacatgtcactcttgattcattgcatatcccggtagaccgccggaggcattcatatagagtcatatcttgttctagttttgagttgtaattcattgagttgtaaataaatagaagtgtgatgatcatcattattagagcattgtcccaaaaaaaaaaaaaaaaaaaaaaaaaaaaaaaaaaaaaaaaactcga

SEQ ID NO: 30589 - DNA, 1343 bp, Triticum aestivum
  Clone ID: PAT_TA_30589
agaagggggaaaaggaagacaggcaagagctcaagcttggggattcccgaggcaatccaagtaaatattcaaggagactcaagcatctaagcttggggataccccagaaggcatcccctctttcttcaacaagtatcggtatgttttcggattcgtttcgttcatgcgatatgtgcaagtcttggagcgtcttttgcatttagtttttacttttctttcatgcaccatgatggtatgagatagttcttggtttatttatagaatgatcattgcacttcacttaaatattttgagtatggctttatagaatgcttcatgtgcttcacttatatcatttgaagtttggattgcctgtttctcttcacatagaaaaccgccatttgtagaatgctcttttgcttcacttatatttgttagagcatgttcttttgtagaaagaattaaactctcatgcttcacttatatctatttagagagtcaacaggaattggtcatttgcgtggttagtcataaaatcctacataaaatttatggatcactgaatatgatatgtttgattccttgcaatagttttgcgatatagagatgataatatgtgggaggtactagtagatggttgtgtttagtaataatattttgtgttaaggtttgtgattcccgaagcatgcacgtttagtctctcattatgctatgaagttggagcatgatttattattgattgtcttccttatgagtggcgggcggggacgagagatggtattttcctaccaatctatccccctaagggcatgcgtagtagtactttgctttgagggataataaacttttgcaataagtatatgagttctttatgactaatgtgagtcagattatacacactcttacccttccgcaatttgctagcctctatggtaccgtgcattgccctttctcaccttgagagttggtgcaaacttcgccggtggatccaaaccccgtgatatgatatgctctatcacacataaacctccttatatcttcctcaaaacagccaccatacctacctattatggcattcccatagtcattccgagatatattgccatgcaactttccaccgttccgtttatcatcatgacatacattacttttgtcatattgccattgcatgaccatgtagttgacatcgtatttgtggcaaagccaccatgcattatttttcatacatgtcactcttgattcattgcaccatcccggtacaccgtcggaggcattcatatagtcatatcttgttctaagtttcgagttgtaatccttatgttgtaatcaatagaagtgcgatcatcattattagagcattgccc

SEQ ID NO: 30590 - DNA, 1044 bp, Triticum aestivum
  unsure (1)..(1044): unsure at all n locations
  Clone ID: PAT_TA_30590
cggacctccgactcccgtgagtccgctgggcgtggtgcgccatgacccccgccctgcttcccctcgccccctcgcctccttatccaaagccaccacggctatgccacaaacccacccccgcgcgcccgctctaccggtgcgacgccacacgccgcgacttcgctgtctacaccgcctccgctgccgcagccgcaatgagccccgccgccgctactgcggcagatgaggcgctcccttcggcgtcacagtcaccgacgcctcaccctccaaacggcggggctacctcgttgctggtcggcatcgcaaacacgaggtcgtggtcgcagtactacggcagcggttctccatccgcgtgccgccgtccttcgatgacatcttggagcccgaggatttcagcgccgccatgacctattatggcgacaaggccaaggtcagggcgtacgcagctcggttcgcatctccagataggtaggttagaacttgtaagcgtggtaatcaagccatctaatcagctcaagatcacattcctagaggccaaagatataacagagttgggcactctaaaggaggcgtccaagttatttgtacctggcggtgcaaaaatatactcagctcgaacaattaaagttaaggatcaggagggtatcaggttatttctctcaattttcaagggaatattacaaaaggcaatggcttctgtagttaaattgctttatgagataatattttgcaggacgtattacttctatgaatttcgttttgacagacaacatgttgctctaatggccaccgtggatagtgggaagggaaaggctgcgtactatagacccaaagtggtcggacccttccccgaccctgcgcaagcgggagctacatgcaccgggctgcccttttcatcatgcattttgtgttgctactttctttagtccttgcagctgtattctagattcttaaactataaatttatatcctactaatgtccccaagcattcatccatttgttcgttccttctnaataggcggaaccgataaacacaaaaacaa

SEQ ID NO: 30591 - DNA, 1006 bp, Triticum aestivum
  Clone ID: PAT_TA_30591
agggggagctggcaattctgggttgaaaaaggagcaaatattagagacctattatgcacaactccaaaagtcctgaaacttcacgaaagtcagttttggattatataaaaaatattgggcgaagaaaggactggaggggggccacccaccatccacgagggcggggggcgtgccctaaccccctgggcgtgccccctgtctcatgggcccccctggcaggcctttggtgcccatctttggctatatggagtctttcacgcctggaaaaaatgataagcaagctttcgggacaaaacaccgccgccatgaggcagaaccttggcgaaaccaatctagggctctcgctgagttgttcttccggggaaacatccctccaggagggggaaatcatcaccatcgtcatctccatcgatcctctcatcgggagggggtcaatctccatcaacatcttcaccagcaccacctcatctcaaactctagttcatctcttgtattcaatcttttgtctcaaaaccttagattggtacatgtgggttgctagtagtgttgattactccttgtagttgattgctacctcttgagcatgtgttggttttcccttgaagaggaaagggtcatgcagcaaagtagcgtaagtatttccctcagtttttgagaaccaaggtatcaatccagtaggaggctacacgcaagtccctcgtacctgcacaaacaaataagaaccttgcaaccaacgcgaagaaggggttgtcaatcccttcacggccacttacaaaagtgagatctgatagagataataagataaatatttttgatatttttgttgtatagattggaaagtaaagattgcaaaataaaatagatcggaaacttatatgatggaaaatagacccaggggccataggtttcactagtggcttctctcaagatagcataagtattatggtgggtgaacaaattactgtcgatcaattgatagaaaagtgcatagttccggtcgacccgg

SEQ ID NO: 30592 - DNA, 592 bp, Triticum aestivum
  Clone ID: PAT_TA_30592
gcaggaattcggcacgagggcattcccccttttccccttgctagatccgcccactcccgatagcctccgccgctcaccgccgtcgattccacgctctccgacgaccccgagccctggcgagatgtcacggagcttcgccgccctccgctgcgtcgcctgagccgagccaccggagacgacgggctcggcatcgagcggatcgagctcgtctccgtcttctgcgtcgccggtgaccgccgccgtcttcgtcatcccctgctgctacaaagctgtcgagggcctttcttggccgctcgatgacggagcccaggagccagacgatgccactgatgtctactactacctggaggatgcctactactacgtgaagaccgccaatgactaggagtagttaggaggctcccaggcaggaggccttgccttttcgatcattgttgcttttgtgctagccttcttaagacaatactgtttaactcatgtttgtactcagatattgttgcttccgctgactcttgtgtatttgagcttatgtattcgagccttcgaggcccctggcttgtaatacaaagtttgtattattttaaaaaaaaaa

SEQ ID NO: 30593 - DNA, 607 bp, Triticum aestivum
  Clone ID: PAT_TA_30593
gacgaaccctagcgccctaagtgcattcccccttttccccttgctagatccgcccactcccgatagcctccgccgctcaccgccgtcgatcccgcgctctctgacgaccccgagccccggcgagatgtcacggagcttcgccgccctccgctgcgtcgcctgagccgagccaccggagactacgggctcggcatcgagcggatcgagctcgtctccatcttctgcgtcaccggtgatcgccgccgtcttcgtcatcccctgctgctacaaagctgtcgagggcctttcttggccgctcgatgacggatcccatgagccagacgatgtcactgaagactactactacccggaggatgcctactactacgtgaagaccgcagacgactatgagtagttaggaggctcccaggcaagaggccttggcttttcgatcgttgttgcttttctgatagccttcttaaggcacacttgtctaacttatgtctgtactcagatattgttgcttccgctgactcttgtgtattcgagcttatgtattcgtgccctcaaggcccctggcttgtaatataaagcttgtattattttaattttatgtctaaaaaaaaaa

SEQ ID NO: 30594 - DNA, 797 bp, Triticum aestivum
  Clone ID: PAT_TA_30594
ccgacctaaacctaactcaactgcgccaccgcccctgatctgcgtgccgccgcccgtcctctggtcccctcgtgccacatcatctccgaccctggcctccctccccgcagggcaccatccgcccgggagcagcagctccgtccgccacgccgaggagcagcagcgccgtcaaccgccgctgaggatccactgctgatttgtctccacgtgcgacctctgtttcatctgatttccttcgctccgccccgcctacagaattcaagatgtaagcttctggtggtggaggcaagtcaagattttacgccggttctgttacaggaacagaggatagtcctccctaagctgcttaatggtagagttggaatccctctagtccagctccaggcaggaggtcggatggaactggatcagtatcgagattaggaatcaaccaagtcgcccttttgatcaactacaacagcaggacaaacaatggtgggaaaatggtagaaagtagcaagtccactagttgatcgaagatgttcttgtgattgcttttcttgataatatggatgacacattttgttcatatggaagttgatttggcttggcgattgaagatttggtcccttggtctcttttgaactttggccattatgtttgtaacatgcctctcttgtatatccgacttgtgtatttccataatggttgtagctaacttgagtgaagaaaactattgaatcttatatagatattaaaattaatgcattgatcaatgatatcttgtggtgaaaaaaaaaaaaaaaaaaaaaaaaaaa

SEQ ID NO: 30595 - DNA, 1306 bp, Triticum aestivum
  Clone ID: PAT_TA_30595
gacgggtcagataatctgttgagttttgtgttgtgaagttttcaagttttgggtaaagatttgatggaatttggaataaggagtggaaagagctaagcttggggatgcccaaggcaccccaccaaggtaaaattcaaggacaaccaaaagcctaagcttggggatgccccggaacgcatcccctctttcgtcttcgtctatcggtaactttacttgaggctatatttttattcaccacatgatatgtgttttgcttggagcgtcttgtgtgatttgagtctttgctttttagtttaccacaatcatccttgctgtacacaccttttgggagagacacgcatgaatcatgatttattagaatactctatgtgcttcacttatattttttgagctaggcaatatcgctctagtgcttcacttatatctttttatagcacggcggtggttttattttatagaaattgttgaactctcatgcttcacttatatcattttgagagtcttttacaatatcatggtaatttgcttgggtataaatttagtcctaatatgataggcatccaagagggatataataaaaaaattcatataaagtgcattgaataccatgagaagtttgattctttatggttgttttgagatatgaagatggtgatattagagtcatgctagtagagtagttgtgaatttgagagatacttgtgttaaagtttgtgattcccgtagcatgcacgtatggtgaaccgttatgtgatgaagttggagcatgatttatttactgattgtcttccttatgagtggcggtcggggatgagcgatggtattttcctaccaatatatccccctaggagcatgcgcgtagtacttcgtttcgataactaataaatttttgcaataagtatgtgagttctttatgactaatgttgattccatggattatatgcactcttaccttaccatcattgctagcctcttcggtaccgtgcattgctctttctcaccttgagagttggggcaaacttcactggtgcatccaaaccccatgatacgatacgctctatcacacataaacctccttataccttcctcaaaacagccaccatacctatctattatggcatttccatagccattccgagatatattgccatgcagctttccaccatttcatttattatgacaggcttcgtcattgtcatattgccttgcatgatcttgtagttgacatcgtatatgtggcaaagccaccatgcataatttatcatacatgtctcttttgtttcattgcccatcccgatacaccgcc

SEQ ID NO: 30596 - DNA, 1716 bp, Triticum aestivum
  Clone ID: PAT_TA_30596
atgttcctaaaaataagggtgaatcttctagtaagaaaaatgtggatctcaaatcaataagtgttcatcccaattgtctctctatcattaaggaaccttttgctacaaatgaatttctcaatttcttgcctaggagtttaatcattgctaaaaagaaagaaactcctaaaatttataagtgctctgttgaagaatttaatgccaaagatggcactacttagatctgttctcgcttttatgcctagctaggggcgttaaatgatagcgctagttgggaggcaacccaattttatttttgtttcttgctttttgctcctgtttagtaataaataattcatctagcctctggttaaatgtggttttgtgttttaattagtgtttgtgctaagtagaacctttgggaagacttgggtgaagtctttataatcttgctgtaaaaaacagaaacttttgcgctcacgagattagcggccattttttactggagagtgattttaggttgattagtttttcagaagattaatagacaaattcctcaggtccaccaatttatttcagaatttttggagttacataagtatgcgtttgatacagattgctacagactgttctgtttttgacagattctgttttccttgtgttgtttgcttattttgatgaatctatgagtagtatcgcagggtatgaaccatagataagttggaatacagtatatattacaccaatataaatttagaatgagttcattacagtacctaagtgttggttttattttctcatactaacggagcttacgagttttgttttgagttttgtgtggttgaagttttcaagttttgggtaaagattcgatggactatggaataaggagtggaaagagcctaagcttggggatgcccatggaaccccaatgtaatattcaaggacaaccaagatactaagcttgggtatgcaccggatggcatcccctctttcgtcttcgttcattggtaactttacttggagctatatttttattcgccacatgttatgtgttttgcttggagcatcgtgtattatattagtctttgctttttagtttaccacaatcatccttgttgtacacaccttttgggagaagactacttgattataatttgctagaatactctatgtgcttcactcatatcttttgagcgtgatagtttttgttctagtgcttcacttatatcttttagagcacggcggtggcttaattttgaagaaattgctagtctctcatgcttcacttatatctttttgagagtcttttagaacaacatggtatttgctatggttacaaagttggtcctagaatgatgagcatccaagttgggtataataaaaactaccatagaaaagaattggatgctatgatcaatatgatgcttgataattgttttgagatatggaggtagttatattaaagtcatgctagttgaggtgattatgaaaagtacttgtgttgagggttgtgattcccgtagcatgcacgtatggtgaaccgctttgtgatgaagttggagaacaattttatttattgattgtcttccttatgagtggcggtcggggacgagcgatgatcttttcctaccaatctatccccctaggagcatgcacatagtgctttggtttttgattacttctagatttttgcaacaagtatatgagttattttgactaatgttgagtccatgg

SEQ ID NO: 30597 - DNA, 2011 bp, Triticum aestivum
  Clone ID: PAT_TA_30597
gacggagaactctgttcttttataaggtccgaagtctcatcccaacttgtgggggaatcatagtctccatcatcctttcctcactgggacaatgctctaataacgaagatcatcacacttctatttacttacaactaaagaattacaactcaatacttagaacaaaatatgactctatgtggatgcctccggcggtgtaccgggatatgcaatgaatcaagagtgacatgtatgaaagaattatcaaggtggctttgccacaaatacgatgtcaactaaatgatcatgcaaaagcaatatgacagatggggcgtgtcataataaacaggacggtggaaagttgcatggcaatatatctcggaatggctgtggaaatgccataataggtaggtatggtggctgttttgaggaaggtatatggtgggtttatggtaccggtgaaagttgcgtgataatagaggttagcaataaataattcatctagcctctgtttagatgtggttttatgcttttaattagtgtttgtgccaagtagaacctttgggaagacttggggaaagtctttgtgatcttgctgtaaaaaaacagaaactttagcgctcatgagatttgctgccatttttcattggagagtgatatttagttaattatttttgaagatgattaataggtaaattcctcacgtccagaaatttattttagaatttttggggttccagatcttgcgctagatacagattactacagactgttctgtttttgacagattctgtttttcgtgtgttgattgcttattttgatgaatctatggctagtaatagtatataaaccatagagaagttggaatacagtagttttaacaccaatataaataaataattagttcattacagtaccttgaagtggtcttttgttttctttcgctaacggagctcacaagattttctactttaagttttgtgttgtgaagttttcaagttttgggtaaagatatgatggattacggaacaaggagtgtcaagagcctaagcttggggattcccaaggaaccccaaggtaaatccaaggacaccaaatatcctaagcttggggatgccccagaaggcatcccctcttttgtcttcgttcatcggtaactttacttggagctatatttctattcgccacatgatatgtgttttgcttggagcgtgttgtatgatttgagtcatttctttttagtctaacacaatcatccttgttgtacacaccttttgagagagacacgcatgattcagaatttattagaatactctatgtgcttcgcttatatcttttgagctatatagtttttgctctagtgcttcacttatatcttttagagcacggtggtggatttgttttatagaaactattgttctctcatgcttcacttatattattttgagagtcctacaaaacagtgtggtaattttctttaattataataggcatccaagattagtaaaaattatcttatgagtgtgttgaatactatgagaagtatgatgcttgataattgttttgagatatgaagatggtgatattagagtcatgctagttgagtagttttgaatttgagaaatacttgtgttaaagtttgtgattcccgtagcatgcacgtatggtgaaccgttatgtaatgaagtcggagcatgatttatttattgattgtcttccttatgagtggcggtcggggacgagcgatggtattttcctaccaatctatccccctaggagcatgcgcgtaatactttgctttgataacttctagatttttgcaataagtatatgagttctttatgactaatgttgagtccatggattatacgcactctcacccttccacctttgctagtctctctaataccgcgcaccttttgccggtatcatacacctaccatataccttcctcaaaacagccaccatatctacctattatggcattttcatagccattccgagatatatttccatgcaactttccagcatc

SEQ ID NO: 30598 - DNA, 1294 bp, Triticum aestivum
  unsure (1)..(1294): unsure at all n locations
  Clone ID: PAT_TA_30598
gggtccacgggacgaggagatatcgggacggagagatccggcatgggcaaggctgtttggttggtgggatgggtggatcttattgtgaaaatgttctgatcctatggtggaagggtgaaagggtgtgtattatattagtctttgctttttagtttaccacaatcatcctttctgtacacaccttttgggagaagcctatttgattagaatttgctacaatactctatatgcttcacttatatcttttgagcttgatagttttttctctagtgcttcacttatattttttagagcacggtggtgtcttaattttgaagaaattgctagtctctcatgcttaacttatattattttgagagtctttgagaacaacatggtatttgctatggttatgaatatggtcctagaatgatgagcatccaagttgtgtataataaaaactatcatagaaagtgcatcaaacattaggatcaatttgatgtttgataattgttttgagatataaatgtagtaatgttagagtcatactagtgggtaactatgaaattgagaaatacttgtgttgaagttggcaagtcccatagcatgcacgtatggtaaaagttgtgtgacaaatttgttgcatgaggtgctcttttaattgccttccttatgagtggaggtcgggatcgcgcgatggttaactcctaccaacccgtcccctaggagcatgcgtagtagtactttgcttcgagggcaagtagacttttgcaataagtatatgagttctttatgactaatgtgattccatggatatacgcacactcatccttccactttgctagcctctattataccgtgcaactttagccggtatcatgcacccattatttaccttcctcaaaacagccaccatacctacctattatggcatttccataaccattccgagatatattgccatgcaactttccaccgttccattttatctttatgacacacattaccattatcatattgccttgcatgatcatgtagttgacatcgtatttgtggcaaagccaccatgcataaattttcatacatgtcactcttgattcattgcccataccggtacaccgccggaggcattcatatagagtcatattttgttctagttttgagttgttattcattcgtcggttgttcgctgatgtattggttcattttttttcttttccttttttcggtttcttaatttcctacctggatttttttgggtttccaattttttggctttanactttgccttttttgttttttcnttcacntttcg

SEQ ID NO: 30599 - DNA, 1914 bp, Triticum aestivum
  Clone ID: PAT_TA_30599
ttccttaaaacagttggtgcaaatattgatatgtaggaagggaatattagattccaatttccactaaggaaaggcatggaacactttacaagaaagaaagttaaattaccttgtgaatctatcatgcgagctacttatgaattgaatgccaaagatggtactacatagatctattctcacttttatgcctagctaggggcgttaaacgatagcgctagttgggaggcaacccaatttgatttttgtttcttgctttttgcttctgtttagtaataaatatttcatctagcttctgtttagatatgtttttatgttttaattagtgtttgtgccaagtaggacctataggataacctacgatgatagttgatttgattctgctgaaaaacagaaactttgcatgcacgaatataattatgataaattacaggaacatgcttttgcgttgattctttttgatactgatcaataaacaaattttcaggacttactagtttggtagaatttttagagttccagaagtttgcgttagttacagattgctacagactgttctatttttgacagattctgtttttcgtgtgttgtttgcttattttgatgaatctatggctagtaaattagtttataaaccatagagaagttgaaatacagtaggtttaacaccaatataaataaagaatgagttcattacagtaccttatgtggtggttttgctttctttcactaacggagcttatgagatttcttgttgagttttgtgttgtgaagttttcaagtttggggtaaagatttgatggactatggaataaggagtgacaagagcctaagcttggggatgcccatggcaccccaagatattcaagaatagccaaaagcctaagcttggggattgccccggaaggcatcccctcttttgtctttgttcattggtaactttatttggagctatatttttatttgccacatgatatgtgttttgcttgtagcatcttgtattatattagtatttgctttttagtttaccacaatcatgcttgctgtacacaccttttgggagaagcctatttgattagaatttgctagaatactctatgtgcttcacttgtatcttttgagcttgatagtttttgctctagtgcttcacttatatctttttgagaacggtggtgaattattttgtagaaattgctagtctctcatgcttcaattatatctttttgagagtcttttataacagcatggtattttctatggttataaattggtcctagaatggtaggcatccaagttgggtataataaaaactatcataggaagtgaattggatgctatgatcaatttgatacttgataattgttttaagatatggaggtagtgatattaaagtcatgctagttgggtgattatgaatttaaataatgcttgtgttgaagttaggaagtcccgtagcatgcacgtatggttaaagttgtgtaacaaatttgaaacatgaagtgtacctggcttgtgcatccttacaagtggcggtcgaggacgagcgatggtcttttcctacaaatctattcccctaggagcatgcatgtagtactttgttttgatagctaatagacttttgcaataagtatgtgagttctttatgattaatgttgagttcatggattatacacactctcacccttccaccattgctagcctctatagtaccgcgcaactttcgccggtacattacacccaccatataccttcctcaaaacaaccaccatacctacctattatagcatttccatagccattccgagatatattgccatgcaacttccaccgttcagtttattatgacatgcttcatgatgaggacatcaataccattgttacacccacatcccctgctactatacataatggaccaat

SEQ ID NO: 30600 - DNA, 517 bp, Triticum aestivum
  Clone ID: PAT_TA_30600
taagactattttctggttgagatcaaaaagttgaggagatatgaactaccacctctcttgcggcgtcgtgtaggcatcgggggtgcgatggctatcggtggcgtcgaagcagatctgcgacggtagacgggtgcatcgggggataagtcccgttgcggtggaagagaaggtcgtgtgagcggccccggcaaagaggacgacggcgctgatgaagcgagaggacgcgatgcaaggctattagtctgtcgccgtggatgagaaacgtccatctctagcagtggacgacgcggtcttggtaggcgctccggcatggtggaggatggtggcgatggatgtggtggaggacggcggcgatggatggggtggaggacggcggcgatggatggggtggccgacggaggctggtgtggggatggtgttcttgcgcggacagtgtatgaatgggaaaatggagggagaggtatagggaaccatgtttttggacgcacctgtatgaaatatgggaaagttacgaact

SEQ ID NO: 30601 - DNA, 1076 bp, Triticum aestivum
  Clone ID: PAT_TA_30601
tcctcttcctcatcctctttccgttccccactcctatcctctcagatctaaactgccaatacatccgctagctccctgtaccggccggcaccggcgcccgtcgacatgtctgcctcgtcctcgtcctcacagtccctcgcacccatcctccaagagcagcctcctcttcctctcatccgttgcccctggtgccacaacggcgacatcgagtggtgggtttcccggactcccaagaaccccgggaaacacttctacaagtgcgagcgtcactgggttagtgaatacttttcctgtcccggattgatcatgttattcgaagggaaactctgcatgccggtcactgcagatccaccccaccccgcacataaacatcgatggattcgggtgcgagccggtcactgcagatccagcacgggctgagactttggggatgaaggtcggcgactaggcaaggatcctcggcggcttggtgttgagtctttcctcgtattttctctctgcaattttttgtttctcgatcgtattttctttccttgttttttctctgaaaatttctttcctaaaaatttctcgctgaggttttctgtttttttcgccaactctgacaccattcggtatgcaacggcggcggccagcagcagaatacgcaacgctagccgctggggcagtgattgcttgtggcggcgagaagcgagcagcaactgcagtacgcggagctggggcaagggcagcccgtgtcggcgagcagcggcagcccgtggcgtcagcgagcagcaagaaataggtggcacagacgagacggggagcagtaaatccatgctgccaactctcaaggtcctcctcatcccggggatcctcaatctagcgccgttctgtatctcttccttaggctagctacagagatcttatttacaagttcagttgagcctcaggaagagatacagaacttgtaaataagatctctgtagctagcctaatctttttcttttttgcggaaaatcacctggttaattgttacctgcccttcgatccaggaagttcatgtgaaaataaaaagttccaggaagttcagattt

SEQ ID NO: 30602 - DNA, 1152 bp, Triticum aestivum
  Clone ID: PAT_TA_30602
aagcttttatggacaaaggaataaagggtggcaagagcctaagcttggggatgcccaaggcaccccaagatattcaataatagccaaaagcctaagcttggggatgccccgggaaggcatcctctctttcgtcttcgttcattggtaactttacttggagctatatttttattcgccacatgatatgtgttttgcttggagcgtcgtgtattatattagtctttgctttttagtttgcaacaatcatccttgctgtacacacattttgggagaagcctttttgattagaatttattagaatactctatgtgcttcacttatatcttttgagctagatagttttgctctagtgcttcacttatatcttttagagcacggcggtggcttgattttgtagaaattgttgatctctcatgcttcacttatattattttgagagtcttctagaacagcatgatatttgctatggttataaaattggtcctagaatgacgggcatccaagttgggtataataaaaactatcatagaaagtgaattggatgctatgatcaatttgatgcttgataattgttttgagatatgaggatggtaatattagagtcatgctagtagagtaattatgaatttaaggaatacttgtgttgaagtttgtgattctcatagcatgcacgtatggtgaaccgttatgtgatgaagtcggagcatgatttatttattgattgtcctccttatgagtggcggtcggggatgagcgatggtcttttcctaccaatctatcccccaggagcatgcacgtaatactttgctttgataaacttctagatttttgcagtaagtatatgagttctttatgactaatgttgagtccatggattatacgcactctcacccttccacctttgctagcctctctaataccgcgcacctttcgctggtatcatacacctaccatataccttcctcaaacagccaccatacctacctattatggcatttccatagccattccaagatatattgccatgcaactttccaccatctagttcatcatgacacactccatcattgtcatattgcatatcccggtacaccgccggatgcattcacatagagtcatattttgttctaagtatcgagttgtaaatgttga

SEQ ID NO: 30603 - DNA, 1599 bp, Triticum aestivum
  unsure (1)..(1599): unsure at all n locations
  Clone ID: PAT_TA_30603
gggggatgccacggaagcatcccatctttcttcaacaaatatcggtatgttttcgtttttgtttcgttcacgtgatatgtgtaaatcttggagcgtcgtgtgctttttattttttaataatgcaccatgctggtatgagatagtccatggttggatttatagaatgcttgtgcttcacttatatcatttgaagtttgggttgcctgtttctcttcacatacgaaaccgttatttgtagaatgctcttttgcttcacttatatttattagagcatggtcttttgtagaaagaattaaactctcatgcttcacttatatctatttagagagatgacaggaattggtcattcacgtggttagtcataaaatcctacttaaaacttgtagatcactgaatatgatatgtttgattccttgcaatagttttgcgatataaagatggtgatattagagtcatgctagtgggtagttgtggattagtagaaatacttgtgttgaggtttgtgattcccgtagcatgcacgtatggtgaacagttatgtaaagaagtcggagcatgatttatttattgattgtcttccttatgagtggcggtcggggatgagcgatggtcttttcctaccaatctatccccctaggggcatgcgtagtagtactttgcttcgagggctaataaacttttgcaataagtatatgagttctttatgactaatgtgagtccatggattatacgcactctcacccttccatcattgctagcctcttcggtaccatgcattgccctttctcacctcgagagttggtgcaaacttcgccggtgcatccaaaccccatgatacgatatgctctatcacacataagcctccttatatcttcctcaaaacagccaccatacctacctatcatggcatttccatagccattccgagatatattgccatgcaacttccatcatcatcacatacatgacttgagcatttattgtcatattgctttgcatcatcgtaagatagctagcatgatgttttgatggcttgtccatttttttgatgtcattgctacgctagatcattgcacatcccggtacacagccggaagcattcctatagagtcatatctttgttctagtatcgagttgtaatattgagttgtaagtaaataaaagtgtgatgatcatcattattagaacattgtcccatgtgaggttatcaaaataaaagaggccaaagaagcccaaataaagaaaaaggccaaagaagcccaccaaaaaaacaaaaaaaatgagagaaaaatgagagaaaaagagagaagggacaatgttactatccttttaccacacttgtgcttcagagtagcaccatgttcttcatatagagagtctcttgagttatcactttcatatactagtgggaatttcattatagaacttggcttgtataatccgatgatgggctcctcaaacaccgaggtctcctgagcaagcaagttggatgcacaccacttagttcatctgagcttcaacacttatagctctantgatccgtgcaaggnaanccctaccaccaattgatancatgatgggatctcananccgttgata

SEQ ID NO: 30604 - DNA, 695 bp, Triticum aestivum
  Clone ID: PAT_TA_30604
ccgctccccacttgcgccccctcgctctctctcttgcccacgcactcgtcacctcctccagatccatcgccgagcgcggtcgttgccgctcgcctcactctgccatggccagcaggcacatctcgcctcgccgttgcgtccacaaagaccgccgtcgtccgctgcgtctactacggagacgaaacgatccggaaccccttccatcgtcgagccggccctctgcttccacctcccggccaccgaaggccgccgccgtcattctgctgcaccgagcctcccacgagcccgctcatgcacatctgcaggtccgcgaccccgtggcggctgccgatgccgctgtaatcgactacgtcaccgatgacccctccatcttgtctgagcaaccagatggtggagtccaggagccagatgccacctttgacgactgctactacaccgagggcgtctactaccacgtgacggagaccgtcgacgaccaggagtagttaggaggctcccaggcaggaggccttgccttttcgatcgttgttgcttttgtgctagccttcttaaggcaaacttgtctaactcatgtctatgctcagatattgttgcttccgctgactcttgtgtattcaagctgatgtattcgagcccttgaggcccctggcttgtaatataaagcttgtattattttaaaaaaaaaaaaaaaaaaa

SEQ ID NO: 30605 - DNA, 1159 bp, Triticum aestivum
  Clone ID: PAT_TA_30605
ttcggcacgaggcgtcgacatgtctgcctcgtcctcgacctcacagtccctcgcacccatcctccaagagcagcctcctcttcctctcatccgttgcccctggtgccacaacggcgacatcgagtggtgggtttcccggactcccaagaaccccgggaaacacttctacaagtgcgagcgtcactgggttagtgaatacttttcctgtcccggattgatcatgttattcgaagggaaactctgcatgccggtcactgcagatccaccccaccccgcacataaacatcgatggattcgggtgcgagccggtcactgcagatccagcacgggctgagactttggggatgaaggtcggcgactaggcaaggatcctcggcggcttggtgttgagtctttcctcgtattttctctctgcaaatttttgtttctcaaattttctctctgaggtgttgtgatcgtattttctttccttgttttttctctgaaaatttctttcctaaaaatttctcgctgaggttttctgtttttttcgccaactctgacaccattcggtatgcaacggcggcggccagcagcagaagtacgcaacgctagccgctggggcagtgattgcttgtggcggcgagaagcgagcagcagctgcagtacgcggagctggggcaggggcagcccgtgtcggcgagcagcggcagcccgtggcgtcagcgagcagcaagaaataggtggcacagacgagatggggagcagtaaatccatgctgccaactctcaaggtcctcctcatcccggggatcctcaatctagcgccgttctgtatctcttcctgaggctcaactgaacttgtaaataagatctctgtagctagcctaattcttttttcttttttgcggaaaatcacctggttaattgttacctgcccttcgatccaggaagttcatgtgaaaataaaaagttccaggaagttcagatttatatgtagcttctctatcttccaagatgtaaccaggatattaagttccaggaagtttacttaatatcctggaagacagagatgctggtttaagtttcaggagatatggatttttgactaagttgaatttaattgtgagtaagatgtttttttacttataaccaagaagctggatattacgtaaaccagg

SEQ ID NO: 30606 - DNA, 2009 bp, Triticum aestivum
  Clone ID: PAT_TA_30606
atgtggagagtaataaaatttctatgcttgtagatcatgaaaagaatactttatgttatagttatattgttgaattaattcatgatgctactgaaaattattatgagggaggagtatatgcttgtagtaattgcaataatatcaagtttcctccctatgtgttgaaaatcttgaagttatgcttgttttaccttcctatgctagttgattcttgttcccataagttgtttgctcaataaatccctatgcataggaagtgggttaggcttaaatgtgttagtcatattcttcatgattctctatttatgtttcaattcatatcttttatgtgagcatcatagaaatattatgcctagctataaggctttaaagaaaagcgcttgttgggagacaacccaatatttttcctttctgttattcaataaataatttatctagcctctgttttggttgtgtttgttgtgtttaattagtgtttgtgccaagtagaaccgttgggaaaacttggggaaagtcttgttaatcttgctgtaaaaaacagaaactttagcgctcacgagaactgctgtaatttttattttgaaagtgctatttagttaattcttttttgaagatgattaatagataaattcctcacgtccagcaatttattttagaatttttggggttccagaagtttgcgttagctatagattactacagactgttctgtttttgacagattctgttttctatgtgtcatttgcttattttgatgaatctatcggtagtatcggggggtatgaaccatggagaacttggaatacagtaggtataacacaaattaatataaatttagaatgatttcacaacagtacctaaagtggtgatttattttattatactaacggatcttacgagttttctgttgagttttgtgttgtgaagttttcaagttttgggtaaagttctgatggaccacgaaataaggattggcaagagcctaaccttggggatgcccatggaacccaaatataattcaaggacaaccaaaagcctaaccttggggatgccccggaaggcatcccctctttcgtcttcgtcaattagtaactttacttggagctatatttttattcaccacatgatatgtgttttgcttggaccgtcttgtatgatttgagtctttgccttttagtttaccacaatcatccttgctgtacacaccttttgagagagacacacatgattcggaatttattagaatactctatgtgcttcacttatatcttttgagctatatagtttttgctctagtgcttcacttacatcttttagagcacggtggtggatttgttttatagaaactattgttctctcatgcttcacttatattattttgagagtcctacaaaacagcatggtaatttgcttaaatcgagaaattggtcctaaagtaataggcatccaagattagtaaaaatttccttatgagtgtgttgaatactatgataagtttgatgcttgataattgttttgagatataaagatggtgatattaaagtcatgctagttgagtagttgtgaatttgagaaatacttgtgttgaagcttgtgattcccgtagcatgcacgtatggtgaaccattatgtgatgaagtcggagcataatttatttatttattgtcttcctaatgagtggcggtcggggacgagcgatggtattttcctaccaatctatccccctaggagcatgcgcgtaatactttgctttgataacttctagatttttgcaataagtatatgagttctttatgactaacgttgagtcaatggattatatgcactttttgccatccttccaccattgctagcctctctaataccgcgcacctttcgcccgtatcatacacccaccatataccttcctcaaaacagccaccatacctacctatcatggcatttccatagccattccgagatatatttccatgcaactttccaccgttccgtttattatgttacgctcc

SEQ ID NO: 30607 - DNA, 1828 bp, Triticum aestivum
  unsure (1)..(1828): unsure at all n locations
  Clone ID: PAT_TA_30607
cggggcatccccaatttcttcttcaacaactatcggttagtatcggttgagcctaagtttttgcttcttcacatgagttgtgctatccttgcattgtcattttattttgttttgcttgatgcttgaatacaataccaagatctgaaatcctttaatgagagagagtatttgcatagttgcataattatttagctactcattgatcttcacttatatctttcggagtagtttttgttgtttgctctagtgcttcacttatatcctttagagcatggtggtagttttattttgaagaaatatatgatctatcatgcttcacttagattattttgagagtcattaatagcatggtaattttcttaaataatcctaatatgctaggtattcaagattagtaaaaactttcttatgagtgtgttgaatactaagaaaagtttgatgcttgataattgttttgagatataaatatggtgatattagagtcatgctagttgagtagttgtgaatttgagatatacttgtgttaaagtttgtgattcccgtagcatgcacgtatagtgaaccgttatgtgatgaagtcggagcataatttatttatttattgtcttccttatgagtggcggtcggggacgagcgatggtcttttcctaccaatctatccccctaggagcatgcgtgtaatgctttggtttttgatgacttctaattttttgcaacaagtgcatgagttcttttgattaatgttgagtccatggattatacgcactctcacccttccaccattgctagcctctctaataccgtgcaccttttgccggtatcatacacctaccacataccttcctcaaaacagccaccatacctacctatcatggcatttccatagccattccgagatatattgccatgcaactttccaccgttccgttcatatgacaaacattacttttgtcatattgctttttgcatgaacatgtagttaatatctattgatgggcatctccatagcccgttggtacgcctagttgatgtgagactatcttctccctttttgtcttctccacaaccaccattctattccacatatagtgctatgtccatggctcacgctcatgtattgcgtgaagattgaaaaagtttgagaacgtcaaaagtatgaaacaattgcttggcttgtcatcggggttgtgcatgatttaaatactttgtgtggtgaagatagagcatagccagactatatgattttatagggataactttctttgggcatgttattttgagaagacatgattactttgttagtatgcttgaagtattattattttatgtcaatattaaacttttgtcttgaatcttatggatctgaatattcttgccacaataaagagaattacatggataaatatgtttggtagcattccacatcaaaaattctatttttatcatttacctactcgaggacgagcaggaattaagcttggggatgcttgatacgtctccaacgtatctataatttttgattgttccatgctattatattacctgttttgaatgattatgggctttattatacacttttatattacttttgggactaacctattaactggaggcccagcccatattgctgttttattgcctgtttcagtatttcgaagaaaaggaatatcaaacggagtccaaaaggaatgaaaccttcggcaatgtgattttttggaagaatatcatcttggagacgtggactccaagttagaagatactcgaggactccacgagataggagggcgcccccctgtanggcgcgccccctgtctcgtgggcccctcga

SEQ ID NO: 30608 - DNA, 1446 bp, Triticum aestivum
  Clone ID: PAT_TA_30608
gagcgggaaagaggggctgcgccccctcccttagtccaattaggactcctcatgggagggggcgtgccacctcctggctgctgccctctctctcccctcaaggcccactaaggcccaatacttccccggggggttccggtaacccctccggcactccggttttatctgaaacttctccggaacacttccggtgtccgaatatagtcgtccaatatatcaatctttatgtctcgagcatttcgagactcctcgtcatgtccgtgatcacatccgggactccgaacaaccttcggtacatcaaaacatataaactcataatataactgtcatcgtaacgttaagcgtgcggaccctacgggttcgagaactatgtagacatgaccgagacacctctccggtcaataaccaatagcggaacctggatgctcatattggttcctacatattctacgaagatctttatcggtcaaactgcataacaacatacgttgctccctttgtcatcggtatgttacttgcccgagattcgatcgccggtatctcaatacctagctcaatctcattaccgacaagtctctttactcattccgtaatgcatcatcccgtgactaactcattagtcacattgcttgcaaggcttatagtgatgtgcattaccgagagggcccagagatacctctccgacaatcggagtgacaaaacctaatcttgaaatatgccaacccaacatgtacctttggagacacctgtagtactcctttataatcacccagttacgttgtgacgtttggtagcacccaaagtgttcctctggtaaacgggagttgcataatctcatagttacaggaacatgtataagtcatgaagaaagcaatagcaagtatactaaacgatcaagtgctaggctaacgggatgggtcatgtcaatcacctcattctcctaatgatgtgatcccattaatcaaatgacaacacatgtcaatggttaggaaacataaccatctttgattaatgagctagtcaagtagaggcatactagtgactatatgtttgtctatgtattcacacatgtatcatgtttccggttaatacaattctagcatgaataataaacatttatcatgatatgaggaaataaataataacttttattattgcctctagggcatatttccttcacccataacccacaggtctactggatcgaaaccagactcttctttacaacccggattctaatgtatcttttgcacctggcttcgtgtgtgattcacgagctaaatgctatactattattcatcctggaatcaaacaccatgttattctcgttgttcaaacccccattctagcttctgtctagtcactgaatgattgcctacccgtttggaactttggtaccatcgtgtattgcactcaacgaattcactgaaatacaactcatggggt

SEQ ID NO: 30609 - DNA, 1277 bp, Triticum aestivum
  Clone ID: PAT_TA_30609
caatcttagagcatcttttgcatttagttttcatttttattttatgcaccatgctggtatgagatagtccttggtttatttatagaatgctctatgcacttcacttatatcttttgagtatggctttatagaatgcttcatgtgcttcacttatatcatttgaagcttggattgcatgtttctctttacatagaaaacctccatttgtagaatgctcttttgcttaagttatatttgttagagcatgggcatatcttttgtagaaagaattaaactctcttgcttcacttatatccatttagagagatgacaggaactggtcattcacatggttagtcataaaatcctacataaaacttgtagatcactgaatatgatatgtttgattccttgcaatagttttgcgatataaagatggtgatattagagtcatgctagtgggtagttgtggattgtagaaatacttgtgttgaagttcgtgattcccgtagcatgcacgtacggtgaaccgttatgtgatgaggtcggagcatgatttatttattgattgtcttccttatgagtggcggtcggggacgagcgatggtcttttcctaccaatctatccccctagtagcatgcgcgtagtactttgtttcgataactaatagatttttgcaataagtatgtgagttctttatgactaatgttgagtccatggattatacgcactctcacccttccaccattgctagccattctaataccgcacacctttcgccggtatcatacacccaccatataccttcctcaaaacagccaccatacctacttatcatggcatttccatagccattccgagatatattgccatgcaactttccaccgttccgtttattatgacacgcttcatcattgtcatattgctttgcatgatcatgtagttgacattgtatttgtggcaaagccaccgttcataattctttcatacatgtcactcatgattcattgcacatcccggtacactgccgggggcattcatatagagtcatatcttgtcctaagtatcgagttgtaattcttgagttgtaagaaaataagagtgtgatgatcttcattattatagcattctcccagtgaggaaaggatgatggagactatgattcccccacaagtcgggatgagactccggacgaaaataaaaaaaggcaaaaaaagaaggcccaaaaaaacaaaaaaacaaaaaaatgagagactagttcacctcggccgcgaccacgctaatcactagtgaattc

SEQ ID NO: 30610 - DNA, 802 bp, Triticum aestivum
  Clone ID: PAT_TA_30610
ggaaatttaacagcgagaaagtagcgtcattggcttatggtaggatccagggaaggaatgcactaatctcacatttccagaattcaagtttgatgaacgaggacaagagatgccgccccattctgtttcattccaatggaccagagactggaaatcaggaaccattcccgaacgggatatgcatccacatgcctctggatggtggggcaggctccagcaaggagcccctcggctttgaagaggacgacaatcccaacgagatgaagatatccggggagaaatccatggcggggagtttgtagattatataaccaacgaagaggctcggagtcgccgccgcggagtctaactgtcttgtgacgaaaggcggtatccacccccaaactgtataaaagtgaggaagattggttcagtagtgcaggaattgtggcgtggcgtggaatgggcgcatctaccggtttttgtcgcagcggatgtcgcccccctgaagcagcggctttgaatcgcagtctgggagtttgctaggtccccccctcttttgaccccccgaactctgtacagatagatgtggggagttgatgatgactggatgatgatgatgcttttggtttggttttctgtaaagaacaccaattgtacagtcggatggatacttgtgctagttctgcatgcttttatttttctgtatggttgaaactcaactcaagacgggtctaatcgggtgatgccagtgtggaaatatgaatccccacattgtgcattgtgggtgaaaaaaaaaaaaaaaaaaaaaaaaaaaaaaaaa

SEQ ID NO: 30611 - DNA, 1808 bp, Triticum aestivum
  unsure (1)..(1808): unsure at all n locations
  Clone ID: PAT_TA_30611
ggtcgaccggtgctctagtgctacacatatatcttttagagcacggcggtggttttattttatagaaataattgatctctcatgcttaacttatattattttgagagtcctttagaacaacatggcaatttgcttttaggcataataagaagctttcatataagtgcattgaatactaagaaaagtttgatgcttgatgattgttttgagatatggagatagtgatatcaaagttgtgctagttgagtagttgtgaatttgagaaatacttgtgttgaagtttgcaagtcacgtagcatgcacatatggtaaacattgtgtaacaaatttgaaacatgaggtgttatttgattgtcttccttatgaagtggcggtcggggacgaagcgatggtcttttcctaccaatctatccccctaggagcatgcgcgtagtacttcgttttgataactaaaatatttttgcaataagtatgtgagttctttatgactaatggttgagtccatgggattataccgcattctcacccttccagcattggctaagcctctttaataccgcgcacctttcgccgggtatcatacacccaccatataccttcctcaaaacagccaccatacctacctatcatggcatttccatagccattccgagatatattgccatgcaacttaccaccgttccgtttattatgacacgctccatcattgtcatattgctttgcatgatcatgtaattgacatcgtatttgtggcaaagccacctttcatgattttttatacatgtcactcttgattcattgcatatcccggtacaccgccggaggcattcacatagagtcatattttgttctaagtattgagttgtaattcttgagttgtaagtaataaaagtgtgatgaccatcattattagagcattgtcccaagtgaggaaaggatgatggagactatgattcccccacaagtcgggatgaggcccagactaaaaagaaagaggccataaaaaaagagaaaaggcccaaataaataaataaataaatgagaggaaaagagagaagggacaatgctactatccttttaccacacttgtgcttcaaaatagcaccatgatcttcatgatagagagtctccaatgttgtcactttcatatactagtgggaatttttcattatagaacgtggcttgtatattccaatgatgggcttcctcaaaatgccctaggtcttcgtgagcaagcaagttggatgcacactcacttagtttcttttgttgagctttcatatatttataactctagtgcatccgttgcatggcaatccctactcactcacattgatatctattaatgggcatatccatagcccgttgatatgcctagttgatgtgagactatcttctccgcttttgtcttctccacaaccaccattctattccacatatagtgctatgtccatggctcacgctcatgtattgtgtgaaagttgaaagagtttgagattattaaagtatgaaacaattgcttggcttgtcatcggggttgtgcatgattaaatactttgtgtgatgaagacagagcaatagccagactatatgattttgtagggataactttctttagccatgctattttgagaagacatgattgctttgattaagtatgcntgaagtatataattttangtaatatgaacttggtctggaaattccggatctgaatatccatactacaattaataagattacattgaattatgccaagtncacnccgcaacaaaatcctttttacatttaccacccaaggggggccg

SEQ ID NO: 30612 - DNA, 1371 bp, Triticum aestivum
  Clone ID: PAT_TA_30612
tcggcacgaggcctcctcctacctgcctgttcacctcgctcccgtggacgcccgtgcgccgtccagcacgcggatgtcgtgctgccgcccatcccgcggttgaagagttggataagagccctccctcgacgcccctctctctgccatgaaccctagctccctccattttcccctctggcgccgttctccaccaaatcgagccgcgttcgagagctcccatggctgcgccgtcgacgttggcgcggacaccggcctcccctcgcctatccagcaggtccaggagacgcgcaccttcaccctcttcgtctacgacaagtcgcgcgagcagggacgccctcacgccgccgcaatcgtcgatccccatcgtcggccgtcgcttctacctcgtcgtcgacccgccgctgcctgcgctcccgttcattcgaagagccaccatgtgctccctgaccccatgacggctaccgatgtcgctgtaatcgactacgtcgacgatgaccctccttctcgcctgagcaaccagatggtggatccttggagccagatgccaccgccgatggatgcaactacatggagaccgccgatgaccaggagtagttaggaggtcccaggcgggaggccttggctcttcgatcgtgttgcttttgtgctagccttcttaaggcatccttgtttaacttatttctgtactcaaatattgttgcttccgctgactcttgtgtatcgagctatgtattcgagccctcgaggcccctggcttgtaatataaagcttgtattattttgatttgtggtaatcttctttcgcggtgtgtttgttgagatccgatgaattgtggatttatgatcagattatctattaatattatttgagtcttctctgaactcttttatacatgattgagatagctttgtatttctctccgatctatcgatttggtttggcctactagattgatttttcttgcaatgggagaggtgctttgtgatgggttcaatcttgcggtgtcctttcccggtgatagtaagggcagcaaggcacgtattgtattgttgctatcgaggataacaagatggggttttcttcatattgcatgcgtctatccctctacatcatgtcatcttgcttaaggcgttactctgtttttaacttaatactctagatgcatgctggatagcggtcgatgagtggagtaatagtagtagatgcaggcaggagtcggtctacttgtctcggacgtgatgcctatatacatgatcatacctagatattctcataactatgctcaattttgtcaattgctcaacagtaatttgttcacccaccatagaatacatatgccccgtcgacttctgtcgtcttctcgcagccgta

SEQ ID NO: 30613 - DNA, 661 bp, Triticum aestivum
  Clone ID: PAT_TA_30613
gccggccgggtcgggctagacccccagttccctcttttccccctcgcactcgatccggaagaggagccgaagcttctgtcgtcgtgccatagtcaccatcgcggccacaggcctccccaacgcacgggaagatgcccaggagctccctcgtcgacgactccttcaccaacctccgctgattcgagctgggccgcgctgtgcgctcgggatctaggcggttattcgtcacggccgccaccgttcgtcgacgagcgcgacgcatccgaccactcccgcgctctctaatcacgtccacaagctccgtgacgatggagcccaggagccagacgccaccgttggcgacgacccctactacactggaggtgcctactactacgtgcagcccgctgacgacgaccgggagtagtttaggaggatcccaggcaggaggcctgcgcctctttcgatctgtatcccattttgtgctagccttcttaaggcatactcgtttaacttatgtctgtactcagatattgttgcttccgctgactcgtctatgaccgagcacttgtattcgagccctcgaggcccctggcttgtattatgatgcttgtatgacttatttaaaaaaaaaaaaaaaaataaaaaaaaaaaaacaaaaaaaaataaaaaacaactaatg

SEQ ID NO: 30614 - DNA, 1519 bp, Triticum aestivum
  Clone ID: PAT_TA_30614
agtacgtttaacaccaatataaataaagaatgtgttcattacagtaccttatgtggtggttttgcgttcttgcactaacggtgcttatgagatttcctgttgagttttgtgttgtgaatttttcaagttttgggtaaagatttgatggactatggaataaggagtggcaagagcctaatcttggggatgcccatggaaccccaagatattcaagaatagccaaaggcctaagcttggggatgccccgggaaggcatcccctctttcgtcttggtttatcgataactttacttggagctatatttttattcgccacatgatatgtgttttgcttggagtgtcgtgtattatattagtctttgctttttagtttaccacaatcatccttgctgtacacaccttttgggagaagcctatttgattagaattttctagaatactctatgtgcttcacttatatcttttgaacttgatagtttttgctctagtgcttcacttatattttttagagcatggtggtgtcttaattttgaagaaattactagtctctcatgcttcacttatatctttttgagagtcttttagaacagcatggtatttgctatgatcataaagttggtcctggaatgatgagcatccaagttgggtataataaaaactatcgtagaaagtgaattggatgctatgatcaatttgatgcttgataattgttttgagatatggaggtagtgatattaaagtcatgatagttgggtgattatgaatttaaagaatgcttgtgttgaagcttgtgattcccgtagcatgcacgtatggtgaaccgctttgtgatgaagttggagcagaattttatttattgattgtcttccttatgagtggcggtcggggacgagcgatggtattttcctaccaatatatccccctaggagcatgcgcatagtgctttggtttttgatgacttctaaatttttgcaacaagtatatgagttcttttgactaatattgagtccatggattatacgcactctttcacccttccatcattgctagcctttcttgtgccgcacaactttcgccggtaccatacacctaccatataccttcctcaaaacatccatcatacctacctattatggcatttccatagccattccgagatatattttcatgcaactttccaccatgtcgttcatatgacacgcattacttttgtcacattgctctttgcatgatcatgtagttgacattgtatttgtggcaaggccaccttcataattttcatacatgtcgctcttgattcattgcatatcccagtacaccgtcggaggcatccacatagagtcatgtcttgttctagctttaagttgtagtttttgatttgtaaatccataaaagtgtcatgatcttccttattagagtattgtcctagtgaggaaaggatgatgaagactatgattcccccacaagtcgggatgagacttcggactttataaaaataaaagaggccaaagatgcccacc

SEQ ID NO: 30615 - DNA, 1974 bp, Triticum aestivum
  Clone ID: PAT_TA_30615
gggccgacgggctatcttagaagaggtttcaatcgattatgatgagaacaaagttgctacttatgataattattgtgatgatatgtatgctatacaaagtagtgatgattatattaaaacttgtcatgattatgattaccctttttctgaatattactcttttaatgtggaaacaatttatagtattcgagtttcttatgatactcccactattccgaatgagaagaattttgcttatgtggagagtaataaaatttctatgcttgtagatcatgaaaataatgctttatgtaatggtcatattgttgaattcattcatgatgctactgaaaattattatgagggagtaatatatgcttgtaggaattgcaataatatcaagtttcctctctatgtgcttaaagttttgaagttatgcttgtttttccctcctatgctagttgattattgttcccagaagttgttttctcagaaaatccatatgcatacgaagtgggttagacttaaatgtgctagtcatattcttcatgatgctctctttatgttacaattcttatcttttatgtgagcatcgttgagatcatcatgcctagctaggggcgttaaacgatatcgcttgttgggaggcaacccaattttattattattctttctttttgttcctgtttagtaataaataatttatctagcctctattatggttgtgttttttgtgtttaactagtgtttgtgccaagtagaacctttgggaagacttgggggaagtcttgttgatcttgctgtaaaaaacagaaactttagcgctcacgagattagctacaactgtttactggagagttatatttagttgattatttttgaagatgattaatagataaatccctcacgtccagaaatttatttcagaattttttgagttccataagtagacgtttgatatagattactacagactgttctgtttttgacagattctgttttccgtgtgttgtttgcttattttgatgaatctatggctagtaaaatagtttataatccatagagaagttggaatacagtagttttaacaccaatataaattaagaatgagttcattacagtaccttgaagtggtcttttgttttctttcgctaacggagctcacgagttttctattttgagttttgtgttgtgaagttttcaagttttgggtgaattcttttgatggatcatggaacaaggagtggaaagagcctaagcttggggattcccatggaacccccaagataatccaaggacaccaaaaattcaaagcttggggatgccctggaaggcatcccctctttcgtcttcattcattggtaactttacttggagctatatttttattcaccacatgatatgtgttttgcttggagcatcatttttttgcttgatgtttgaataaaataccaatatctgaaattattaaatgttagagagtcttcacatagttgcataattattcgactactcattgatcctcacttatatcttttggagtagtttgtcatttgctctagtgcttcacttatatctttttagagcacgatggtagttttattttgaagaaatatatgaactctcatgcttcacttagattattttgagagtcctaaacagcatgttaatttgctttggttatgaatttaatcctaatatgatgggcatccatcagggatatacttgtaactttcatatgaagtgcactgaatactaagagaagtttgatacatgataattgttttgagatatgaagatggtcagtggcggagccaactcaagtttagagccggggcaagatctacatgctgccaaattacttactttctacccaaacaaacgtccacttcacccaattttctctactaaagcttcatggacttgcaccaagggaacccgggcaagtgccccagcgtcacacgtgctgtcaccgccactgaagatggtgatatt

SEQ ID NO: 30616 - DNA, 1141 bp, Triticum aestivum
  Clone ID: PAT_TA_30616
ggccccctcgccgacctcgggagccatcatccacggacccgccgccgccgtcgagcactcgagcgcagcggagcggaccacagccggtgctagggcttcggttcgagggaggatggggaagtcgaagagcaagggcgccaagttcgccgccgtgaagaagatcatcagcaagaagaccatcaagaagtacaaggacgaggtgctggacccgcggaagaagcacaccgagaaggagaagctcggccggaatgtgccgcaggtgtcgtcggcgctcttcttcagctacaacatggcgctcgggccgccctaccgggtcatcgtcgacaccaacttcatcaatttctccatccagaacaagttggatttggagaaaggaatgatggactgcctttatgcaaaatgtaccccctgcatcactgattgtgttatggctgagcttgaaaagctaggacaaaaataccgtgtcgcgttgagaattgctaaggaccctaggttccagagattagcgtgcacacacaagggaacttatgctgatgactgtattgttgagagaattactcagcacaaatgctacattgttgccacctgcgatagagatttaaagaggagaataagaaaggttcctggtgttccaatcatgtacatcacccaacacaggtactcgatagaacgactccctgaagctacaattggtggagcaccaagaatctgattagccatgcgctggtaccaaacaccatcacagttgcccagattccttgatttaggatggatatgagtactgccgtgctgaatcgagctgattgtaaccacttcaaaatcgtgtaccaacctccttaggggcatcgttttcataaattttggaagaaactttagaagaaagtgtatcgttgtcctctgttttgaactgaactgtagccaacttcccagcttgcttggtgttgttaatgttgcagactctagaatatattttatgtaatatgtaagtgttgtcatatggttcagtgctttggcatgcttctggttcattgcactcagttgccaagccaacatattgttctgggtcttggattttgtaaactatctgttctgaaaggaaatgagctcagtgtaaaaaaaaaaaaaaaaaatgcgagactgt

SEQ ID NO: 30617 - DNA, 654 bp, Triticum aestivum
  Clone ID: PAT_TA_30617
acgaggcgcactctcgctcgcgtccagatccaccttgccgtgcgcccgcatcaccatggccgacctcacccgcacacccacttagctccccgctgtacctgctttctccagaagaacaaccgccgactacctcgtctactggagccacctgttggagttgaagctctctgcatcaaccacgacgatgtcttcttcatcctcgtcaccgaccgctgccctgctgttgattcccctatctccgaacctccccagagccacccgggcctcgtcgagctcgccaccggccctccccatgactacgagactgacgttgctgctgcccagttcgactacggagttgacgacccctccttcttgccaagagcaaccagactacgagaccgacgctgctgctgtccagttcgactacggagttgacgacccctccttcttgccaaagcaaccaggtatggtgaactctcatggcaaaactgggtttaaggatatttggaagcacaagtagtatctctacttggtgcgagaaatttggctagcatgagggggaaaagcaagctcaacatgtttggaaggtcaatgacaatatagtttaactgagatgtcggaaaacataaaccattacgttgtcttccttgtacctcggccgcgaccacgcta

SEQ ID NO: 30618 - DNA, 1633 bp, Triticum aestivum
  unsure (1)..(1633): unsure at all n locations
  Clone ID: PAT_TA_30618
tgcggctcttaggggcgccagatgaaggaaatatgccctagaggcaataataaagttgttatttatattttcttatatcatgataaatatctattattcatgctagaattgtattaaccggaaacttgatacatgtgtggatacatagacaaaacagagtgtccctagtaagcctctactagactagctcattaatcaaagatggttaagtttcctaaccatagacatgtgttgtcatttgatgaacatgatcacatcattaggagaatgatgtgatggacaggacccatccgttagcttagcataatgatcgttaagttgtattgctattgctttcttcatgacttatacatattcctatgactatgagattatgcaactcccgtttaccggaggaatactttgtgtgctaccaaacgtcacaacataaatgggtgctaagctaacggaatgggtcaagtcaatcacgtcattctcctaatgaggtgatcccgttaatcaaatgacaactcatgtctatcgctaggaaacataaccatctttgattaacgagctagtcaagtagaggcatactagtgacacactgtttgtctatgtattcacacatgtattatgtttccggttaatacaattttagcatgaatnataaacatttatcatgatataaggaaataaataataacttattattgcctctagggcatatttccttcagtcttccacttgcactagagtcaataatctagattacacagtaatgattctaacactcatggagccttggtgctgatcatgttttgctcgtggaagaggcttagtcaatgagtttgctacattcagatccgtatgtatcttgcaaatctctatgtctcccacctggactagatcccggatggaattgaagcgtctcttgatgtgcttggttctcttgtgaaatctggattccttttgccaaggtaattgcaccagtattgtcacaaaagattttcattggacccgatgcactaggtatgacacctagatcggatatgaactccttcatccagactccttcatttgctgctttcgaagcagctatgtactccgcttcacacgtagatcccgccacgacgctttgtttagaactgcaccaactgacagctccaccgtttaatataaacacgtatccggtttgcgatttagaatcgtccggatcagcgtcaaagcttgcgtcaacataaccatttacgatgagctctttttcacctccataaacgagaaacatatccttagtccttttcaggtattcaggatgttcttgaccgctgtccagtgctccactccgggattactttggtaccttcctgctatgcttatagcaagacatacatcaggtctagtacacaacattgcatacatacatgatagaacctatggctgaagcatagggaatgactttcattttctctctatcttctgcggtggtcggtgagggagtccgggattaaggggtcctcggacagccggactatatactttggctggactgttggactgtgaaaatacaagattgaagacttcgtcccgtgtccggatgggactctcctttgcgtggaaggcaagcttggcaattcggatatgtagatctccttct

SEQ ID NO: 30619 - DNA, 656 bp, Triticum aestivum
  Clone ID: PAT_TA_30619
gatcgggccgttcccccttccccctcgccgcgtccccgacgccacctcgcttagggcccccctcgtcggagcctcccgacgccgccgcacgccatctcctcccgcacgatgcctccccctcgacgcggactgaatcggcggctcgatcccgcggcgccccgagccctgacgccgtgccgtcgctgctcaccaccacctcgtcggcgtcgcctcgtcttcgtcctcctccccatcggacgcccccacgcctcgacgcccccctgctctccaacgccgaccccgagaccgatgttgatgtccctgtgatcaactacgtcgacgatgaccgtccttcttgtctgagcaaccagatggtggatccttggagccagatgccaccgccgacggatactgctacgtggagaccgccgatgaccaggagtagttaggaggtcccaggcaggaggccttgcctcttcaatcgtgttgcttttgtgctagccttcttaaggaaaactttgtttaacttatgtctgtactcagatattgttgcttccgttgatctcttgtgtatcgagctatgtattcgagccctcgaggcccctggcttgtaatataaaacttgtattatttcatttggtgtccaaaaaaaaaaaaaaaaaaaaaaaaaaaaaaaa

SEQ ID NO: 30620 - DNA, 570 bp, Triticum aestivum
  Clone ID: PAT_TA_30620
ggccccggtttcgggattcgacgccacgcgtccgcccacgcgtccgcgagggcaaagaactctagtacatacgtaagtgtagctagcctcctcctgtaccgcacaccatggcggtcctgaagaagaacacgagctccctgagcttcgtcgtggccgccctcatggtggtcatggctgccacccttctcctctcctcgtgcgacgcccgcaaagtgaaggataagcccatcgctttccccgtgccggggaagtgctacgcgaggtttttcccgaactgcaccgagccgcggtgcaaaaagttctgcgtccagccgctccccggagcagtctgcctcgacaaaaaacctgctgctgccctgttgcttaactataagtgccgctgaagcgatcgagccaagaaacggtgaaagatgacaataagcaatcttggtacacctccaaatacatagtccttatttgttaacgttgtccctatttatgacctgtcaaccaaagatttgtgtattgtattaatgtgtgtattatatcaccacaacaatgtgcctgctattagcaataatgagtaccaaa

SEQ ID NO: 30621 - DNA, 1537 bp, Triticum aestivum
  Clone ID: PAT_TA_30621
tattataataacagatctcacgaaggtttttgttaagttttgtgtgggtgaagtgttcaaagatcgaggaggtctcgatatgaggagaaggaggagaggtaggagttcaagcttggggatgcccaagtaaatatgcgaggagactcaagtgtctaatcttggggtaccccggaaggcatcccatctttcttcaacaagtatcgatatgtttcagttttcgtttcgttcatgtgatatgcttaaatcttggagtgtcttttgtgtttagtttttgctttttattttatgcacaatgctggtatgatatagtccatggttgatttatggaattctctttgcacttcaattatatcttttgagtatggctttatagaatgcttcatgtgcttcacttatatcttttgaagtttggattgcctgtttctcttcacataaaaaaccgccatttgtagaatgctattttgcttcacttatatttgttagagcgtgggcatatcttttgtagaaaggattaaactatcttgcttcacttatatctatttagagagatgacaggaactggtcattcacatggttagtcataaaatcctacataaaacttgtagatcactgaatatgatatgtttgattccttgcaatagttttgcgatataaaatggtgatattagagtcatgctagtgggtagttgtggattgtagaaatacttgtgttgaggattgtgattcccgtagcatgcacgtatggtgaaccattatgtaacgaagttggagcatgaggtatttattgattgtcttccttatgagtggcggtcggggacgagcgatggtcttttcctaccattctatccgcctaagggcatgcgtagtagtactttgcttcgagggctaataaacttttgcaataagtatatgagttctttatgactaatgtgagtccatggattatacgcactctcacccttccaccattgctagcctcttcggtaccgtgcattgccctttctcacctcgagagttggttcaaacttcgccggtgcatccaaaccccgtgatatgatatgctcacacataagccttattatatcttcctcaaaacagctaccatacctacctatcatggcatttccatagccattccgagatatattgccatgcaacttccatcatcatcatatacatgacttgagcattcattgtcatattgctttgcatgatcgtaagatagctagcatgatatttttatggcttgtccatttttgatatctttggtacgctagatcattgcacatcccggtacaccaccggaggcatccatatagagtcatactttgttctagacattgagttgtaatattgagttataagtaaataaaagtgtgatgatcatcattattagagcattgccccagtgaggaaaggatgatggagactatgattcccccataagtcgggatgagactccggacttcacaaaagaataaaagaggccaaagaagcccaccaaaaaaataaaaatatataaaaaaaaaaaaaaaaa

SEQ ID NO: 30622 - DNA, 1013 bp, Triticum aestivum
  Clone ID: PAT_TA_30622
ggcacgaggccacgacgaggggcggacccacccatcggacgaggtccgtcgccggacattccagccggtggtgagcggagggcggcaaggcgtgggagctcgcggcgacgtacaaggctgggtgagagtggcgcttgagtcagggtgcttgaggcggacggccaactccgacaggggacccctcagccgacgacgccaccgtctctgatctatttcaccagcaaccgctggagctgataggaagttggtcagcattagctgcttcaggcttctggccggtgtgaaaagttgctaggtcaccatggatgtcgatcgacaagaaacgatggaagagaccattctcgtcggtgatgatcttatgcgtgggccaccttcccctgtcgtaccgaaagagattgcatcccatgtccttgaaggtgttgagctttgtgatggtatcctgaagaatcttttcctatgcttgcaaatcaatgatattgagccattttgtcaagatgagattgtgctatacaaacaatgtgctgagaaaagggataaggaaataagggaacgacttcaggatagtgagtataaattaggtttctcgatgcccctcgaagatgcaaaggaaagagtcactcaactccaatcagaactcacactgctcgaaaggcgcatgattcttgctagtggtcttccgggtatggaaggatttcgccaacgatggagcttgcatggacagcttggcgatacaaggaaaaggttggaggcgctgaacagtgggatggcaaaaagagagagcccaagtcctccaggcgaaggcacaacacctgcagttaagaagaggtggttcttttagtacgttagcgcatatttttccgacttgcaaaacgttgtaactaatgctgtgttagtggcaatgtcatccactctttcttggtttggggttctacctccaaagtaactactactgtgtttgctaacagtggtttcgccacagctgcacttttgattaaaaatatggaaataaaaaa

SEQ ID NO: 30623 - DNA, 802 bp, Triticum aestivum
  Clone ID: PAT_TA_30623
tggcacgaggttccctctctccctccccacagatctcccatgccccaagcacgtccatggccgcgtcatcgtcgttcccatggccggagccgtccccgacccgtgaggttatgctctgcagctccgttggcctcgtctgcatcgcctacaaccttcggttcgagctgaagccctccacaacctcgccatctggtcgtcttccccgccacggccacggcgccatcgccgtcgatctccatcaccggcgcctcccggcggttccaggcacgtccacgacctccctcgaaacaccgagatcgacgccactgctacccaagtacgactacggagttgacgaaccctctctcttgccaagagcaaccagatgctggagccctggagccagacgccaacatcgatgacgaccccctactacaccggaggtgcctactactacgtgcaggccgctgacgacgaccaggagtagtttaggaggatcccaggcaggaggcctgcgcctctttcgatctgtatcccagtttgtgctagccatcttatggcaacttgtttaacttatgtctgtactcagatatttgttgcttccgctgactcgtctatgatcgagcacttgtattcgagccctcgaggcccctggcttgtattatgatgcttgtatgacttattttatttttagagttgtgttgtgatatcttcccgtgagtccctgatcctgatcgtacacgtttgcgtgtatgattagtgtacgattgaatcgggggcgtcacagggggagttgtaattgtcttagactcgagacgtaaag

SEQ ID NO: 30624 - DNA, 1716 bp, Triticum aestivum
  Clone ID: PAT_TA_30624
caaataaaaaggtgcatgcgatagaagaaattaatgttttgagtggaaagatggatgaacttatgaaattatttgctaataagagtgtttcttctgatcctaatgatgtgcccttttctactttgattgaaaataataatgaatctatggatgtgaattttgttggttggaacaattttggtaacaacgcgtataggggaaatttcaatcctaggccttatcctagtaatccgtctaataattatggtaattcctacaacaattcttatggaaattataataagatgccctctgattttgaatctaatattaaggaatttatttctttgcaaaagaattttaatgctatgattgaagaaaatttgattaagattgatgatttgtctaggaacgttgatagaattgctcttgatgttgatgctttgaaacttagatctatcccacctaagcatgatatcaatgagtctctaaaagccatgagaatttcaattgatgagtgtaaagaaagaaccgctatgatgcgtgcttcaaaagatgcctttattaaagcgtgttcttccaattcctatgaaaatcaagatgaagatctaaaatttattgatgtgtctccaattaaatctttattttgcaatatgaatcttgacgaaactgaatatgatcttcctttacctagaaggcgctctaaaaattcagagtatttagatcttaatgatgaaattgatgaaagtgggattgaaagaaataaaaatctagatgctaaacccactatattggatttcaaggaatttaattatgaaagttgctctttaattgagtgtatttccttgttgcaatccgtgctaaattctccacatgcttatagtcaaaataaagccttcaccgaacatattgttgatgccttgatgcaatcttatgaagaaaaacttgagttgaaagtttctatccctagaaaactctatgatgagtgggaaccaactattaaaattaaaattaaagatcatgagttttatgctttgtgtgatttgggtgctagtgtctctactattcccaagactttgtgtgatttgctagattttcgtaattttgatgattgttctttaaatttgcatcttgcggatttcactattaataaacctatgggaaggattaattatgttcttattgttgcaaataggaattatgtgcctatatatttcattgttcttgatatatattgcaatcctacacgtcctattattcttggtagatctttccttagaacgattggtgtaattattgacatgaaagaaggaaatattagattccaatttccattaaggaaaggcatggaacactttcctagaaagaaaattaaattactttatgaatctattatgagatccacttatggattgcataccaaaaatgacaatacctagatctattcttgtttttatgcctagctaggggcgttaaacgatagcgcttgttgggaggcaacccaattttattttcgtttcttgttttttgttcccgtttagcaataaatggttcatctagtctatgtttggatgtggttttatgttttaattggtttttgtgccaagtagaaccttcgggaagacttgggggaagtctttgcggtcttgctgtaaaaaacagaaactttagtgctcacaagattttatgccattttttactaaagagtgccattaggttgattaattttaagatgat

SEQ ID NO: 30625 - DNA, 956 bp, Triticum aestivum
  Clone ID: PAT_TA_30625
gtgttttgcttggagcgtcgtgtattatattagtcttttctttttagtttaccacaatcatccttgctgtacacaccttttgggagaagcctatttgattagaatttgctagaatactctatgtgcttcacttatatcttttgagcttgatagtttttgctctagtgcttcacttatatcttttagagcacggtggtgacttatttttgtagaaattattagtctctcatgcttcacttatatctttttgagagtcttttataatggcatggtatttgctatggttataaaattggtcctagaatggtaggcatccaagttgggtataataaaaactatcgtagaaagtgaattggatgctatggtcaatttgatacttgataattgttttgagatatggatgtagtgatattaaagtcatgctagttgggtgattatgaatttaaaaaatacttgtgttgaagttagcaagtcccgtagcatgcacatatggttaaagttgtgtaacaaatttgaaacatgaagtgtccttggattgtgcatccttatgagtggcggttggggacgagcgatggtcttttcctaccaatctatccctctaggagcatgcacgtagtgcttggtttttgatgacttccaaatttttgcaataagtatatgagttcttttgactaatgttgtgtccatggattatacgcacttttacctttccatcattgctagcctcttcggtaccgcgcattgccctttctcaccttgagagttgctgcaaacttcgccggtgcatccaaacccgtgatatgatacactctatcacacataaacctccttagatcttcctcaaaacagccaccatacctacctattatggcatttccacagccgttccgagatatattgccatgcaactttccaccgttccgtttatcatcatgacacgcattactattgtcata

SEQ ID NO: 30626 - DNA, 2194 bp, Triticum aestivum
  Clone ID: PAT_TA_30626
caataatatcaagtttcctctttatgtgctcaaagtttcgaagctatgcttgttttgccttcctatgctagttgattattgttcctataagttgttttctcacaaaatccctatgcataggaagtgggttagacttaaattttctagtcatattcttcatgatgctctctttatgttacaattcctatcttttatgtgagcatcattgaaattatcatgcctagctaggggcgttaaacgatagcgcttgttgggaggcaacccaactttatttttgtcccttgatttttttctcctgtttattaataaataatttatctagcctctgttatgattgagtttttatgttttaattagtgtttgtgccaagtagaaccgttgggaagacttggggaaagtcttgttgaacttgctgtaaaaaacagaaactttagcgctcacgaggactgctgtcatttttatttgggaagtgctatttagttaattatttttgcagatgattaatagataaatgtctcacgtccagaaatttattttagaatttttggggttccagatcttgcgctagctacagattactaaagactgttctgtttttgacagattctgtttttcgtgtgttgtttgcttattttgatgaatctatggctagtaaaatagtttataaaccatatagaagttggaatacagtaggtataacaccaatataaataaataatgagttcattacagtaacttaaagtggtggtttgttttcttatactaacggagctcatgagattttctgtttaagttttgtgttgtgaagttttcaagcttttgggtaaatatttgatggattttggaacaaggagtggccagagcctgagcttggggattcccaaggcaccccaaggtaaaattcaaggacaagcaaaggcctaagcttggggattctctggaaggcatcccctctttcgtcttcgtctatcggtaaatttacttgaggctatatttttattcaccacatgatatgtgttttgcttggagcgtcttgtatgatttgagtctttgctttttagtttaccacaataatccttgctgtacacaccttttggagagacacacatgaatcggaatttattagaatactctatgtgcttcacttatatctttttgagctagataattttgctctagtgctttgcttatatctttttagagcacggtggtggttttattttatagaaattattgatctctcatgcttcacttatattattttgagagtcttataaaacagcatggtaattttctttggttataaaatttagtcctaatatgataggcatccaagagggatataataaaaactttcatataaagtgcattgaatagtatgagaagtttgattccttatgattgttttgagatatgaagatggtgatattagagtcatactcgttgagtagttgtgaatttgagaaatacttgttctaaagtttgtgattcccgtagcatgcacatatggtgaaccgttatgtgatgaagtcggagcatgatttatttattgattgtcttccttatgagtggcggtcggggacaagcgatggtcttttcctaccaatctatacccctaggagcatgcgcgtagtactttgtttcggtaactaataaatttttgcaagaagtatgtgagttctttatgactaatgttgagtccatggattatacgcactctcatccttccaccattgctagcctctctaatactgcgcacatttcgcgggtatcatacacccacgatataccttcctcaaaacagccaccatacctacctattatggcatttccatagccattccgagatatattgccatgcaacttaccatcgttccatttattatgacatgcttcatcattgtcatattgctttgcatgatcatgtagttcacatcgtattcatggcaaagccaccttcataattctttcatacatgtcgctcttgattcattgaatatctcggtacaccgccagaggcattcacatagagtcatatttttttctaagtattgagttgtaattcttgagttgcaagtaaataaaagtgtgatggtcatcattattagagcattgtcccagtgaggaaaggatgatggagactatgattcccccacaagtcgggatgagactccggacgaaaaaaagaggccat

SEQ ID NO: 30627 - DNA, 650 bp, Triticum aestivum
  Clone ID: PAT_TA_30627
attcggcacgaggtctggatcgagatcggggcagcgagcctgatcccatcatcgccattgccccgcccccttcaccccgtcgtcgaccccgccgcctggacaccgcctgtcgctactcgacgccgtctccctcgtcgcctcgctttccccgactcctctccgtctgtcgtccgcggacctcgccatttgacgccacgccgctgcgccccgaggtcgtcgtcgccaccgcctcgtcctcacccccacgccgctcccgccatcgtgttccccctgcatcgggcctccccttcaacgcggaccccgagaccgctactgatgccgctgtgatcgactacgtcgacgacgaccctccttcttgtctgagcaaccagatggtggatccctggagccagatgccaccgtcgatggatgctactacgtggaggccgccgacgaccaggagtagttaggaggctcccaggcaggaggccttgcctcttcgatcgtgttgcttttgtgctagccttcttaaggcatccttgtttaacttatgtctgtactcagatattgttgcttccgctgactcttgtgtatcgagctatgtattcgagccctcgaggcacctggcttgtaatataaagcttgtattattttatttgtgtctaaaaaaa

SEQ ID NO: 30628 - DNA, 1960 bp, Triticum aestivum
  Clone ID: PAT_TA_30628
cgctagttgggagataacccaattttatttgtgttttttgtttttgtttctgtttagtaataaattttgcatctaacttctgtttagatgtgtttttatgttttaattagtgtttgtgccaagtagaacatataggataacctatggtgatagttaatttgattctactgaaaaacagaaactttgcacgcacgaaattagttttgttatatcacataaacgtgcttttgcgttgattctttttgctgctgatcaatagacaaattgtccaggacttactattttggtaggagttttagagttccaaaagtttgcattagttacagattgctacagactgttctgtttttgactgattctgtttttcgtgtgttgtttgcttattttgatgcatctatggctagtattaagtggtatgaaccatagagaacttgaaatacagtaggtttaacgccaacataaataaagaatgagttcattacagtaccttatgtggtggttttgctttctttcactaacggagcttatgagatttcttgttgagttttgtgttgtgaagtttacaagctttgggtaaagatttgatggactatggaataaggagtggcaaaagtctaagcttggggatgcccatggcaccccaagatattcaagaatagccaaaagcctaagcttggggatgcccccagaaggcatcccctctttcgtctttgttcattggtaactttacttggagctatatttttattcgccacatgatatgtgtcttgcttggagcatcgtgtgttatattagtctttgctttttagtttatcacaatcatccttgctgtacacaccttttgggagaagcctacttgattagaatttgctagaatatgctttgtgcttcacttatatcttttgagcttgatagtttttgctctagtacttcatttatatcttttagagcacggagctgacttatctttgtagaaattgctagtctctcatgcttcacttatattattttgagagtcttttagaacagcatggtatttgctgtgatcataaagttggtcctagaatgatgagcatccaagttgcgtataataaaaactatcctagaaagtgaattggatgctatgatcaatttgatgcttgataattgttttgagatatggatgtagtgatattaaagttatgctagttgggtgattatgaatttaaagaatgcttgtgttgaagtttgtgattcccgtagcatgcatgtatggtgaaccgctttgtgatgaagtcggagcacaattttatttattgattgtcttccttatgagtggcggtcggggacgagcgatggccttttcctaccaatctatccccctaggagcatgcgcgtagtgctttggtctttgatgacttctagatttttgcaacaagtatatgagttcttttgactaatgttgagtccatggattatacgcacttttacctttccatcattgctagcctcttcggttccgtccattgcactttctcaccttgagagttggtgcaaacttcaccggtacatccaaaccccgtgatatgatatgctctatcacacataaacctccttatatttttctcaaaacagccaccatacctacctattatggcatttccatagccattccgagatatattgccatgcaactttccaccgttccatttatcatcatgacacgcattacttttatcatattgccattgcatgatcatgcagttgacgtcgtatttgtggcaaagccaccatgcataatttatcatacatgtcactcttgattcattgcccatcccggtacaccaccggaggcattcatatagagtcatattttgttcaagtatcgagttgtaattcattgagttgtaaataaatagaagtgtgatgatcgccattaatagagcattgtccccaaaaaaaaaaaaaaaaaaaagagaaa

SEQ ID NO: 30629 - DNA, 1651 bp, Triticum aestivum
  Clone ID: PAT_TA_30629
tcccccctctccgttccgcagtgtcagggccgcctatctcctcgttttccaggaaacggtgctgcctccggccccacgggatggcctccggaacctcggcaggtcgcgagccgtacgacgaggaggccgcgagccgccgcccgctcgagctcggcgtccgcgactccgcccccgcttccgcctccgaccaccggtctggaaatattgtgcctagatatcaggtgggatgtactaaagctgatacaagtaagagatacttggagggatggcataagaagcaatctagtacagatgatgtacgcaagagcaagtcaggatacttcacggcattcggggtggacctatctcctgataatatggcagttgccattgtatattttatgcaaggggtcttaggccttgcccgacttgctgtgagcttttacttaaaagacgatcttcaccttgatccagctgagactgcagttatatctggcttctcatccttgccctggttgatcaagccaatctatggctttatcagtgattctattccactatatgggtatcgaagaagatcctatcttattctgtcaggatttcttggaacactttcatggagtctgatggctacagtagtgaacagtaaatatggtgcaggattctctattcttcttggatcactttctgttgccttctcagatgttatgctggagtccaggagtcagacgccaccgtcgacgacgacgactactacaccggaggtatctactactacgtgcaggctgctgacgacgaccaggagtagttaggaggatcccaggcaggaggcctgcgcctctttcaatctatatcccagtttgtgctagccttcttaaggcaaacttgtttacttatgtctatactcagatattgttgcttccgctgactcgtttatgatcgagcacttgtattcgagccctcgaggcccctggcttgtattatgatgcttgtatgacttatttatgtttttagagttgtgttgtgatatcttcccatgagtccctgatcttgatcgtacacgtttgcgtgcatgattagtgtacgattgaatcgggggcgtcacaccctaggggcatgcatagtagtacttttcttcgagggctaataaacttttgcaataagtatatgagttctttatgactaatgtgagtccatggatcatacgcactctcacctttccgcaatttgctagcctctacggtaccgtgcattgccctttctcacctcgagagttggtgcaaacttcgtcggtgcatccaaaccccgtgatacgatacgctctatcacacataaacctccttatatcttcctcaaaacagccaccatacctacctattatggcatttccatagccattccgagatatattgccatgcgacatccaccatcatcatcatgacatacattacttttgtcatattgccattgcatgatcatgtagttgacatcgtatttgtggcaaggccaccatgcattatttttcatacatgtcactcttgattcattgcaccatcccggtacaccgccagaggcattcatatagagtcatatcttgttctaagtttcgagttgtaatccttatgttgtaatcaatagaagtgtgatgatcatcattattagagcattgccc

SEQ ID NO: 30630 - DNA, 1420 bp, Triticum aestivum
  Clone ID: PAT_TA_30630
tgtgttgttctgcctcccactgcagggggctctggggccccggggggggggggggggggttcgtttattcagaaaacaaccccaccgtaaggtttaaaaaaagggctcatatagggcgaattgggcccgacgtcgcatgctcccggccgccatggccgcgggattggaatggggggggtcggtaaaacaaaaaggagaagatagtctcacatcgactaggcgtatcaacgggctatggagatgcccattaatagatatcaatgtgagtgagtagggattgccatgcaacggatgcactagagctataaatgtatgaaagctcaacaaaagaaactagtgggtgtgcatccaacttgcttgctcacgaagacctagggcaatttgaggaagcccatcattggaatatacaagccaagttctataacgtaaaattcccactagtatatgaaagtgactgttggggaacgtagtaatttcaaaaaaatttctttcgccccccgcaagaccatggtggtgcatagcaacgaggggagagtgtgatctacgtacccttgtagatcgacaacggaagcgtttagtaccgcggttgatgtagtctaacttcttcgcgatccaacggatccaagtaccgaacgtacggcacctccacgttcagcacacatttagcttgatgacgtccctcgtactcttgatccagttgaggccgagggagagttctgttgcctggactaaggggtcctcgggcgtccggcctgctatctatgggccggactgatgggccgtgaagacatgaaggccgaagaccgtacccgtgtccggattggactctacttggcatggaaggcaagcttggcgaccgattatgaagattccttcttatgtaaccgactctatgtaaaccctagatccccccggtgtctatataaactggagagtttagtccgtaggacacaacatacaatcataccataggctagcttctagggtttagcctctttgatctcgtggtagatcaactcttgtaatatcatatcatcaagaacaatcaagcaggacgtagggtattacctccatagagagggcccgaacatgggtaaacattgtgtcccttgtctcctgttaccattgaccttagacgcatagttcaggacaccctacccgagatccgccagttttgacatcgacattggtgcttccattgagagttccactgtgccgtccccaaaaggtttgatggctccttcaatcatctacaacgatgatgtccaaggggaaatcttcctccccagacagatcttcgtattcggcagcttcgcactgcgggccaactcgcttggccatctggagcagatccatacctacacccctagccatcaggtcagatttgggagcttgaactacgtcgtagatatctgtggag

SEQ ID NO: 30631 - DNA, 2114 bp, Triticum aestivum
  Clone ID: PAT_TA_30631
cgacccacgcgtccgcggacgccataaccgtccccctccctcccccccccaatcaccaaacactcgtctagatccagaaggttcgccggccatggaggcgttcggcggcttcttcgtggacgagaaggcggcgcgggtggagaacatcttcctcgagttccttaagcggttcaaggagccggatgcggcggagccgttctacgatgtagagatggaggcgatgcggtcgcgtgagtccaccaccatgtacgtcgatttcgcgcacgtcatgcgcttcaacgacgtcctccagaaggccatctccgaggagtaccttaggtttgagccgtaccttcgcaatgcgtgcaagaggtttgtgatggagcacagagctggcgagaaccgtgcgccaataatctccgacgacagccccaacaaggatattaatattgccttctacaacattccgatgctgaaaaggttgagagagctggggacagcagagattggtaagctcacagctgtaacgggggttgtaacaaggacgagtgaggtccgacctgagttattgcaaggcaccttcaagtgccttgattgtggaaatgttgttaaaaatgtagaccagcagttcaagtatactgagccaataatatgcgttaatgcaacatgccaaaaccgatcaagatgggcccttctccgtcaggatagcaaatttacggattggcagcgggtcaggatgcaggagacatcaaaagagatacccgctgggtcactacctcgttccctggatgtcattctgcggcatgagattgttgagaaagctagagctggggatacggtcatatttacgggaacggttgttgctgttccagatgttatggcattaacttcacctggtgagagagcagagtgtcgccgggaaggtcctcagcggaagaatgggtcaggtgtccaagaaggtgtaaagggcttgaagtcccttggagtacgagatctctcatatcgccttgcttttgtggccaactcagtgcaggtggcggatggcaggagggacgtggacatcagggaccgtgacatagatggtgatggcagcgagagacagaagttcactgaagaggaggaggatgaggttgttaggatgagaaacactcctgatttttttaataagatagttgatagcatatgtcctactgtctttggtcatcaagaaataaagagggcacttctccttatgctcttgggtggcgttcacaagataacacatgaaggcataaaccttagaggagacataaatgtctgtattgttggagatccaagttgtgcaaagtctcagtttttaaaatacactgctggtattgttccgcgatctgtttacacatcagggaagtcctcgtctgctgctggattgacagcaactgttgcgaaagaacctgagaccggtgaattttgtattgaggcaggtgcactcatgttagctgataatggcatctgttgtattgatgaatttgataagatggatattaaggatcaggttgctatacatgaagcaatggagcagcaaaccatcagcataacaaaagctggaatacaagcaactttgaatgcacgaacttcaatactggcagcagcaaatcccacaggaggacggtatgacaagtcaaaaccacttaagtacaatgtggcgctacctccagccattctttcaagatttgatctggtatacatcatgattgatgaacctgatgaaaacactgactaccacattgctcattacattgtgagagtccatcaaaaacgtgaagaagcacttttcccccgcatttagcacttgcaaaattgaaacgctactttgttgttgcaaagtttttaaaccttaatttgattctgaagcaaagaaagttctggtcgaatcttattttggccctcctgcaaggatccaatacttcctgtgactaaggtatcttacaggatgacaattagccacttgaggctcttatttagcctgtcaaagcttttgtccctagtcttttggaagaatggtttcccccgctctagacccctcggtcgattgatttcctcacaccttctcttttgatcgcgtcctctggatagatgccctcctctgtttccaatct

SEQ ID NO: 30632 - DNA, 598 bp, Triticum aestivum
  Clone ID: PAT_TA_30632
ctgcaaagataaccaatcatacataaaagaattcagagaagattcaaatattattcatagatagacttgatcataaacccacaattcatcggtctcaacagacacacgcaaaaagaagattacatcgaatagttctccacaagagagggggagaactttgtattgagatccaaaaagagagaagaagccatctagctactaactatggacccgtaggtctgaggtaaaccactcacacttcatcggagaggctatggtgtttatgtaaaagccctccatgatcgataccccctccggcggagctccgtaaaaggccccaagatgggatctcgtggatacagaaagttacggcggtgaaattagggttttggctccgtatctaatagtttgggggtgagctcggaggttgccgctggcttgaccggtcgaggctgatcagaaaacgcaacgaagcaactacattattatcctctatatctatagtctataaaatgtaccaattgaagtggaagcttatgatagtgatcatgaaatttcagatcaagtcactaccaaacctcgtgggatgacaaggatgcgtacctgcccgggcggccgc

SEQ ID NO: 30633 - DNA, 1032 bp, Triticum aestivum
  Clone ID: PAT_TA_30633
agctcatcttctttagctcaaataaaaaagagtcgctcatcttctccgcgtgactctaatcgccgccgctatctcttccgctgcagcgaccgaatctctcccgacgcattcatcgcccctcattatcttgccctccgttacaggaaaaaaagttagattaaactgcgcggccaccgccttcgcgtctactaacctgtctatgctaccatcctccccaccatcgccggtctgcctctgttcggattcaattctgggtgcgggtaggacgcggttccgttgtcgagcacccacatcgtcgaggaagacacgccgttgctctgcttcggaccacctcccgtacgcccgcctatccgcgtcgcctcgctccaatgtgtctctgatcgtgggaacacagaacgggccgacggccgccgtcggcgggaggagaggtggggaatccgactcaatctctgaacaggacttccaaagggactccacctttggggctaacacatcagcttatcagtccaacatctgttcatccgctccacacgcgtttgacactcccaaggctaggctatcagctcgatgtgcttccacatggacttcatggagattctgtttcacttggacataagcaatattattgatgtgcaatggcatcattcctaccaaggggttggcaaaattgcaagcaggccgcacgccaccagcaattcggcaatttttacttcatctaccaaccggagatgttggagtccaggagccagacgccaccgtcgacgacgactcctacgacactggaggtgcctactactacgtgcaggccgctgacgacgaccaggagtagttaggaggatcccaggcaggaggcctgcgcctcgttcgatctgtatcccagtttgtgctagccttcttaaggcaaacttgtttaacttatgtctgtactcagatattgttgcttccgctgactcgtctgtgatcgagcacttgtattcgagcctcgaggcccctggcttgtattatgatgcttgtatgacttatttatgtttt

SEQ ID NO: 30634 - DNA, 2215 bp, Triticum aestivum
  unsure (1)..(2215): unsure at all n locations
  Clone ID: PAT_TA_30634
atgcaaaggaagagagttagacttcgtcgttacatgatatatgctgctttgtgctcgctactaaattacaaataattgctaattaaaattggctttgatataccttgggatccgggtggattcactacttgagcactatatgcctagcttaatggctttaaagaaagcgctgccagggagataacccggaagttttagggagtcatttatttctgttgagtgctttcatatagtttaaaaataacaaaaataaagaggggaacccaaaactttttcaaaaaggaaagtgaaagtgagaaagacaagcattgttgaagtgggagagctccttgaactttgttcatgctcacggcaactttgtgaatcttgattacagaaacttttcaacaaaaataattacccccgtgtacaattccattgtattataaaaataatgtgccagggtttgcctttaggatgtttacatttgcttgatggtttgtacggtgcaagacagaaactttggctgtantgcgcgattttacatttttagctggaacatcaaatagttctgattctttttgcactgtcttcctatacaaattgtttattttgcctaattttggtagaatttttaaagtatcataagtatggtgaatgttcaaattattacagactgttctgttttagacagattctgtttttgatgcatagtttgcttgttttgatgaaactgtcaatttatatcagtggattaagccatgaaaaggttatactacagtagaaacaatgcaaaaacaaaatatgaattggtttgcaacagtacttagagtagtgatttgctttattatactaacggatcttaccgagttttctgttgaagttttgtgtggatgtagtgtctaatcgaggatgtttcgatgcgagaagaaggaagagaggcaagagctcaagcttggggatgcccgaggcaccccaagtaaatattcaaggagtctcaagcgtctaagcttggggatgctggggaggcatcccctctttcttcaacaagtatcggtatgttttcggattcgttttgttcatgcattatgtgcaagtcttggagcgtcttttgcatttagttttcacttttcttttatgcaccatgatggtatgagatagtccttggttgatttatagaatgctcattgcacttcacttatatcttttgagtatggctttatagaatgcttcatgtgcttcgcttatatcatttgaagtttggactgcccgtttctcttcatatagaaaaccgccatttgcagaaagatcttttgcttcacttatatttgttagagcatgggcatatcttttgtagaaagaattaaactctcttgcttcacttatatctatttacagagttgacaggaattggtcattcacatggttagtcataaaatcctacataaaacttgtagatcactgaatatgatatgtttgattccttgcaatagttttgcgatataaagatggtgatattagagtcatgctagtgggtagttgtggattgtagaaatacttgtgttgaagtttgtgattcccgtagcatgcacgtatggtgaaccgttatgtaacgaagttggagcatgaggtatttattgattgtcttccttatgagtggcggtcggggacgagcgatggtcttttcctaccaatctatccccctaggggcatgcatagtattactttgcttcgagggctaataaacttttgcaataagtatatgagttctttatgactaatgtgagtccatggattatacgcactctcacccttccatcattgctacctcttccgataccgtgcattgccctttctcacctccgagantgggtgaaaactccccgggtgcatccaaaccccgtngatacgatacgctctatcaacacataacctccctttaatcttcctccaaaacagcaccatacctacctatccatggattcccataccattcccgaatatattgccatacacttccancatcatcatatacataacttggacattaatgncanatgctttgcaagatcgtaagatacgacatgagtttaaaggttgtccttttgangncatgcacccagataatgacaccggtanactcggagnatcaataagtanacntgtcacacantgacatnattgataanaanggggtacattnaatnncatataggtnnggaatgtncccaaccgg

SEQ ID NO: 30635 - DNA, 1606 bp, Triticum aestivum
  unsure (1)..(1606): unsure at all n locations
  Clone ID: PAT_TA_30635
cttgccagagcaaccaggcaagccccccttgatcaccagatatcgcctattcttctctatactgcttgcattagaatagtgtagcatgttactgctttccgatatcctatcctgatgcatagcctatccttgctactactgttgttacctttacctgcaatcctacatgcttagtataggatgctagttttccatcagtggccctacattcttgtccgtctgctgtgctatactatcgggccgtgatcacctgggcggtgatcacgggtatatacttatatactaaatacatgacacttgtgatgactaaagtcgggtcggctcgtaggagtacccgcaagtggatctttgtggcagagcgacagggcaggttgagaccgcctatgtgagaggtgggcctggccctggtcagcgttcgcggatacttaacacgcttaacgagatcttggtatttgatctgagtctggccatttggtctatacgcactagccatctacgcgggagtagttatgggtatcccggcgtcgtggtatcagccgaagccttcgtgacgtcagcgactgagtggcgcgcgccggattggactggaacgccactaggctaggtctgctttcggccgcgtacgcaacgtgccaggtgtgcatagggcgatgggcccagacccctgcgcgcatagggctagaccgacgagctgacctctctgttgtgcttaggcggggctgcgacgcgttgatcttacgaggccgggcatgactcagaaaagtgtgtccggccaaatgggatcgaccgtgttgggttatgtggtgcacccctgcagggaagtttatctattcgaatagccgtgtccctcggtaaaaggacgacccggagttgtaccttgaccttatgacaactagaactggatacttaataaaacacacccttccaagtgccagatataacccggtgatcgctctctaacggggcgacgaggaggggaccgccgggtaggattatgctatgcgatgccacttggaggacttcaacctactctcttctacatgctgcaagatggagatgtccagaagcttagtcttcgacaggactagctatccccctcttattccggcattctgcagttcagtccactgatatgcctctttactcatatacccatgcatatgtagtgtagttccttgcttgcgagtactttggatgagtactcacggttgcttctctccctctttttccccctttcctttctatctggttgtcgcaaccagatgttggagtccaggagccagacgccaccgtcgtcgacgacactggaggtgcctactactacgtgcaggccgctgacgacgactaggagtagttaggaggatcccaggcaggaggcctgcgcctcgttcgatctgtatcccagtttgtgctagccttcttaaggcaaacttgtttaacttatgtctgtactcagatattgttgcttccgctgactcgtctatgatcgagcaatgtattcgagccctcgaggccctggcttgtattatgatgctgtatgacttattatgttttagagtgtgttgtgatacctcccgtgagtcccgattgatcttaanatngcgtg

SEQ ID NO: 30636 - DNA, 1927 bp, Triticum aestivum
  Clone ID: PAT_TA_30636
ggtcaaatattccgggtcgacgggttttgctacttcttagtaataaataaattatctagtctctgttttggttgtgttttttgtgtttaattagtgtttgtgccaagtagaaccgttgggaagacttggggaaagtcttgttgaacttgctgtaaaaaacagaaactttagcgctcacgagaactgatgttatttttatttgaagagtgctatttagctaattcttttttaagatgattattagataaattcctcgtgtccagaaatttattttagaatttttggggttccatatcttgtgctagctacagattactacagactgttctgtttttgacagattctgttttctatgtgttgtttgcttattttgatgcatctacggctagtactaagtggtatgaaccatagagaagttataataaagtagatattacaccaatatgaatttataatgagttcattacagtacctaagtggtggttttattttcttatactaacggagcttacgagttttgttttgagttttgtgtggttgaagttttcaagttttgggtaacgattcgatggacaatggaataaggagtggaaagagcctaatattggggatgcccaaggcaccccaaggtaatattcaaggacaaccaagcaactaagcttggggatgcccaagaaggcatcccctctttcgtcttcgttcatcggtaactttacttggagctacatttttattcaccacatgatatgtgttttgcttggagcgtcattttattttgttttatgcttgctgtttgaataaaataccatgatcttaaattcttatatgttagagagtcttcacatacttacataattattcgactactcattgatcttcacttatatctttcggagtagtttgtcgtttgctctagtgcttcacttatatcttttagagcacgacggtggttttattttgaagaaatacatgaactctcatgcttcacttatattattttgagagtctttagaacagcatggtaatttgctttggttatgaatttagttataatatgatgggcatccaagagggacataataaaaactatcatataaagtgcattgaatactatgagaagtttgattctttatgattgttttgagatatgaagatggtgatattagagtcatgctagtggagtagttgtgaatttagaaatacttgtgttaaagcttgtgattcctgtagcatgcacgtatggtgaaccgttatgcgatgaagtcggagcatgatttatttattgattgtcttccttatgagtggcggtcggggacgagcgatggtcttttcctaccaatctatccccctaggagcatgcgcgcaatactttgctttgataacttctagatttttgcaataagtatatgatttctttaaaactaatgtacagtccatggattatacgcactctcacccttccacctttgctagcctctctaaatatcgcgcacctttcgccggtatcatacacctaccatatatcttcctcaaagcagcgagcataccaacctattacggcatttccatagccattctgagatatattgccatgcaactttccaccgttccgtttattatgacactcttcatcattgtcatcttgatttgcatgatcatgtagttgacattgtatttgtggcaaagccaccgttcataatttttcatacatgtcactcttgattcattgcacatcccggtacaccgccggaggcattcacatagagtcatattttgttctaagtatcgagttgtaattcttgagttgtaagtaaataaaagtgtgatgatcttcattattagagcactgtcccagtgaggaaaggatgatggcgactatgattcccaaaaaaaaaaaaaaaaaacaaaaaaaaaaagcggccgctct

SEQ ID NO: 30637 - DNA, 1414 bp, Triticum aestivum
  Clone ID: PAT_TA_30637
cgggtcgactcccccctccttccaacagagaggagaaaagggaaagagggggagagggagaaggaaagggggtctgcgccccccaccccttgtccaattcggactgccatgggggggcgccacctcttgtggcctgtctcctctccactatggcccatgaggcccattaactttcccggggggtttcggtaacctcccagtactccgaaaaatcccggaacctcttcggaactattccggtgtccgtacataaccttccaatatatcaatctttacctctcgaccatttcgagactcctcgtcatgtctgtgatttcatccgggactccaaacaaacttcggtcaccaaaacacataactcataatacaaatcgtcatcgaacgttaagcgtgcaaaccctacgggtttgagaactatgtagacatgaccgagacacgtctctggtcaataaccaatagcggaacctggatgctcatattggctcccacatattctacgaagatctttatcggtgaaaccgcataacaacatacgttgttccctttgtcatcggtatgttacttgcccgggattcgatcgtcggtatctcaatacctagttcaatcttgttaccggcaagtctctttactcgttccgtgatgcatcatcccgcaactaactcattagtcacattgcttgcaaggcttatagtgatgtgcattactgagagggcccagagatacctctccgataatcggagtgacaaatcctaatctcgatctatgccaactcaacaaacaccatcggagacacctgtagagcatctttataatcacctagttatgttgtgacgtttgatagaacactaagtgttcctccgatattcgggagttgcataatctcatagtcataggaacatgtataagttatgaataaagcaatatcaataaactaaacgatcatagtgctaagctaatggatgggtcaagtccatcacatcattatctaatgatgtgatcccattcatcaaatgacaactcatgtctatggctaggaaacttaaccatctttgattcaacgagctagtcaagtagaggcatacttgtgacactttgtttgtctatgtattcacttttgtactaagtttccggttaatacacttctagcatgaataataaacataggccgcctccacctctctcccactaaggcccaataaggcccatacactccccggggggttccggtaacctcccggtactccggtaaatgcccgaacccacccgggaccattccgatgtccaaacatagccatccaatatatcgatctttatgtctcgaccatttcgagactcctcgccatgtccgtgatcacatccgggactctgaacaaccttcggtacatcaaaacacataaactcataataccgattg

SEQ ID NO: 30638 - DNA, 2032 bp, Triticum aestivum
  Clone ID: PAT_TA_30638
agaccttaccttagaacgattggcgcgattattgatatgaaggaagggaatatcagattccaatttccattaagaaaaggcatggagcacttcccaaaaaataaaattaaattaccttatgaatctatcatgcggtctacttatgaattaagtgccaaagatggcactacttagatctatcctcgcttttatgcctagctaggggcgttaaacgatagcgctagttgggaggcaacccaattttatttgtgttctttgtttttgcttctgtttattaataaattttgcatctacattctgtttagatgtgtttttatgttttaattagtgtttgtgccaagtaaaacctataggataacctatggtgatagttaatttgattctggtgaaaaacacaaactttgcgctcacgagaaaaaattcaataaatctaagaaatgtgcttttgcgtagattatttttgctgtagatcaatagacaaatttcctaatacttcctattttggtaggatttttggagttccagaagtattcgaaagttacagcttgctacagactgttctgtttttgacagattctgcctttcgtgtgttgtttgcttattttgatgcatctatggctagtattaagtggaatgaaccatagagaacttcgaatacagtaggtttaacaccaaaataaataaataatgagttcattacagtaccttatgtggtggttttgttttctttcactaacggagcttataagatttcctgttgagttttgtgttgtgaagttttcaagttttgggtaaagctttgatggagtacggaataaagagtggcaaaagcctaatcttggggatgcccatggcaccccaagatattcaagaatatccaaaagcctaagcttgggggatgccccgggaaggcatcccctctttcgtcttcgttcattggtaactttacttggagctatatttttattgccacatgatatgtgttttgcttggagcatcgggtatgatattagtctttgctttttagtttaccacaatcatccttgctgtacacaccttttgggagaagcccacttgattagaattttctagaacactctatgtgcttcacttatatcttttgagcttaatagtttttgctctagtgcttcacttatatcttttagagcacggcggtggcttaatttttacgaaattgctagtctctcatgcttcacttatattattttgagagtcatttagaatagcatggtatttgatatggttacaaatttggtcctagaatgatgagcattcacgttgggtataataaaaactatcataggaagtgaattggatgctatgatcaatttgttgcttgataattgttttgaaatataaaggtagtaatgttagggtcatgctagtggataattatgaaattgataaatacttttgttgaagttggcaagtcccgtagcatgcacgtatggtaaaagttgtgtgacaaatttgttgcatgaggtgctcttttgattgtcttccttatgagtggcagtcggggacgagcgatggaactttttcctaccaatctatccctcttggggcatgtgtagcagtactttgcttcgagggcgaagtagatttttgcaataagtatatgagttctttatgactaatgtgagtccatggatatacggacactcagccttccactttgctagcctctattctgccgcacaactttcgccggtttcatgcacccattatttaccttcctcaaaacagccaccatacctacctattatggcatttccatagccatcccgacatatattgccatgcaactttccattgttccgttattatgacacgctccattattgtcatattgctctttgcatgatcatgtagttgacattgtatttgtggcaaggccaccctcataattttcataaatgtcactcttgagtcattgcatatcccggtacaccgccggaggcattcatatagagtcatattttgttccaagtgttgagttgtaattcctgag

SEQ ID NO: 30639 - DNA, 1967 bp, Triticum aestivum
  Clone ID: PAT_TA_30639
gatcttaatctttttgctatggattggtacacaagtttcttaggacttcctaatttggtagaatttttgcggttccagaagtatacgtttgttacagattactacagactattctatttttgacagattctgttttctatgtgttgtttgcttattttgatgaatctatgagtagtatcgaagggtatgaaccatagagaagttataatacagtagatattacaccaatatgaatttagaatgagttcattacagtacctaagtggtggttttattttcttatactaacaaagcttacgagttttttgttgagttttgtgttgtggagttttcaagttttgggtaaagatttgatggacaatggaataaggagtggcaagagcctaagcttggggatgcccaaggcaccccaagatattcaataatagccaaaagcctaagcttggggatgccctgggaaggcatcccctctttcgtctttgttcattggtaactttacttggagctatatttttattcgccacatgatatgtgtttttcttggagcgtcgtgtattatattagtctttgctttttagtttaccacagtcatccttgctgtacacaccttttgagagaatcccacttgattagaatttgctagaatactctatgtgcttcacttatatcttttgagcttgatagtttttgctctagtgcttcacttatatctttaagagcacggcggtggcttaattttatataaatttctagtctcccatgcttcacttatattattttgagagtctcttataacagcatggtatttgctatggttatgaatttggtcctagaaagatgagcatccaagttgggtataataaaaactatcatagaatgtgcattaaaacactaggatcaattttatgcttgataattgttttgagatataaaggtagtaatgttagagtcatgctagtgggtaattatgaaatttagaaatacttttgttgaagttggcaagtcccatagcatgcacatatggtaaaagttgtgtaaacgtcttattgcatctggcgcgcctttgaatgccttctcttgagtggaggttcggggcgcgcgatggttaactcctaccaacctcccccctaggagcatgcatagtagtacttttcttcgagggctaataaaactcttgcaataagtatatgagttctttatgactaatgttgagtccatggattatacacgctttttacctttccatcattgctagcctcttcggtaccgtgcattgccctttctcaccttgagagttggtgcaaacttcgccggtgcattaaaaccccgtgatacgatatgctctatcacacataagcctcattatatcttcctcaaaccagccaccatacctacctatcatggcatttccatagccattccgagatatattgccatgcaacttccatcatcatcatatacatgacttgagcattcattgttatattgctttgcatgatcgtaagatagctagcatgatgttttcatggcttgtccgttttttgatgtcattgctatgctagatcattgcacatcccggtgaatacttttcctgtcccggattgatcatgttattcgaagggaaactctgcatgccggtcactgcagatccaccccaccccgcacataaacatcgatggattcgggtgcgagccggtcactgcagatccagcacgggctgagactttggggatgaaggtcggcgactaggcaaggatcctcggcggcttggtgttgagtctttcctcgtattttctctctgcaattttttgtttctcgatcgtattttctttccttgttttttctctgaaaatttctttcctaaaaatttctcgctgaggttttctgtttttttcgccaactctgacaccattcggtatgcaacggcggcggccagcagcagaagtacctcggccgcgaccacgcta

SEQ ID NO: 30640 - DNA, 838 bp, Triticum aestivum
  unsure (1)..(838): unsure at all n locations
  Clone ID: PAT_TA_30640
aaggagagaactccatggcagccgagggttccagcggcggcggcggcggcggccggaaaacaccgttgcctcataacccaagagagcgcggagcggcgaaattcctcaccggcttgccatcgcgaggaaacttctcctcaagttccatctcttccaatctgggaggcctcagggtttatgtctgcgagcacgacacaaatcctccagagggacaagtgatcgagacggatacgacaaatatcttaatcagacatctgcaactaaagaagaaagagagtgaggccaaagacgcaggttctaggactccaggggaaagtggcaagggtaaaagatgtgctgccagaagtttgggtgtgcaaaagtcatcaaaaaagcccaacttgggcagttcttccggattgccttcctctgatgaagcaatatctggcttttcacagcacacactgcagtccttcaccgtagagaggttgcgtgcacttctccgacaaagaggcctcacaaccaaggggaaaaaggacgaactgatcactcgcttaagagaggcgcagagttgatatcaatctcaagtttctgccttgtttgtgattgatcaattgcctactggcaccgtaaaacgttgctgagttgaatgaattattatcaggctttacttgtttacattttgtaggtgtatgacttaaggtgatgtagtgatttactcaggctcaggctatcatgaatttgatgtcttgtagcgaactttactatatgcttgtcaagaatcctgtttcatccttgaattttgggattaagaaatgtggcggtccaatgtnagaaacacatgttaataatagncccc

SEQ ID NO: 30641 - DNA, 997 bp, Triticum aestivum
  Clone ID: PAT_TA_30641
tagtacacacgacaacatccaagtttggtataataaaaactatcataggaagtgaattggatgctatgatcaagttgatgcttgataattgttttgagatatggaggtggtgatattagagtcatgctagttgggtaattgtgaatttaaagaatacttgtgttgaagttggcaagccccatagcatgcacttacggtaaccgttgtgtaacaaatttgaaacatgaggtgttcttagattgtcatccttatgagtggcggtcggggacgagcactggtcttttcctagcaatctatccccctaggagcatgcgcgtagtgcttgatttttgatgacttgtagatttttgcaataagtatatgagttctttatgactaatgtgagtccatggatgtacgcacagtcatccttccactttgctagcctctgttttaccgcgcaactttcgccggtagcatgcacccattacttaccttcctcaaaacagccaccatacctacctattatggcatttccatagccattccgagatatattgccatgcaactttccacaattcggtttattatgacacgcaccatcattgtcatattgctctttgcatgatcatgtaattgacatcgtatttgtggcaaagccaccttcataattcttccatacatgtcactcttgattcattgcatatcccggtacaccgccggaggcattcatatagagtcatatcttgttctagctttgagttgtaattcttgagttgtaaatcaataaaagtgtgatgatcttcattattagagcattgtcccaagtgaggaaaggatgatggagactatgattcccccataagtcgggatgagacttcggacttcataaacataaaagaggccaaagaagcccaaataaaaagaggccataaaaaagtgaaaaggtccaaataaaaaaatataaaatatatatataaaaatgagagaaaaaaagagaagggacaattttactatc

SEQ ID NO: 30642 - DNA, 1014 bp, Triticum aestivum
  Clone ID: PAT_TA_30642
tttttttttttttttttttttttttttttttttttgtcggagaaggagcttatttatttaaaagatgaaaaatacattacacgccgaacttaattgcaaagccttgcctatccttcctaccaataatcaattgtctagaataaacaaacgtccttatcctgtttttgtgttttacatacctaaaatatgggaatataaaaaaattctctgacgtaaccacgctcaactaaaacagggtaacgactagaagctggagcctagaattgtttttgcttcattcattccttgaaatcgtccttgtcatctgctggaaggcctctgtttctccagaaaactgcgagagcactgcctccgagcgccatgcacacaacactgacagcagagggaacagcaacaagaggattcgtgaagtgcttttgggcaagtaaaaatccaagcgcagaactctgcatcccacactcaattgagatggttctagaagttgattccccgaaaggaagaccatttcgagatccaatagccaagagcgaatgcaacagcatgcagcagagcaacagggagaataagttgagcaccttgagttttcaacacttctgcgacttgcccaatagggctagcacagagcaaggtggtgaggatgacccctatcagtggtgttatggagataatccgctcggtaaacttgggaaaatactcatgtgccaacactccaacgatagtcggtactaaaacaacctgaaaagtactgatggccaagccctgcacaaaaatagtttaatttaactaagatttgatcaattaaactagcaagcagttgattcaagatacggatcatagtgtgtttactgcagcatcaacagggactaattgaccagcaaggagtttagtaaggagtggtgtcatcgctatagcaccaatagtcgagcaagtggtcataagaactgaaagtgccacatttcctttggatatgtaagttgcaacgtttgatgcttgaccaccaggacaacatgagac

SEQ ID NO: 30643 - DNA, 841 bp, Triticum aestivum
  Clone ID: PAT_TA_30643
ttccagatccccttcctctcgctctcccactacgcccgagacctcgtcgccacgccttcgtcgatcccgcggccaccgactccccatcgccgcatcgccatgtccatgaggttctccgtcgactacttcatcatctccaccaccggatcgagcccggggagccacaccgacgacgcgcccgtcttcttcttcgcccacggccaccgcgggccatcgccgtcgatctccaccaccggcgcctcccggcctcggcgagctcgtccacggcctcctcgggaccccgagaccgatgctgcccctgtgatcgactacatcgacgacgaccccttcttgccagagcaaatagttgatgcaaccagatgtcggagcccaggagccagatgccaccgtcgatgcctactactacgtggagaccgccgatgaccaggagtagttaggaggctcccaggcaggaggccttgcctttttgaccgatgttgcttttgtgctagccttcttaaggcaaacttgtctaactcatgtctgtactcagatattgttgcttccgctgactcttgtgtattcgagcttatgtattcgagccctcgaggcccctggattgtaatataaagcttgtattattttattttgtgtctagagttgtgttgtgatatcttcccgtgagtccttgatcttgatcgtacacatttgcgtgtatggttagtgtatgattgaatcgagggtgtcacagtatcttcatacctagttcaatctcattactgacaagtctctttactcattccgtaatacatcatcttgcaactaactcattagtcactttgcttgcaaggctttttatgat

SEQ ID NO: 30644 - DNA, 828 bp, Triticum aestivum
  Clone ID: PAT_TA_30644
gcacgagggtggagcccacgcaccaaacgtcaccgccagcgctccttcctccgttccccaattcccctggaggcgcgccgcatatcagcggcgacattgggcggcgatggcctcggttaggccccctctccgccgcctcgcgctactgcttaacagccgcatccgcgccaacaaccgcttcctcgcctccgcctccacctccacctccacgtcctcctaccccaccgccgcggcagccggcgccaccaccactgagacgccgggcgccggaggggccggaggtcgtcagcatgacggataactgcgtccgtaggctcaaagagttacatactaaacaaccatctgctaagggcaacatgttgcgcttgagcgttgaagctggtggttgttctggattccagtacaccttctcactggatagcaaggaaaatgctgatgatagggtcttcgagaagaatggcgttaagttggttgtcgacaatgtctcatatgactttgtgaaaggttcaacagtcgattatgtagaggaattgataagctcagcatttgtggtttcaaccaatccaagtgctgttggaggctgcagctgcaagagttccttcatggttaaataattcgaacattagtaactttaagaggtagcctgacagaactttaagtggtcggacccttccccagaccctgcgcaagcgggagctacatgcactggggctgccccttttttactacaatacttcgatacttccaaataagtccctgttattgctactatcttaggaatcttatgtaacctactgctttactagaatatttttgttatgtggatgc

SEQ ID NO: 30645 - DNA, 2118 bp, Triticum aestivum
  Clone ID: PAT_TA_30645
aggatacacaagcgtctaagcttggggatgccccagaaggcatcccctctttcttcaacaagtatcggtatcttttcggattcgtttcgttcatgcgatatgtgcaatcttggagcatcttttgcatttagttttcatttttcttttatgcaccatgctggcatgagatagtccttggttgatttatagaatgctcatttcacttcacttatatcatttgaagtttggatttcctgtttctctttacatagaaaaccgccatttgtagaatgttcttttgcttcacttatatttgttagagcacgggcatatcttttgtagaaagaataaaactctcttgcttcgcttatatctatttagagagatgacaggaagtggtcattcacatgattagtcataaaatcgtacataaacttgtgggtcactggatatgatatgtttgattcctcgcaatagttttgcgatataaaagtggtgatattagagttatgctagtgggtgactgtggattagtagaaacacttgtgttgaggtttgtgattcccgtagcatgcacgtatggtgaaccgctttgtgatgaagttggagcacaattttatttattgattgtcttccttatgagtggcggtcggggatgagcgatggtcttttcctaccaatctatccccctaggagcatgcgcgtagtactttgttttcaatggcttgtagatttttgcaataagtatatgagttctttatgactaatgttgagtccatggattatacgcactctcacccttccatcattgctagcctcttcggtactgtgcattgccctttctcacctcgagagttggtgcaaacttcgccggtgcacccaaaccctgtgatatgatacgctctgtcacacataagcctcattatatcttcctcaaaacagccaccatacctacctatcatggcatttccatagccattccgagatatattgccatgcaacttccatcatcatcacatacatgacttgagcatttattgtcatattgctttccttgatcgtaagatagctagcatgatgtttgcatggcttgtctgttttttgatgtcattgctacgctagatcattgcacatcccggtacaccgccggaggcattcatatagagtcatatctttgttctagtatcgagttgtaatattgagttgtaagtaaataaaagtgtgatgatcatcattattagagcattgccccagtgaggaaaggatgacagagactatgattcccccacaagtcgggatgagactccggacttaaaaaaataaaagaggccaaagaagcccaaattaaaaaaagaggccaaagaagcccaccaaaaaaataaaaaaaatgaaaaaaaaaattgaaaaaaatgagagaaaaagagagaaggggaaatgttactatccttttaccacacttgtgcttcaaagtagcaccatgttcttcatatagagagtctcattgagttatcactttcatatactagtgggaattttcattatagaacttggcttgtatattccgatgatgggcttcctcaaatgcccgaggtcttcatgagcaagcaagttggatgcacacccacttagtttctagtttgagctttcataaacttatagctcttagtgcatccgttgtatggcaatccctactcctcacattgatatctattaatgggcatctccatagcccgttaatacgcctagtagatgtgatactttctccctttttgtcttctccgcataacccctatcatcatattctattccacctatagtgctatgaccatggctcacgctcatgtattgcgtggaagttgaaaaggtttgagaaacatcaaaagtatgaaacaattgcttggcttgtcatcggggttgtgcatgatgtgaatgctttgtgtggtgaagatggagcatagccagactatatgattttgtagggatgagctttctttggctatgttatttcaataagacataattggcttggttggtatgcttgaagtattattgtttttatgtcaaatgatagattattgctttgaatcactcgtgtcttaatattcatgccatgattagacatatgatcaagattatgct

SEQ ID NO: 30646 - DNA, 1606 bp, Triticum aestivum
  Clone ID: PAT_TA_30646
gacgggtagaatgatcttttgattcacttatatttgttagagtgtgggcatatcttttgtagaaagaattaaactctcttgcttcacttatatctatttagagagatgataggaattggtcattcacatggttagtcataaaatcctacataaaacttgtagatcactgaatatgatgtgtttgattccttgcaatagttttgcgatataaagatggtgatattagagtcatgctagtgggtggttgtggattgcagaaatacttgtgttgaagtttgtgattcccgtagcatgcacgtatggtgaaccgttatgtgatgaagttggagcataatttatttattgattgtcttccttatgagtggcggtcggggacgagctatggtcttttcctaccaatctatccccctaggagcatgcgcgtaatactttgctttgataacttttagatttttgcaataagtatatgagttctttatgactaatgttgagtccatggattatacgcacttttcttccttccaccattgctagcctctctaataccgcgcacctttcaccgatatcatacacccaccatataccttcctcaaaacagccaccatacctacctatcatgacatttccatagccattctgagatatattgccatgcaactttccactgttccgtttactatgacacacttcatcattgtcatattgctttgcatgatcatgtagttaatatcgtatttgtggcaaagccaccgttcataattctttcatagatgtcactcatgagtcattgcatatcccgacacaccgccgtaggcattcatatagagtcatatcttgttttagtttcgagttgtagtgcacgtgttgtaatcaatagaagtgtgatgatcatcattattagagcattgtcccatgtgatgaaaggatgatggagactatgattcccccacaggtcgtgatgagactccggactaaataaaaaaagaggccataaaaaaaggagaaaaggcccaaaagaaataaaagagaaaaaaatgatgagagaaaagagagaagggacaatgccactatcctttttccacacttgtgcttcaaagtagcaccatgatcttcatgatagagagtctcctatgatatcactttcatatactagtgggaatttttcattatagaacttggcttgtatattccaataatgggcttcctcaaatgccctaggtcttcatgagcaagcaagttggatgcacacccacttagtttattttgttgagctttcatacatttatagctctagtgcatctgttgcatggcaatccctactccttgcattgacatcaattgatgggcatctcgatagcccgtttattagtcgcgtcaatgtgagactttctccctttttgtcttctcacacaacctcaatcattatattctattccacccatagtggtatgtccatgactcgcgctcatatattgtgtaaaagttgaaagagtttgaaaaggctaagtatgaaacaattgcttggcttgtcatcggggttgtgcatgatgagagcattttatgtgatgaaaatgaagcatagccaaattatatgattttgtaggga

SEQ ID NO: 30647 - DNA, 1740 bp, Triticum aestivum
  Clone ID: PAT_TA_30647
tcggcacgaggacgatcccctggttccccaccccacgacccgatgtggatcgggggcgctcgccccccccccgaccctggtgactgcgccgccccgcgccccgacgccggcgccttccccggtgccgccccaccaccgacgcctcgcctcctcccggagcccccttcgccggcgccttgccacctcgccgccccgtccacgaccgcgccgtcggtggaccccgcccggagctacctcgcccccgcctccccaacgccgcgtcgccgaactgccccgtcctcggctcctccccgagcccgctgccaatccctacaaccgcataaccgacgccgctgctacccagtacgactacggtgttgacgacccctccttcttgccagagcaaccagacgaaggagcgcaggagccagatgccactgtcgatgacgactactactacactggaggtgcctactactatgtgcagcccgctggcgacgaccaggagtagtttaggaggatcccaggcaggaggcctacgcctcttttgatctgtatcccagtttgtgctagccttcttaaggcaaacttgtttaacttatgtttgtactcagatattgttgcttccgttgacttgtctatgatcgagctcttgtattcgagccctcgaggctcatggcttgtaatatgatgcttgtatgacttatttttatttgtagagttgtgttgtgatatcttcccgtgagtccctgatcttgaccgtacacgtttgcgtgtatgattagtgtacggttgaatcgggggcgtcacatagagggataaactcaagcaatatgatataaaccccatatttttatcctcgatggcaataatacaatacgtgtcatttcccctactatcactggaatcgagcactgcatgattgaacccaaagctaaccacttctcccattgcaagaaagatcaatctagtaggcaaaaccaaactgataatttgaagagacttgcaaagataaccaatcatacataaaagaattcagagaagattcaaatattgttcatagataatcttgatcataaacccccaattcatcggatctcgacaaacacaccgctaaaagagttacatcaaatagatctccaagaagattgaggagaactttgtattgagatccaaagagagagaagaagccatctagctaataactaggcacccgaaggtctgtgttaaactactcacacatcatcggagagactatggtgttgatgtagaagcccttcatgatcgattcccattccggcggagcgccggaaaacgccccaagatgggatctcatgggtacagaaggttgcggcggtggaaatagggtttcacggtgctcctggatgttttcagggtatatgggtatatataggaggaagaagtacgtcaggggagccacgagaggcccacgagggtgggggtgcgcccagggggcaggcgcgccaccgtgcatagtggccacgtcgaagcttccctgatgtcaactccaagtctcatggattgcttccgttccaaaaataactctcccaaaggtttcattccgtttggactccgtttgatattccttttcttcgaaacactgaaataggcaagaaaacaacaatttgggctgggcctccggttaataggttagtcccaaaaataatataaaagtgtataaataagcccattaaacatccaaaatagaatatataatagcatggaacccgtcgacccgga

SEQ ID NO: 30648 - DNA, 2115 bp, Triticum aestivum
  Clone ID: PAT_TA_30648
cccgggccgacgggtatcacaggaatgtgcttttgcgttgattctttttgctgctgttcaatagataaattgtccaggacttcctattttggtaggatttttagagttccagaagtttgcgttagttacagattgctacagacttttctgtttttgacagattctgtttttcgtgtgttgtttgcttattccaatgcatctatggctagtaaaatagtttataaactataaggaagttggaatacagtaggtttaacaccaaaataaataaagaatgagttcattgcagtaccttatgtggtggttttgttttctttcactaacggagcttataagatttcctgttgagttttgtgttgtgaagttttcaagttttgggcaaagcttttatggactatggaataaggagtggcaagagcctaagcttggggatgcccttggcaccccaatctattcaaggatagccaaaatcctaagcttggggatgccccgggaaggcatcccctctttcgtctccgttcattggtaactttacttggagctatatttttattcgccacatgatatgtgttttgcttggagcgtcgtgtattatattagtatttgctttttagtttaccaaaattatccttgatgtacacaccttttgggagaatcccacttgattggaatttattagaatactctatgtgcttcacttatatcttttgagctagatagtttttgctctagtgcttcacttatatcttttagagcacgacagtggcttaattttgtagaaattgctagtctctcatgattcacttatattattttgagagtctcttagaacaacatggtatttgctttggttataaaattggtcctagaatggtaggtatccaagttgggtataataaaaactatcataggaagtgaattggatgctatgatcaatttgatacttgataattgttttgagatatggatgtagtgatattaaagtcatgctagttgggtgattatgaatttaaagaatacttgtgttgaagttagcaagtcccgtagcatgcacgtatggttaaagttgtgtaacaaatttgaaacatgaagtgtacctggcttgtgcatccttatgagtggcggtcggggacgagcgatggtcttttcctaccaatctatccctctaggagcatgcgcgtagtgcttggtttttgatgacttctaaatttttgcaataagtatatgagttctttcgactaatgttgagtccatggattatacgcacttttacctttccaccattgctagcctcttcggtaccgtgcattgccctttctcaccttgagagttggtgcaaacttcgccggtgcatccaaaccccgtgatacgatacgctctatcacacataagcctcattacatcttactcaaaacagccaccatacctacctatcatggcatttccatagccattccgagatatattgccatgcaacttccatcatcatcatatacatgacttgagcatttatcatcatattgctttgcatgatcgtaagatagctagcatgatgttttcatggcttgcccgttttttgatgtcattgctacgctagatcattacacatcccggtacaccgccggaggcattcatatagagtcatatctttgttctagatatcaagttgtaatattgagttgtaagcaaataaagtgtgatgatcatcattattagagcattgccccaagtgaggaaaggatgatggagactatgattcccccacaagtcgggatgagactccggacgagaaataaaaaaaagaggaaaatatgccatgaaaaaagagagaaggccccaaaaaacaaaaaaaatgagagaaaaagagagaaggggcaatgctactttccttttaccacacttgtgcttcaaagtagcaccatgatcttcatgttagagagtctcctatgttgtcacttacatatacttgtgggaatctttcattatagaacttggcttgtatattccaatgatgggcttcctcaaaatgccctaggtcttcgtgagcaagcgagttggatgcacacccacttagtttctttttgagctttcatagacttatagctctagtgcatc

SEQ ID NO: 30649 - DNA, 663 bp, Triticum aestivum
  Clone ID: PAT_TA_30649
gcttcacagcacttgtgcacgttaaaatagtatggccactagtagtttacagagtatgtccgctcatttacagagtaccacatacacgaaaaatcaactggagcctgagcaaccttgtaaaactacctcccatcgagctccagagtggagtccacttctttctactagtgtacactaaaagttccttaaaatcatcgtgcacgtttatgtagcacttctctacccaagttctggacagaaggttgatgcgccgaagcgatttgaggatgctgccgtgttcttcatagctcgcttttgctggatttcacaggcttcttcttccctttccaccaattctttaccaccttagacaccttgctcacatgccctttcagtttcttgccggtatccttgatctgttccacgacctgttgcttcaggtctttcttttgcggacccttgttttttagaatgtttcccaagttcttgggtaagttatcctcctcttcatcgtcatcttcatcatcctcatcaccgtcaacgccaaagttgttcttcatcagatcatctctggagtacatcttcatgtttggggctcccggcatgccctccattgatctcattatcttctccatctcggcatcttttgatggctttgcagcaaagggttctccggggattcgg

SEQ ID NO: 30650 - DNA, 1705 bp, Triticum aestivum
  Clone ID: PAT_TA_30650
ggcacgaggtcagcccagcggcagtttggcgggctcttttgtgagcgctgcagcctggcgggatatcccgtccaccttgcaacctgacgcgtagtattcttcacggcggcgtgaagcgaatttacaaatgcttctcatttgctgctgaattttgatcgatggagcccaacgccgacaagctacgtggtctttgcatcacctccctggacgatgaagacgatgatgagacagaactgcccaaccaacctctgcccgcctccaccgtgaccgtggctgcggccgcctcgggctatgatgacgaggacgaagatgaagaagcagaagtcatgcttgggttcctggagaagccgaagcatcccggcctcctcctccgccacctctttcctagcaaggctggaggcatcccggcgtggttggatcccgtgaacttgcccacggggaactccagctgctgtgggcttctgtggcgagcccctgcactttgtcctccagatttatgctccgattgagagcaatgcagcagcattccaccgcactctgttcatgttcatgtgcccgtcgatggcatgcttgcaccgagaccagcacaaacagtggacacgcaaccaaggcaatcctcgtagaagcgtgagggttttccggtgccagctgcctcgtaccaacgtgttctactcaagtgaacctccaagtcgcaataactctgacaagccactatgtgccggagctgctctgtgtcattggtgtggtacatggaaaggggataaaatatgtggtggctgcaagaaatcacgttactgttctgagaaacatcaggcactgcactggcgctctggtcataaaaatgattgcctacagataatcaattcttctgaagcttcaagttctgtgctgccagctgtaggaaaagttccagctaggacttcttggccggaatatcagatagcaattgacgatgaagttgatttggattctgatggttgtgatgaaaacagctcaaaatccttggtgatgcaaaagcatggtaaaccagatgatacaatgcagtcatggatggatcaatttgaggctgatgctgacaaccaatgctgggcatattttcaagagcgtatctcaagagcaccagagcaagtattgagatactgtcgagatccaaatgtaaaacctctgtgggctttatcagctgggcgtccatcaaatcctgacatcccttcatgtagctactgtaaaggtccactatgctatgaatttcagataatgccacaattgctttattactttggtgtgagaaatgaaccagactctcttgattgggcaacaattgttgtgtacacatgtaaaggatcatgtgatcaaagtactagctacaaggaagaatttgcatgggttcagttatatcctacatcaatctcaaggccgtagtaatgtttacctgttccacagagtggtgtctgggagttgggaacttgaaagtgacggtctaccttgcatttcaatctgaagacaggcgttccaagccagatagatctttttttagatgtcaacttcaatgcagggccatggtcccaattcgctcgctacattgggcttggtctagtatttagccactggggccatctagagcatttgatgtgaaatagttgtggtcgccagcattgcctgttcagtgtgcatctttatttcgttatataggattcttcgtctcttt

SEQ ID NO: 30651 - DNA, 1463 bp, Triticum aestivum
  unsure (1)..(1463): unsure at all n locations
  Clone ID: PAT_TA_30651
tcctcaggagacggctcttcgccctggggtcttgaggggcgcagcctgccccgatgtcttgaaaggttatgggactcgggttggcctacccgtggtccattactccgacaaatactaagagaagtttgatacttgatgattgttttgagatatgaggatggtaatattagagtcgtgctagttgagtagttgtgaatttgagaaatgcttgtgttgaagtttgcaagtcccgtagcatgcacgtatggtaaacgttgtgtaacaaaaatgaaacatgaggtgttatttgattgtcctccttatgagtggcggtcggggacgagcgatggtcttttcctaccaatctatccccctaggagcatgcgcgtagtactttgtttcgatgactaatagatttttgcaataagtatgtgagttatttatgactaatgttgagtccatggattatatgcactctcacccttgcatcattgctagcctcttcggtaccatgcattgccctttctcaccttgagagttgtgcaaacttcgccgatgcatccaaaccctgtgatacgatacgctctatcacacataagcctccttatatcttcctcaaaacagccaccatacctacctattatggcatttccatagccattccgagatatattgccatgcaacttccatcatcatcatatacatgacttgagcatttattttcatattgctttgcatgatcgtaagatagctagcatgatgttttcatggattgtccatttttttgatgtcatttctacgctagatcattgcacatcctgttacaccgccggaagcattcatatagagtcatatctttgttctagtatcgagttgtaatatcgagttgtaagtaaataaaagtgtgatgatcatcattatagagcattgctccatgaaaaaaaagaaaaaaagaaaaaaaaaggaaaggccaaagaagcctaaataaaaaagggggccaaagaagcccatcaanaaaaaaagaaaaacaaagagagaagggggcattgttactatccttttaccacacttgtgcttcaaagtagcaccatgttcttcatatggagagtctcctattttgtcactttcatatactagtgggaatttttcattataggattagatgcacacccacttagtttcatattgagctttcatacacttatagctcttagtgcatccgttgcatggcaacccctactcctcgcattgatatcaattgatgggcatctccatagcccgttggttagccgcatcgatgtgagactttcttaattttttgtcttctttatatttacccctatcatcatactctattccacccgtagtgctatatccatggcttgcgctcatgtattacgtgagggttaaaatctgaagcgcgttaaaaagtatgaaccaattgctcggcttgtcatcggggttgtgcatgatcggacgcgtgg

SEQ ID NO: 30652 - DNA, 1169 bp, Triticum aestivum
  unsure (1)..(1169): unsure at all n locations
  Clone ID: PAT_TA_30652
atcaaaatatgtttncttggcgcacatttgttccaagggaagagcgatcagatccacgagcatcttgtataactcaaatcatgatcacttgaaagcataggactatacgatgagtgatcctacacaaagcaaatctaacaagtgtttttacctatggttacagaggacagaaaataacatgtgaaacttaaattacactggcagataaggaatttacagtgacagacaaactgtagttacaatacttagaccacttaaaatttcagtggacagcaatagaaattacagtagtggacccagggtgaaaaatcctttgtaattacagtttgaattacatctctagaccactggaattacagtgtaagcaaactgtaattccagtgctagaccactggaactacagtgtaaaatacagtgtattatatagagaaaccaatatgttcctgctcagaaaccaaaatgacactatgattgaatatttgaaactttggaactttataaaagggcaaattactgtcacttgaacttagaattactatgatcttttaaatgtaattactatgaagatcacactgaactaaaaaaactaagcactgatactatgaaggggagccttggcgcagtggtaaagctgctgccttgtgaccatgaggtcacgggttcaagtcctggaaacagcctcttacagaaatgtagggaaaggctgtgtacaatagacccaaagtggtcggacccttccccagaccctgcgcaagcgggagctacatgcactggggctgccctttttttatagaaagactgtaagggaaccccctacagtataattggtgcaacaaacccaaattgcaagtaccatgccttgaacctgggtgtgtgggaaggcatcaacccctccccaccactaggctatgccttagtctgctgcagggaatttcttgccatatatattgcatagaataaaatatatccatatatgtagaaacccaaatttataatgtaagtgtacagtattgaaattacttttcaccatgtacattactcaaaggaagaaaggctaagcactaaccatacactaaacggtaagctacaaacgtacaactaaaatagacaatccattattatttatgaactatcgatcaaatagaccattattagaggagagaataagc

SEQ ID NO: 30653 - DNA, 1578 bp, Triticum aestivum
  Clone ID: PAT_TA_30653
acccgaaccactcagaacctttccgatatccgaatatagccttccaatatattgatctttatgtctcgaacatttcgagactcctcgtcatgtccctgatctcatccaggactccgaacaaccttcggtacatcaaaacacataaactcataataccaatcatcactgaacgttaagcgtgcggaccctacgggttcgagaactatgtagacatgaccgagacacatctccggtcaataaccaatagcggaacctggatgctcatattggatcctacatattctacgaagatctttatcggtcaaactgcataacaacatatgttgttccctttgtcatcggtatgttacttgcccgagattcgatcgtcggtatcctcatacctagttcaatcttgttaccgtcaagtctctttactcgttccgtaatgcatcatctcatgactaactcattagtcacattgcttgtgaggcttatagtgatgtgcattaccgagagggcccagagatacctctctgatacacggagtgaaaaatcctaatcttgatctatgccaactcccaaacaccttcggagacacctgtagagcatctttataatctcccaattacgttgtgacgtttgatagcacacaaggtgttcctccggtattcgggagttgcataatctcatagtcaaaggaatatgtataagtcatgaagaaagcaatagcaataaaactaacaatcataatgctaagctaatggatgggtcttgtccatcacatcattctctaatgatgtgatctctttcatcaaatgacaacacatgtctatggtcaggaaacttaaccatctttgattaacgagctagtcaagtagaggcatactagggacactttgtttgtctatgtattcacacatgtactaagtttccggctaatacaattctagcatgaataataaacatttatcatgatataaggaaatataaataacaactttattattgcctctagggcatatttccttcagtctcccacttgcactaagagtcaataatctagattacataagtaatgattctaacacccatggagtcttggtgctgatcatgttttgcttgtggaagaggcttagtcaacgggtctgcaacattcagatccgtatgtatcttgcaaatctctatgtctccctccttgacttgatcgcggatggaattgaagcgtctcttgatgtgcttggttctcttgtgaaatctggattcctttgccaaggcaattgcaccagaattgtcacaaaagattttcattggacccgatgcactaggtatgacacctagatcggatatgaactccttcatccagactccttcatttgttgcttccgaagcagctatgtattccgcttcacacgtagatcccgccacgacgctctgcttgcaactgcaccaactgacagctccaccatttaataaaaatatgtatccggtttgtgacttagagtcatccggatcagtgtcaaagcttgcatcgacataaacgttcacaacgagctctttgtttcctccatatacaagaaacatatccttagtcttttt

SEQ ID NO: 30654 - DNA, 1365 bp, Triticum aestivum
  Clone ID: PAT_TA_30654
taagtgaatccatttcaatagattttcagcaagcaaagatgcaatcatatagaaggcacatggcaacactagcaaacaaaaggacgaacgggaaagagagggcgaataaaacggcaagggtgaagtgggggacagagaaacgagaggcaaatggcaaataatgtaaatgcgagggagatgagtttgtgatgggtacttggtatgtcttgacttgagcaaagacctcccagacaacggtgccataaatccttcttgcaacatcttgagcttgcgttggttttccttgaagaggaaaggatgatgcagcaatagtagcgtaagtatttccctcagtttttgagaaccaaggtatcaatccagtaggaggctcctgaaaagtcccacgcacctacacaaaaaaactgagaaatcgcaaccaacgcaataaaggggttgtcaatcccttcacggccactagcgaaagtgagatctaataaagatagtatgataagatagatatatttttggtattttataatatagatgcaaaaagtaaagatgcaaataaaagtagatagaaagcaaatatgataagagatagacccgggggccataggtttcactagtggcttctctcaagatagcattagtattacggtgggtgaacaaattactgtcgagcaattgatagaaaagcgcataattatgagattatctaggcatgatcatgtatataggcatcacgtccataacaagtagaccgactcctgcctgcatctactactattactccacacatcgaccgctatccagcatgcatctagagtattaagttcataagaacagagtaacgcattaagcaagatgacatgatgtagagggataaactcaagcaatatgatataaaccccatctttttatcctcaatggcaacaatacaatacgtgtcgtttccctttctgtcactgggtaagaacaccgcaagattgaacccaaagctaagctcttctcccattgcaagaaagatcaatctagtaggccaaaccagactaataattcgaagagacttgcaaagataactcaatcttacataaaagaatttagagaagattcaattaatatccatagattaatcagatcataaacccacaattcatcggatctcgacaaacacaccgcaaaaagagttacatcgaatagatctccaagaagatcaaggagaactttgtattgagattcaaagagagagaagaagccatctagctaataactatggacccgaaggtctaaagtaaactactcacacatcaccggagaggccatggagttgatgtagaggccctctgtgatcgttgccccttcggcagagctccggaaaaggcccca

SEQ ID NO: 30655 - DNA, 2277 bp, Triticum aestivum
  unsure (1)..(2277): unsure at all n locations
  Clone ID: PAT_TA_30655
ccaataataatgatttccttagtactccgattgctcctcttaatgatgttgagtcttgtgaaatcaatactgctttgctgaatcttgttatgaaagatcaattcaccggccttcctagtgaagatgccgctactcatctatcatgcgggctacttatgaacttagtgccaaagatggcactacttatatctatcttcacttttaggccaagctaggggcgttaaacgatagcgctagttgggaggcaacccaattttctttgtgttttttgtttttgttcctgtttagtaataaattttgcatctaccttctatttagatgtgtttttatcttttaattagtgttcgtgccaagtagaacctataggataacctatgatgatagttgatttgattctgctgaaaaacagaaactttgcacgcatgaatttagttttgttaaatcacagaaacgtgattttgtgttgattctttttcttctgatcaatagacaaattgtccaggacttcctattttggtaggatttttagagttccagaagtttgcgttagttacagattgctacagactgttctgtttttgacagattctgtttttcgtgtgttgtttgcttattttgatgcatctatggatagtaaaatagtttataaaccatagagaagttggaatacagtaggtttaacaccaaaatacataaagaatgagttcattacagtaccttatgtggtggttttgttttctttcactaacggagcttataagatttcatgttgagttttgtgttgtgaagttctcaagttttgagtaaagcttttatggactatggaataaggagtggcaagagcctaaacttggggatgaccatggcaccccaagatattcaagattagccaagatcctaagcttggggatgccccgggaaggcatcccctgtttcgtcttcgttcattggtaactttacttggagctatatttttattcgccacatgatatgtattttgcttggagcggtgtgtattatattagtctttgctttttagtttaccacaatcatccttgctgtacacaccttttgggagaagcctatttgattagaatttgctagaatactctatgtgcttcacttatatcttttgagcttgatagtttttgctctagtgcttcacttatatctttttgagcacagtggtgtcttaattttgaagaaattgctagtctctcattcttcacttatatctttttgagagtcttttagaacagcatggtatttgctatggttttaaagttggtcctagaatgatgagcatccaagttgggtataataaaaactatcatagaaagtgcattgaacactaggatcaatttgatgcttgataattgttttgagatataaaggcggtaatgttagagtcatgctagtgtgtaattatgaaattgagaaatacttgtgttggagttggcaagtcccgtagaatgcacgtatggtaaaagttgtgtgacaaatttgttgaatgaggtgctctttcgattgtcttccttatgagtggcagtcggggacgagcgatggtcttttcctaccaacctatccctctaggggcatgcgtagtagtactttgcttcgagggctaagtagacttttgcaataagtatatgagttctttatgactaatgtgagtccatggatatatgcacactcatccttccactttgctagcctttattattaccgcgcaactttcgccggtatcataaaccccttatttacctttcctcaaaacagccaccatacctacctattatggcatttccatagccatttcgagatatattgccatgcaactttccactgttccgtttattatgatacgttccatcattgtcatattgctctttgcatgatcatgtagttgacatcgtatttgtggcaaaggccaccttcataattttcaataatgtggtcgctcttggatcaattgcatatcccggtacaccgccagaggcattcaatatagaagtcatatcctgttccaactttgattgtaatcctgagttggtaaatccataaaagtgtgatgatctcaataataagagaatttctcagtgaggaaaggtgatgaagactatgatcanccacaagtccggatgacacttggacttncaacaagaaaaaaggcgaaaaaaaggaggcaaagaaaaaatgggagaaaangaaaaaagaaganaagngaaaagaaaaaatgngagaaangnaganggacaagcacaacncttttcaact

SEQ ID NO: 30656 - DNA, 1075 bp, Triticum aestivum
  Clone ID: PAT_TA_30656
attcggacgaggcctctcgatcccccttctcccctctcctgtgtgactcgaaatcgagctcgggctcgatgcggtgactgcgttcgtcgttgtcattaccgcggccaccatcgcctccctcgcgcgggaagacgtccaggagatccgcagctgtcgtcttcgtcttccccgtgcaccaaatcgagccagggcggcccatacgcccgccatcgccgacgtcttcaccgcgtacatcgccatcctccgccattgtttgccacagctccggaccgtccccgcctccccgacctcgttatcgatttctcaactacgagaccgacgctgctgccgccccattggactgcggagttgacgacccctccttcttgccagagcaaccagaccccaagaccgctgctgatgcccttgtgatcgactatgtcaccgacgacccttctaccctttcagcggaacttccagatgctggagcccaggagccagacgccaccatcgtcgatgattcctaatacactggaggtgcctactactacgtgcaggatgctgacgacgcccaggagtagtttaggaggatcccaggcaggaggcctgtgcctctttcgatctgtatcccagtttgtgctagccttcttaaggcaaacttgtttaacttatgtctgtactcagatattgttgcttccgctgactcgtctatgaccgagcacttgtattcgagccctcgaggcccctggcttgtattatgatgcttgtatgacttatttatgttttagagttgtgttgtgatatcttcccgtgagtccctgatcttgatcgtacacatttgcgtgcatgattagtgtacgattgaatcgggggcgtcacaagtagttaggaggctcccaggcaggaggccttgcctcttcgatcgttgttgcttttgtgctagccttcttaaggcatccttgtctaacttatgtctgtactcagatattgttgcttccgctgactcttgtgtatcgagcttatgtattcgagccctcgaggcccctggcttgtaatataaagcttgtattatgttatttgtgtcaaaaaaaaaaaa

SEQ ID NO: 30657 - DNA, 971 bp, Triticum aestivum
  unsure (1)..(971): unsure at all n locations
  Clone ID: PAT_TA_30657
aagttgtcgggggattgaactcataaaatattatatcctctgcagttgcgtatataggtccagatacaattattacatccaaagactatcttggagttcggaaaaaggggaacccgccttgcaatgccgaagacaaatctgcgcgccggactcctcgtcattgaagccaggttcaggggctactgagggagtcctggactaaggggtcctcgggcgtccagcgtgttagccatgggccatactgatgggctgtgaagatacgaagaccgaagactgcacccgtgtccggatgggactctccttggcgtggaaggcaagcttagcgatcaactatgtagattcttttcctatgtaaccgaccctatgtaaccctagatcctcccggtgtttatataaactggggggtgtagtccggaaaggatatacacattaccatagtcatacaggctaggcttctagggtttagccattacgatctcgtggtagatcaactcttgtaatactcatattcatcaagatcaatcaagcaggaagtagggtattacctccatagagagggcccgaacctgggtaaacatcgtgtcccctgtctcttgtaaccatcgatcctagacgcacagttcgggaccccctacccgagatccgccggttttgacaccgacaccccacgcgtatgaggggttgtcaatccctcctcgttaaaaagatagattaatttgtatgagattggataaatagatctgaataaaacatgaaataaaataagtaaagaaaaagtgcagcaaggtatttctgggtttttggaataatagatctgaaaacaaacatggtaaaagataggtagaaaagcaaatatgataaaagtagaccggtggccgtagattcactagtgggctccccnaagggggggccggtaccaatcgccctatagtganccgtattacgcgcgccacgggcgtcgtttacaactc

SEQ ID NO: 30658 - DNA, 1730 bp, Triticum aestivum
  Clone ID: PAT_TA_30658
tgggaggccagaatatgggagtactatgatgtggaacaaataaaagaatttgttgcttttatgggtgcttatgaaattgaatctatgtttaaagagtttgatgatattgatgatgcttgttatagatctgaaaatttagctatcctcaaatattgctatgagaattatgaatagaattatgaaattaatgcacttattaagaaagtctccgctgtccaagaagagactaatattttgcaggaatctatgaaagaagaagttgatgacactgtgagctcattggatgaaaaagatgaggaggagagcgaagaacaaaaggaggaagagcggattgatcacccgtgcccaccttctaatgagagtaactcttcaactcatacattgtttaattccccttcgtgcttaccgaaggatgattgctatgatgattgttatgatcccgttgattctcttgaaatatccctttttgatgatgcttgctatgcttgtggccaagatgccaatatgaattatgcttatggagatgaacttgctatagttccttatgttaaacatgaaattgttgctattgcacccacgcatgatagtcctattatctttttgaattctcccgactacactatattggagaagtttgcccttattaaggattatattgatggattgcgttttactactacacatgatgattttgatgaatataatatgcatgtgcttgatgctcctacttgcaattattatgagagaggaactatatctccacctctctatgcttcccacatgataaaattgcaagaaactgtttatactatgcattggcctttactttgtgtgcatgaattgttcttttatgacatgctgatgcataggaagagagttagactttgttgttgcatgatatatgttactttgtgctcactactaaattacaaatcattgttaattaaaattggctttgatataccttgggatccgggtggattcactacttgagcactatatgcctagcttaatggctttaaggaaagcgctgccagggagacaacctggaagttttagagagtcatttatttctgttgagtgcttttataaagtttaaaaacaaaaaataaataaagaggggaacccaaaaatttttcaaaaaggaaagtgaaagtgaaagagacaagcatggttgaagtgggggagctccttgaactttgttcatgctcacggaaactttgtgaatcttgattacagaaacttttcaataaaaataattatccccttgtacaattccattgtattataaaaataatgtgccaaggtttgcctttaggatgtttacaatgcttgttggtttgtatggtgcaggacagaaactttgactgtagtgcacgatttttaatttttttactggaacgtcaaacggttctgattccttttgaactgtcttgatgtacaacttgtttatgtttcctaattttggtagaatttttgggggtagcataagcatagtgaatgttcagattgctacagactgttctgtttttgacagattctatttttgatgcatagtttgcttgttttgatgaaactatcaatttatatcagtggattaagccatggaaaagctatattaaagtagacacaatgcaaaaataaaatatgaattggtttgctacagtacttagagtggtgatttgctttattatactaacagatcttaccactacaaaaaaatacacttc

SEQ ID NO: 30659 - DNA, 628 bp, Triticum aestivum
  Clone ID: PAT_TA_30659
aagtcccgggccgacgggggcggataccaaaaccatcgcactatataataacaagcaataataaaagtaagaaaataatacaagtatctatgtaaacatacaagtaagaatatttttcctttcagaaagaagataagaacaagaggctcaccacggtggtgccggcgatgagctcggcgcgggtgatcgacggcagtgaagacggggacggggcgtgacaaaccgctaaacctagacaaatattgaggaaaatgaagtttgacggtcgagcttggagaggagaaaccttaagtagtgtggctcgggcattccatcgaacaccttgtgtgcataggaggtgagctagagcacccaaatgccctctccccctcgggccagaaaaaacagagcagtgtgctctgctcttgcgtgagggggtatatataggcaccatcattggtcccggttggtggcatgaaccgggaccaaaggcatccgggaccaaaaggtccggacgaaccgggaccaatggcccacgtggcccggccggcccctgggctcacgaaccgggccaaatagcctcattggtcctggttctggattgaactgggactaatgggctgacctggcctggacaatatcccccttt

SEQ ID NO: 30660 - DNA, 1206 bp, Triticum aestivum
  Clone ID: PAT_TA_30660
gggccgacggggtttaccacaatcatcattgctgtacacaccttttgagagagccatacatgatttggaatttgttagaatactctatgtgctttgcttatatcagttgacttatacagttttgctctggtacttcacttatattttttagggcacggtggtggagttgttttatagaaactattgatctctcaagcatcacttagattattctgagagtcttaaatagcatggtaattttcttaaataatcctaatatgcttggtgttcaagaatagtaaaaactttcttatgagtgttatgaatgctatgagaagtttgatgcttgataattgttttgagatataaagatggtgatattaaagttgtgctagttgagtagttgtgaatttgagaaatacttgtgttgaagtttgtgattcccgtagcatgcacgtatggtgaaccgttatgtgatgaagtcagagcatgctttattttttgattgccttccttatgagtggcggtcggggacgagcgatggtcttttcctaccaatctatacccctaggagcatgcgcgtagttcttggtttttgatgacttgtagatttttgcaataagtatgtgagttctttatgactaatgttgagtccatggattatacgcactctcacccttccatcattgctagcctcttcggtaccgtgcattgcccttactcacattgagagttggtgcaaacttcgccggtgcatccaaaccccgtgatatgatacgctctttcacacataaacctccttatatcttcctcaaaacagccaccatacctatctattatggcatttccatagccattccgagatatattgccatgcaactttccaccgttccgtttattatgacacgcttcatcattgtcatattgcgtgcatgatcatgtagttgacattgtatttgtggcaaagccaccgttcataattctttcatacttgtcactcatgagtcattgcacatcccggtacaccgccggaggcattcatatagagtcatatcttgttctaagtatcgagttgtaattattgagttgtaagtaaataaaagtgtgatgatcatcattactagagcattgtcccagtgaggaaaggaggatggagactatgattcccccacaagtcgggatgagactccggactaaataaaaaataaaataaaataaagaggccat

SEQ ID NO: 30661 - DNA, 2072 bp, Triticum aestivum
  Clone ID: PAT_TA_30661
tcccctagcgtttctggaatactagggtatttagagcaaagagccggtgcgggaggccaccgaggtgggcataacccaccagggcgcgcccaggtgggttgtgcccccctcgggcacccctcttgtattttcccaggcgcgcctaggtgggttgtgccctcctcaggcatccctctggtatttctttggcccatcttgtgtctactggtcgagaaaaatcaccaaaaagttttgctgcatttggactccgtttggtattgatttcccacgatgtaaaaaactaggaaaaaaagaacaactggcactgggcactgggtccataggttagtcccaaaaaatgatataaagttgctataaaatgattgtaaaacatccaagatggataatataacaggatgaatacttcataaattatagatacgttggagacgtatcaggagcatgcgcgtagtgcttggtttttgacgacttgtagatttttgcaataagtatgtgagttctttatgactaatattgagtccatggattatatgcactctcacctttccatcattgctagcctcttcggtgccgtgcattgccctttctcaccttgagagttggtgcaaacttcgccggtgcatccaaaccccgtgatatgatacgctctatcacacataaacctccttatatcttcctcaaaacagcaaccatacctacctattatggcatttccatagccattccgagatatattgccatgcaactttccaccgttccatttatcatgacacgttcatcattgtcatatttctttgcatgatcatgtagttgacatagtatttgtggcaaagccaccattcataatcctttcatacatgtcactcttggttcattgcatatctcggtacaccaccggaggcattcatatagagtcatactttgttctagtatcgagttgtaatcattgagttgtaaataaatagaaatgtgatgatcatcattttctagagcattgtcccaagtgaggaaaaaagaggaaggaaataaaaaagagaaggcccaaaaaaatgagagaaaaagagagaagggacaatgatactatcctttttccagacttgtgcttcaaagtagcaccatgatcttcatgatagagagtctctcattttgtcactttcatttactagtgggaatttttcattatagaacttggcttgtatattccaacgatgggcttcctcaaaatgccataggtctttgtgagcaagcaagttggatgcacatccacttagtttcttttgttgagctttcatatatttatagctctagtgcatccgttgcatggcaatcccttctcactcacattgatatctattgatgggcatctccatagcccattgatacgcctagttgatgtgagaccatcatcctcctttttgtcttctccacaaccaccattctattccacctatagtgctatgtccatggctcgcgctcatgtattgcgtgaaagttgaaaaagtttaagaatactaaagtatgaaacaattgcttggcttgtcatcggggttgtgcatgattgaagcattttgtgtgacgaaaatgaagtatagccaaactatataattttgtagggatgagctttctttggctatgttattttgagaagacataattgcttggttagcatgcttgcagtattattatttttatgtcaatattaaacttttgtcttgaatctttcggatctgaacattcatgccacaataaagaaccttacgttgaaaactatgttaggtagcattccacatcataaattctgtttttatcatttacctattcgaggacgagcaggaattaagcttggggatacttgatacgtctccagtgtatttataattttttattgttccatgctattatattatctgttttagatgtttaatgggctttaatatgctgttttatattatttttgggacgaacctattaatcgaaggcccagtgccagtttctgtttttttgcctatttcagtgtcttgcaaaaacggaataccgaacggaatgaaaccttcgtgatgatcttttttgga

SEQ ID NO: 30662 - DNA, 1829 bp, Triticum aestivum
  Clone ID: PAT_TA_30662
cattactattttaatgtggaaacaatttttagtgttcaaatctcttatgatactcccaccattccgaatgaaaagaattttgcttatgtggagagtagtaaaaattctatgcttgtagatcatgaaaagaatgctttaggtgttgtttatattgttgaattcattcatgatgctactgaaaattattatgagggagtaatatatgcttgtaggaattgcaataatgtcaagtttcctctctatgtgttgaaaatcttgaagctatgcttgttttaccttccaatgctagttgattatcgttcccataagttgtttgctcacaaaatccctatgcataggaagtgggttagacttaaatgttctagtcatattcttcatgatgctctctttatgtttcaattcttatcttttatgtgagaatcattgaaatcatcatgcctagctaggggcgttaaacgttagcgcttgttgggaggcaacccaattttatttttgttccttgctttttgctcctgtttagtaataaataattcatataacctctgtttagatgtggttttatgttttaattagtgtttgtgccaagtagaacctttgggaagacttgggtgaagtctttgtgatcttgctgtaaaaaacagaaactttagcgctcacgagattagctgccattttttactggagagtgattttaggttcattatttttgcagatgattaatagacaaattactcacatccaccaatttatttcagaatatttggggttccataagtatacgtttgatacagatttctacagactgttctgtttttgacagattctgttttcattgtgttgtttgcttattttgatgaatctatgagtagtatcggaggataagaaccatagagaagtttgaatacagtagatattacaccaatatgaataaagaatgagttcataacagtaccttgaagtggtgttttgttttctttcgctaacggagctcacgagattttctgttgagttttgtgttgtgaaattttcaagttttgggtaaagattcgatggactatggaataaggagtggcaagagcctaagcttggggatgcccaaggcacaccaaggtaatattcaaggacaaccaagagcctaagcttggggatgccccggaaggcatcccctctttcgtcttcgttcatcggtaactttacttggggatatatttttattcgccacatgatatgtgttttgcttggagcgtcattttattttgttagtttttgcttgatgttatttagattaatgttttgcatcattaggttcaataaaaaagtcaaggatagactttgccatgcttattttgctagtatacatgttggttgtttgaaaacagaaagtttaccgctgttgcaaaaattccctagaaaagtaagaaatggtataacattgaatctttttgcatattaagatgtgataaatttattacagtgggaattttatttcataattttggagtcagggaagtattgttactcttgcattctttacagactatattgttttggcagattgctgttatgtttgcattgtttgcgtatgtttgcttgtttaatgattctatttgaggataggagtattaaatatgcagaggaatttagtattaaatgttgaataataattctagtgatttgttatagtaaaaaataataaggttttgcattggtttgtactaacctatctcacgagttcttgttgagtttgttgtgaatgaagctcttgataaaaagagaaaccatgatatgagaggaattaaggagacacaaaagttcatgcttggggatcc

SEQ ID NO: 30663 - DNA, 798 bp, Triticum aestivum
  Clone ID: PAT_TA_30663
tttttttttttttttttttaactactaacttaatatccagcaaagggtcacaacaattcagcaaggatacatgaggtttcagcaaaggtacacaggtaacaaagtaattttcagatccaacagtgcatatattcagagaacaggaacaagagaagaaagaggttcagagcctatgggtcttgatgatcttcgatccgaagctgtagatgttgcaggcaaagaagagtagcagcagaggcacgttggagacgatcttgcgtggagcaccagaaggcccgacgcccctggcctctggtcgatcctctccctctcagcagcgaggagggggagagaaggagtggcagagatcgtcggtcagggaggtcgcagcagcaggagttggagctgagtagcagtggtcgatcttgaggttggagacgagaaagtgaagcaggtcggcgtcgtcgttggagacgaggaagtgcagcaggtcggcgtcgtagttggagaggagcggtggatcgccgatcagttcggggcagcttcatggtggatcgggcgccaccgccagtctcccggcaccctcttctccctctctctctctccttcgatctggttattctactggttcccccttgatccaccttgttcgatctggtggtaggtgagtagtggaaggcagcgaggaggagggggagaaaaagccagtcggcgctgatgattttctttccttcgacccccttgtactcgtgctatctcgtggtcgcacgcgtgggatcagacatgcatcttgctggtcgcgccagaccagcccctttc

SEQ ID NO: 30664 - DNA, 867 bp, Triticum aestivum
  Clone ID: PAT_TA_30664
cctttccccaattcagattccccaagatcgtctcgtctcgtctcgaatcgcatccatgggttggcgttggcacgacgacggcgagggcgacggtggccgcggcgggctcggcgacatccccgacctcgccggccgaggcggcggcgaggcggcgcacgtcggcacgcgccgggtggtgcagtcccgctgccacacggaggaggtggagcccggccgcttcgtccgcaagtgcgagaagaccgagcagctcctccgcaactgcgtcggcaggccttctgaactggtggagtcgaaaactgagaacaccgaagaagatgtcacagatgaaatgaccggtggtgcctcgcattctcttggcttcccaacaaaagagccctttgcatttccaggacttcgcagtgacattgaagctattgagaaaggcttcggtagctttctggatgaagctgagcggatgaccaacgaattcttcaaatcttttggatttccaaccattcacgacggggactcgagaccgtttcctaggcaacctgcagagaggcatgttggagaaggtaccgtgaagaagcccaatgagaatgagtactcagaattcggtagccagataactgatgtgtaacaagctacagtcgtataacatgccttgttggagctgaagcctgagaagtgtgtttcgctgggtatctagggtactaaagtggtttctcttttggactcttcattatggttgtaatagtcgatgaagaatcatattttactaattttatctgcaactatcataagtgtatgacttttggttgtatgggcattatgtatagtactgttttcagacgcttcagctgtaacatggataaatctgaagatctc

SEQ ID NO: 30665 - DNA, 1610 bp, Triticum aestivum
  Clone ID: PAT_TA_30665
ctcttcctcgacaagggtacacccccggcacagatagatcagatttacagcccaccgccgcccaagacagtcaagaagctcttgaccgacaacaccgaacagagaattaggctactcaatactaccgccagggcatctaggtccgtcaagcggcctctacttcttggccttcttggccgcgggcttcttggccggagcggccttcttcaccggcgtcgccctcttggtgggcggctttcttggccggggacttggcggccgtcttcttggctggcgccttggccttgggcttggcggcgggcttcttcttggtcgccgtcttgggcttgacggcggcgggggccttggcgagcttgtaggagcccttgaccttggtcagcttgccggcggcgacgagcttcttgatctgggtcagcaggatcttgcggaagttggccgggaggtgcgccttgtgcttatcctcgatgaacttgccgatcgcgatggtgctcgacccgctcctctccttcagggcggcgatcgcctccgacaccatctcggcgtaggacgggtgggccggggtgacgcggggcttcttcgggccagtggacttcttggccttggccgccttgggcgccttggccggcttcgccgccggtgcgtcaacggcggcgtcggcggctacctccacttgaggcaccgggatgtcgactgaagtggctgccgctgacatcccggtgcctcaggtggaggtagccgccgacgccgccgttgacacaccggcggcgaagccggccaaggcgcccaaggcggccaaggccaagaagtccactggcccgaagaagccccgcgtggaccccggcccacccgtcctacgccgaggtaagcccccgagtccttcgccgtcgttcctcgttccgtctgttctcccgtgtttcccctgatctgactttggttttgtccgttcgtgcgtgctcagatggtgtcggaggcgatcgccgccctgaaggagaggagcgggtcgagcaccatcgcgatcggcaagttcatcgaggataagcacaagggcgcacctcccggccaacttccgcaagatcctgctgacccagatcaagaagctcgtcgccgccggcaagctgaccaaggtcaagggctcctacaagctcgccaaggcccccgccgccgtcaagcccaagacggcgaccaagaagaagcccgccgccaagcccaagggcaaggcgccagccaagaagacggccgccaagtccccgtccgccgcggtgtctgctccgctcaactccgagctccccaacggctgcgtaccctagggacgggaccgtctcgtcctcctgaacattggcggtaggtcgggcatcgccaatggtggcccgtgccaccggcaatcgccgtcgggagccgcccctctcctctgcctggcgcgcgcgagaagaagacggaaggggacaaccagctcagcctgccagtgggccctcggcccgacacgtcagccactccaggcgtttggcggtccttcccgttggattaagtkkgrggcatwcttccgtaaagdwcgctwwccssttytccgaaggktaacccycgttwtwyacmtttttgggtcwcccccgcct

SEQ ID NO: 30666 - DNA, 1653 bp, Triticum aestivum
  unsure (1)..(1653): unsure at all n locations
  Clone ID: PAT_TA_30666
tatcaatttatatcagtggatttatccatgaaaaagttattttacagtagacacaatgcaaaaacaaaatatgaattggtttgatacagtacttagagtggtgatttgctttattgtactaatggatcttatcgagttttctgttgaagttttgtgtggatgaagtgtctaaacgaggaggtctcgatatgaggaaaaggaagagaggcaagagctcaagcttggggattcccaaggcaccccaagtaaatattcaaggagactcaagcgtctaagcttggggatgccccggaaggcatcccctctttcttcaacaagtatcggtatgttttcgtattcgcttcgtttatgcattatgtgcaagtcttggagcgtcttttgcatttagttttcatttttattttatgcaccatgctggtatgagatagtccttggttgatttatagaatgctctttgcacttcacttatatcttttgagtatggctttatagaatgcttcatgtacttcacttatatcatttgaagtttggattgcctgtttctctttacatagacaaccaccatttctagaatgctcttttgcttcgcttatatttgttagagcacgggcatatcttttgtagaaagaattaaactctcttgcttcacttatatctatttggagagatgacaggaattggtcattcacatggttagtcataaaatcctacataaaacttgtagatcactgaatatgatatgtttgattccttgcaatagttttgcgatataaaggtggtgatattagagtcgtgctagttgagtaattgtgaaattgagaagtacttgtgttgaggtttgcaagtctcgtagcatgcacgtatggtaaacgttgtgtgacaaatttgaagcatggggtgttctttgattgctttccttatgagtggcggtcggcgacgagcgatggtcttttcctaccaatctatccccctaggggcatgcgtagtagtactttgcttcgagggctaataaacttttgcaataagtatatgagttctttatgactaatgtgagtccatggattatacgcactctcacccttccatcattgctagcctcttcggtaccgtgcattgccctttctcacctcaagagttggtgcaaacttcgccggtgcatccaaaccccgtgatatgatatgctatgtcacacataagcctcattatatcttcctcaaaacagccaccatacctacctatcatggcatttccatagccattccgagatatattgccatgcaacttccatcatcatcatatacatgacttgagcatttattgtcatattgctttgcatgatcgtaagatagctagcatgatgttttcatggcttgtccgttttttgatgtcattgctacgctagatcattgcacatcccggtacaccaccggaagcattcatatagagcatactttgttctaagtatccgantataatattgagttgtaagtaaataaaagtgtgatgatcatcattattagagcattgccccagtgaggaaaggatgatggagactatgattcccccataagtcgggatgagactccagactttaaaaataaataaaagaggccaaagaagcccaaataaaaaaagaggccaaagaagcccacc

SEQ ID NO: 30667 - DNA, 586 bp, Triticum aestivum
  Clone ID: PAT_TA_30667
ttcggcacgaggctttccctcgctctctctctcttctccccgcgtgagaccgccgctgccgtcgacatggccgcggccaccatcctccccacgcctcgagaccctgctcagaagacgcgccgtcgtccgctacttcctctacggccaagaacgcgcgccggggagtactccgtcgccggatcgccttcgtcttcctccccggcaccgacgaactccgccaccccgattcgccgccctccagtgctcctaagcccatcgccggccaccgtgtgcctcactatggtggagcccaggatccatacgacaccaccgatgactactactaccccgagggtgcctcctactacgtggaggccgccgacgaccaggagtagttaggaggctcccaggcaggagtcctttccttttcgattgatgttgcttttgtgctagccttcttaaggcaaacttgtttaactcatgtctgtactcagataatgttgcttccgctgactctgatgtattcgaccttatgtattcgagccctcgaggcccctggcttgtaatataaagcttgcattattttaatttgtgtctaaaaaaaaaa

SEQ ID NO: 30668 - DNA, 942 bp, Triticum aestivum
  Clone ID: PAT_TA_30668
acggcaaaacacaccgcatgcatatctcgaaactgacaacatggtgcaacgttcacatatgattgagagagaacaaagggatgaaaatccacggcaaaacacacggccacatgatgatacgatactccggcagggaaagatcctggccggacttggagaaaaaggaagcgaacaaggctaggcggtgagctccatgatggcgctgacgatgtcgccgtcgtgcgccttgagggccttgacggccttggcgcgggacacgctggcctgcgtcatgacgaggtcgatgtcgcgggcctcgatgccggtctcgtccaccacctcctcctcgtcggccggcgcgccggcccccgccgccgccgcggcgtcgggcctcatcgccttgctcaggtcctgcatcctgaactgctgcgccgcctgcgcctgcagctgcgagctcaggtcctcgatcttggcctccccgaagatcacgtacgtctccgacgtcgggctcttgaacacgtccggcttcgacaccacgaacaggatgttcttggctctcttgatggtgatcctgctgacgccggtgacgggcttcatccccagcttcatcatggccttgcggctcttcttctcgctccggctctgcttcgacccctcgctcccggccacacccagctcgccgtcttcatcctcgtcgtcctcgtcgtcatcctcgtcctcctcctcctcctcgtcaccgtcgccctccttgacgtcctcgacgacgggcgcgccgtcctctgcgggctcctcggccttgatgacctccggcgccgcgtcgccgctctccagctccggctcggtggccaccggcgtctgctcgctgaccatggtgagctgctgcgagtgttggtgcaggaacgagcgtgctgctggagtgaggataaggagcggacgcgtgggtcgacccgggaatccggaccg

SEQ ID NO: 30669 - DNA, 2921 bp, Triticum aestivum
  unsure (1)..(2921): unsure at all n locations
  Clone ID: PAT_TA_30669
ggtcgaggcgattcttcatgatgatctctttgcgtttcaattcttatcttttatgtgagcatcattgaaatcatcatgcctagctaggggcgttaaacgttagcgcttgttgggaggcaacccaattttatttttgttccttgctttttgttcctgtttagtaataaataaatcatctagcctctggttagatgtggttttatgttttaattagtgtttgtgccaagtaagacctacaggatcttcttggatgataattatttgatcttgctgaaaaagacagaaactttctgctcacgtaaacaattgttaaaaatcaccagaaagcgataaaatactgattccaattgcagtagatcaataatcaaattatataggttgtcctattttggctgaatttttggagttccagaagtttgcgttagttacagattactacagattgttctgtttttgacagattccgtttttcgtgtgttgtttgcttattttcatgaatctatggctagtaaaatagtttataaaccatagagaagttggaatacagtaggtttaacacaaatataaataaatagtgagttcattacattaccttgaagtggtgttttgttttctttcgctaacggagctcacgagattttttgttaagttttgtgttgtgaagttttcaagttttgggtaaaagatttgatggattatggaacaaggagtggcaagagcctaagcttggggatgtccaaggaaacccaaggtaaaattcaaggacaaccaaaagcctaagctcggggatgccccggaaggcatcccctctttcgtcttcgtccatcggtaactttacttgaggctatatttttattcaccacatgatatgtgttttgcttggagcgtcttgtatgatatgagtctttaatttttagtttaccacaatcatccttgctgtacacaccttttgggacagactcacatgaatcggaatttattagaatactctatgtgcttcacttatatcttttgagctagacaattttgctctagtgcttcatttatatctttttagagcacggcggtggttttattttgtacaaattattgatctcttatgcttcacttatattattttgagagtcttttagaacatcatggtatttgctatgatcataaagttggtcctagaatgatgagcatccaagttgggtattaataaaaactatcatagaaagtgaattggatgctatgatcaatttgatgcttgataattgttttgagatatggaggtagtgatattaaagtcatgctagttgggtgattatgaatttaaagaatgcttgtgttgaagcttgtgattcccgtagcatgcacgtatggtgaaccgctttgtgatgaagttggagcacaattttacttattgattgtcttccttatgagtggcggtcggggacgagtgatggtctttcctaccaatctatccccctaggagcatgcacgtagtactttgtttctatgactaatagatttatgcaataagtatgtgagttctttatgactattgttgagtccatggattatacgcactctcacccttccatcattgctagcctcttcggtatcgtgcattgccctttctcacctcgagagttggtgcaaacttcgccggtgcatccaaaccccgtgatacgatacgctctatcacacataagcctccttatatcttcctcaaaacagccaccatacctacctatcatggcatttccatagccattccgagatacattgccatgcaacttccaccatcaccatatacatgacttgagcattcattgtcatattgctttgcatgatcgtaagatagctagcatgatattctcatggcttgtcatttttttatgtcattgctacgctagatcattgcacatcctggtacaccgccggaggcattcatatagagtcatatctttgttctagtatcgagttgtagtattgagttgtaagtaaataaaagtgtgatgatcatcattatagagcatttccccataaaaaataaaaaataaaaaaaaggaaagaccaaagaagcctaaataaaaaaaggggccaaacaagcccacccaaaaaaagaagaaaagcaaaaagaaaaggggcaatgttactatcctttttccacacttgtgcttcaaagtagcaccatgttcttcatatagagagtctcctatgttgtcactttcatatactagtgggaattttcattatagaacttgggcttgtatattccaacgatgggcttcctcaaatgccctaagtcctcatgagcaagcaaagttggatgcacacccacttagtttcttttgttgagctttcatacatttacagctctagtgcatccgttgcatggcaatccctactccttgcattgacgtcaattgatgggcatctccctagcccgttgattagccacgtcaatgtgagactttatccttttttttgtcttctccacacaacccccatcattctattctattccacccataggggtatgtccatggctcacgctcatgttatgccgttgaaagttgaaaaaantccgagattaactaaagtatgaaccatttccttgggttggtcatccgggtttgtgcatgatgaganattttggtggtgacgaaaatgaagcatggccgactatatattttggtangnaaacttcctttggcaagttatttttgagaaacaaattctaattagaagctggagtatanaattttaaggccaaataaatttaacctgagttccggtcggaaacaagcacaattaaggattcatngaantagtanggacatcantnaaaatcgtttacattaccaancaggggccggaccaatccctaangatcatagnnccangcgtcgttaaagcngacggaaacctgg

SEQ ID NO: 30670 - DNA, 1489 bp, Triticum aestivum
  Clone ID: PAT_TA_30670
cggtcaggaataccgggtcgaccgggagttcattacaatacccaagtggtgatttattttcttgtactaacgagcttacgagttttctattaagttttgtgttgtgaagttttcaagttttgggtaaagattcgatggactatggaataaggagtggcgagagcctaagcttggggatgcccaaggaaccccaaggtaatattcaaggatgaccaagagcctaagcttggggatgccccggatggcatcccctctttcgtcttcgttcatcggtaactttacttggagatatatttttattcaccacatgatatgtgttttgcttggagcgtcattttattttattttgtttttcttgctgtttaaataaaatacaaagatctgaaattattaaatgttagagagtcttcacatagttgcataattattcgactactcattgatcttcacttatatctttcggagtagtttctcattttctctagtgcttcacttatatccttttagagcacggtggtggttttattttgaagaaatagatgaactctcatgcttcacttatattattttgagagtcttttagaacatcatgataatttgctttggttatgaaataatcctaatatgataggcatccaagatgggtataataaaaaatcttataaagtgttttgaatactaagggaagtttgatgcttgatgattgttttgagatatggaggtaataatatcaaagtcgtgctagttgagtagttgtgaaattgagaaatacttgtgttgaagtttgtgattcccgtagcatgcatgtatggtgaacattatgtgatgaagtcagagcatgatttatttattgattgtcttccttatgagtggtggtcggggacgagcgatggtgttttcctaccaatatatccccctaggagcatgcgcgtagtactttgtttcgataactaataaatttttgcaataagtgtgtgagttctttttgactaatgttgagtccatgaattatacgcactctcacccttccaccattgctagcctctcttgtaccgcgcagcttctgtcggtacggcggtaccatacacccaccatataccttccttaaaacagccaccatacctacctattatggcatttccatagccattcctaaatatatttccatgcaacttgccactgttccgtttattatgacacgcttcatcattgtcatatttcttcgcatgatcatgtagttgacatcgtatttgtggcaaagccaccgatcataattctttcatacatgtcactcttgattcattgcacatcccggtacaccgccggaggcattcatatagagtcatattttgttctaagtattgatttgtaattcttgagttgtaagtaaaaaagaagtgtgatgatcatcattattagagcattgtcccagtgaggaaaggatgatggagactatgattccccacaagtcgggatgagactccggacg

SEQ ID NO: 30671 - DNA, 803 bp, Triticum aestivum
  Clone ID: PAT_TA_30671
cggccatgggtgcacccggccaggtgccggccatcccgcggccctccctggctattaagtccgacgcctgcgaccccctggcaaaccctaacgcccatccccctcgtctccctctccgcctctcgatttcgtccacacccgagaccacagttgctgctgccttctcgatcccgtggccaccggcctcacctcatcgcgccaagacgtccaggagctccttcatcgtcttctccttcgccctcgcctaagggctcgagctaggagggctggtacgctcgacatcgagcatatcttcgtcggtacatcgccgggtgtccgacgtcgtttgccgcggctccggtccacctccggcctccccgaccacatcttcgagctcgcgacaccgagaccgacgccgctgctacccagtacgactacggtgttgacgacccctctctcttgccagagcaaccagatgttggagcccaggagcccagacgccaccttcgacgacgactcctactacactggaggtacctactactacgtgcaggccgctgacgacgaccaggagtagtttaggaggatcccaggcaggaggcctgagcctccttttgatctggatccctgtttgtgctagccttcttaaggcaaacttgtttaactaatgtctgtactcagatattgttgcttccgctgactcgtctttgatcgagcacttgtatccgagccctcgaggcccctggcttgtaatatgatgcttatatgacttattttatttttagagttgtgttgtgatatcttcccgtaaaaaaaaaaaaaaa

SEQ ID NO: 30672 - DNA, 1090 bp, Triticum aestivum
  Clone ID: PAT_TA_30672
gctatggttgggtttcacgaccttaatgatctttagtagttgcggatgcttgctaggggtccaatcataagtgcatatgatccaggtagagaaagtatgttagctcatgcctctccctcatatagaattgcaagaatgattaccggtacttgttatcgattgcctagggacaaatgactttcttgttgacaaaatccatctacttttactttcccgcaatttattcatagttttattctcgcaaagtactcgtagtttattcttgcaaaatagttcatacttgttctaggtaaagcgaacgtcaagtgtgcgtagagttgtatcggtggtcgatagaacttgagggaatatttgttctacctttagctcctcgttgggttcgacactcttacttctcgaaagaaggctattgcgatcccctatacttgtgggttatcactctccacatctattggcgtaagctgatggacaaaacgacttgtgcggccaacgccacgggagaatacgacagaagtcgacggggatggtctggctggcatgaagcaaggggatctaatcatttggtatgttgagcagcagaatgcccaaggcgcatatagttctacagaagaggtgaaggaggaagtaaagtgcatcaaggccattatagagaggctgatacagagggaaggccatcttgtagtcatagatgaaggaacagcggcagcagaaggtgctacggcaagggcatcggagcacagaatcctggctgttaacccaaactacgtcattgattgattaaccagctgaggtcacacagctaactagatccatcatatgtggttgaccaatatagcagacattcaaacggaagacatcctgttgtcatgctctagaaatgatatgttgcacctgccatccccttcccaaggaagcacaagatctctggaattgtatcttccttccaaggttgaagtgtggtaattaatttgccaccagtattggttgtgtattttccaccgtttcatggttatgtaaactgcaactctgtaagacaagtacagcttaatttatgtgcttctgaatttcaaaaaaaaacaaaaaaaaaaaa

SEQ ID NO: 30673 - DNA, 989 bp, Triticum aestivum
  Clone ID: PAT_TA_30673
atcttttcctatgcttgcaaatcaatgatattgagccattttgtcaaggcgaaattgtactatacaaacaatacgctgagaaaagggataaggaaataagggaacgactgcaggatagtgaatataaattgggtttctcgatgcccctcgaagatgcaaaggaaagagtcactcaactccaatcagaactcacactgctcgaaagaccccgtgacgaggctgacgccccagttcgactacggagttgacgacccctctctcttgccagagcaaccagatgctggagccctggagccagacgccaccgtcgacgacgacccctactacactggaggtgcctactactacgtgctgcccgctgatgacgacctggagtagtttaggaggatcccaggcaggaggcctgcgcctctttcgatctgtatcccagtttgtgctagccttcttaaggcaaacttgtttaacttatgtctgtactcagatattgttgcttccgctgactcgtctatgatcgagcacttgtattcgagccctcgaggcccctggcttgtattatgatgcttgtatgacttatttatgttttagagttgtgttgtgatatcttcccgtgagtccctgatcttgatcgtacacgtttgcgtgcatgattagtgtacgattgaatcgggggcgtcacaagttggtatcagagccgactgcctgtaggaatcccccttccacactccttggccgaagtcgagtctagacattacaaaaacttttactaacatggctgtgtgccttacgggcccacgtcgccattgggtggtattaggatcttttattcctcgtctatactctaggactataatctctctcctattcgggttaaatgaagtttactaactccaacattaggttctcgtaattacttcctctcagagagcctctcactccagatgattgcttggtgcaccgaaggattccgaagatactctccgttgttaacc

SEQ ID NO: 30674 - DNA, 1038 bp, Triticum aestivum
  unsure (1)..(1038): unsure at all n locations
  Clone ID: PAT_TA_30674
aggccacacgtcggccatcctgcggccgtccccgtcgcccccatcgacctacaagnacacccatgccctggttgaaccctagctgccctccagatccccctctctttgcccctctcccacacgcccgagctcgtcggcgctgccgtcgccataccgccgccataggcgcggccaccggcctcccggcaccatcggagaatgcccaggagctccaccagcatgccctgcttcccctacgcggatcaactcgagctcggagcaaccacctcgactggatcgacgccttcttcttcctcggtcgtcgtcgctgctcttcatcgatccgtcgcctctgcagctcctaagccaccaacgggcctccgtgtgcctccgcgatgctagagccctggagccagacgccaccatcgacgatgattcctactacactggaggtgcctactactacgtgcagcccgctgacgacgaccaggagtagtttaggaggatcccaggcaggaggcctgcgcctctttcgatctgtatcccagtttgtgctagccttcttaaggcaaacttgtttaacttatgtctgtactcagatattgttgcttccgctgactcgtctatgatcgagcacttgtattcgagccctcgaggcccctggcttgtattatgatgcttgtatgacttatttatgttttagagttgtgttgtgatatcttcccatgagtccctgatcttgatcgtacacgtttgcgtgcatgattagtgtatgattgaatcgtgggcgtcacacattggcatgcacggcttggtcatcctgcaactcccatagttcgtagtatcctacatagtcataatcttcccattgtgtccaataaagatgctgccacagtctgtgatgcctgtcagcaaggcaagagtcatcagctttcgttttcagattcgagtcgtgtcgttaaaactccacttgagcttattttttctgatgtatgggggcatgcccaaacttctgtgagggtcataattattagtcagttttattagcttaagtcgatt

SEQ ID NO: 30675 - DNA, 2344 bp, Triticum aestivum
  Clone ID: PAT_TA_30675
gtatgctataaagaataaagataaccatgaaaattgtcatcatgattttaattttcaattggagtatgcttcacattatagttattttgttgagtttgctcccactactattcatgagaaaaaatttgcttttgtggagagtaataaaatttctatgcttgtagatcatgaaaagaatgctttatgtgatagttatattgttgaattcattcatgacgctattgaaaattattatgagggaggaatatatgcttgtaggaattgcaataatttcaagtttcctctctatgttcttaaaatcgtgaagttatgcttgttttgccttcctatgctagttgattattgttcccataagttttttgctcacaaaattcctatgcataggaagtgggttagacttaaaagtgctagtcatatgcttcatgatgctcccgttatgtttcaattcttatcttttatgtgagcatcattgtcatcatcatgcctagctagaaaggcattaaagaaaagcgcttgttgggagacaaaccaatacttatccttactgtttttgtgtgttcacatgattatgctactgtagtaatcatgttttataggttttgtttcaataaagtgccaataagacctttaggatggcttacggtgatagttgtgttgatcctgctgaaaatcagaaacttttgcgcccagtaaattagttttgataattcacagaaacgtggttttgatctgattcattttgctctggatcggtacacaaattgctcaggttttcctaatttggtaggatttttggagttacagaagtattcgagagttacaaattactacagactattctgtttttgacatattctgttttctatgtgttgtttgcttattttgatgaatccgtgagtagtatcggagggtatgaaccatagagaagttggaatacagtagatattacaccaatatgaatttagaatgagttcacaacagtaccttatgatggtgatttattttctcatactaacggagcttacgagttttctgttaacttttgtgttgtgaagttttcaagttttgggtaaagattcgatggactatggaataaggagtgccaagagcctaagcttggggatgcccaaggcaccccaaggtaatattcaaggataaccaagcgtctaagcttggggatgccccggatggcatcccctctttcgtcttcattcatcggtaactttacttggagctatatttttattcaccacatgatatgtgttttgcttggagcgtcattttcttttgttagtatttgccttttagttttccacaatcatccttgctgtacacaccttttgggagaagcctacttgattaaatttattagaatactctatgtgcttcacttatatcttttgagctagatagtttttgctctagtgcttcacttatatcttttagagcacggcgatggcttaatttgtagaaattgctagtctctcatgcttcacttatattattttgagagtcttaaacagcccggtaatttgaatgaaaactatcatagaagtgaattggatgctatgatcaatttgttgcttgataattgttttgagatataaaggtagtaatgttagggtcatgctagtggataattatgaaattgagaaatacttttgttgaagttggcaagtcccatagcatgcacgtatggtaaaagttgtgtgacaaatttgttgcatgaggtgctcttttcattgtcttccttatgagtggcagacggggacgagcgatggtcttctcctaccaatctatccctcttggggcatgcgtagtagacttttgcaataagtatatgagttctttttgactaatgtgagtccatggatatacgcacactcatccttccattttgctagcctttattattaccgagcaactttcgccggtatcatgaaccctttatttaccttcctcaaaacagccaccatacctacctattatggcatttccatagccattccgagatatattgccatgcaacttccatcatcatcatcatgacatacattacttttgtcatattgccattgcatgatcatgtagttgacatcgtattggtggcaaagccaccatgcattatttttcatacatgtcactcttgattcattgcaccatcccggtacaccgccggaggcattcatgtagagtcatatcttgttctaagtttcgagttgtaatcctcgtgttgtaatcaatagaagtgtgatgatcatcattattagagcattgcccaaacaaaaaaaaagagaaaggccaaaagaaaaagagaaaggacaaaataaaaaaaggaaggccc
